United States Patent 11,931,406 (FLAVIVIRUS VACCINE) - sequence listing, part 69

SEQ ID NO: 23965 - RNA, 9879 nt, Artificial Sequence
  derived and/or modified CDS sequence (opt11) from DENV-1__KF973454__SS-prME
agcgucaccaugcucuugaugcuucugcccacagcccucgcuuuucaccugacaaccagagguggggagccgcacaugaucgugagcaagcacgagcggggcaagagccugcuguuuaaaaccucgaccggggugaacaugugcacccugaucgcaauggaucuuggcgagcucugcgaggacacaaugaccuacaagugcccccgcaucacagaagccgagcccgacgacguggacugcuggugcaacgccacggauaccugggugacuuacgggacguguagccagacgggagagcaccggcgcgauaagcgguccguagcccuggcuccccacgugggucuggggcucgaaacacgcaccgagaccuggauguccuccgagggcgcguggaagcaaauccaacggguggagacgugggcccugcgccaucccggguucaccgugaucgcccuguuccucgcccaugcgauaggcacuaguaucacccagaaggggauuauauuuauccuguugaugcucguuacgcccucaauggccaugcguugcguuggcaucggcaaccgcgacuucguggaggggcuuagcggcgcaaccuggguggacguugugcuggaacauggguccugcgugaccaccauggcuaagaacaaacccacgcuagacaucgagcugcugaagaccgaggucaccaaccccgccgugcuccggaagcugugcaucgaggcuaagaucagcaacaccacgaccgacucacggugcccaacccaaggcgaggccacccuuguggaggagcaggacgccaacuucgucugccggcgcacgcucguggaccggggcugggguaacgggugcgggcuguucggcaaggggagccugcuaacgugcgccaaguucaagugcgucaccaagcuugagggcaagaucguccaguacgagaaccucaaauacuccguaauagucaccguccacacgggcgaccaacaccagguggggaacgagaccaccgagcacggcaccauagcuaccaucacgccccaggcuccuaccagugagauccaacuuaccgacuacggggcccuggcccuggauugcucaccgcggaccggucuggacuucaacgaaaugguccugcuuacgaugaaggagaaguccuggcucguucauaagcagugguuccuggaccuaccccugcccuggaccagcggagcgagcaccagccaggagaccuggaaccggcaagaccugcuggugacguuuaagaccgcacacgcgaagaagcaggaggucgugguccucggcagccaggagggugccaugcacacugcucuuaccggggccacggagauucagaccagcgggaccaccaccauuuuugccgggcaccuaaagugccgcuuaaaaauggacaagcuaacccugaaggguaccucuuaugucaugugcaccgggagcuucaaacuggagaaggaaguggcggagacgcagcacggcaccguucucguacaggugaaguacgaggguacugaugcccccugcaaaauaccguucucgacccaggacgagaagggggugacgcaaaacggccgucugaucaccgccaacccgaucgucaccgacaaggagaaaccugucaacaucgagacugagccuccuuucggugagagcuacauaguagucggcgcgggcgaaaaggcguugaagcuguccugguucaagaaggggagcagcaucggcaaaauguucgaggccacugcucgcggggcccgacgcauggcaauccugggggauaccgcgugggacuucggaagcaucgggggagucuucaccuccguggggaagcugguccaccaaguuuucgguaccgccuacggaguccuauucagcggcgucuccuggacuaugaagauagggaucggcauccuacugaccuggcucggccugaauucucgauccaccagccugucaaugacaugcaucgcaguggggauggugacgcucuaccucggcgucauggugcaggccgacagcggaugcgucauaaacuggaagggucgugagcugaagugcgggucaggcaucuuugucaccaacgagguucacaccuggaccgagcaauacaaauuccaagcagacagcccgaagcgccucagcgcggccaucgguaaggccugggaggagggcguuugcgguauccgguccgccacgcgccuggagaacauuauguggaagcagauuagcaacgagcucaaccacauccuuuuagaaaacgacaugaaguucacggucgugguaggagacgccaacggaauccuggcgcaggggaaaaagaugauccggccccaacccauggaacacaaguauuccuggaaauccugggggaaggcaaagaucaucggcgcugacauacagaacaccaccuucaucaucgaugggcccgacaccccggagugcccugacgaccagcgcgccuggaacaucugggaggucgaggacuacggcuucgggauuuucacgaccaacaucuggcucaagcugcgggacuccuacacccagaugugcgaucaccgcuuaaugagcgcagccaucaaggacuccaaggccgugcacgcugacaugggcuacuggaucgagagcgagaagaacgagaccuggaagcucgcgagagcguccuucaucgaggugaagacgugcaccuggcccaagagccacacccugugguccaauggcguccuugagagcgagaugauaauaccaaagauuuacggggguccgauuucccagcacaacuaccgccccggguacuucacccagacggccggacccuggcaucuggggaaguuagagcuggacuucgaccucugugaaggcaccaccgugguggucgacgagcacugcggcaaccggggaccgagccuacgcaccacgaccgugaccggcaagauuauacacgaauggugcugucggagcuguacccugccgccccuccgcuuccgaggggaggacggcugcugguacgggauggagauacgccccgugaaggaaaaagaggaaaaccuaguccgauccaugguguccgcgggcagcggagagguagacucauucucccuggggauccucugugucagcaucaugauagaagagguuaugcgcucccgguggucgcgcaagaugcugaugacgggcacccuggcaguguuccuacugcugaucaugggacagcucaccuggaacgaccugauacgucugugcaucaugguuggcgccaacgccuccgaccgaauggggaugggcacgacguaccucgcauugauggccacauuuaagcugcgcccgauguuugccguaggcauccucuuccggcgucugacgagccgggaagugcugcucuuaaccaucggucugagccucguugccagcguagaauuacccaacucccuggaggagcuaggggacggucuugcaauggguauuaugaugcuuaagcuccugacggaauuccagccacaccagcuguggaccacccuccugagccucacuuuuaucaagacgacguuauccuuggacuacgccuggaagacuaccgccauggcccugagcaucgucucccucuucccuauaugccugagcacgacgucccagaagaccacguggcugccggugcuccugggcucuuuuggguguaagccccugaccauguaccucaucaccgagaacaaaaucuggggccgcaaguccuggcccaucaacgaggggaucauggccaucggcaucgugagcauccugcuguccagccuccugaagaacgacgucccccuggccgguccgcucaucgcuggcggcaugcugauagccugcuacguuaucucuggguccagcgcagaucugucccucgagaaggcggcugaggugagcugggagcaagaggccgagcacuccggcaccagccacaacaucuuggucgaaguccaagaugaugggaccaugcggauuaaggacgaggagaaggacgacacccugaccauccuccucaaggccacccugcuagccgucuccggcgucuaccccaugagcauacccgcuacccuguucgugugguacuucuggcagaagaagaagcagcggucggggguucugugggacaccccgagcccgcccgaagucgagagagccguguuagacgacgggaucuacaggauccugcagcggggccugcugggacgcagccaaguaggcgucgggguguuccaggacggcguguuucacaccauguggcacguuacccggggggcggugcucauguaccagggcaaacgccuggaaccuagcugggccuccgugaagaaggaccugauaagcuacggcgggggcuggcgcuuccagggguccuggaacaccggcgaggagguccaggucaucgcaguggagcccgggaagaaucccaaaaacguacagaccacaccgggcacuuucaagaccccggaaggcgaagugggggcgaucgcccuagacuucaaacccggcaccagcggaagcccaauugugaaccgcgagggcaagauagucggccuuuacgguaacggcgugguaaccaccagugggacauacgucuccgcuaucgcccaggccaaggcaagccaggagggcccccugcccgagaucgaagacgagguauucaagaagcggaaccucaccaucauggaccugcacccgggcagcggcaagacgagacgguacuuaccagcaaucgugcgcgaggccaucaagagaaaacucagaaccuugauccuggccccgacccgcgucguggcguccgaaauggcggaggcccuuaagggcaugcccauccgcuaccagacuacggcugucaagagcgaacauacugggcgcgagaucgucgaccugaugugucacgcaaccuucaccaugcgguuacucagcccggugcgcguucccaacuacaacaugaucauuauggaugaggcgcacuucaccgauccugccagcaucgccgcccguggcuacauauccacccgcgucgggaugggcgaggcugcggcuaucuucaugaccgccacgccucccgggucuguugaagcuuucccccaguccaacgccguuauccaggacgaggagcgggacauccccgagcgcagcuggaauuccggcuacgauuggauaacggacuuccccgguaagaccgucugguucguuccuagcaucaaguccgggaacgacauugcgaacugccugcggaagaacggaaagagggugauucagcugagccgcaagaccuucgauaccgaguaucagaagacaaagaauaacgacugggacuacgucgugaccaccgacaucuccgaaaugggggccaacuuucgcgccgaccgggucaucgacccccgccgguguuuaaagcccgucauucugaaggacggcccagagcgcgugauccucgcaggcccuaugccagucaccgucgcaagcgccgcccagaggaggggacggaucggccgcaaccagaacaaagaaggugaccaguacguguacaugggccaaccccuaaacaaugacgaggaucacgcacauuggacggaggccaagaugcugcuugacaacaucaacacucccgagggaaucaucccggcccuuuucgagcccgaacgcgagaaguccgccgccaucgacggcgaguaccgacugcgcggggaggcccggaagaccuucgucgagcugaugcgccggggcgaucugcccguguggcugagcuauaagguggcguccgagggcuuccaguacagcgaccggcgguggugcuucgacggggagcgcaacaaucaaguccuggaggaaaacauggauguggagaucuggacaaaggaaggggaacgaaagaaacuccgcccgcgauggcuggacgcgcgaaccuauagcgacccccuggcccucagagaguuuaaagaauucgccgcggggcgccggagcgugagcggcgaucugauccuggagaucggcaagcucccccagcauuugacgcugcgcgcgcaaucagcgcucgauaaccuggucaugcugcacaacagcgagcaaggcggaaaggccuaucgucacgccauggaggagcuccccgacaccaucgagacccugauguugcucgcccugaucgcgguccugaccgggggcgucaugcuguucuuccugagcgggaaaggccuaggaaaaacgucgauugggcuccucugcgucaccgccuccagcgcgcuucucuggauggccucuguggagccacauuggaucgccgcgucgaucauccucgaguucuuccugauggugcuccugauaccggagccggaccgccagcgcacgccccaagacaaccaacuggcuuacgucguuaucggccuccuuuucaugauccugaccguggccgcgaacgagaugggacuccuggagacaacaaagcgagaucugggcaucgggcacgucgcagcggagaaccaucaacacgccaccauguuagacgucgaucugcggccagccuccgccuggacccuguacgccguugccacgaccgucaucaccccuaugaugcgccacaccaucgagaacacgaccgcgaacaucagccucaccgcgaucgccaaucaggcggcgauccugaugggccuggacaagggauggcccauaucuaagauggacaucggggugccguugcuggcucugggaugcuacagccagguuaacccgcucacccugacugccgccguccugauguuaguggcgcacuacgccaucaucgggcccggccugcaggcuaaggccacccgcgaagcccagaaacggaccgcggcugggaucaugaagaaccccaccguugauggaaucgucgccauagaccuggaccccguaguauacgacgccaaguucgagaagcaguuaggucagauaauguugcugauccuuugcacaagucagauucugcucaugcguaccacuugggcccucugugagagcaucacgcuggcgacgggcccccugaccacucugugggagggcucccccgggaaguucuggaauaccacgauugccgucagcauggccaacaucuuccggggguccuaucuggccggcgccgggcuggcuuucagccucaugaagucccugggcggagggcgcagagggaccggcgcccagggcgagaccuugggggaaaaauggaagcgucagcucaaccaauuaagcaagcccgaauucaauaccuacaaacggucggguaucauggagguggaccgcuccgaggccaaggaggggcugaaacggggcgagacgaccaagcaugcggugagccgggggaccgcgaagcuccggugguuugucgagcgcaaccuggugaagcccgaggguaaggugaucgacuugggcugugggcggggggggugguccuacuauugugccggccuaaagaaggucaccgaagugaaaggguauacaaagggcggcccuggucacgaggagccuaucccaauggccacguacggcuggaaccucgugaaguuacauagcgggaaggacguguuuuucaugcccccggagaagugcgacacccugcucugcgacaucggcgaguccagcccgaauccaacaauugaggaggggagaacgcugcgggugcuuaagauggucgagcccuggcuccgaggcaaccaguucugcaucaagauccugaauccguauaugcccuccgucguggagacgcuagagcagaugcagcggaagcacggcggcaugcucgugcggaacccccuuucaagaaacaguacccacgagauguauugggucagcuguggcaccgggaacaucguguccgcugugaacaugaccucaagaaugcugcucaaccgcuucacgauggcccaccgcaaacccaccuacgagcgcgacgucgaccugggcgcggggacccggcacguuaccguagagccggaagucgcuaaccuugacaucaucgggcaacgcauugaaaacaucaagaacgagcacaaguccacguggcauuacgacgaggacaaccccuacaaaaccugggcuuaccacggcucauacgagguaaagcccagcgggucugcauccucuauggucaaugguguagugcggcuccugaccaaacccugggacgucaucccgauggucacacagaucgcgaugacggacaccacgcccuucgggcaacagcgcguguucaaggagaagguagacacccgcacgccccgugcgaagcggggcaccacccagaucauggagguuaccgccaaguggcuguggggauuccucucccgcaauaagaagccgcggaucugcacgagggaggaguucacgaggaaagugaggagcaaugccgcuauuggugccgucuucguggacgaaaaccaguggaacagcgcuaaggaggccguagaagaugagcgguucugggaccugguccaucgcgagcgggagcugcauaagcaaggcaagugcgcgaccugcguauacaacaugauggggaagagagagaagaagcucggcgaguucggcaaggccaagggcucccgggcgaucugguauauguggcugggugcacgcuuccuggaguucgaagcccucggguucaugaacgaggaccacugguucagccgggagaacucccuaagcggugucgagggggagggccugcacaagcucggguacauccugcgugauaucuccaagauccccggaggcaacauguaugcggaugacaccgccgggugggacacuagaaucaccgaagaugaucugcagaacgaggcaaagaucacggauauuauggagcccgagcacgcccuccuggccacaagcaucuucaaguugacguaccagaacaaggucgugagagugcagcgccccgcgaagaauggcaccgucauggacgugaucagucgccgcgaccagcgggggagcggccaggugggcaccuacgggcugaacacauucacgaacauggagguccaguuaaucagacagauggaauccgagggcaucuuccugccuucugagcucgagaccccaaaccuggccgagcgggugcuggacuggcuggagaagcacggggcugagcgucuuaaaaggauggccaucagcggcgaugacugcgucgucaagcccaucgacgaucgcuucgccaccgcgcugacggccuugaacgacauggggaaggugcggaaagacauuccccagugggaaccgaguaagggcuggaacgacuggcagcaggucccguuuugcucccaccacuuccaccaacuaauaaugaaggacggucgcgagaucgucgugcccugccggaaucaagacgagcugguggggcgcgcgcgggucagccagggcgccggguggagccuccgggagacggcaugucuggguaagagcuacgcccagauguggcaguugauguacuuccaccgccgcgaucuccggcuggccgcgaacgccaucugcuccgccguacccgucgacuggguuccgaccagccguacuaccuggucgauccacgcccaccaucaguggaugaccaccgaggacaugcuguccguuuggaaccgcguguggaucgaggagaacccuuggauggaggauaagacccacgucagcuccugggaggaggugcccuaccuugggaagagggaggaucaguggugcggcagccugaucgggcugaccgcucgcgccaccugggccaccaacauucaaguggccauuaaccagguccggcgcuuaaucgguaacgagaauuaccuggacuacaugaccuccaugaagcgguucaaaaacgaauccgacccggagggcgugcugugguga

SEQ ID NO: 23966 - RNA, 9879 nt, Artificial Sequence
  derived and/or modified CDS sequence (opt11) from DENV-1__KF973455__SS-prME
agugucacaaugcuucucaugcuccuacccacggcauuagcauuucaccucacaacucgcggaggggaaccucacaugauugucucaaaacacgaacgcggcaaaucucugcuauuuaaaacaucgaccggcguaaacauguguacacuaaucgcaauggacuuaggagaacugugcgaagacacgaugaccuacaaaugcccacggaucacggaagccgagccggaugacguagacugcuggugcaacgcuacagacaccugggucacguacgggacaugcagccaaaccggcgaacacagaagggauaaacgaagcgucgcacucgcgccccacguaggucuggggcuagagacuagaaccgagacguggaugucgucggagggggcguggaaacaaauccaaagagucgagacgugggcauuacggcauccaggcuucacagucauagcguuauuucuagcgcacgccauaggcacaagcauaacgcagaaagggaucauauuuauuuuacugaugcucgugaccccaaguauggcaaugagaugugugggcaucggcaacagagacuucguggaggggcuaaguggagcaaccugggucgacgucguccuagagcacggcucgugcgugacaaccauggccaaaaauaaaccgacuuuagacaucgagcuccuaaaaaccgaaguaacuaacccugcaguacucagaaaauuaugcaucgaggccaaaaucagcaauacaacgacagauaguaggugccccacucaaggcgaagcgacccuaguugaagaacaagacgccaauuuugucuguaggcgaacccucgucgaccgcggcuggggaaacggaugugggcuauucggcaaaggaucgcuacuaacaugcgcaaaauucaaaugcguaacuaagcuggaagggaaaaucgugcaauacgaaaaccucaaauauagugugauaguaacgguccacaccggagaucaacaccaaguugguaaugaaacaacugaacacggaacgauagccacgaucacaccucaggcaccaacaucagagauacaacuaacagauuacggugcucucgcgcucgauuguagcccgcgaacaggacucgacuucaaugaaauggugcuccucaccaugaaagagaagucauggcugguccauaaacaaugguuccuagaucuaccccuucccuggacgucgggggcuagcaccucccaagaaacauggaaccggcaagaccuacuugucacguuuaaaaccgcccacgcgaagaaacaagaagucguaguccucgggagccaggagggcgcaaugcauacugcccuaaccggcgcaacggagauccagacaucgggaacgaccacaaucuucgccggccaucuaaagugccgcuugaagauggauaaacucacacuaaaaggcacaagcuacgucaugugcacagggaguuucaagcuagagaaggagguggcagaaacacaacacggcacugugcugguccaaguaaaguacgagggaacagacgcgcccugcaagauaccauucagcacccaagacgaaaaagguguaacacaaaacggccggcuaauaacagcgaacccaauagugaccgacaaggagaagccagugaacauagaaaccgagccucccuucggggaauccuauauugucgucggcgcgggggagaaagcacuaaaacucucgugguucaagaaaggcucaagcauaggaaaaauguucgaggcaacagcaagaggugcgcgcaggauggccauccucggcgauacggccugggacuuuggauccaucgggggcgucuucaccucaguagggaaauugguccaccaaguguucggcacagcauauggaguacucuuuucgggcgucagcuggacaaugaaaaucgggaucggaauccuucucacguggcucgggcuaaacagcaggagcacaagccuuagcaugacauguauugcuguaggaaugguaacacuauaccuuggcgugaugguccaagccgacucagggugcguaaucaacuggaaaggcagagaacuuaaaugcggcagcggcauuuucgugaccaacgaaguacacaccuggacagagcaauauaaauuccaggcagauuccccaaaaaggcucucagcagcuauugggaaggccugggaagaaggugucugcggaauccgaagcgcaacccgacucgaaaauauaauguggaagcaaauauccaaugagcucaaucacauacuccucgaaaacgauaugaaauucaccgugguuguaggcgaugcuaacggaauacuagcucaagguaagaaaaugauacgcccacagcccauggaacacaaauacaguuggaaaagcugggguaaggcuaagaucaucggagcagacauccagaauaccaccuucauaauagauggcccagauacgccugagugcccggacgaccaacgcgcauggaacauaugggaaguagaggacuacggguuugggaucuuuacuacaaauauauggcuaaaacugcgagacucguauacacaaaugugcgaccaccggcugauguccgcugcaaucaaagacucuaaggcugugcacgcagauaugggguacuggaucgaauccgagaaaaacgaaacuuggaagcuggcacgugcuucuuuuauagagguuaaaacaugcaccuggccaaaaucgcauacucuuugguccaacgguguacucgaaagugagaugaucauaccgaagauuuacggagggccuauaucacaacacaacuacagacccggauacuucacccagacagccggccccuggcaucuaggaaagcuagaguuagauuucgaccuaugcgaaggcacaacaguuguaguagaugagcauugugguaaucgcggccccucacuacgaacuacaaccguaaccggcaagauaauacacgagugguguugcagaagcugcacguuacccccgcuaagauuccgcggagaagaugggugcugguaugggauggaaauccguccgguaaaagagaaggaggaaaaccucguaagaucaaugguaagugcgggcuccggagaaguagacucguuuuccuuagguauucucugcgucucgaucaugaucgaagaggugaugcgcucaagguggucucggaaaaugcuuaugacaggaacauuggccgucuuccucuuacucaucaugggacagcucacguggaacgaucucauccgccugugcaucauggugggagcuaacgccucggaccgaaugggcaugggcacaaccuacuuggcccucauggcuacauuuaagcuaaggccgauguucgcgguuggcauacuguuccgccgucucacgagcagagaggugcugcuccugaccaucgggcugagcuuaguagcuaguguugaacuaccgaacagccuagaagaacuaggagauggccuagccaugggaaucaugaugcucaaauugcucacggaauuucagccucaucaauuauggacuacgcuacucucucugacguucaucaagaccacacucucccuugauuacgcauggaagaccacugcaauggcucugagcaucgugucccuauucccgauaugcuuaaguaccaccagccagaaaacgaccugguuacccguccuccucgguagcuuugggugcaaaccacuaaccauguaccugaucacggagaauaagaucuggggccggaaauccuggccgaucaaugaaggcauaauggccauaggcaucgucuccauacuacuuucgucccuccucaaaaacgaugucccgcuggcaggaccccucauugccggcggcaugcucauagcaugcuacguaaucuccgggucaucggcagacuugucccucgaaaaggcggccgaagucucaugggaacaagaagcugaacauagcggcaccagccauaauaucuugguagaaguccaggacgacgggaccaugcgcauaaaggacgaggaaaaggacgacacgcucacaauccuucucaaagccacauugcucgccguguccggagucuacccuaugagcauucccgcaacucucuucgucugguacuucuggcagaagaagaaacaacgaucgggcguacucugggacacaccauccccgcccgaggucgaacgggcaguccucgacgauggaauauaccgaauccuacagcgaggccuacucggaagaagucaagucggcguaggcgucuuucaagacggaguguuccacacuauguggcacguuacucggggcgccguucucauguaccaaggaaagaggcucgaacccuccugggccucagugaaaaaggauuugauuucauacgggggcggauggcgguuucaaggaagcuggaacacaggcgaggagguacaagugaucgcggucgaaccaggcaaaaaccccaagaauguucagaccacaccaggcaccuucaaaaccccggagggggaggugggcgccaucgcccuagauuucaaacccgguacauccggcagccccauaguaaaccgugaaggaaaaauuguaggcuuguacgggaacggaguaguuacaacaucagggacguacgucagcgcaauagcacaagcgaaagcgucgcaagagggaccacugccagaaaucgaggacgaagucuucaagaaacgcaaucuuaccaucauggaccuacauccaggauccggcaaaacucgucgauaucugccggcaauaguaagggaagccauuaaaagaaagcuaagaacauugauacuagcaccaacccgaguggucgccagcgagauggcggaggcauuaaaaggaaugccaauacgcuaccaaaccaccgccgugaaaagcgaacacacaggucgagagauaguagaccucaugugccacgcaacguucaccaugcgacuucuauccccgguaagaguuccaaauuacaacaugauuaucauggaugaagcacacuucacagacccggccagcauagcagcaagaggguacauauccacgcgagugggaaugggagaagccgcugcaauauuuaugacugcgacucccccgggcucaguggaggcauuuccgcaaucuaacgcaguaauacaggacgaggaacgcgacauucccgaacgaucauggaacaguggauacgauuggauaacggacuuuccgggcaaaacgguuugguucguaccgucaauaaagagcggcaacgacauagcaaacugcuuacgcaaaaaugggaagagaguuauccaacugucgagaaaaacguucgacacagaauaccagaaaacuaaaaauaacgacugggauuacgugguuaccacugauaucagugagaugggcgccaacuuccgagcggacagaguaauagacccaagacgaugcuuaaagccggucauacuuaaagacggaccggaacgcgucauccuugcggguccgaugccgguaaccguggcgagugcugcgcagcgucgagguaggauaggacgaaaucagaacaaggaaggggaccaauacguauauaugggacagccccugaauaacgacgaggaccaugcccauuggacggaagcaaagauguuacucgacaacaucaacacgcccgaaggcaucauccccgcgcuauuugaacccgaacgggaaaagagcgccgcgauugacggagaguacagacuucguggagaagccagaaaaacuuucguggagcucaugcgacggggcgaccuaccgguguggcugucguauaaaguggccagcgagggcuuccaguauagcgaucgaaggugguguuucgacggggaaaggaauaaccaaguacucgaggagaauauggacgucgaaaucuggacaaaggaaggggagcgcaaaaagcugcggccccgguggcuagaugcucgaacuuauucggacccuuuggcacuccgggaguucaaagaauuugccgccggucgucgcucaguaucuggggaccugauccuagagaucggcaaauugccacaacaccucacacuacgugcgcaaaacgcgcuugacaaccuagugaugcuucacaacagcgaacaaggcggaaaagcauaucgacaugcaauggaagaacuacccgacacgaucgaaacccucaugcuccuagcgcugaucgcuguccuaacagguggaguaaugcuauucuuccucucgggcaaggguuuagguaaaaccaguaucggucuacucugcguaacugccucaucagcccuacuguggauggccucaguagagccucacuggaucgcagcgucaaucauucuagaguucuuucugaugguacuccuaauaccugaaccagaucgacaacgaacgccgcaagacaaccaacuagcauacguagucauaggacucuuguucaugauccucacugucgcagccaacgaaaugggguuauuagaaaccaccaaacgggaccuaggcauagggcauguugccgccgaaaaccaccagcacgcgacaaugcuagacguagaccuucauccagcaagcgccuggacgcuguaugcagucgcaacaaccgugaucacgccuaugaugaggcauacaaucgagaauacaacugcaaacauaagccuuacagcaauagcgaaucaagcagcaauacucaugggccuagacaaagguuggccuaucagcaaaauggacauagggguacccuuauuggcgcucggaugcuauagccaagucaacccauuaacacugaccgccgcgguccugaugcucguagcacacuacgcaaucauagguccaggccuccaggcgaaggccaccagagaagcccagaagaggaccgcagcaggcaucaugaagaaucccacgguugacggaauuguagcuauagaccucgacccgguggucuacgacgccaaauucgaaaaacaacucgggcagaucaugcuacucauacuguguacaucccaaaucuuacuuaugaggaccaccugggcccugugcgaauccauaacccuggcgaccggaccacugacuacccucugggaagguucgccgggaaaauucuggaacaccacaauagccguaagcauggccaacauauuccgcggcagcuaccucgccggagcaggccucgccuuuucuuuaaugaaaucacuaggaggaggcaggcggggcacgggcgcgcaaggggaaacccucggugagaaguggaaacggcaauuaaaccaacucucgaagccggaguucaauacauacaagcgaucggggauaauggaagucgaucgcagcgaagcgaaagaaggccuaaagcguggagagacgaccaaacaugcggucucgcgcggcacagcgaaacuucguugguucgucgaaagaaacuugguaaagccggaaggaaaaguaauagacuugggaugcggacgcggcggauggagcuacuauugcgcaggacucaagaaaguaacagaagucaaaggcuacacgaagggcgguccgggacacgaagaaccaauuccaauggcaaccuauggauggaaccucgucaagcugcacucggggaaagacguauucuuuaugccgccggaaaagugcgacacguuacuaugugauauaggugagucaucgcccaacccgaccauagaggaaggcaggacccuaagagucuugaaaaugguugaacccuggcuacgcggaaaucaauucugcauuaaaauauuaaaccccuauaugccaucggucgucgaaacacucgaacagaugcaacgaaaacacggagggaugcuggugagaaauccacucucacgcaacucuacccacgaaauguauuggguguccugcggcacaggaaauauagucuccgcagucaacaugaccagccgaaugcugcuaaaccgauucacuauggcacaccgaaaacccaccuaugaacgagacguggacuuaggcgcaggaacgagacacgucaccguggagcccgagguugcaaacuuggacaucauaggucaacgcaucgaaaacaucaaaaaugagcauaaaaguacuuggcacuaugacgaggacaaucccuacaagaccugggccuaccacgggucuuacgagguaaaaccguccggcuccgcuucgagcauggugaacggcguugugcgauugcuaaccaaaccaugggaugucauaccgauggucacccagauagccaugaccgauacaacgccuuucggacagcagcgaguuuucaaggaaaaaguggacacaagaacaccccgcgccaagcggggaaccacccagaucauggaaguaaccgcaaaguggcuguggggauuccuuucacgcaauaaaaagcccaggaucugcacccgcgaagaguuuaccaggaagguacgaucaaacgccgcuauuggcgcuguguuuguagacgaaaaucaguggaacucggccaaggaagccguagaggacgagcgcuucugggacuuagugcaccgcgaacgcgagcuacacaaacaagguaagugcgcaaccugcgucuacaauaugauggggaaacgcgaaaagaaacuaggagaguucggcaaagccaaaggaaguagagccaucugguauaugugguuaggggcgagauuccuagaauuugaagcacuaggguucaugaacgaggaccacugguucuccagggaaaacucccuuaguggcguggagggcgaaggauugcacaaguuggguuacauccugagagauauaagcaagaucccgggcggaaacauguacgccgacgauacggcgggcugggacaccaggauaacagaagaugaccuacagaacgaggcgaagauuaccgacaucauggagccagaacacgcccucuuagccaccucaaucuucaaacuaacauaucaaaacaaagucguacgaguacagcggcccgccaaaaacggcaccgucauggacguaauaucacgcagagaccagaggggcuccggccaggugggcacauauggccucaauacguucacaaacauggaaguacagcucaucaggcaaauggaaucagaagggaucuuccugcccagugaacuagaaacacccaacuuagcagagcggguauuggauuggcuagagaagcacggggccgagcgauugaaaagaauggcaaucagcggcgacgacugcgugguuaaacccauugacgacagauucgccacugcacuaaccgcgcuuaaugauaugggaaaggugcggaaagacauaccacagugggaacccucgaaagguuggaacgacuggcagcaaguccccuuuuguucacaccacuuucaccagcugauaaugaaggacggccgagagauagucgucccguguagaaaccaggacgaauugguaggcagggcgagagugucgcagggagcaggcuggucacugcgagagacagccugccuggggaaaaguuacgcccaaauguggcaacucauguacuuccaucgccgggaucuccgccuagcagcuaacgccauuugcucugccgugcccgucgacugggugccaacgagcaggaccaccugguccauccaugcccaccaccaauggaugacuaccgaagacaugcuaucgguguggaaccguguauggauagaggagaauccauggauggaagacaaaacgcaugucagcagcugggaagaggugccauaccuaggaaaaagagaggaccaguggugcggaagccuaaucggacucacagcaagggcaaccugggcaaccaauauacaaguggcgauaaaccaaguccggcgccuaaucggcaacgaaaacuauuuagacuacaugacaagcaugaagagguucaagaacgagucagacccagaaggcgcacuuugguag

SEQ ID NO: 23967 - RNA, 9879 nt, Artificial Sequence
  derived and/or modified CDS sequence (opt11) from DENV-1__KF973456__SS-prME
agugugacaaugcuccucaugcuccugccaaccgcccuggcguuccaucuaaccacgagggggggagagccgcacaugaucgugagcaagcacgaacggggcaagucucuccucuucaagaccagcaccggggugaauaugugcaccuugaucgccauggaccugggcgagcuuugugaggacaccaugacuuacaaauguccccgcaucaccgaagccgagccagacgacguggacugcugguguaacgcgacggacaccugggucaccuacgggaccugcucacagacgggcgagcaccggagagacaagcgguccguggcccuggcgccccacgugggccuggggcucgagaccagaaccgagacuuggaugagcuccgaaggcgcguggaagcagauccagcgcguggagacuugggcccuucgucacccaggguucaccguuaucgcccuguuccucgcccacgcgaucgggaccagcaucacccagaaggggaucaucuuuauccugcugaugcucgugacgccuuccauggcuaugcggugugucgggaucggaaaccgggacuucguggaggggcugagcggugccaccuggguggacguagugcuggagcacggguccugcgugaccacuauggccaagaacaagccuacacucgacaucgagcugcugaaaaccgagguaaccaaucccgccguucuccggaaguugugcaucgaggcgaagaucagcaacaccacgaccgacucccgcugcccgacccagggcgaggccacccuuguggaggaacaggacgccaacuucguaugccgucguacccucguggaccgcgggugggggaacggcuguggauuauucgggaaaggcagccugcugaccugcgccaaguuuaaaugcgugacaaaacuggaggguaaaaucguccaguacgaaaaccugaaauacuccgugaucgugaccguccacacgggugaccagcaccagguggggaaugagaccaccgagcacggaaccaucgccaccaucacgccccaggcccccaccagcgagauccagcucaccgacuacggggcccuggcccuugacuguagccccaggaccggccucgacuucaacgaaaugguccuucugacaaugaaggagaaguccuggcucgugcacaagcagugguuccucgaccugccgcuucccuggaccucuggugcuagcaccagccaggagaccuggaaccggcaagaucugcuggugacguucaagacagcccacgccaagaagcaggaggucguggugcucggcucccaggagggcgcaaugcacacagcccugaccggggccacggagauccaaaccagcggcacgaccacgaucuuugccggccaccugaagugccgccucaagauggauaagcugacccugaaaggcacuuccuacgucaugugcaccgggucguucaagcuggagaaggagguggcugagacgcagcacggcacggugcucguccaaguuaaauacgagggcaccgaugcccccugcaagauccccuucucgacccaggacgagaagggggugacgcagaacggccggcugaucaccgccaacccgaucgucacggacaaggagaagcccgucaauaucgaaaccgaaccgccuuucggugaaucguauaucguggucggcgcgggagagaaggcgcugaaacuauccugguucaagaagggguccaguaucggcaagauguucgaggccacugcucgcggggcccgaagaauggccauccugggcgacacggcgugggacuuugggaguaucggcggcguuuucaccucgguggggaagcugguacaccagguguucggcaccgccuacgggguccucuucagcggcguuuccuggacuaugaagaucgggaucggcauccuucugaccuggcucggucugaauagccgcuccaccucgcuguccaugaccugcaucgcggugggaaugguaacguuguaccuaggcgucauggugcaggcggacagugggugcgugauuaacuggaagggccgggagcugaagugcgguuccggcaucuucguuaccaacgagguucacaccuggacugaacaguacaaguuccaggcggacagcccgaagcgccucagcgccgccaucggcaaggccugggaggagggggugugcggcauccgguccgcgacucgccuggagaacaucauguggaagcagaucagcaacgagcugaaccacauccuccuggagaaugacaugaaguucacgguuguggugggggacgccaacggcauccuagcucaggggaagaagaugauccggccccagcccauggaacacaaguacuccuggaaguccuggggcaaggccaaaaucaucggcgccgacauccaaaacaccaccuucaucaucgaugggcccgacacccccgagugccccgaugaccagcgcgcguggaacaucugggaggucgaggacuacggcuucgggaucuucacgaccaacaucugguuaaagcugcgggacucguacacccagaugugcgaccaucgccuaaugagcgcggccaucaaggacagcaaggccgugcaugccgauaugggcuacuggaucgagagcgagaagaacgaaaccuggaagcucgcccgggcguccuucauugaggucaagacgugcaccuggcccaagagccacacccuguggucaaacggcguccuggagagcgagaugaucaucccuaagauauacggaggcccgaucucccaacacaacuaucgccccggauacuucacccagacggccggccccuggcaccucggaaagcuggagcuggacuucgaccucugcgaaggcaccaccguaguggucgacgagcacugugguaaccgggggccgagccuucgcacgacgaccgugaccggcaagaucauccacgaguggugcugccgcuccugcacccucccgccccugcgcuuccgcggcgaggacgggugcugguacgguauggaaauccgccccguuaaggagaaggaggagaaccugguccggagcaugguguccgccggcagcggggaggucgacagcuucucccuggggauucucugcgucucaaucaugauugaggaagugaugcgcucacgguggagccgcaagaugcugaugacggguacccuggcuguuuuccuccugcugauuaugggccaacucaccuggaaugaucugauacgccuguguaucauggugggcgccaacgcuuccgaccggaugggcaugggcaccacguaccucgcccugauggccacguucaagcugcgccccauguucgccgugggcauccucuuccgccgcuugacgagccgggagguacugcuccugaccaucgggcugucccucgucgccucaguggagcugcccaauucccuggaggagcucggcgacggacuggcgaugggcaucaugaugcucaagcuccugacggaauuccagccccaccagcuauggacgacgcuccuaagccugaccuuuaucaaaacuacccucucccuggacuacgcuuggaagaccaccgccauggcccuuagcauagucagccucuuccccauuugccugagcacaaccucccagaagaccacguggcugccggugcuucugggcucuuuugggugcaaaccccugaccauguaccucaucacggaaaacaagaucuggggucgcaaguccuggcccaucaacgaggggaucauggcgauuggcaucgucagcauccugcugucaagccuucugaagaacgacgucccccuggccgggccgcuaaucgccggcggcaugcugauagccugcuacgugaucagcggguccucagccgaccugucccuugagaaggcggccgaggugagcugggagcaagaggccgagcacucgggcacaagccacaacauccuggucgagguacaagacgacggcaccaugcguauaaaggaugaggagaaagacgacacccugacgauccucuuaaaggccacccugcucgccgucuccggcgucuaccccaugagcauaccggcgacccucuucgugugguacuucuggcagaagaagaagcagcgcagcggagugcuaugggacacccccucaccgcccgaggucgagcgggccgugcucgacgacgggaucuaccgcauccugcagcggggccugcuggggagaagccaagugggcgucgggguguuccaagacggcgucuuucacacgauguggcaugucaccagaggggcugugcucauguaccaaggcaaacgccuggagccaagcugggccucgguuaagaaggacuugaucaguuacggcggcggcuggcgguuccaagggucuuggaacacaggagaggaaguccaggugaucgccguggaacccgggaagaaccccaagaacgugcaaacuacgccaggcaccuuuaaaacacccgagggagaggugggggcgaucgcgcucgacuuuaagcccggcaccucuggguccccuauagugaaccgcgaggggaagaucgucggccuguacgggaacggcguggugacaaccagcgggaccuacgucuccgccaucgcccaggccaaggccagccaggaggggccgcugcccgagaucgaggaugagguguucaaaaagcggaaucucaccaucauggacuugcacccugguagcggcaagacgcgccgauaucugccggcgaucgugcgcgaggccaucaagagaaagcuccgcaccuugauccuggcgcccacccgcgucguggccuccgagauggcggaggcccucaaggggaugcccaucagauaccagaccacggccgucaagagcgagcauaccggucgcgagaucguagacuuaaugugccaugccaccuucacuaugcggcugcucuccccggugagagugcccaacuacaacaugaucaucauggacgaggcgcauuucacggacccugccuccaucgccgcccggggguauauuuccacgcgagucgggaugggcgaggcugcggccaucuucaugacugccacuccgcccgggagcguggaggccuucccccaguccaacgccgugauccaggaugaggagcgggacaucccagagcgcucauggaacuccggcuacgacuggauaacggauuuccccgggaagacaguaugguuugugcccagcauuaaauccgggaacgacaucgcgaacugccugcggaaaaacggcaagagagugauccagcugagccgaaagaccuucgacaccgaauaccagaagacuaagaauaaugacugggacuacgucgugaccacggacauuagcgaaaugggggccaacuuccgcgccgaccggguaaucgacccccgccggugucugaaaccagucauccuaaaggauggccccgaacgcgugauccuugccggcccgaugcccgucaccguugccagcgccgcccagcgacgcggccggaucggccgcaaucagaauaaggaaggcgaccaguacgucuauaugggccagccccucaacaacgacgaggaccacgcacacuggacagaggcaaaaaugcuucuggacaacaucaacacccccgaagggaucauuccggcccucuucgagcccgagcgcgaaaaaucggcugcuaucgacggcgaauaccgccugcgcggggaggcccggaagaccuucgucgagcugaugcgccgaggcgaucuccccguuuggcugucauacaagguggccuccgagggcuuccaguacuccgaccgucgguggugcuucgacggggagcgcaacaaucagguacuggaggaaaacauggacguggagaucuggacaaaagagggagagcggaagaagcuccgaccacgguggcuggacgcgcgcaccuacuccgacccgcuagcccucagagaguucaaggaauucgccgccgggagacgcagcgugucgggcgaccugauccuggagaucgggaagcucccccagcaccugacgcugcgugcccagaacgcgcucgauaaccuggucaugcugcacaacucugagcagggcgguaaagccuaccggcacgccauggaggagcuccccgacaccaucgagaccuuaaugcuguuagcccugaucgcggugcugaccgggggcgucaugcuguucuuucugucugggaagggccuggguaagacguccaucgggcuguuaugcgugaccgccagcuccgcccugcucuggauggcgagcguggagccccauuggauagcugcgucuaucaucuuagaauucuuucugauggugcuccugaucccggagcccgaccgccagcggacgccccaagacaaucagcucgccuacgucgugauuggccuccuguucaugauccugacaguggcggccaacgaaauggggcuccuggagacuaccaagcgcgaccuggggaucggccacgucgccgcggagaaccaccagcacgccaccaugcuggacguggaucugcggccggccagcgcguggaccuuauaugccguggcgacgaccgucaucacucccaugaugcgccacacuaucgagaacacuaccgccaacaucucucucacagccaucgccaaccaggccgcgauccugaugggccuggacaagggcuggcccaucagcaagauggacaucgguguacccuuacucgcccuggggugcuauucccaggugaauccgcucacccugacggccgccguccugaugcuaguggcacacuacgccaucaucgggcccggccugcaggccaaggccacccgugaggcucaaaagcggaccgcagcggggaucaugaaaaaccccaccguggacgguaucguggccauugacuuagaccccgucguguacgaugcgaaguucgagaagcagcucggucagaucaugcugcugauucucugcacgagccagauccugcucaugcgcacuaccugggccuugugcgaguccauaacccuggcgacggggccgcugaccacucuuugggagggaagccccgggaaauucuggaauacgacuaucgccgucuccauggccaauauauucaggggcagcuaccuggccggugcugggcuggcguucucccucaugaagucccugggcgggggcagacgggggaccggcgcccagggcgagacccugggggagaaguggaagcgccagcucaaccaacuguccaagcccgaguucaacaccuacaagcgguccggaauuauggagguagaccgcagcgaggccaaggaaggccugaagcggggggagacuaccaagcacgccguaucccgcgggacagccaagcuccggugguuugucgagcgcaaucuggugaagcccgaaggcaaggugaucgaccugggcugugguaggggcggcuggagcuacuacugcgccggucugaagaaggugaccgaggugaagggguacaccaagggcggcccggggcacgaggagcccauccccauggccacauacggauggaaccuugugaagcugcacuccgggaaggaugucuucuucaugcccccggagaaaugcgacacccugcucugcgauaucggcgagagcagccccaacccuaccauugaggagggacgcacccugcgggugcuuaagaugguggagcccuggcuccgcgggaaucaguucugcaucaagaucuuaaacccguacaugccgagcgucguggaaacacuagagcaaaugcaacggaagcacggcgggaugcucgugcgcaacccccugucccggaacagcacgcaugagauguacuggguguccuguggcaccgggaacaucgugagcgccgugaacaugacguccaggaugcugcucaaccgguucacgauggcccaccggaagcccacauaugagcgcgacguagaccugggggcgggcacccggcacgugaccguagaacccgaggucgccaaucuagacauaauuggccaacgcaucgagaacaucaaaaaugagcacaaaagcacguggcacuacgacgaggauaaccccuacaagaccugggcauaccacggcagcuacgaggugaagccgagcggguccgccagcuccaugguuaauggggucgugcgucuccugaccaagccgugggacgucauaccgauggugacccagaucgccaugaccgauaccacccccuucgggcagcagcgcguauucaaggagaaagucgacaccaggacaccccgagcgaagcggggcaccacccagaucauggaagugacagccaaguggcuguggggguuucucagccggaacaagaagccucggaucugcacgcgcgaggaguuuacccggaaggugcgcagcaacgccgccaucggcgccgucuucguggacgaaaaccaauggaacucagcgaaggaagccguugaggacgagcgguucugggaucucguccaccgcgagcgggagcugcacaagcagggcaagugcgcgaccugcguuuacaacaugaugggaaagcgcgagaagaagcucggcgaguucgggaaggccaaggguagccgggcaaucugguacauguggcugggcgcccgcuuccuggaguucgaggcccucgguuucaugaacgaagaccacugguucuccagagagaacagccuaagcgguguggagggggagggccugcacaagcucggguacauccugagggacaucagcaagauccccggcgggaacauguacgccgacgacaccgccgggugggacacgcgcaucacagaggaugaccugcagaacgaagcaaagaucaccgacaucauggaacccgagcacgcccucuuggccaccuccaucuucaaguuaaccuaccagaauaaagucgugcgggugcagcgccccgccaagaacggcaccgucauggacguaaucagccggcgcgaccagcguggguccggccaggucggcaccuacgggcucaacaccuucacgaacauggagguccaauugauccgucagauggagucagagggcauuuucuugccguccgaguuagagacgcccaaccuggccgagcgggugcuggauuggcucgagaagcacggggcggagcgcuugaaacggauggccaucucaggcgacgacugcguggucaagcccauagacgaccgcuucgccaccgcccugaccgccuugaacgacauggggaaggugcggaaggacaucccccaaugggagccauccaagggcuggaacgacuggcagcaggugcccuuuugcucacaccauuuccaccagcugaucaugaaagacggccgcgagaucgucgugcccugccggaaccaggaugagcuaguggggcgcgcgcgagucucccagggggccggguggagucuccgcgagaccgccugcuuaggcaaauccuaugcucagauguggcaacuaauguacuuccaccggcgagaccuacggcucgccgcgaacgccauauguagcgccgugcccguggauugggucccgacgucccggaccaccuggucgauccacgcccaccaccaguggaugaccaccgaggacaugcugagcguauggaacaggguguggaucgaggaaaacccguggauggaggauaaaacccacguguccagcugggaggagguacccuaccucgggaagcgggaggaccaguggugcggcaguuuaaucggccugaccgcccgugcgacgugggcaacgaacauacagguggccaucaaccagguccggcggcucaucgguaaugagaauuaccuggauuacaugaccagcaugaagcgguuuaagaacgagucugaucccgagggggcgcugugguga

SEQ ID NO: 23968 - RNA, 9879 nt, Artificial Sequence
  derived and/or modified CDS sequence (opt11) from DENV-1__KF973459__SS-prME
agcgugaccaugcugcucaugcugcugcccacggcccucgcguuccaccugacuacccggggaggggagccccacaugaucgugagcaagcaggaacggggcaaaucgcuccuguucaagaccagcgccgggguaaauaugugcacccugaucgccauggaccugggcgagcucugcgaagacacccugaccuacaagugcccccagauuaccgaggccgagcccgacgacguggacugcuggugcaaugccaccgacacguggguuaccuacgggaccugcucucagaccggcgagcaccggcgggauaagcgcuccguggcccuggcaccccacgugggccucgggcuggagacgcguaccgaaaccuggaugagcuccgagggcgccuggaagcagauccagcgcguggagaccugggcccugcggcaccccggguucacggucaucgcucucuuccuggcgcacgccaucggaaccuccaucacccagaaggggaucaucuucauccugcucaugcuggugacccccuccauggcaaugcgaugcgugggcauuggcaaucgggacuucguugaggggcuguccggcgcaacgugggucgacgucgugcucgagcacggcuccugcgugaccaccauggcaaagaauaagcccacccuugacauugagcugcugaagacggaagugaccaaucccgcgauccugcgcaagcugugcaucgaggccaagauaagcaacacaaccacggacucccguugcccgacccagggcgaggccaccuuaguagaggagcaggacgccaauuucgugugccgccggaccuuugucgaccgcggcugggggaacggcugcgggcuguucgguaagggaagccuacucacaugcgccaaguucaagugcgugaccaagcuggagggcaagaucguucaauacgagaaccugaaguacuccgugaucguuacagugcacaccggcgaccagcaccaggucgggaaugagacgaccgagcacggcaccaucgcgaccauuacgccgcaggcccccacgagcgagauccagcuaacugacuacggcgcccugacccuggauugcagcccccggaccggacucgacuucaacgagaugguccuacugacgaugaaggagaaguccuggcugguccacaagcagugguuccuggaccugccguugcccuggaccuccggggcgagcaccagccaggaaaccuggaaucgccaggaccugcuagugacguuuaagaccgcucacgcgaagaagcaggagguggucgugcucgggucccaggagggcgccaugcauaccgcccugaccggggccacggagauccagacaagcgguacgaccacgaucuucgccggacaccugaagugccggcucaaaauggacaagcugacccugaagggcacguccuacgugaugugcaccgggagcuucaagcuggagaaggaagucgcggagacgcaacacggcaccgugcucgugcaggucaaguacgaaggcaccgacgcccccugcaagauccccuucuccacccaggacgagaagggggugacacagaacggccgccugaucaccgcaaacccgaucgugaccgacaaggaaaagcccgucaacaucgagaccgagccuccuuucggggaaagcuacaucguggucggcgcuggcgagaaggcgcugaagcucuccugguuuaagaaaggcagcucgaucgguaagauguucgaggccacggcccgaggugcgcgccggauggccauacugggcgacacugcgugggacuucgggaguaucggcggagucuucaccuccguggggaaguuagugcaucaggucuucggcaccgccuaugggguccucuucagcggcguguccuggacgaugaagaucgggaucggcauccugcugacauggcucggccugaacagccgcaguacuagccucuccaugacaugcaucgccgucgggauggugacgcucuaccugggcgucauggugcaggccgacagcgggugcgugaucaacuggaagggucgcgagcugaagugcgguuccgggauauucgugaccaacgaaguccacaccuggaccgagcaguauaaguuccaagccgacagcccgaagcggcucagcgcggccaucgggaaagccugggaggaggggguguguggcauucggucugccacccggcuggagaacaucauguggaagcagaucagcaacgagcugaaccauauccuccuggagaacgacaugaaauucacuguggucgugggcgacgccaacggcauucuggcccaggguaagaagaugauccguccccagcccauggagcacaaguacuccuggaagucuuggggcaaggccaagaucaucggcgccgauauccagaauacuacguucaucaucgacgggcccgauaccccggagugcccggacaaccaacgagccuggaacaucugggagguggaggacuacggcuucgguaucuucaccacgaacauuuggcucaagcugcgcgacuccuacacacaggugugugaccaccgacucaugagcgcugccauaaaggacagcaaggccgugcacgccgacaugggcuauuggaucgagagcgagaaaaacgagaccuggaagcucgcccgcgcuuccuucaucgaggugaagacgugcaccuggcccaagagccacacccugugguccaacggcguccuggaaagcgagaugaucauucccaagaucuacgggggcccgaucucccagcacaacuacagacccggguauuuuacccagacggccggccccuggcaccucggcaagcuggaacuggacuucgaccucugcgaggguaccaccguggucgucgacgagcacugcggaaaucgcgggccgagccugcggaccacgaccgugaccggcaagaucauccacgaauggugcugucgcuccugcacccugccgcccuuacgguuccgcggugaggacggaugcugguaugggauggagauccggcccgugaaggagaaggaggagaaccugguccgcagcaugguauccgccggcagcggcgagguggacagccuguccuuagggauacugugcgccagcaucaugauagaggaggugaugcggucccguuggagccggaagaugcugaugacgggcacgcucgccguguuccuccugcucaucaugggacagcugaccuggaacgaucugauccgccucugcaucaugguaggagccaacgccucggaccgcauggggaugggcaccacguaccuggcccugauggccaccuucaagaugcggccgauguucgcugucggccuccuguuccgccggcugaccagcagagaggugcuccuucugacgauugggcucucgcucgucgcgagcgucgagcugcccaacucccucgaagaguuaggcgacgggcuggccaugggcaucaugaugcucaagcugcugacggaguuccagccccaccaauuguggaccacccugcugucucucaccuucaucaagacgacucugucccuggacuacgccuggaaaaccacggccauggcgcucagcaucaucagccuguucccccugugucucagcacgaccagucagaagacuaccugguugccggugcugcucggcagcuucgggugcaagccccugaccauguuccugaucacagagaacaagaucuggggccggaagucguggcccuuaaaugaagggaucauggccaucggcaucgucagcauacugcuguccagccugcugaagaacgacgugccccuggccgggcccuuaaucgcuggcgguaugcugaucgccugcuacguuaucucgggguccagcgcggaccugucacucgagaaggcggccgaggucagcugggagcaggaggccgagcacucugggacgagccacaacauccugguggaggugcaggacgacgggaccaugaagaucaaggacgaggagcgcgacgacacccugacgauccuccucaaggccaccuuacucgcggucuccggcguguauccgaugagcauccccgccacccuguucgugugguacuucuggcagaagaaaaagcagcgguccgggguccugugggacacccccaguccacccgagguagagcgcgccgugcuggacgauggcaucuaccggauacuccagcgcggacugcuggggcggucccaagucggcgugggggucuuucaggacggcguuuuccauacgauguggcacgugacccgcggggccguacucauguaccagggcaaacggcuggagcccagcugggccuccgucaagaaagacuugaucagcuacggcggcggguggagauuccagggguccuggaacaccggggaggagguacaggugaucgcagucgaacccgggaagaacccgaagaacgugcagaccacgcccggcaccuucaagacccccgagggcgaggugggggccaucgcccucgacuuuaagcccgguacaagcgguuccccgaucgucaaccgggaaggcaagaucgugggccuguacgggaauggcguggucacgacuagcgggaccuauguguccgccaucgcccaggcgaaggugagccaggagggcccccugcccgagaucgaggaugaggucuuuaagaaacgcaaccucacgaucauggaccugcacccagggagcggcaagacgagacgcuaccuucccgccauagugcgggaggccaucaagagaaagcuccggacccugauccuggcccccacucgcguggucgcguccgagauggccgaggcccucaaggguaugcccaucagauaccagaccacggccgucaagagcgagcacaccgguagggagaucguggaccugaugugccacgccaccuucaccaugcgccugcucuccccgguccgggugcccaacuacaacaugaucaucauggacgaggcgcacuucaccgaccccgccagcauugccgcccgcggcuacaucuccacccgggugggcaugggcgaggccgcggccaucuucaugaccgccacgccgccagggagcgucgaggccuucccccaaucgaacgccgugauacaggacgaggagcgcgacauccccgagcggagcuggaacuccggguacgauuggaucacggacuuccccggcaagaccgugugguucguccccagcaucaaguccggaaacgacaucgcgaauugcuugcgcaagaacggcaagcggguaauacagcugagccgcaagaccuucgauaccgaguaccagaagacgaaaaacaacgacugggacuacguagucaccaccgacaucuccgagaugggggccaacuuccgugccgaccgcguuaucgacccccggcgaugccucaagcccgugaucuuaaaggauggcccggagcgggucauccuggccgggccgaugcccguuaccguggcgucagccgcccagcgcaggggccgcaucggccggaaucagaauaaggagggggaccaauacgucuacaugggccagccccucaacaacgacgaggaccacgcccacuggacggaggccaagaugcuguuagacaacauaaacacccccgagggaaucaucccggcccucuucgagcccgagcgcgaaaagagcgcggccaucgacggcgaguacaggcugcguggggaggcccgcaagaccuucguagaguuaaugcggcgcggcgaccuccccgucuggcugagcuacaaaguggccagcgagggcuuccaguauagugaccggcguuggugcuucgauggggaacggaacaaccagguacuggaagagaacauggauguagagaucuggaccaaggagggcgagcguaagaagcuccggccccguuggcuggacgcgcggaccuacuccgauccgcuagcccugcgcgaauuuaaggaguucgccgccggucggcgcucggugagcggcgaccugauccuggagaucggcaagcucccccagcaccugacgcugcgggcccagaacgcgcucgacaaucuggugaugcugcacaacuccgagcagggagggaaggccuacaggcacgcgauggaagaacuccccgacaccaucgagacccuaaugcuguuagcccugaucgcgguccugaccgggggcgugacccuuuucuuccuguccgggaaaggccugggcaagaccuccaucgggcuacugugcgugaccgcuagcuccgcucugcucuggauggccagcguggagccccauuggaucgccgcguccaucauccuugaguucuuucugauggugcuccugaucccugagcccgaccggcagcgcacgccgcaggacaaccagcuugccuacguggucaucggccuccuauucaugauccugacgguggccgccaacgaaaugggacucuuagagaccacuaagaaagaccugggcaucgggcacguggccgcggagaaccaccagcacgccaccaugcucgacgucgaccugcggccggccagcgcguggacgcuguacgccguggcgaccaccgugaucacccccaugaugcgccacacgaucgagaacaccacagccaacaucagcuuaaccgccaucgccaaccaggccgcaauacugaugggccuggacaaggguuggcccaucagcaagauggacaucggagucccccuucuggcccuggggugcuacucccaggugaacccccugacgcucaccgccgccgugcugaugcucgucgcccacuacgcuaucaucgggcccggccuacaggcaaaggccacccgggaggcccagaagaggaccgcggccgggauaaugaagaaccccacgguagacggcaucguggccaucgaccuggaucccgucguguacgacaccaaguucgagaagcagcucggccagaucaugcugcugauccucuguaccucucagauccugcugaugcgcacaacaugggcccucugcgaguccaucacccuggccaccgguccgcugaccacgcucugggagggcuccccugggaaguucuggaauaccaccaucgcgguuuccauggccaacaucuuccggggcagcuacuuggccggcgccgggcuggccuucucccucaugaagucccuaggagggggccgccgggggaccggcgcgcagggcgagacgcugggagagaaguggaagagacagcucaaccagcugucuaagagcgaguucaacaucuauaaacggagcgguaucauggaggucgaccgcagcgaggcgaaagaggggcugaagcgaggcgagaccaccaagcacgccguuucucgcgggaccgccaagcugaggugguucguggagcgcaaccucgucaagcccgagggcaagguuaucgaccugggaugugggagagggggcugguccuauuacugcgcgggccugaagaaggugaccgaaguaaagggguacacgaagggcggcccaggacacgaggaaccgauccccauggccaccuacggcuggaaccucgucaagcugcacagcgggaaggacguauucuucaugccgcccgagaagugcgacacccugcucugcgacaucggcgaguccagcccuaaccccaccaucgaggaggggcguacguugcggguacucaagaugguggagcccuggcuccgcggcaaccaguucugcaucaagauccugaaccccuacaugccguccguggucgaaacccuggagcagaugcagcggaaguacggcgggaugcucgugcgcaacccccucagcagaaauuccacccacgagauguacugggugagcugcggcaccgggaacauuguguccgccgugaacaugacgagccgcaugcugcucaaccgguucaccauggcccaccgcaagcccaccuacgagcgugacgucgaccugggggccggcacccggcacgucgcgguugagcccgagguggccaaccuggacaucauuggacagcgcaucgagaacaucaagaacgagcacaaguccacguggcacuacgacgaagacaacccguacaagacaugggccuaccacggaagcuacgaggucaagccuuccgggagcgccuccagcauggugaauggugugguccggcuccugaccaagcccugggacgugauccccauggucacccagaucgcuaugacggacacuaccccauucgggcagcagcgcguguucaaagagaaggucgacacccggacgccccgcgcaaaacggggcaccacccagauaauggaggucacugcaaaguggcuguggggcuuccucucccgcaacaagaaaccccggaucugcacccgcgaggaguucacccgaaaggugcgaagcaacgccgccaucggggccguguucguggaugagaaccaguggaacucggcgaaggaggccgucgaggacgagcgguucugggaccugguucacagagagcgagaacugcacaagcagggcaagugcgcgaccugcgucuauaacaugauggggaagcgcgagaagaagcucggcgaguucggcaaggccaagggcucccgggcgaucugguacauguggcugggcgcccgcuuccuggaguucgaggccuuaggguucaugaaugaggaucacugguucagcagagaaaacagccugagcggaguggagggggagggccugcacaagcucggguacauucugcgcgacaucuccaaaauccccggcggcaacauguacgccgacgacaccgccgggugggacacgcggaucaccgaggacgacuugcagaacgaggcgaagaucaccgacauaauggagcccgagcacgcacuccuggccacgagcauuuucaaacugaccuaccagaacaaagucguccgcgugcagcgccccgcuaagaacggaacagugauggaugucaucucccggcgcgaccagcgggggucuggccaggugggcaccuacgggcucaacaccuucacgaacauggaggugcagcuaauccgccagauggaguccgagggcaucuuccugcccucggagcucgagaccccgaaccuggcaaagcggguccuggacuggcuggagaaacacggcgcggagcgacuaaagcggauggccaucuccggcgacgacugcguggugaagcccaucgaugaucgcuucgccaccgcacugaccgcccucaaugacauggggaagguucggaaggacaucccccagugggagcccagcaagggcuggaacgacuggcaacaggugccguucugcucccaccauuuccaccagcugaucaugaaggacggucgcgagaucguggucccgugccggaaccaggacgagcucguggggcgcgcgcgggugagccagggugccggguggucgcuccgcgaaaccgcgugcuuaggcaagagcuacgcccagauguggcagcuuauguacuuccaccgucgggaccuccgccuggcugcuaacgcuauuugcuccgccguccccguagacugggugcccacgagccgcaccacuuggagcauccacgcccaccaccaguggaugaccacggaggacaugcuguccguauggaaccggguguggaucgaggagaaccccuggauggaggacaagacccacgugagcucaugggaggagguccccuaccucgggaagcgcgaggaccaguggugcggcagccugaucggccugaccgcacgcgccaccugggccaccaacauccagguggccaucaaccagguucggcgucucaucggcaaugagaacuacuuagacuacaugaccagcaugaagcgguucaagaacgagagcgaccccgagggcgcucugugguga

SEQ ID NO: 23969 - RNA, 9879 nt, Artificial Sequence
  derived and/or modified CDS sequence (opt11) from DENV-1__KF973460__SS-prME
ucaguaaccaugcuacuaaugcuacuccccacggcucuagcauuccaccucacaacaagagggggagaaccccacaugauuguaucgaagcacgaacgagggaaaucgcuucucuuuaaaacaucaacaggaguaaauauguguacccuaauagcuauggaccuaggcgagcucugcgaagacacgaugacauacaagugcccgcgaauuacggaagcagaaccggacgacgucgauugcuggugcaaugccacugauacuugggugaccuacggaaccuguagccaaaccggggaacacagacgggacaaacgaucgguagcccucgccccacaugugggccucggauuggaaacgagaacggaaaccuggaugucauccgaaggggcuuggaaacaaauacaacgggucgagacaugggcacuaaggcaccccggguucaccguaauagcccuguuuuuagcacaugcaaucgggacaaguauaacccaaaagggaaucauauucauacucuuaauguuagucacacccagcauggcaaugcguugcguuggaauaggaaacagagauuucgucgagggacucagcggcgcuacgugggucgacguugugcuagaacacggcucaugugucacgaccauggccaaaaacaagccgacgcucgacauagagcuacucaaaacagagguaaccaauccagcagucuuaaggaagcucugcauagaggcaaagauuaguaacacuaccacggacucgaggugccccacucaaggggaagcgacccuaguagaagaacaagaugccaauuucgucugcaggcgcacccuugucgaucggggauggggcaacggauguggccuauuuggcaagggcucacuacuaaccugcgcuaaauucaaaugcgucacaaagcucgaaggcaaaaucguccaguacgaaaaccucaaguacuccguuauaguaaccguccauacaggagaccaacaccaaguggguaacgaaacgacugaacauggaaccauugcuacaaucacaccacaggcccccacguccgaaauucaacucacugacuacggcgcgcucgcgcuagacuguucaccccgcaccggccuggacuucaaugaaaugguucuccucaccaugaaggaaaaaucauggcucguccacaaacaaugguuccuagaccuaccucugccguggaccagcggggccucaacgucccaagaaacuuggaacagacaagacuugcucguuacguucaaaaccgcgcacgcgaagaagcaagaaguagucgugcuaggaagucaggaaggagcaaugcacacagcccuaaccggagccacagagauacagacaagcggcacaacaaccaucuucgcgggacaucucaaauguagacugaagauggacaagcuaacccucaaagguacaucguacguaauguguacgggauccuucaagcucgaaaaggaagucgcugagacacaacaugggacgguccuaguucagguuaaguacgagggaaccgacgcgccaugcaaaauaccauucagcacucaggacgaaaaaggcgucacgcaaaacgguagacucaucacagcgaaccccaucgugacggacaaagagaaaccaguaaacaucgaaacggagccacccuucggcgaaucuuacauaguggucggagcuggagaaaaagccuugaagcuaucuugguucaagaagggcucaagcaucgggaagauguucgaagcgacggcgcguggagcaagacgaauggcuauccucggugacaccgccugggauuuugggagcaucggaggcguguuuacaaguguugggaaacucguccaccaaguauucgggacugccuacgggguacucuucaguggcgugucguggacgaugaagauaggaaucggaauauuacugacguggcuggggcugaacagccguuccacaucccucuccaugaccugcaucgcugucggcauggucacccuguaucugggaguaaugguacaagccgacagcggcugugucauuaacuggaaagggcgcgaacugaagugcgguucugggauuuuugucacgaaugaaguccacacguggacggagcaauacaaauuucaggcagacuccccgaaacgacucagcgcagcgauaggcaaggcaugggaagaaggagucugcggcauacgcagcgccacuagacuggaaaacauaauguggaaacagaucucaaacgagcugaaccacauccugcuugaaaacgauaugaaauuuaccguaguaguaggcgacgcaaaugguauauuagcccagggcaagaaaaugauccgcccacagccaauggagcacaaauacaguuggaaaucauggggaaaagcgaaaauuaucggcgccgacauccaaaacacaacauucauaaucgauggccccgacacccccgaaugucccgacgaccaacgagcauggaauauaugggagguggaagacuacggauucggcauauucacgaccaacauuuggcuaaaacuaagggacagcuacacacagaugugugaccacagacucaugucggccgccauaaaggacucuaaagcaguucacgcggacaugggauacuggaucgaaucagagaaaaacgaaacauggaagcuagcuagggcaucguucaucgagguaaagacuugcacauggcccaaaucacacacguuauggucgaacggcguauuggaaagcgagaugauaauuccgaaaauauacggggguccuauaucacaacacaacuaucguccaggguacuuuacgcagacggcaggccccuggcaucucggaaagcuagagcuagauuuugacuugugugagggaacaacgguggucguagacgagcauugugggaacagggggccuucguuaaggacaacgacgguaacaggaaagauaauacacgaaugguguuguagaagcuguacccugccaccccugcgcuucagaggagaagacggcugcugguauggcauggagaucagacccgugaaggaaaaggaggagaaucuaguccgcucgauggucagcgcgggcucaggcgaaguagacucucuaagccuaggaauccuaugcgugaguauaaugaucgaagaagucaugcgcagucguuggucgaggaagaugcucaugaccgggacuuuagccgucuuccuccuacugaucaugggacaacucacguggaacgaccuuauacggcuguguauuaugguaggcgcaaacgccucagacagaaugggaauggguacaacguaccuggcucugauggcgacauucaagcuaaggcccauguucgcgguaggcauccuguuccgacgcuuaaccucuagagaaguacuccucuugacgauaggccuaagccuggucgcgucaguggaacuccccaauagccuggaggagcucggugacgggcucgcgaugggcauaaugauguuaaaacuccuuacugaguuccaaccacaccaacuauggacaacgcuccuaagccugaccuuuaucaaaacgacucucagucuggacuacgcguggaagacaacagcaauggccuuaagcauuguaucccuauuuccucugugccugagcaccaccagccagaagaccacauggcugccgguacuguuggguagcuuugguugcaagccccucacaauguacuucaucaccgagaauaaaaucuggggccguaagagcuggcccauuaacgaggggaucauggccauaggaauugucucaauucucuuaaguucauuguugaagaacgacguaccccuugccggcccacugauagcaggcggcaugcuuauagcguguuacguaaucaguggaagcucagcugauuuaagccuagagaaggcagccgaaguuagcugggagcaagaagcagagcacucagggaccagccacaauauucucguagaaguucaagaugacggcacuaugcgaauaaaagacgaggaaaaagacgacacgcucaccauucuauugaaggccacauuguuagcggucucaggaguauauccaaugucaauccccgcaaccuuauucguaugguacuucuggcaaaagaagaagcagcguagcggaguauuaugggacacuccgucacccccagaagucgaacgcgcaguacucgaugacggaaucuacaggaucuuacagagagggcuacugggccgcagccaagucggcguggggguguuccaggauggcgucuuccacaccauguggcacgugacacgcggcgcaguccugauguaccaaggcaagcgacuggaacccuccugggcgagcguaaagaaagaccucauuagcuacggaggcggguggcgauuucaaggcucauggaacacaggagaggaagugcaaguaauagccguagaacccgggaaaaaucccaaaaacguucagacuacaccaggcacauuuaaaacaccagaaggugaaguaggcgcuaucgcgcuugauuuuaaacccggaaccuccgggagcccaauagugaaucgagaaggcaaaauaguugggcuauacggaaacgggguuguaaccacaucuggaaccuacgugagugcaauagcgcaagccaaggccagccaagagggcccccugccagagaucgaagaugaaguuuucaagaagaggaaucugacaaucauggaucuccaucccgggucugguaaaacgcgccgcuacuugccugcaauuguacgagaggcgauaaaacgcaagcuccguacgcucaucuuagccccaacuagagugguagccagcgagauggccgaagcccuaaaggggaugccaauacgauaccaaaccacggccgucaaaagcgaacauacgggacgagaaauaguugauuuaaugugccacgcuacauuuaccaugagacuacuaucgcccgucagggucccgaauuauaauaugauuauaauggaugaagcccacuucacagaccccgccucaaucgcagcccggggauauaucaguacaagaguuggaaugggugaagcggcagccauuuucaugaccgcaacaccgcccgguuccguggaagccuucccccaauccaacgccgucauccaagaugaggaaagagacauaccagagagaucguggaacagcggauacgauuggaucacagacuuuccaggaaaaacggucugguucguucccucuauuaagagcggaaaugacaucgcgaauugccuccggaagaacggaaagcggguaauccagcugagccgaaagacauuugacaccgaauaccagaaaaccaaaaacaaugacugggacuaugucgucacgacggacaucagcgagaugggugcaaacuuccgcgcagaccgaguaaucgacccacggcggugccucaaacccgugauacuaaaagacggaccagagcgaguaauccucgcaggcccaaugcccgugacgguugcaagugcugcucagcgacgaggacgaauaggcaggaaccaaaacaaagaaggagaccaauacgucuacaugggacaaccgcucaacaacgacgaggaccaugcgcacuggaccgaagcaaaaaugcuccuugauaacauuaauacgccagaaggcauuauaccagcguuauucgaaccagagcgcgagaaaucggcugcgauagacggggaauaccgucugcggggagaagcgcgcaaaaccuucgucgagcuaaugcguaggggcgaccugccaguguggcuaagcuacaaaguagcgucggaaggcuuccaauacucggacagacgcuggugcuucgacggcgagcguaauaaucaaguucucgaggaaaacauggacguagaaauauggacaaaggagggagagcggaagaaacugcgcccaagaugguuggacgcacguacauacucugacccucucgcauugagagaguucaaggaauuugcagcugggcgaagguccguauccggagaucugauacuagagauagggaaacugccacaacauuuaacccugagggcacagaaugcacuggacaaccucguuaugcuacacaacucagaacaaggagggaaggccuacagacaugccauggaagaacugccagauacuauagaaaccuuaaugcuucuggcuuugaucgccguucugaccgggggagucacgcuauuuuucuuaagcggaaaagggcugggcaaaaccuccaucggauuacuaugcgugaccgcgucauccgcacuccuguggauggcuagcguagaaccacauuggauugcugcaagcauaauccuggaguucuuucucaugguuuuacugaucccggaacccgacaggcagaggacgccucaagacaaccaauuagcguacguggucaucggacuacucuucaugauccucacaguagcagcaaaugaaaugggucugcuagaaacgaccaagcgagaucuggggauagggcacguagcagcugagaaccaucagcacgcuacuaugcuagacguagaucugaggccggcuucagccuggacgcuguacgcaguugcaaccacuguaauaaccccaaugaugagacacaccaucgagaacacgaccgcgaacauaagccucacggcuauagcaaaccaggcagccauccucaugggguuagacaaaggauggccgauauccaaaauggauauuggagugccccuccuagcgcuggguugcuacagccagguaaauccccuaacccugacagccgcuguacucaugcuaguugcacauuacgcuaucaucggaccgggccuacaagcaaaagcaacaagagaagcccagaaaagaaccgccgcagggauuaugaagaaccccacaguggacgguauaguagccauagaucuagacccgguaguguaugacgccaaauuugaaaagcaacuaggccagaucaugcuucuaauccucuguaucucucaaauccuacuuaugcgaaccacaugggcgcugugcgaaucgauaacauuagccacagggccccugaccacccugugggaggggucuccugggaaauucuggaacacgacaaucgcagucagcauggcaaacaucuuccgcggguccuaccuagcaggggccgggcuggccuucagccugaugaaaucccucggcggcggacguagagguacuggggcccaaggagaaacauuaggagaaaaguggaagcgccagcucaaccagcuuuccaagccagaguucaacacguauaaaagaucgggaaucauggaaguagaccgcucggaggcaaaggagggucuaaaaaggggugagacaaccaagcacgcagucucgcggggaaccgcaaaauuacgaugguucguggaacgaaaccucgugaagccugaggggaaaguaauagacuuaggcugcggaagaggaggcuggucguacuacugcgcugggcucaagaagguuacggaagucaagggauacacgaaagggggacccggccacgaggagccgauuccaauggccacauacggauggaauuuaguaaaacuacacucaggcaaagacguauucuucaugccacccgagaagugcgacacucuccuaugcgacauaggggaaagcuccccaaaccccacgaucgaggaagggcguacgcucaggguacuaaagaugguagagccguggcugcgaggaaaccaauucugcaucaaaauccuuaacccauauaugcccuccguagucgagacccuggaacaaaugcagaggaaacacgggggaaugcuagugcgcaaccccuugucccgcaacagcacgcacgagauguacuggguauccugcgggacgggcaacauaguaagcgccgugaacaugacaucccggauguuacuaaaccgcuucaccauggcgcaccggaagccuaccuacgaacgcgacguagaccuaggggccgggacccgccacguagccguagaaccagaagucgcgaaccuagacauaaucggccaacgcaucgaaaacaucaaaaaugaacacaagucaaccuggcacuacgaugaagacaacccguauaaaaccugggcuuaucacggaagcuacgaaguuaaaccuuccggcucagcaucaagcauggugaauggcguaguacgccuacuaacaaagcccugggacgugauaccaauggucacacagaucgcgaugacagacacuacuccuuucggccagcagagaguauucaaagagaaaguagacacacgcaccccucgugcaaagagaggcaccacacagauaauggaggucacggccaaguggcucuggggauuccuuuccagaaacaagaaaccccgaauaugcacuagagaagaguucacacgaaaaguaaggucaaacgcugccauaggcgcaguguucgucgaugagaaucaauggaacucagcuaaagaagcggucgaagacgaacgauuuugggaucucguccaccgggagagagaguuacacaaacaaggaaagugcgccacaugugucuacaacaugaugggcaaaagagagaagaaacuaggagaguucgggaaggcuaaagguucucgcgcaauuugguacauguggcucggcgcgagauuccuagaguuugaagcacugggauuuaugaacgaagaccacugguucagccgcgagaacagcuugagcggaguagagggagagggccugcacaaauugggguacauauuaagagauauaucaaagauaccuggagggaacauguacgcggaugacacagccggcugggacacgcgcaucaccgaagacgaucuacagaaugaagccaaaauaaccgacauaauggagcccgaacacgcccucuuagcaacgaguaucuuuaagcugacguaccaaaacaagguuguaaggguccaacgcccagcgaaaaacggaacugucauggacguaaucucucgacgcgaccaacgcggaucuggucaaguagggaccuacggcuugaacacauucacgaauauggagguacaacucauccgccaaauggagagcgaaggaauuuuccugcccagcgagcuggaaaccccaaaccuggcagaaagggucuuagacuggcuggagaagcacggcgcggaaaggcuaaagcgcauggcaauaucgggggacgauuguguagucaaacccaucgacgaucgcuucgcaacagcacuaacagcgcucaaugacaugggaaaaguacggaaagauauaccgcaaugggaaccgagcaaaggcuggaacgacuggcagcaagugccauucugcucucaucacuuccaucagcugauuaugaaagacggacgcgaaaucguagucccgugccgaaaucaagacgagcuaguaggccgcgcacgugucucccagggcgccggauggucacuacgcgagacagccugccugggaaaauccuaugcacaaauguggcagcuaauguauuuccaccgacgagaccugcguuuagcagccaaugcaauuugcuccgccguacccguagacugggugcccacgucaagaacaacuuggucaauucaugcacaccaccaauggaugacaacggaagacaugcucagcguguggaaccgcguauggaucgaggagaacccuuggauggaagacaagacccaugucucgagcugggaagaaguuccauacuuaggaaagcgcgaagaccaauggugcgggagccuaaucggacugaccgccagagcgacaugggcuacgaacauacaagucgcaaucaaucaagugcgaagacugaucggaaacgaaagcuaccuugacuauaugacgucgaugaaaagauuuaaaaacgagucagacccugaaggagcacugugguag

SEQ ID NO: 23970 - RNA, 9879 nt, Artificial Sequence
  derived and/or modified CDS sequence (opt11) from DENV-1__KF973461__SS-prME
agcgugacaaugcuauuaaugcuccuccccaccgcucucgcauuccaccucacuacgcggggaggcgaaccgcacaugaucgugagcaaacaagaaagggggaaaucacuacuauucaaaaccucagcuggcguuaacaugugcacacugaucgcgauggacuugggcgaacucugcgaagauacaaugacauacaagugcccccaaauaacagaggcggagccggaugacgucgacuguugguguaacgcgaccgacaccugggucacguacgggaccuguucccaaacaggcgagcaccgccgggacaagcgaucaguggcacucgccccgcacguaggccucgguuuggagacccguacagaaacuuggauguccucggaaggagcauggaaacaaauucaaagaguagaaaccugggcacuaaggcacccaggguuuacagugauagcauuguuccucgcucaugcaauaggaacauccauaacucagaaagggauaauauucauacuacucaugcucguaacaccgucaauggcuaugcgaugcgucgggauaggcaaccgggacuuuguagagggucuguccggagcgaccuggguugauguaguauuagaacauggaucgugcguaacgacgauggcuaaaaacaagcccacacuggacaucgaacuacuuaaaacagagguaaccaaucccgcaauucuuaggaaacugugcauugaggccaaaaucagcaacacgacaacagauucgcgcugcccaacacaaggcgaagcaacccuggucgaagaacaagacgccaauuucgucugcagacgaacguucguugaccgaggauggggcaacggguguggccuuuucggaaagggaucacugcuaacgugcgcgaaauucaaaugcgucacaaaacuggaaggaaagaucgugcaauaugaaaacuugaaguacuccguaaucgucacgguacacacaggcgaucagcaccagguaggaaacgagacuaccgaacacggaacaauagcaaccauuacaccacaagcuccaacuucggagauucaacuaacugacuacggcgccuugacccucgacugcuccccucgaacaggccuagacuuuaacgagaugguguuacuuaccaugaaagaaaaauccuggcuuguacacaaacagugguuccucgaccucccccugccguggacaagcggagcaagcaccucgcaagaaaccuggaaccggcaagaucuguuaguaaccuucaaaacagcccacgccaaaaagcaagaaguagucguacuagguucacaagaaggggcgaugcacacggcacucaccggggcgaccgaaauccagacaucaggcacgacaacaauauuugccggacaccugaaaugcaggcuaaaaauggacaaacucacauugaagggaacguccuaugucaugugcacuggaucauucaaacuggaaaaagaaguugcagaaacucagcacggaacuguacucgugcagguuaaauacgaagguaccgacgccccuugcaaaauuccauuuucaacacaggacgaaaagggcgucacacaaaacgggagacugauaacggccaaccccaucgucaccgacaaagaaaaaccgguaaauauagagacagaaccacccuucggagaaagcuauaucguagucggggccggggaaaaagcgcucaagcuauccugguuuaagaaaggaucuucaaucgggaaaauguuugaagcgacagcucgcggcgccaggaggauggcaauccuaggggauacagccugggacuucggcagcaugggcgguguauuuaccuccguuggcaaacugguccaccaagucuuugggaccgcauacgguguacucuucagcggcguaagcuggacaaugaagaucgggaucggcauccuccugaccugguuagggcuaaacucgcgauccaccucccuaaguaugacaugcauugcagucggaaugguaacccuauauuugggcgucaugguacaagcagauucgggaugcgugauaaacuggaaaggaagagagcuaaaauguggcaguggcauauuugucaccaacgaagugcacacguggacggaacaauacaaauuccaagcggacucccccaagagguuguccgcagcaaucgguaaggccugggaagaagggguaugcggcauccgcagcgcgacccgacucgagaacaucauguggaagcagauuucgaaugaacuaaaccacauccucuuggagaacgacaugaaauuuaccguaguggucggcgacgccaacgggauuuuggcucaaggcaaaaagaugaucagaccccaacccauggaacacaaauauucguggaaaagcuggggcaaggccaaaauaauaggagcggauauccagaacacuacuuucaucaucgauggucccgacacccccgaauguccagauaaccaaagagcguggaauauaugggaagucgaagacuacggcuuuggaauauuuacaaccaacaucuggcucaaauugcgggacaguuauacacaaaugugcgaccauaggcugaugagugcugccaucaaagauuccaaggcaguccacgcagacaugggcuacuggauugagucagagaaaaaugaaacuuggaaauuggcccgugcauccuucauugaagucaagacuugcacguggccaaagagccauacccuauggaguaacggcguccuagagagcgaaaugauaauaccgaaaaucuacggcggccccauaucacagcauaacuauagacccggcuacuucacacaaacugcaggacccuggcaucucgggaagcuagaacuagacuuugagcuaugcgaaggcacuacugucguuguagacgagcauuguggcaauagaggucccucucuaagaacuaccacagucacggggaaaaucauacacgaaugguguugccgaucaugcacacucccaccacuaagauuccgcggggaggacgguugcugguacggcauggagauacgaccagugaaagaaaaggaggaaaaccugguacgcaguauggucucggcaggaucgggggaagucgauucauucagucuggggauacucugugccagcaucaugauagaagaaguaaugcggaguagguggagccgaaaaauguuaaugaccggaacuuuagcaguguuucuacugcucaucaugggccagcugacauggaacgaccuuaucagauugugcaucaugguaggggcaaacgcaagugacaggaugggaaugggaacaaccuacuuggcccuaauggccacguucaagaugcgcccgauguucgcggucggacuacuguuuagacggcuaaccucgcgcgaaguacuuuuacuaacaaucggccugucuuugguagccaguguggaacuacccaacucacuggaggaacuaggcgauggccuggcaauggggaucaugauguuaaagcuguuaaccgaguuccaaccacaucaacuguggaccacgcuccucagucuaacguuuauaaaaacaacccuaagccuagacuacgcauggaaaauuaccgcaauggcacuauccauaauaucacucuucccccucugccuauccacaacuagccaaaagacaaccuggcuuccaguccuacucggcagcuucggauguaaaccacuaaccauguuucucauuaccgagaacaaaauauggggaagaaagucuuggccgcugaacgaaggcaucauggccauaggcaucgucuccauucugcuaucaucacuccucaagaacgauguccccuuagcggggccgcugauugccggaggaaugcugauagcguguuauguaauauccggguccucagccgaccugagccucgagaaggcugcggagguuucgugggagcaggaggcggagcacuccggcacaucgcacaacauccuaguugaaguacaagacgacgguacaaugaagauaaaagacgaagaaagagaugacacguuaacaauccuacuaaaggcaacacuccucgcaguuagcggcguauacccaaugucaauaccggcaacccuauucguaugguacuucuggcaaaagaagaaacaacgaucaggcgugcucugggacacaccgagcccgcccgaaguagaaagagcggugcucgacgacggcauauaccgcauccuacaaagaggucuccuugggagaucgcaaguaggaguaggagucuuucaggacgguguauuccacacuauguggcaugugacaagaggcgcgguccuuauguaccaggggaagagacucgagcccucuugggccucagugaagaaagaccuaaucagcuacggagggggauggcgauuccaagggagcuggaauacaggggaggaaguccaggucaucgccguggaacccggcaaaaaccccaaaaauguccaaacuacuccagggacguucaaaacaccagagggugaggucggggccauagcgcuugacuucaaaccuggaacguccggcucccccaucgucaaccgagaagggaaaaucgugggacuuuaugggaacggcgugguaacuacaucaggaacauacguaagcgcaaucgcacaagcaaaagcgagccaggaaggcccucuuccggagauagaagacgagguuuuuaagaaaaggaaccucacaauaauggaccuacacccaggaagcggaaagacacggcgcuacuugccagcuaucguacgggaggcaauaaagcggaaguugagaaccuugauacuugcgccgacccguguagucgcaucagaaauggcagaagcucuaaaagguaugccgauacgauaccagacaaccgcaguaaagagugagcacaccggccgcgaaaucgucgaccucaugugccacgcuacuuucacgaugcgccucuuauccccgguucgcguuccgaacuacaacaugaucauaauggacgaagcacacuucacagacccagcaagcaucgcagcgcgggguuacauuuccacacgcguaggaaugggagaagcagcagcgauauucaugacggcaacgccuccgggaucggucgaagcauuuccccagaguaacgcgguaauacaagacgaggagcgugacaucccagagcgcuccuggaacagcggcuacgacuggaucacggacuucccuggcaagaccgugugguucguccccucaauaaaaagcgggaacgacauagccaacugccugagaaagaacggaaaacgaguaauccagcuaagcaggaaaaccuuugauaccgaauaccagaaaacaaagaacaacgacugggacuacguggugacaaccgacauaucagaaaugggagccaacuuccgggcagacagaguaaucgacccgcgucggugucuaaaaccgguuauacugaaagacggccccgagcgaguaauuuuggcggggccaaugcccgucaccguagcaagugcagcgcaaaggcgaggccgaaucgggaggaaccagaacaaagaaggagaccaguacguguacaugggccagccccuaaauaacgaugaagaccacgcgcacuggacugaggccaagaugcuauuggacaacaucaauacaccggagggaauaaucccugcucuauucgagccagaaagagagaaaagcgcagcgaucgacggagaguaccgacuccguggggaagcccgcaagacauucguggaacugaugcgucgaggugaccuccccguguggcugagcuauaaagucgcauccgagggcuuccaauacucugacagaagguggugcuuugauggagaacggaacaaucaaguacuggaggagaauauggauguagagauuuggacgaaagaaggcgagcgaaagaaacugagaccgcgauggcuagacgcccggacauacagcgacccccucgcccuccgagaauuuaaagaguucgcugcgggcaggcgaagcguguccggcgaccuuauccuugaaaucggaaaauuaccgcagcaucucacgcugcgcgcgcaaaaugcgcuggacaaccuggucaugcuacauaauucggaacaaggaggaaaagccuaucgccaugcaauggaagaacuaccagacacuauugagaccuugaugcucuuggcccugauugcugugcucaccgguggaguaacgcuguuuuuccugagcgggaaggggcugggaaaaacaagcaucggacuccuaugcgugaccgcuuccuccgcauuacuuuggauggccuccgucgagccccacuggaucgcggcauccaucauacuugaguucuuucucaugguacuccucauuccggaaccggauaggcaacgaacaccccaagacaaccaacuggcauacguaguaauuggccuacucuucaugauacuaacgguagcagcaaacgaaaugggccuccuggaaacaacgaagaaagaccuuggcauaggccacguagccgcugaaaaccaccaacacgcgaccaugcucgacgucgaccugaggcccgcgagcgcauggacccuauacgccguagcaaccacagucaucaccccgaugaugcgccacaccauagaaaauacaacggcaaacauaagccuuacagccauagcgaaccaagccgcaauccucaugggacucgacaaagguuggccaaucuccaaaauggacaucggcguaccccuacucgcccugggcuguuacucccaagugaacccgcucacccucacggcggcagugcugaugcucguagcccacuacgcaauaauaggaccgggccuacaggcuaaggcaacccgcgaagcgcaaaagaggaccgcugcaggcauuaugaagaauccaaccguagauggaaucgucgcuauagaccucgacccagucgucuaugacacuaaauucgagaaacaacuaggacaaauaauguugcuaauccugugcaccagucaaauauuacuaaugcggaccaccugggcacugugugaguccauaacauuggcuacuggcccacucacaacucuaugggagggcucuccggggaaauucuggaacaccacaauagcggucagcauggcgaacaucuuccggggcucguaccucgcaggcgcggggcuagcguucaguuugaugaaaagccuaggaggaggcagacgcggcacgggugcccaaggugagacccucggagaaaaauggaaacgccaacucaaccaacuaagcaagucugaguucaauauauacaaacggagcgggauaauggagguagacagauccgaggcgaaagaaggacucaagagaggugagacaacgaaacacgcgguaagucgcggaaccgcaaaguuacgcugguucgucgaacgcaaccuaguaaaacccgagggaaaggucaucgaccuugggugcgggcgaggcggcuggucauacuacugcgcagggcugaaaaaggugaccgaaguaaagggauacacuaaaggagggccuggccaugaggaaccaauacccauggcaacguauggcuggaaccuugucaaacuacacaguggcaaagacguauucuucaugccaccggaaaaaugugauacccuacucugcgacaucggcgagucgucccccaaccccacuauagaggaggggcgaacacuucggguacugaaaaugguggagcccuggcugcggggcaaucaauucugcaucaaaauccuaaacccuuacaugccaucggucgucgaaacuuuagaacaaaugcagcgcaaauacggcggaaugcuagugcgaaacccucugagcagaaauaguacccacgaaauguacugggugagcugcggcacaggaaacauaguaucagccgucaacaugacuagcagaauguuauuaaacagguuuacuauggcccacagaaagcccaccuacgagcgggacgucgaccuaggcgcagguacgcggcauguggcaguagagccggagguagcgaaccucgauauaauaggacagcguauugaaaauaucaaaaacgaacacaagucgaccuggcacuacgaugaggacaaccccuauaagacaugggcauaccacggauccuaugaggucaagccaaguggguccgccuccuccaugguaaacggggugguacggcuccuaacgaagccgugggacgucaucccaauggugacucaaauagccaugacagacacgacgcccuuuggccaacaaagggucuuuaaggaaaaaguagacacccgaacaccacgcgcgaaacgaggcacaacccagaucauggaggucacggcgaaauggcuguggggauuccuaucccgaaacaagaaaccuagaauuugcacgcgggaagaauuuacuagaaaagucagaagcaacgcggccaucggagcgguauucgucgacgaaaaccaauggaacucugcaaaagaggcaguugaagacgaacgauucugggauuuaguccgacgagagagagaguuacacaaacaaggcaaaugcgccacgugcguuuacaacaugaugggcaagcgcgagaagaaacuuggagaguucggcaaggccaaaggcucccgugccauaugguauaugugguugggagcgcgauuucucgaguucgaggccuuagguuuuaugaacgaagaccacugguucagcagagagaacagucuaucaggaguagaaggugaggggcuucacaaacucggguauauccuccgcgauauaaguaaaauaccagggggaaacauguaugccgacgauacugcugguugggacacucgcaucacagaggacgaccuacaaaaugaggccaaaaucacugacauuauggagcccgagcacgcacugcucgcaacuuccauauuuaaacucacguaucaaaacaaggucgugcgcguccaacguccagcuaaaaacggaacuguaauggaugucauaagccgccgggaccagaggggcaguggccagguugggaccuacgggcuaaacacguucacaaacauggagguccaacugaucaggcaaauggaaagcgaagguauauuccucccgagcgagcucgaaacacccaacuuggcggagcguguacuggacugguuagaaaagcacggcgccgaacgccugaagcgaauggcaauaucaggagacgacugcguggucaagccuaucgacgaccgauucgcaacagcccuaaccgcgcugaacgacaugggaaaagucagaaaggacauaccucagugggagccgucgaaaggauggaaugacuggcagcaaguacccuucugcagccaccacuuucaccagcuaauaaugaaagacgguagagagauaguagucccgugucggaaccaggacgaacucguugggcgagcgagaguaagccaaggagccggguggagccuccgcgagaccgccugccugggaaagucauacgcgcaaauguggcaacucauguacuuccaucggcgagaccuaagacucgcagcaaacgcaauaugcucggcggucccuguagacuggguaccaaccagcagaaccacaugguccauccaugcacaccaccaauggaugacuacagaggauauguuaagcguuuggaaucguguguggauagaagaaaaucccuggauggaagauaagacacacguaagcucaugggaagaggucccguaucugggcaaaagagaagaucaauggugcggcucauuaauagggcucacagcucgcgccacgugggccacaaacauucagguagcaaucaaucaagugcggagacucauaggcaaugagaacuaucucgacuauaugacuuccaugaaaagauuuaagaaugagucggaccccgaaggggcacucugguga

SEQ ID NO: 23971 - RNA, 9879 nt, Artificial Sequence
  derived and/or modified CDS sequence (opt11) from DENV-1__KF973462__SS-prME
agcgugacaauguugcucaugcugcugcccacagcccucgccuuccaccugaccacccggggcggggagccccacaugaucgucagcaagcaggagcgggguaaaagucuucuguucaagaccucugccgggguuaacaugugcacccugaucgcaauggaccugggcgaguugugugaagacacccugaccuacaagugcccccagaucaucgaggccgagccugaugacguggacugcugguguaacgccaccgacaccuggguaaccuaugggaccugcagccagaccggcgagcaucggcgggacaagcgcagcgucgcacuggcgccccacgugggccucgggcuggagaccagaaccgagaccuggaugagcuccgagggcgccuggaagcagauccagcgcguagagaccugggcccugcggcacccuggguuuacugugauagcccuguuccuggcgcacgccaucggaaccaguaucacccagaaggggauuaucuuuaucuugcuaaugcuggugacgccuuccauggccaugcgcugcguuggcaucggcaaccgggacuuuguggagggguugagcggagccacguggguggauguagugcucgagcacggguccugcgugacuaccauggccaagaacaagcccacccuugacauagagcuccucaagaccgaggucacgaaccccgccauccugaggaagcuuugcaucgaagccaagaucucaaacaccaccacggacucccggugcccgacgcagggcgaggcuacacucguggaggagcaggacgccaauuucgugugccgccggaccuuuguggaccgcggcugggggaauggcugcgggcuauuuggcaaggguagcuugcuuacgugcgcaaaguucaagugcgugacuaagcuggaagggaagauuguccaguaugagaaccugaaguacuccgucaucgugacagugcacacuggugaccaacaccaggucgggaaugagaccacggagcacggcaccaucgcgaccaucacgccccaggccccgacgagugagauccagcucacggacuauggggcccugacccuggacugcuccccccgcacuggccucgacuucaacgagauggugcuccucaccaugaaggagaagagcuggcuaguccacaagcagugguuccuggaccugccacuccccuggacguccggggcgagcaccagccaggagaccuggaaccgccaggaucugcuggugacguucaagacggcccacgccaaaaagcaggagguggucgugcucgguagucaggagggggccaugcacaccgcguuaaccggugccaccgagauccagaccagcggcaccaccaccaucuuugccgggcaccugaaauguaggcucaagauggacaagcugacgcugaaaggcaccucguaugugaugugcaccgguagcuucaagcuugagaaggaaauggcggaaacucagcacggcacggucuuaguccagguuaaguacgaagguacagacgcgccguguaaaauccccuucaguacccaggacgagaagggcgugacacagaacggacgucucauuacggccaauccgaucgugaccgacaaggagaagcccgugaauaucgagaccgagccgccguucggggagaguuacauaguggugggcgcaggcgagaaggcccugaagcucucaugguucaagaaggguagcaguaucgggaagauguucgaggcgaccgcucgcggggcccgccggauggccauccugggcgacacugccugggacuucgggucgaucggcggcguguucacaucuguugggaagcuggugcaccagguguucggcaccgccuacgggguccucuuuucuggcguguccuggaccaugaagaucgggauagguauuuuacugacguggcuggggcugaacucucgcuccaccagccuaagcaugacgugcaucgccguggggauggucacccuauaccuuggcguuaugguacaggcugacaguggcugcgucaucaacuggaaagggcgcgagcugaagugcggguccggcauuuucgugacgaacgaggugcacaccuggacggagcaguacaaguuccaggccgacucaccgaagcggcucagcgcggccauuggcaaggccugggaagagggggucugcgggauucgcuccgcaacgcgguuggagaacaucauguggaagcagaucagcaacgagcugaaccacauucuacuugagaaugacaugaaguuuaccgugguggucggggacgcaaacggcaucuuggcgcaggggaaaaagaugauccguccacagcccauggaacacaaguacuccuggaaguccuggggcaaggccaaaaucaucggcgccgacauacagaauacgacuuucaucaucgacggucccgacaccccggaaugucccgacaaccagcgugccuggaacauaugggagguagaggauuacggcuucgggaucuucacgacuaacauauggcugaagcugcgcgacuccuacacccagguaugcgaccaucggcucauguccgcggccaucaaggauuccaaagccguccaugccgacaugggcuacuggaucgaguccgagaagaaugaaacguggaagcucgcgcgcgcuuccuucaucgaggugaagacgugcacguggcccaagucgcacacacugugguccaauggcgugcuggaguccgagaugaucauaccgaagaucuacggggguccgaucucccaacacaacuaucggccaggguacuucacccaaaccgcggguccauggcaucucgggaaacuggagcuggacuucgaccucugcgagggcacgaccgucgugguggacgagcacugcggcaaccgcgggccaucacugcguacgaccacggugaccggcaaaaucauccaugagugguguugccgcagcugcacccugccgccccugcgguucaggggggaagacggguguugguaugggauggagauccggcccgucaaggagaaggaagaaaaucuggugcggagcauggucuccgccggcagcggcgagguggacagcuucuccuuagggaucuuaugcgccagcauaaugaucgaggaggugaugcgaucccgcuggucucgcaagaugcugaugaccggcacguuagccguguuccuccugcugaucauggggcagcucacguggaacgaccugaucaggcugugcaucaugguuggagcgaacgccucggaccgcauggggaugggcaccaccuacuuagcccuuauggccacguuuaagaugcggccgauguucgccguaggucuacucuucagacgccugacgucacgcgagguucugcuccucacaauagggcugucucucguggcgagcguggagcugccgaacucucuggaagaguuaggcgacgggcucgcgauggguaucaugaugcugaagcuccugaccgaguuccagccccaccagcuauggacuacccuccuaagccugaccuucaucaagacuacgcugucguuggacuacgccuggaagaccaccgccauggcgcuuagcaucaucucccucuucccucuaugucugaguacaacuucucaaaagaccaccuggcucccgguacugcugggcagcuucgggugcaaaccccucaccauguuccugauaaccgaaaauaagaucuggggccggaaauccuggccccuuaacgaagggaucauggcgaucgguauagugagcauccugcuaaguagccuacucaagaacgacguccccuuagccgggccguuaaucgccggcggcaugcucaucgcaugcuacgugauuucuggaagcagcgcggaucuguccuuagaaaaggcggccgaggugagcugggagcaggaggccgagcacucgggcacgagccacaauauccugguagaggugcaggaugauggcaccaugaagauaaaggacgaggagcgcgaugacacucugaccauucugcucaaggccacgcugcuagcgguguccggcguauacccaaugagcauccccgccacccucuucgugugguacuucuggcaaaagaagaagcaacgguccgggguccugugggacacuccgagcccgcccgagguugagcgcgccguguuagacgacggcauauaccggauacugcagcgcggcuugcugggucggucccaggugggggucgggguguuccaggacggcguguuccacaccauguggcacgugacgcgcggggccguucugauguaccaagguaagcggcucgagcccagcugggccaguguuaagaaggaccucaucucauacggcgggggcuggcgcuuucagggguccuggaacacaggcgaggagguucaggugaucgcgguggaaccgggcaagaacccgaagaacgugcagaccacccccgggacguucaagaccccagagggcgaaguaggggccauugcccuggacuucaagcccggcaccagcggguccccgaucgugaaucgcgaaggaaagaucgucggccuguacgggaacggcguagugaccacgagcggaacguauguguccgccaucgcgcaagcgaaggugagccaggaggguccacugcccgagaucgaagacgagguguucaagaaacgcaaccugaccaucauggaccuccauccggggagcggcaagacccggcgcuaccugccggccauaguacgagaggccauaaaacgcaagcuccggacgcucauccuggcccccacacgagucguggcgucggagauggccgaggcucugaagggcaugcccauaagauaccagaccaccgccgucaaaagugaacauacggggagagagaucguggaccuaaugugccaugcgaccuucaccaugcgccuccugaguccggugcgaguccccaacuacaacaugaucaucauggacgaggcgcacuucacggacccugccagcaucgcggccagaggcuacauauccacgcgagugggaaugggcgaggccgcggccaucuuuaugaccgccacaccgccugggagcguggaggccuuuccccaauccaacgccguaauccaggacgaggagcgcgacauccccgagcggucauggaacucgggauacgacuggaucaccgacuuccccgggaagacggugugguucguccccagcaucaaguccgggaaugauaucgcgaacugccuacguaaaaacggcaagcgggucauccagcugagccgcaagaccuuugacacugaauaccagaagaccaaaaacaacgauugggacuacguggugacgaccgacauaucugagaugggagcgaacuuccgggcugauagggucaucgacccccggcgcugccugaagccgguaauccucaaggacggccccgagcgggugauccuggccgggccgaugcccgucaccguggccucugcggcccagcgccggggccgcauuggccgcaaucagaacaaagaaggggaucaguacguauauaugggccagccccugaacaacgacgaggaucacgcccacuggaccgaggccaagauguuacuggacaacaucaacacgcccgaagggauaauccccgcgcuguuugagccagagcgagagaaguccgccgccaucgauggcgaguaccggcuccgcggggaggcccgcaagaccuucgucgagcugaugcggcguggggaccugcccguuuggcucagcuacaaggucgcgagcgagggcuuccaauacucagaccggcgcuggugcuucgauggggagcggaacaaccaggugcucgaagagaacauggacguagagauauggacgaaggaaggcgagcgcaaaaaacugaggccccgauggcucgacgcgcgaaccuacuccgacccgcuggcccugcgcgaguucaaggaguucgccgccgggcggcgcagcgucagcggcgaucuaauccuggagaucggcaagcugccccaacaccucacccugcgggcccagaacgcacuggacaaccucguaaugcuacacaacuccgaacagggcgggaaggcuuaccgccacgccauggaagaacugcccgacacgaucgagacccucauguugcuggcccucaucgcggugcucaccgggggcgucacucuguucuuccugagcggaaaaggacuuggaaagacguccauagggcuccucugcgugaccgccagcuccgcccugcuauggauggccagcguagagccccacuggauagccgcguccaucauccucgaguucuuccugaugguuuuacugaucccggagcccgaucggcagcgcacaccccaagacaaucaguuagccuacguggugauaggacuccucuucaugauccugaccguagcggccaacgagauggggcugcucgaaacaacaaagaaggaccugggcaucgggcacguagcggcggagaaccaccagcacgccaccaugcuggacguggauuugcggccggcgucugcuuggacccuguacgccguggcgacgaccgugaucacccccaugaugagacauacaaucgaaaacacgaccgcaaacaucucccuuaccgccaucgccaaccaggccgcgaucuuaaugggacuggacaagggcuggcccaucagcaagauggacaucgggguaccgcugcucgcccuaggcugcuacucucaggucaacccccugacguugacggccgcugugcugaugcuaguggcgcauuacgccaucaucgggcccggccuccaggccaaggccacucgggaggcucaaaagcgcaccgcggccgggauuaugaagaaccccacggucgacggcaucguggccaucgaccuugaccccguggucuacgacacuaaguucgaaaagcagcugggucagaucaugcuccugauccugugcacuucccagauccuccugaugcgcaccaccugggcccugugcgaguccaucacgcucgccaccggaccucugaccacucugugggagggcagcccggggaaguucuggaauacgaccaucgccgucuccauggccaacaucuuucggggcagcuaccucgccggcgccggguuagccuuuuccuuaaugaaaucccuuggcgggggaaggcgggguaccggcgcgcaaggcgagacccugggugagaaguggaaacgccagcucaaucagcucuccaagagcgaguuuaacaucuacaagcggagcggcaucauggagguggaucgcuccgaggcaaaggaagguuugaagcggggggagacgacaaagcacgccgucagccgcgggaccgccaaacugagaugguucguggagaggaaccucgugaagccggagggcaaaguuaucgaccucgggugcgggcggggaggaugguccuacuacugcgcgggacugaagaaagugaccgaggugaagggauauacuaagggcggacccgggcacgaggagccgauccccauggccacguauggcuggaaccuggucagguugcauagcgggaaggacgucuucuucaugccacccgagaagugcgauacccuccuaugcgacaucggcgaauccagcccgaaccccaccaucgaggaggggcggacccucaggguccugaagaugguugagcccugguuacgggggaaccaguucugcaucaagauccucaaucccuacaugccgucaguaguggagacacuggagcagaugcagcgcaaguacggcggcauguugguccggaacccauuaagccgcaacuccacucaugagauguacugggugagcugcggcacugggaacaucguguccgccguaaauaugaccagccggaugcuccuaaaccgauucacaauggcccaucgcaagccgaccuacgaacgggauguggaucuaggagccggcacccgccacguggcgguugagcccgagguggcgaaucuggacaucauagggcagcggaucgagaacauaaaaaacgagcauaagucuacauggcauuaugaugaggacaaccccuacaagacuugggccuaccacggcuccuaugaggucaagcccuccggguccgccucaaguauggucaauggcguuguucgccugcucacuaagcccugggacgucaucccaauggugacccagaucgccaugaccgauacgacgccguucgggcagcagcgggucuucaaggagaaaguggacacccgcacgccccgggcgaagcgcggcaccacgcagaucauggaggugaccgcaaaguggcuguggggcuuccuuucucgcaacaagaagccccgaaucugcacaagagaggaguucacgcgcaagguucgaagcaacgccgccaucggggccgucuucguugacgagaaccaguggaacagcgcgaaagaggccgucgaagacgagcgcuucugggaucucguucaucgcgaacgcgagcugcacaagcagggcaaaugcgcgaccugcguuuauaauaugauggggaagcgggagaagaagcugggcgaguucggcaaggccaagggcucuagggcgaucugguacauguggcucggugcccgguuccuggaguucgaggcccugggguuuaugaacgaggaucacugguucucucgcgaaaacucccucagcggcgucgagggggagggcuugcacaagcugggguacauccuccgggacaucagcaagauaccgggaggcaacauguacgcagaugauaccgccgguugggacacccgcauuacggaggacgaccugcagaacgaggcgaagauuacugacauaauggagccagaacacgcccugcucgccaccagcaucuucaagcugaccuaccaaaacaagguggugcgcguccagcggcccgccaagaaugggacugucauggacgugaucagccgcagagaccagcgcgggagcggccaggucggcaccuacggguuaaacaccuuuaccaacauggaagugcaacucaucaggcagauggagucagagggaaucuuucugccgucggagcuggagacgccgaaccuagcaaagcggguuuuggauugguuagagaagcacggugcggagcggcucaagcgcauggccaucagcggcgacgacugugucgugaagccuaucgacgaucgguucgcgaccgccuugaccgcgcugaacgacaugggcaagauccgcaaggacaucccccagugggagcccagcaagggcuggaaugacuggcaacaggucccguuuuguagccaccacuuccaccaacuaaucaugaaggacgggcgggagauagucgugcccugccgcaaucaggacgagcuggugggucgggcgcgggucagccagggcgcagggugguccuugcgggagaccgccugccuaggcaaguccuacgcacagauguggcagcuuauguauuuccaccgccgggaccugcggcucgccgcgaacgccaucugcucggccgugcccguggacuggguccccaccagccggacgacuuggucaauccaugcccaucaccaguggaugacaaccgaggacaugcugucggucuggaaccgcguguggaucgaggaaaacccauggauggaggacaagacgcacgucagcuccugggaggaggugcccuaccuggggaagcgcgaagaccaguggugcggcagccuuauagggcugacugcgcgggcuaccugggccaccaauauucaggucgcgaucaaccagguccgucggcugaucggaaacgagaacuaucuagacuacaugacguccaugaaacgguucaagaacgagagcgacccagagggggcuuugugguga

SEQ ID NO: 23972 - RNA, 9879 nt, Artificial Sequence
  derived and/or modified CDS sequence (opt11) from DENV-1__KF973463__SS-prME
agcgugacuaugcugcucaugcugaugccuacugcccuggcauuccaccuaacgacgcgcggcggggagccacauaugaucgucuccaagcacgagcgaggcaaagcgcugcuuuucaagaccagcaccgggguaaacaugugcacgcucaucgccauggaccugggcgagcugugcgaggacaccaugaccuacaaaugcccccguaucacggaggccgagccagaugacguggacugcuggugcaacgccacggacaccugggucaccuacggaaccugcagucagacgggcgaacaccggagggacaagcggucgguggcccucgcgccgcacgugggccuggggcuggaaacccggaccgagaccuggauguccagcgaaggggccuggaagcaaauccagcgggucgagacgugggcccuccggcacccgggguuuacagucaucgcgcuguuccuggcgcacgccaucggcacuuccaucacccagaaggggaucaucuuuauccuccugaugcuggucacgcccucgauggccaugcggugcgucggcaucggaaaucgcgacuucguugaggggcucucgggcgcuaccuggguggacgucgugcucgaacacgggagcugcgugacuaccauggcuaagaacaagccgacgcuggacaucgagcuccugaagaccgaggucaccaaccccgcgguguugagaaaacucugcaucgaggccaagaucuccaacacaacgaccgacagccgcugcccgacccagggcgaggcgacgcugguggaggagcaagacgcgaacuuuguuuguagacgcaccuucguggaccggggcugggggaacggcugcgggcuguucgggaagggguccuuacugaccugugccaaguuuaagugcgugacuaagcuggaaggcaagaucguacaguacgagaaccucaaguacagcgugaucguuaccguucacacgggagaccagcaccagguggggaacgaaaccacagagcacggcacaaucgcgaccaucacgccccaggcccccaccagugagauucaguugaccgacuacggcgccuuaacacucgacugcucaccgcgcacgggucuggauuucaacgagaugguucugcucaccaugaaggagaagucguggcucgugcauaagcagugguuccuugacuugccgcugccguggaccagcggagccuccaccagccaggagacguggaaccggcaggaccugcucgugaccuuuaaaaccgcccacgcaaaaaagcaggaggucguaguguugggcagccaggagggcgccaugcacaccgcccugacgggggccacugagauccagaccucuggcaccacgaccauauucgccggccaccucaagugcagacugaaaauggacaagcucacacugaagggaaccagcuaugucaugugcacggguuccuucaaguuggagaaggagguugcggagacccagcacggcaccgugcugguacagguuaaguacgaggggaccgaugcccccugcaagaucccguucucuacgcaggaugagaaaggggucacccagaacggccgccugaucacugccaacccuauugucaccgacaaggagaaaccaguuaacaucgagaccgagccccccuucggggaauccuacaucguggucggcgccggcgagaaggcccucaagcugagcugguucaagaaaggguccagcaucggcaagauguucgaagccaccgcgcgcggagccagacgaauggccauccugggagacaccgcgugggacuucgggucgaucggcggcguguucaccagcguggggaaguuaguucaccagguguucgguacggcguacgggguccuguucuccggcguuagcuggaccaugaagaucgggaucggcauccuauuaaccuggcugggccugaauucccggagcacgucccucagcaugacuugcaucgcgguugguauggugaccuuguauuuaggcgucaugguacaggccgacuccgggugcgugaucaauuggaaaggccgggaacucaagugcggaagcggcaucuucgucaccaacgaggugcacaccuggacugagcaguacaaauuccaggccgacuccccgaagcgccugagcgccgccauuggcaaggcgugggaggagggggugugcggcauacggucugcaacucgucuggagaacaucauguggaagcagaucuccaacgaacucaaucauauucugcuggagaacgacaugaaguucacgguuguggugggggaugccaaugguaucuuagcgcaggggaagaagaugauccguccucagccaauggagcauaaguacucguggaaauccuggggcaaggccaagaucaucggcgcugacauccagaacaccaccuucaucaucgacgggcccgacacgccggaguguccggacgaccagcgcgccuggaacaucugggaagucgaggacuacggguucgggaucuucaccaccaacaucuggcugaagcugcgggacagcuacacacagaugugcgaccaccgcuuaauguccgcggcaaucaaggacagcaaggccguccacgccgacaugggcuacuggaucgaguccgagaagaacgagacguggaagcuggcccgggcgagcuucaucgaagugaagaccugcaccuggcccaagucccauacccucugguccaacggaguccucgagagcgagaugauaauucccaagauuuacggggguccgaucagccagcacaacuaucgccccggguacuucacgcagacggccggccccuggcaccugggcaagcuggagcucgacuucgaccugugcgaggggaccaccguaguggucgacgagcacugcggcaaccgagggccgucucugagaacgaccacagugaccggcaagaucauacacgaguggugcugccggagcugcacgcuccccccccugcgcuuccggggggaggacggcuguugguacgggauggagauccgccccgugaaggagaaggaggagaaccugguccgguccauggugucugcaggcuccggggagguggacagcuucagccuaggaauacugugcgucaguauuaugauugaggaggugaugcgcagccgguggucaaggaagaugcugaugaccgguacccucgccguguuccugcugcugauaauggggcaacucaccuggaacgaccugaucagacucugcaucauggugggcgcuaacgcgagcgacaaaauggggaugggcacgaccuaccuagcccugauggccaccuucaaaaugcggccgauguucgccgucggcauccucuucaggagacugaccucccgcgaggugcugcuacuuacgaucggucugagccucgucgccuccguugagcugcccaacagccuggaggagcucggcgacggguuggcgaugggcaucaugaugcugaagcuccugaccgaguuucagccccaccagcucuggaccaccuugcuguccuuaacguucaucaagacgacucucagccuggacuacgccuggaagaccacggccauggcguugucaaucgucagcuuauucccccuuugccuuuccacaaccucccagaagaccaccuggcucccggugcugcugggcuccuucgggugcaagccccuaacgauguuccuuaucaccgagaacaagauauggggccgaaaaagcuggccgaucaacgagggaauuauggcgaucggcauuguguccauccuucucagcucccugcugaagaacgacguccccuuggccgggccuuugaucgccggcggcaugcugaucgccugcuacgucaucagcgggagcuccgccgacuuaagccuggagaaggcggccgagguguccugggagcaggaggcagagcauagcggcaccucacauaauauccuagucgaggugcaggacgacgggacgaugcgcauuaaagacgaggagaaggacgacacgcucaccauucugcugaaggcaacccuccuggcagugagcggcgucuaccccauguccauacccgcgacgcuguucgugugguauuucuggcagaagaagaagcagcggagcgguguguuaugggacacgcccucaccgccugaggucgagcgcgcugugcuggacgacggcaucuaccggauccuacagcgcggccuccuggggcggagccaggugggcguuggaguguuccaggacggcguguuccacaccauguggcacguuacgcgcggggccguucugauguaccagggcaagcggcuggagcccuccugggcgagcgugaaaaaggacuugaucucuuauggcggggguuggcgcuuccaggggagcuggaacacaggcgaggagguucaagugauagccguggagccggggaagaaucccaagaacguccagacgacucccgguaccuucaaaaccuccgagggggaagugggggcgaucgcccuggauuucaaacccgggacgucgggguccccuaucgugaacagggaggggaagaucgucggacuguacgggaacgguguggugacgaccagcgggacuuacgucucugccaucgcccaggcaaagacgagccaggaaggcccgcuccccgagauagaagacgagguguucaagaagcgcaaccucaccauuauggaucugcacccggggagcggcaaaacacggagauacuuaccggcgauagugcgcgaggccauaaagaagaagcugcgcacucugauccucgcccccacccgggucguugccuccgaaauggcggaggcacugaagggcaugcccauccguuaccagaccacugccgugaagagcgaacacaccgggcgcgaaauagucgaccugaugugucacgccaccuucaccaugagacuucugucccccgugcgcgugccgaauuauaacaugaucaucauggacgaggcacacuuuaccgaucccgcuagcaucgccgcgcggggguacaucuccaccagagucgggaugggcgaggcugccgcgaucuucaugacggccacuccccccgguagcguggaggcauucccacagaguaacgccgugauccaggacgaagagcgggacauucccgagcgcagcuggaacucugguuaugacuggaucaccgacuuccccggcaagacugucugguuugugcccagcaucaaguccggcaacgacaucgccaauugccugcggaagaacggcaagcgcguaauccagcugagccggaagacguuugacaccgaauaccagaagacgaagaacaacgauugggacuacgucgugacgacggacaucuccgagaugggggcaaacuuccgcgccgacagagugaucgacccaagaagaugccugaagcccgucauccuaaaagacggcccugagagagugauacucgcggggcccaugccggugaccgucgccagcgcagcucagcggagagggcggaucggacgcaaccagaacaaagagggggaccaguacguguacaugggucagccccugaacaaugacgaggaucacgcccauuggaccgaggccaaaaugcugcucgauaacauaaacacacccgaagggauaaucccggcccuguucgagccggaacgggagaaauccgcggcgaucgacggggaauaccgccugagaggggaggccagaaaaaccuucgucgagcucaugcgccggggcgaccugccgguguggcugagcuacaagguggccuccgagggauuucaguacagcgaccgccgguggugcuucgacggggaacggaauaaccagguccucgaggagaauauggacguggagaucuggacgaaggagggcgagcggaagaagcugcgcccccgguggcuggacgcucgcaccuauuccgacccccucgcgcugagagaguucaaggaguuugccgccgggcgccggagcguuagcggagaccucauccuggagaucggcaagcugccgcagcaccugacccuccgcgcccagaacgcucuggacaaccuggucaugcuccacaauuccgagcaggggggcaaggcguaccggcacgccauggaggagcuaccugacaccaucgagacgcugaugcuccuggcccuuaucgccgugcucaccgggggcgugacauuguuuuuccugagcgggaagggccucggcaagaccuccaucggacugcugugcgucacggcgagcuccgcccuccuguggauggccuccguggagccccacuggaucgcggccucaaucauccuggaguucuuccuaauggugcugcugauccccgagcccgaccgccagcggaccccccaggauaaccagcuggcuuacgucguaaucggcuugcuuuucaugauacucacaguggccgccaacgagauggggcuguuagagaccacgaagcgcgaccucgggaucgggcacgucgccgccgagaaccaccagcacgcgaccaugcuggacguggaccuucggcccgcaagcgccuggacccucuacgccguggccacgacggucaucaccccgaugaugcgacacaccaucgaaaacaccacggcgaacaucuccuuaaccgccaucgccaaccaggccgccauccugaugggccucgacaaggguuggccaaucagcaaaauggacaucggcgugccccuccuggcgcucggcugcuacucccaggugaacccacugacccugaccgcagccguccucaugcugguggcgcacuacgcgaucaucgggccgggccugcaggccaaagccacgcgggaggcccagaagcgcaccgccgcggggaucaugaaaaaccccaccguggauggcauagucgcuaucgaccucgaccccgugguguacgacgccaaauucgagaagcagcugggccagaucaugcugcucauccucugcaccucccagauccuacucaugcgcacgacaugggccuugugcgaauccaucacacuggccaccgggccucucacgacccugugggagggcagcccgggaaaguucuggaacaccacgaucgcggucuccauggccaacaucuuuagaggcagcuaccuggcgggggcaggcuuggccuucucccugaugaagagccugggagggggccgccgggggacgggagcgcaaggugagacccucggcgagaaguggaagcgccaacugaaccaacuguccaagccggaguuuaauaccuacaagcggagcggcaucauggagguggaccgcagugaggccaaggagggacucaagaggggcgagaccaccaagcacgccgugucccgugggacagccaagcugcggugguucguagagcguaaccuggugaagccggaagguaaagugaucgaccucggcuguggucguggcggguggagcuacuacugcgcgggucugaaaaaggucaccgagguuaagggguacaccaagggcggccccggacacgaagagccgauccccauggccaccuacggcuggaaccugguuaagcugcacuccggaaaggacgucuucuucaugccccccgagaagugcgacacgcuccugugcgacaucggcgagagcuccccgaaccccacaaucgaggaggggcgcaccuugagagugcucaagaugguggagccauggcugcgcggcaaccaguuuugcaucaagauccugaaccccuacaugccgagcguaguggagacccucgagcagaugcagagaaagcacggagggaugcuggugcgcaacccauuguccagaaacagcacgcacgagauguacugggucucaugcgggacaggaaauaucguuucggccgugaacaugaccaguagaaugcuccugaaccgguucaccauggcccaccgcaaacccacguacgagcgcgacgucgaccugggcgccggcacgagacauguggcgguggaaccggaagucgccaaccucgacauaaucgggcagcguaucgagaacaucaagaaugagcacaagagcaccuggcacuacgacgaggacaacccguauaaaaccugggccuaccauggcuccuaugaagugaagcccagcgggucugccagcuccaugguuaacggcgucgugcggcuacugacgaagcccugggacgucaucccgauggucacgcagaucgcaaugaccgacaccacgccguucggccagcagcgcguuuucaaggagaaagucgauacccggaccccccgcgcgaaacgggggaccacgcagaucauggaagugacugcaaaguggcucuggggcuuccugucccgcaacaagaagccccggaucugcacccgcgaggaguucacccggaagguccgcuccaacgcugcaauaggggccgucuucguggacgagaaucaguggaacuccgccaaggaagccguugaggaugaacgguucugggaccuggugcaccgcgagcgggagcuccacaagcagggcaagugcgcaacgugcguguacaacaugauggggaagcgcgagaagaaacugggggaguucgggaaggccaagggcagccgggcgauuugguacauguggcugggcgcccgauuccucgaauucgaagcccugggguucaugaacgaagaccacugguucucacgggagaacagucucuccggcguugagggggagggacuccacaaacugggguacauucugagggacaucagcaagauaccaggcggaaauauguacgccgacgacaccgcugggugggacacccggauuaccgaggacgauuuacagaacgaggcgaagauuacagacauuauggagccugaacacgcccugcuggccacauccauauucaagcuuaccuaccagaacaaggucgugcgcgugcagcgccccgccaaaaacgggaccgucauggacguaaucagccggcgcgaccagcggggguccggccaggugggcacguacgggcugaacaccuucaccaacauggagguccaacugaucagacagauggagucagaggggaucuuccucccuucggagcuggagaccccgaaccuagcagagcgggugcucgacuggcuggagaaacauggggcagagcgacugaagcguauggcuaucagcggcgaugauugcguggucaaacccaucgacgaccgcuucgccacggcccucacggcuuugaacgauauggggaaagugcggaaagacaucccccagugggagccguccaagggcuggaacgauuggcagcaggugccguuuuguagccaucacuuccaccaacucauaaugaaggacggccgagaaaucgucgugcccugucggaaccaggacgaguuaguggggcgcgcaagagucucccagggcgccggauggucacugcgcgagaccgccugccugggcaaguccuaugcacagauguggcaacucauguacuuccaccggcgcgaccugcggcuggccgcuaacgccaucugcagcgccguucccguggacuggguuccgaccucccgcaccacguggagcauccaugcacaccaucaguggaugaccaccgaggacaugcucagcguguggaaccggguguggauagaggaaaacccguggauggaggacaagacacaugucuccagcugggaggaggugcccuaccugggcaagcgcgaagaccaguggugcgguucccugaucggccucacugcgcgcgccaccugggccacgaacauccagguggcgauuaaccaaguccggcgccugauagggaaugaaaacuaccuggacuacaugacgagcaugaaacgguuuaaaaacgagagcgaccccgagggcgcccucugguga

SEQ ID NO: 23973 - RNA, 9879 nt, Artificial Sequence
  derived and/or modified CDS sequence (opt11) from DENV-1__KF973464__SS-prME
agcgugaccaugcuucucaugcuccugcccaccgcccucgcuuuccaccugacaacccgggguggagagccccacaugaucgugucuaaacaggagcgaggcaagagccugcuguucaagaccucugccggggugaauauguguacgcugaucgcuauggaccugggcgaguugugugaggacacaaugaccuacaagugcccgcagaucacugaggccgagccggacgacguggauugcuggugcaaugcuaccgacaccugggugaccuacgggaccugcagucaaacaggcgagcaucgccgugauaagagauccguugcccuggcgccccacgugggacugggacucgagacccggaccgaaaccuggaugucguccgagggggcuuggaagcagauccagcgcguggagaccugggcccucaggcaccccggguucacgguaauugcccuguuccuagcucaugcaaucggcacaucaauaacgcagaaggggauaauauucauucugcugaugcucgugacccccagcauggccaugagguguguaggcaucggcaauagggacuucguggagggucugagcggagccacguggguggacgucguucuagagcacggguccugcgugaccaccauggccaagaauaagcccacucucgacauagagcuguugaagacggagguuaccaacccugcgauucuccgcaagcuguguaucgaagcuaagaucagcaacaccaccacggauucccguugcccgacccaaggggaggcgacccugguggaagaacaggacgcgaacuuuguaugccgccgaacauucguggaccgcggcuggggaaacggcugcggccucuucggcaaggggucucuucugacgugcgccaaguucaagugugugacuaagcucgagggaaagauugugcaauacgagaaccugaaauauuccgucaucgugacagugcauaccggcgaccagcaccaaguagggaacgagacgaccgagcacggcaccaucgcgacgaucacgccacaggcgcccacgagcgaaauccagcugaccgacuacggggcucugacccuggacugcagucccagaacaggccuggacuucaacgagaugguacuccugacgaugaaggagaaauccuggcugguacacaagcagugguuccucgaccuaccccugcccuggaccuccggugcgagcacgagucaggagaccuggaaucgacaggaccuccuggugaccuucaaaaccgcucacgcaaagaagcaggaaguagucguccugggcucccaggagggggcaaugcacacugcgcucaccggggccacggagauucagaccagcggcacgacgacgaucuucgccggccaccugaagugccgucuuaaaauggacaagcucacccugaagggaaccuccuacgugaugugcaccggguccuucaaacucgagaaagagguugcggagacgcagcacggcaccguacuggugcaagucaaguacgagggcacagacgcccccuguaaaauccccuucuccacccaggacgagaaaggggugacgcagaacggcagacucauuaccgcuaauccgauagugaccgacaaagagaagcccgucaauaucgagaccgagccgcccuucggggagagcuacaucguugucggcgccggggagaaggcgcugaagcuguccugguucaagaaggggagcuccauuggcaagauguucgaggcuacagccagaggagcccgccggauggcuauccucggagacacggcgugggauuucgggucuaucgggggcgucuucacauccguggggaagcuggugcaccaagucuucggcacugcauacggggugcuguucuccggcguguccuggacgaugaagaucgguaucgggauccuccugacguggcuggggcugaacagccgcuccacuagccugucaaugaccugcaucgccgugggcauggugacgcuguaccucggcgugaugguccaagccgacuccgggugugugaucaauuggaagggccgggaacugaagugcggaucgggaaucuuugugaccaacgagguccacaccuggacggagcaguauaaauuccaggcugacuccccgaagagacugucagccgccaucgguaaggccugggaggaggggguuugcggcauccgcuccgcaacccgacucgagaacauaauguggaaacagauuucaaacgaacugaaccauauccugcucgagaaugacaugaaguucacgguuguaguaggagacgcuaacggcauccucgcucagggaaagaagaugauucgcccccagcccauggagcacaaguacuccuggaaauccuggggcaaagcuaagauuauuggcgcggacauccaaaacaccaccuucauuauugacgggcccgacaccccggagugcccggacaaccaacgggcauggaacaucugggagguagaggacuacggcuucgggauuuucaccaccaauaucuggcugaagcuacgagacuccuauacccaaaugugcgaucaccggcuuaugucggccgcaaucaaggacuccaaggcaguccacgccgacaugggcuacuggaucgagagcgagaagaacgagaccuggaagcuggcccgcgcguccuucauagagguuaagacguguaccuggccuaaaagccacacgcucuggucaaauggcgugcuggaaucggagaugaucaucccgaagaucuauggcggcccgauaucccaacacaacuaucggcccggguauuucacccaaacggccggcccuuggcaccuugguaagcucgagcuggauuucgaccugugugagggcaccaccgucgugguggacgaacacuguggcaauagagggccuagccugaggaccacgaccguaaccggcaagaucauccacgagugguguugucguuccugcacccuaccacccuugcgguuccguggugaggacggcugcugguaugggauggagauacggccggugaaggaaaaggaggaaaaccucguccgcagcauggucagugcaggcagcggggagguugacaguuuuucccuggggaucuuaugugccagcaucaugauagaggaagugaugcgaucccgcuggagcagaaagaugcuaaugacgggcacccuggccgucuuucugcugcugauaaugggccagcuuaccuggaacgaccugauccgccugugcaucauggugggugcgaacgccuccgaccgcauggguauggggaccacguaccuggcucucauggccacauuuaagaugcggccgauguuugccguugggcuacuguuccgccggcuuacaagccgcgaagugcugcugcucacuaucggguuaucccugguggcaagcguggaacuccccaacucccuggaagaacuuggcgacgggcuugcgaugggcaucaugaugcugaagcugcucacggaguuccaaccccaccagcuauggacaacccuguugucguuaaccuucaucaagacgacccuauccuuggauuacgccuggaagaccaccgcuauggcguugucgaucauuucccuuuucccauugugccugaguacgaccucacaaaagaccaccuggcugccgguacuucuuggcagcuucggaugcaagccacuaacuauguuccucaucacagaaaacaagauauggggccggaaaagcuggccacucaacgaggguaucauggccaucgguaucgugagcauccugcucagcagccuccugaaaaaugaugucccccuugccgggccgcugaucgccggcggcaugcugaucgccuguuacgugaucagcgggucaagcgcggaccucucucucgagaaggccgccgaggugagcugggaacaggaggccgagcacagcggcacaagucacaacaucuuaguggaagugcaggacgacgggaccaugaagauaaaggacgaggaaagggacgacaccuuaacaaucuugcugaaggccacccuccuggcgguguccgguguauaccccaugagcauccccgccacccuguucgugugguauuucuggcagaagaaaaagcagcggaguggaguacugugggacacgcccagcccgcccgaagucgagcgcgccguucuggacgacggcaucuaucggauccuccagcggggacugcucggacggagucagguaggcgucgggguuuuccaggacggaguauuucacacgauguggcacgucacccgcggggcggugcugauguaccaggggaagcgucuagagccuagcugggccuccgucaagaaggaucucaucagcuacggugggggcuggcgcuuccagggguccuggaacacaggcgaagaaguccaggugaucgcgguggagcccgggaagaauccgaagaacguccagaccacgcccggcauauucaaaacccccgagggcgaggugggggccaucgcguuagacuucaagcccgguacgagcgggaguccgauaguuaaccgggagggcaaaauugugggguuguacgggaacggcguggugaccacuuccgguaccuacgucuccgccaucgcgcaggccaaggcgucgcaggagggaccccuccccgagaucgaagacgaaguguucaagaagcgcaaccugaccaucauggacuuacacccgggguccggcaagacacggcgcuaccuccccgccaugguucgggaggcgauuaagaggaagcugcggacgcugauccucgcgcccacacgcguuguggccucggaaauggccgaggcccugaaaggcaugcccauccgcuaccaaaccaccgccgucaaaagcgagcauacggggcgggagauagucgaccugaugugccacgcaaccuucaccaugcgccuccuguccccugugagagugcccaauuauaacaugauuaucauggaugaggcccacuucaccgacccugccagcaucgccgcccgcggcuauaucuccacacgggucgguaugggcgaggcggcugcgauuuucaugaccgcaaccccgcccgggagcguggaggccuucccacaauccaacgcggugauccaggaugaggaacgcgacauucccgagcggagcuggaacuccggcuaugacuggauuaccgacuuccccggcaagacugucugguucgugccgagcaucaagagcgggaaugacaucgcaaauugccugcgcaagaauggcaaacgcgugauucaguuaagccguaaaaccuuugacaccgaguaccaaaagaccaaaaacaacgacugggauuacgucguuacgaccgacaucagugagaugggcgccaacuuuagggcugaccgcgugaucgacccgcggcgcugccuuaagcccgucaucuuaaaagacggccccgagcggguuauccucgcggggccgaugcccgucacagucgccucggcagcacagaggagaggccguaucggcagaaaucagaacaaggagggggaccaguacguguacaugggccaaccccugaacaacgacgaggaccacgcccacuggaccgaggccaaaaugcugcuugacaacaucaacacgccagagggaaucaucccggcccuguucgaaccagagagggagaaauccgccgcgauagauggcgaguaccgccugcgcggggaagcccggaagaccuucguggaacucaugcggcgcggcgaccugccaguuuggcugucuuauaagguggccuccgaggguuuccaguacucggaccggagaugguguuucgauggugaaaggaacaaccagguccuagaggagaacauggacgucgagaucuggaccaaggagggcgaacgaaagaaacugcgccccagguggcuggacgcccggaccuacuccgacccgcucgcccuccgugaguucaaggaguucgccgccgggcggcguagcgugagcggagaccucauacucgaaauuggaaaacuuccccaacauuugacccuucgcgcucagaacgcgcuggauaaccuggucaugcuccacaauuccgaacagggcgguaaggccuacagacacgcuauggaggaauuaccugacaccaucgagacacugaugcucuuagcgcugaucgccguguugaccgguggggugacucuguucuuccuaagcgggaagggccuaggcaaaacgucuaucgggcugcuaugcgucaccgccucauccgcccugcuguggauggccagcguagagccccacuggaucgcagccuccaucauccuggaguucuuccucauggugcugcugaucccagagcccgaccggcagcguacgccccaagacaaccaacuagccuacgucgugaucggccugcuguucaugauccucaccguugcugccaaugagauggggcugcuggagaccacuaaaaaggaccucggcaucgggcacguagcugccgagaaucaucaacaugcgacgaugcuggacguugaccugcggccggccagcgccuggacacucuaugcuguggcgacgaccgucaucaccccgaugaugaggcacaccaucgagaacaccacagccaacaucucccugacagccaucgccaaucaggcggccauccugaugggauuagacaagggcuggcccaucagcaagauggacaucggggugccccugcuggcauuagggugcuacucgcagguuaacccgcugacccugacggccgcggugcucaugcucgucgcucauuaugcgaucaucgggccuggccugcaggccaaagccacccgcgaggcgcagaagcgcaccgccgccgggaucaugaagaacccuaccguggauggcaucgucgccaucgacuuggacccggugguguacgauacgaaauuugaaaagcaacugggccagaucaugcugcucauccugugcaccagccaaauucugcuuaugcgcacaaccugggcccuuugcgaauccaucacguuggccacagggccgcucaccaccuuaugggagggcagcccagggaaguucuggaauacgaccaucgccgucucaauggccaacauuuuucggggcucauaccuggccggggccggucucgcguuuucucugaugaaaagccugggcgggggccgccgggggacaggcgcccaaggcgagaccuugggugagaaguggaaacggcaguuaaaccagcuguccaagagcgaguucaacaucuacaagcggagcggcaucauggagguggaccggucagaggcuaaggagggccucaagcggggcgagacgacgaagcaugcggugagccgcggaaccgcgaaacugcgcugguucgucgagcggaacuuagugaagccagaaggcaagguuaucgaccuggggugcggccggggcggcuggucguacuacugcgcuggcuugaagaagguuaccgagguaaagggguacacaaaggguggucccggccacgaggagccgauccccauggccacauacggcuggaaccugguuaaauuacauagugguaaggaugucuucuucaugccgcccgaaaagugcgauacccuccuuugugauauaggcgagucuucaccgaacccuacaaucgaggaggggcgcacccugcggguacucaagaugguggagcccuggcugcgagguaaccaguucugcaucaaaaucuuaaaucccuacaugccguccguuguggaaacgcuagagcagaugcagcggaaguauggcggcaugcuggugcgcaacccacugucucggaacucaacccaugagauguacugggucuccugcggcaccggaaacaucguaucggccgucaacaugaccagcagaaugcuccugaacagauucacgauggcccaccgcaagcccaccuacgagcgcgacguggaccucggcgcgggaacccggcacguggccguugagcccgagguagccaacuuagauaucaucggucagcgcaucgagaauaucaagaacgagcacaagucaaccuggcauuacgacgaagacaacccguacaaaacuugggcuuaccauggcucuuacgaggugaaacccaguggaagcgccuccagcauggugaauggcgucguccggcuguugaccaagcccugggaugugauccccauggucacccaaaucgcgaugaccgauacaacaccguuugggcaacagcgcguguucaaggagaaggucgacacccggacgccccgggcaaagagaggcacgacccagauuauggaagucacggcaaaauggcucuggggcuuccuuucgcgcaacaagaaaccccgcauuugcacccgcgaggaguucacccggaaggugcgcagcaacgccgccaucggagcggucuucguggacgagaaccaauggaacucagccaaggaggccgucgaagacgagcgguucugggaccuaguccaccgcgagcgugagcuccacaagcaggguaagugcgcgacaugcguguacaauaugaugggaaagcgcgagaaaaaguugggcgaguucgggaaggcaaagggcucccgcgccaucugguacauguggcugggugcccgcuuccucgaguucgaggcccugggguuuaugaaugaggaucacugguuuucacgggagaacucccuguccggcguagaaggggaggggcuucacaagcugggguacauccugcgcgacaucuccaagaucccuggcggcaacauguacgccgaugacaccgcugggugggauacucggaucacggaggaugaucuucagaacgaggccaaaauaaccgacauaauggagcccgaacacgcccuauuggccacuuccauauuuaagcuaaccuaccagaacaaagucguacgcguccagcgcccagccaaaaacggcacggucauggacguaauuagccggagagaccagaggggcagcggccaagugggaaccuacggucugaauaccuucacuaacauggagguccagcugauccgccaaauggagucugagggcaucuuccuccccagcgagcuggagacaccaaaccuggccgagcgagugcucgacuggcuugagaagcacggggccgagagacugaaacguauggccaucuccggcgacgacugcgugguaaagcccaucgacgaccgcuucgccaccgccuuaaccgcgcugaacgacauggggaaggugcggaaggacaucccacagugggagcccagcaagggcuggaacgacuggcagcaggucccguucugcucccaucacuuccaucagcugauuaugaaggauggccgcgagauuguagugcccugccggaaucaagaugagcucgugggaagggcccggguaagccagggcgccggguggucccuccgggaaaccgcuugccugggcaagagcuacgcccagauguggcaacucauguauuuccacaggcgagaccugcggcuggcggccaaugccaucugcucugccgugcccguggauuggguccccacaagccgcacuacuuggagcauacacgcucaccaucaguggaugaccaccgaggacaugcucuccguguggaacagaguuuggauagaggagaacccguggauggaggacaagacgcaugucagcuccugggaggaggugcccuaccuggggaagcgcgaggaccaauggugcgggagccugaucgggcucacggcucgugccaccugggcgaccaauauccagguggccauuaaccaggucaggcgccugauugggaaugagaacuaccuggacuacaugacguccaugaagcgguucaagaacgagagugaccccgagggugcgcucugguga

SEQ ID NO: 23974 - RNA, 9879 nt, Artificial Sequence
  derived and/or modified CDS sequence (opt11) from DENV-1__KF973465__SS-prME
agcguaaccaugcugcucaugcuucugccgacggcccuugccuuucaucugacaacgcguggcggugaaccucacaugaucguaucuaaacaagaacggggcaagagccuccuauuuaagacaagcgccggcguaaacaugugcacccuuaucgccauggaccugggugaacucugcgaagacacaaugacguacaagugcccccagauuaccgaggccgagcccgacgauguggauuguuggugcaacgcuaccgacacguggguaaccuacgggaccugcagccagaccggcgagcaccggcgggacaagcgaucgguggcccuggcgccccacgucggcuuggggcuugagacucggacggaaacuuggaugucuucugagggcgccuggaaacagauccaacguguagagaccugggcuuuacggcaccccggguucacggugaucgcccuuuuccuagcgcacgcgaucggcaccaguaucacccagaaggggaucaucuuuauccugcugaugcucgucacccccaguauggccaugcgcugcgucggcaucgguaaucgggacuucguggaggggcuaagcggcgccacguggguggacguggugcuagaacacgggucuugugugaccaccauggccaaaaacaagcccacgcuugacauagagcugcugaagacggaggucaccaacccagcgauccuccgcaagcugugcauagaggccaagaucucuaacacgaccaccgauucccggugcccaacacagggcgaggccacccugguggaggagcaggacgccaauuuugugugcagacgaaccuucgucgaucgcggcuggggcaacggcugcggccuguucggcaaggggagccugcugacgugcgcuaaauucaagugcguaaccaagcucgaagggaagaucgugcaguacgagaaccugaaguacucaguaauuguaaccgugcauaccggcgaccagcaccaaguggggaacgaaaccacggagcauggcacuaucgcuacuaucacuccccaagcucccacaucugagauccagcugacagacuacggugcccucacccuggacugcagcccucggacgggccuggacuucaaugagaugguucucuugacaaugaaggagaaguccuggcugguccacaagcaaugguuucuggaccucccucugcccuggacauccggggccucuaccagccaggagacguggaaccgccaggaccuccuggugacguucaagaccgcacacgcgaagaagcaggagguggucguacugggaucucaggagggcgccaugcacaccgccuuaacuggagccacggaaauccagaccucaggcacgacuacgauauucgcaggucaccuaaagugucgguuaaaaauggacaaacuaacucuuaagggcaccuccuauguaaugugcaccgggagcuuuaaacuggagaaggaggucgcggagacgcagcauggcaccgugcuagugcagguaaaauaugaaggcacugacgcccccugcaagauacccuucuccacccaggaugagaagggggucacgcagaacggccgcuugaucacagcgaacccuaucgucacggauaaggagaaacccguaaacaucgagaccgaaccuccuuuuggggaaagcuacaucguggucggcgcuggugaaaaggcuuuaaagcucuccugguucaagaaggggucguccaucggcaaaauguucgaggccacggcacgcggggcgcgcagaauggccauucucggcgacacggcgugggacuuugguagcaugggaggcgucuucacaucugucgguaaacuuguacaccaagucuucggcacagcuuauggaguucuguucucuggcgucuccuggacgaugaagauagggaucggcauuuuauugacuuggcugggccucaacagccgcucaaccagccuguccaugacgugcauugccguggggaugguaacgcuguaccucggcgucaugguccaggcagacagcgguugugugaucaacuggaaggggcgggagcugaagugcggcucggggaucuucguaaccaaugagguccacaccuggaccgagcaauacaaauuucaggccgacagcccgaaacggcugagugcggccaucggcaaggcaugggaggagggggugugcgggauaaggucugccaccagacuagagaacauaauguggaagcagaucucgaacgaacugaaccacauccugcuggagaacgauaugaaguucacuguuguuguuggugacgcaaauggcauccucgcgcaggggaagaagaugaucagaccccagcccauggagcacaaauauuccuggaaguccuggggcaaggccaagaucauuggggcggacauccaaaauaccaccuuuaucaucgacgggcccgacaccccggagugccccgacaaccaaagggccuggaacauaugggagguagaggacuacggcuucgggaucuucacaaccaacauauggcugaagcuccgagacucauacacgcaaaugugugaccaccgguugauguccgcggcuauuaaagacuccaaggccgugcacgcugauaugggcuacuggaucgagagcgagaagaacgagacauggaagcuggcgagggccucguuuaucgaagugaagacguguacauggcccaagucccacacacucuggucaaacggagugcuggagagugagaugaucauccccaagaucuauggagggccgauaucccagcacaauuaccgacccggguacuucacucagacggccggucccuggcaccugggcaagcucgaguuagacuucgagcugugugagggcaccaccgucgugguggacgagcacugcgguaaccgcgggccgagccuccgaaccacgaccgucacuggcaagaucauucacgaguggugcugucguuccugcaccuugccgccuuugcguuucagaggggaagacgggugcugguacgggauggaaauccggcccgugaaggaaaaggaggagaaccucgugcgaucaauggucuccgccggcagcggugagguggauagcuucagucuugggauccuaugcgcuuccauuaugauugaggaagucaugcggucgagguggagccggaaaaugcucaugacgggcacccuggcuguguuucugcuacugaucaugggccagcugaccuggaacgaccucauaaggcugugcaucauggugggugcgaacgcgagcgaccgcaugggaaugggcaccaccuaucuagcccucauggccaccuuuaagaugaggcccauguuugcagugggguuacuuuuccgccgguuaaccagccgugaggugcugcugcucaccauugggcugucccugguagcgucaguggagcuaccgaacucccuggaggaacucggcgacggucucgccaugggcaucaugauguugaaacuucucacggaguuccagccucaccaacuguggaccacccuguuaagccugaccuucaucaaaacgacccugagucucgacuacgcuuggaagaccaccgcaauggcgcugagcauaaucucucuguuucccuuaugucuuagcaccacgucacagaagaccaccuggcugccgguccuccugggcaguuucgggugcaaaccgcugacaauguuccucaucacggaaaacaaaaucuggggucggaaguccuggccgcugaacgaggggauuauggccauaggcaucguaagcauucuccucucgagccuguugaaaaacgacguccccuuagccgggccucuaaucgccggugguaugcuaaucgccuguuacgugaucucuggguccagcgcggaccucucauuggagaaggccgccgaggugagcugggagcaggaggcagagcauagcggcacaagccauaacauacuggucgaagugcaggacgacggaacaaugaagauuaaggacgaggagcgcgaugacacccucacgauccuccugaaggccacgcuccuggccgugucuggggucuaucccaugagcauccccgccacccuguucguuugguacuucuggcaaaagaagaagcagcggucgggggugcucugggauacccccagcccgcccgaggucgaacgcgccguccucgacgacggcaucuaccggauccuucagcgcggucugcucggacggagucagguagggguggggguuuuccaggacggcgucuuccacacgauguggcacgucacccgcggggccgugcugauguaccaggguaagcggcuggaacccagcugggccucgguuaagaaagaccuuauuucuuacggugguggguggcgcuuccaggggaguuggaacacaggugaggagguucaggugauugcgguagagccggggaagaacccgaagaacguccagaccaccccuggcacguuuaagacucccgaaggugaggugggggccauugcccuagacuucaaacccggcacgagcggcagucccauagugaaccgggagggcaagaucguuggcuuguacgggaacggcguggugacgaccagcgggacuuacgucuccgccauagcccaagcgaaggcuagccaggaaggcccccuccccgaaaucgaggaugagguauucaagaaacgcaaccugacaaucauggaucugcacccggggagcggcaagacgcggagguaucuccccgccauagugcgagaggccaucaaacguaagcugagaacccucauccucgcgcccacuagggucgucgcauccgaaauggccgaggcacugaaaggcaugcccauccgcuaccagacaaccgcugucaaaagcgagcacaccgggagggagauugucgaccugaugugccacgcgaccuucaccaugcgccuccuguccccgguaagggugcccaacuauaacaugauuaucauggacgaggcgcacuuuacggaccccgccagcauagccgcacgcggcuauaucuccacgagaguugggaugggcgaagcggcugcaaucuucaugacagccacgccacccggcaguguggaggccuuuccucaguccaacgcggugauacaggacgaggagcgcgauauccccgagcggaguuggaauagcggcuaugacuggauuacagacuuccccggcaagaccguuugguucgugcccucaaucaagucagggaaugauauugcuaacugccugcgcaaaaacggcaagcgcgugauccagcuaagccggaagacguucgauacugaguaccaaaagacuaagaacaacgacugggacuacguggugaccacagacaucuccgagaugggggccaacuuccgggccgaccgagugaucgacccccggcguugccuaaagcccgucauccuuaaggacggccccgagcggguaauuuuagcggggccuaugcccgugacugucgcgagcgcugcccagcgccggggccgcaucggccggaaucagaauaaggaaggggaucaguacgucuacaugggccagcccuugaacaacgacgaggaucaugcgcauuggacggaagcaaagaugcugcucgacaacauuaacaccccagaggggaucaucccggcuuuguucgagccagagcgugagaaguccgccgccauugauggcgaguaccgccuccgcggggaggcccgcaagaccuucguugagcuuaugcggcgcggcgaccuacccguguggcuaagcuacaagguggcgucugagggcuuucaguauuccgaucggcgcuggugcuucgacggggagcggaacaaccagguguuagaggaaaacauggauguggaaauauggaccaaggagggcgagcgcaagaaacuaagaccccgcuggcuggacgcccggaccuauuccgacccacucgcacuucgcgaguucaaggaguucgccgcugggcggcgcuccguaagcggcgaccugauccuagagaucggcaagcugccccagcaccugacgcucagagcccagaacgcccuggauaaccuggucaugcuccacaacuccgaacagggagggaaggccuacaggcaugccauggaggagcuuccagacaccaucgagacucugaugcuccuggcguuaaucgccguauugaccgggggugugacacuguucuuucugagcgguaagggccucggcaaaaccuccaucgggcugcugugcgucaccgccaguuccgccuugcuguggauggccagcguagaaccccauuggaucgcggcuucuaucauucuugaguucuuucugauggugcugcugauuccggagcccgaccgucagcgaacgccucaagauaaccagcucgccuacgucgugaucggcuuacucuuuaugauuuuaacgguggccgcaaacgaaauggggcugcuggagacuaccaaaaaggaccucgggauaggccaugucgcagcagagaaccaccaacacgccaccaugcuggacguggaucuucgaccugccagugccuggacguuauacgcgguggccacaacugucaucacacccaugaugagacacacgaucgagaacaccacagcuaacaucagucucaccgccauugcgaaccaagccgcgauccucaugggacucgacaaggguuggcccaucucgaagauggacaucggggugccccugcucgcccucggcugcuacucccaggugaacccccuuacgcugacagccgcgguccuuauguuaguggcucacuacgcuaucauaggccccggccuucaagcaaaggccacccgggaagcgcaaaagcgcaccgccgccggaauaaugaagaacccgacaguggacgguauugucgcgaucgauuuagauccuguugucuacgacaccaaauucgagaagcaacugggucagauaaugcuccucauccugugcaccagccagauccuccucaugcggaccacgugggcccugugcgaguccaucacccuugccacggggccccucaccacccucugggagggaagcccagguaaguucuggaacacaaccaucgccgucuccauggccaacauuuuccggggcagcuaucuggcuggcgccggguuggcuuucucccuuaugaagaguuuaggcgggggucgcaggggaaccggggcccagggugagacguuaggggagaaguggaagcgccagcugaaccaacuguccaagucugaguuuaacaucuacaagcgguccgggaucauggaaguggaccgcucagaggccaaggagggccugaagcggggcgagacgacaaagcacgccgucagucgcgggaccgcgaagcugcgaugguucgucgaaagaaaccuggugaagcccgagggaaagguaaucgaccucggcugcgguaggggcgggugguccuacuauugcgcgggccucaaaaaggucacagaggugaagggcuauacgaaagggggccccggacacgaggagccuauacccauggcgacauacggcuggaaccuggugaagcuccauucgggcaaggacgucuucuucaugccgcccgaaaagugugacacccuccugugcgauaucggagaguccagcccgaaccccaccauagaagaagggcgcacgcugcggguacucaagaugguggagcccuggcuacgcggcaaccaguucugcauuaagauccugaaccccuacaugccgagcgucguagagacucucgaacagaugcaacguaaguauggcgguaugcugguucgcaacccccugagccggaacucgacccacgagauguacugggucagcuguggcaccggcaacaucguguccgccguaaauaugacgagccgcaugcuccugaaucgguucaccauggcacaucgcaagccgacuuacgagagagacgucgauuugggcgcuggcacucgccacguggccguugagccagaggucgcaaaucucgacaucaucggacaacgaaucgagaacaucaaaaacgaacauaagucaacauggcauuacgaugaagauaaucccuacaagaccugggccuaccacggaaguuacgagguaaagcccuccggcagcgccuccuccauggugaauggcguagugcggcugcuaacuaagcccugggacgugaucccuauggugacacagaucgcgaugacugacaccacaccguuugggcagcaacgcguuuuuaaggaaaagguugacacccgcacgccccgcgcgaagcggggaaccacccaaaucauggaagugacagccaaguggcucuggggcuuccuguccaggaacaaaaagccacggaucugcacuagagaggaguucacgcggaaaguaaggaguaaugccgcaauaggggcgguguucguggacgagaaucaguggaacagcgcgaaggaggcugucgaggacgagagauucugggaccucguacgccgggagagagagcuccacaagcaggguaagugcgcaaccugcguuuacaacaugauggggaagagagagaagaaguuaggcgaguucgggaaggccaaggggucccgcgccauaugguauauguggcugggcgcacgguuccucgaguuugaggccuugggguucaugaacgaggaucacugguucucgcgcgagaacucccucucagguguggaaggcgagggccuucacaaacuuggguacauccugcgcgacauuucgaagauaccaggcggcaacauguacgcggacgacacggcgggaugggacacgcgcauaaccgaggacgaccuccaaaacgaagccaagauaaccgacaucauggagcccgagcacgcgcuucuggcuaccagcauuuucaaacucaccuaccaaaacaaggucgugcgcguucaacggcccgccaaaaaugggaccgucauggacgucaucucccggcgugaucagcgcgggagcggccaggugggcacauaugggcugaacaccuucacgaacauggaagugcagcugauucggcagauggaguccgagggcauuuuccuccccagugaacuggagaccccgaaccuugcggaacgcguuuuggacuggcucgagaaacacggggccgagcggcugaagcgcauggcuaucuccggcgacgauugcguagucaagcccaucgacgaccgguucgccaccgcgcucaccgcgcuuaacgacauggggaaagugcgcaaggacaucccgcagugggagccuaguaagggauggaaugacuggcagcagguaccuuucuguucccaucacuuccaucagcugaucaugaaggacggaagggagauaguaguuccuugccggaaccaggaugagcucguagggcgcgcccgcguaagccagggugccgguuggucccugagggagacggcgugcuuaggcaagagcuaugcgcagauguggcagcuaauguacuuccacagacgggaucuccgacuggcggccaaugccauuuguagugccgugccuguggauuggguccccaccagccggacuaccugguccauccacgcgcaucaccaguggaugacuacagaggacauguugucaguguggaaucgcguguggaucgaagagaacccguggauggaagacaagacccacgucagcuccugggaggaggugcccuaucuggggaagagagaggaccaguggugcggcagcuuaaucggccucaccgcccgggcuacgugggccaccaacauccagguugccauaaaccagguccgcagauuaauugguaacgagaacuaccuggauuacaugaccuccaugaagcgcuuuaagaacgagucugacccagaaggagcccucugguga

SEQ ID NO: 23975 - RNA, 9879 nt, Artificial Sequence
  derived and/or modified CDS sequence (opt11) from DENV-1__KF973466__SS-prME
uccgugaccaugcugcucauguugaugcccaccgcccuggccuuccaccucacgacccgcggcggggagccgcacaugauugucuccaagcaugagcggggcaaggcgcuccuguucaagaccagcaccgggguuaacaugugcacgcucaucgccauggaucugggcgaacugugcgaggacaccaugaccuacaagugcccccgcaucaccgaagccgagcccgaugacguggacugcugguguaacgcgacggacaccuggguuacuuaugggacgugcucccagacgggcgagcaccggcgagacaagaggucgguugccuuggcgccccaugugggccuggggcuugagacccguaccgagaccuggauguccagcgagggagccuggaagcaaauccagcgggucgagaccugggcacuucgccacccgggauucaccguaaucgcccuguucuuagcucacgccaucggcaccuccaucacccagaaaggcaucaucuucauccuccugauguuagugacgcccagcauggcgaugcggugcgucggaaucggcaaccgcgauuucguggagggacuauccggcgcaacguggguggaugucgugcuggagcacgguagcugcgugaccacuauggccaagaacaagcccacgcuggacauugagcuccugaaaaccgaggucaccaaccccgcgguucugcgaaaauugugcauagaggccaaaauauccaacacgaccacugacucgaggugcccgacccagggcgaggccacucugguggaggaacaggacgccaacuucgucugccggcgcacguucguggaccggggcugggggaacggaugcgggcuguucgggaaggguucccuucugaccugcgccaaauucaaaugcgugaccaagcuggagggcaagauuguccaguacgagaaccucaaguacagcgugauagugaccguccacacaggcgaccagcaccagguggggaacgaaaccaccgagcauggcacuaucgcgaccauaacgccccaggcccccacauccgagauccagcugaccgauuacggggcucugacccuagauugcagcccccggacuggccuggacuucaaugagaugguccugcucacaaugaaggagaaguccuggcuggugcacaagcagugguuccuagaccucccgcugcccuggaccagcggagccuccaccagccaggagacauggaaccggcaggaucuccucguaaccuucaagaccgcccacgcgaagaaacaggaggucguagugcugggcagccaggagggcgccaugcauaccgcucugacgggggccaccgagauccagacguccgggaccacuaccauauucgccgggcaccucaaaugccgccugaaaauggauaaguuaacauuaaaaggcaccagcuaugucaugugcacgggaucuuucaagcuggagaaggagguggcggagacccagcacggcaccgugcucguucaggugaaguacgagggcaccgacgcccccugcaagauaccuuucagcacgcaggacgagaagggggugacccagaacggccggcugaucacggccaaucccauugucaccgacaaggagaagcccgugaauaucgagacggagccacccuuuggggaguccuacaucgucguaggcgccggcgagaaagcgcucaagcugagcugguucaagaaaggauccagcaucggcaagauguucgaggccaccgcccgcggggcccggcguauggcgauucucggcgacaccgcgugggacuucggcuccauaggcgguguauucaccagcguggggaaauuaguccaccagguauucggcacggccuaugggguacuguuuuccggcgucagcuggacaaugaaaauugggaucggcaucuuacucacguggcugggcuugaacucccgcagcacgucccucucaaugacguguaucgccguggggauggugacguuauaccugggcgucaugguucaggccgacuccgggugcguaauuaauuggaagggccgggagcucaagugcgggagcggcaucuuugucacuaacgaggugcacaccuggaccgagcaguauaaguuccaggcugacuccccgaagcgccugagcgcggccaucggcaaggccugggaggagggggugugcggcauaaggagcgccacccgccuggagaacauuauguggaagcagaucuccaacgagcuuaaccacauccugcuugagaacgacaugaaguucaccgucguggugggggaugcuaacggcauccucgcgcaagguaagaagaugauccggccccaacccauggagcacaaguauagcuggaagucuugggggaaagcgaagaucaucggcgccgacauucagaauaccacuuucaucaucgacgggcccgauacgccggagugccccgacgaccagcgcgccuggaacaucugggaagucgaggacuacgguuucgggaucuucaccacuaacauauggcugaagcugcgggacagcuacacccagaugugcgaccaccgccucaugucagcggccaucaaagacagcaaggccgugcacgccgacaugggauacuggaucgaguccgagaaaaaugagacuuggaagcuggcccgggccagcuuuauugaagugaaaaccugcaccuggcccaaaucgcacacccuguggagcaacggcguccuugaguccgagaugaucauccccaagaucuacggaggcccgaucucccagcacaacuacagaccgggguacuucacgcaaaccgccggccccuggcaucugggaaaacuagaguuagacuucgaccugugcgaggggaccaccgugguggucgacgagcacugcggcaaccgggggccgucauugcgcacgaccaccguuaccgggaaaauaauccacgagugguguugcaggagcugcacccuaccaccccugcgguucagaggggaggacggaugcugguacgggauggagauccgccccgugaaggagaaggaggagaaucugguacggaguauggugagcgcaggcuccggcgagguagacagcuucucucucgggauccugugcgucuccaucaugaucgaggagguuaugcgcagccgcuggucccgcaagaugcugaugaccgggaccuuagccguguuccuacugcuuaucauggggcagcugacauggaacgacuugaucagacucugcaucauggucggagccaaugcgagcgaccgcauggggaugggcacgaccuaucuggcuuuaauggccaccuucaagaugcgcccgauguucgccgugggcauccucuuucggcgccucaccuccagggaggugcugcuacugacgauagggcuuagccucgucgccuccguugagcugcccaacagccuggaggaauugggcgacggccuggcgaugggcaucaugaugcugaaguugcugaccgaguuccagccccaccaauuauggaccacacucuugagccugacguucaucaagaccacucuaagccuggauuacgccuggaagaccacggcgauggcccuguccauugucaguuuauucccccugugccuguccaccaccagccagaagacgaccuggcucccgguacugcuggguuccuucggcugcaagccccuaacgauguuccugaucaccgaaaauaaaaucuggggccgcaagucauggcccaucaacgaggggauaauggcgauaggcauaguguccauccuguuauccucccugcugaaaaaugacguaccccucgcaggaccgcugauagccggcgguaugcugaucgccugcuacgucaucagcggcaguuccgccgaccuuagccuggagaaggcggccgaggugagcugggaacaggaggccgagcacagcggcaccucccacaacaucuuggucgaggugcaagacgacgggaccaugcggaucaaggaugaggaaaaggacgacacgcucaccauccugcugaaggccacccuccuggcugugagcggcguuuaccccauguccauccccgcgacccuguucgugugguacuucuggcagaagaagaaacagcgcagcggggugcucugggacacgcccuccccgcccgaggucgagcgggcugugcuggacgacggcaucuaccgcauccugcagcggggccuccuggggcgcagccaggucgggguugggguuuuucaggauggcguguuccacaccauguggcaugucaccagaggggcagucuuaauguaccagggaaagcgccuggagcccuccugggccucggugaagaaggaccucaucucauacggcggggguuggcgguuccaaggauccuggaacacaggcgaggagguccaggugaucgccguagagcccgggaaaaacccgaagaacguucagacaacccccggcacuuucaagacuuccgagggcgaggugggggcgaucgcccuggacuucaagccgggcacgagcgggucccccaucgugaaucgcgagggcaagauagucggccuguacgggaauggcgugguaaccaccucugggaccuacgucuccgcaaucgcccaggccaagaccagccaggagggcccgcuccccgaaaucgaggacgagguguuuaagaagcggaaucuuaccaucauggaccugcaucccgggagcggcaagacccgccgauaccucccggcgaucgugcgcgaggccauuaagaggaaacugcgcacucugauccucgcccccacgcguguggucgccucagagauggcggaggcccugaaaggcaugccgauuagauaccagaccaccgccguaaagagcgagcacaccgggagagaaauugucgaccucaugugucacgcgaccuuuaccaugcggcuccuguccccagugcgcgugccgaacuacaacaugaucauuauggacgaggcccacuuuaccgacccggcgagcaucgccgccaggggcuauaucucuacccgcgucgggaugggcgaggccgccgcgaucuuuaugacggcuacaccacccggaagcguggaggccuucccgcaguccaacgcggugauccaggacgaggagcgcgacauccccgagcgcagcuggaacuccggcuacgacuggaucaccgacuuccccggcaagaccgucugguuuguucccagcauuaaguccgggaacgacaucgccaacugccugaggaagaacggaaagagggugauccagcucucucggaagacguucgacacugaguaccagaagaccaagaacaaugacugggauuacgucgugaccacggacaucuccgagaugggggcgaacuuccgcgccgaccggguaaucgacccgagacggugccuuaagcccgucauccugaaagacgggcccgaacgcgugauccucgcagggcccaugccggugaccgucgccagcgcggcccagcggcgcggccggaucggucgcaaccagaacaaagagggggaccaguauguguacaugggccagccccugaacaacgaugaggaccaugcccacuggacugaggcgaaaaugcugcucgacaacauaaacacccccgaggggaucauccccgcucuuuucgagccggagcgcgagaaguccgcggcuaucgacggcgaguaccgacugcgcggggaggcccgaaaaaccuucgucgagcucaugcgccgaggugaccugcccguguggcugagcuacaagguggccagugagggcuuccaguacagcgaccgccggugguguuuugacggggagcggaacaaccagguccuugaagagaauauggacguggagaucuggacgaaagaaggcgagcgaaagaagcugcgcccccgguggcuagacgcccgcaccuacuccgacccccucgcguuacgggaguucaaggaguucgcagccgggcgacggagugugagcggggaccugauccuugagaucggcaagcugccgcagcaccugacccucagggcucaaaacgccuuggacaaccuggugaugcuccauaacuccgagcaaggggguaaggcguaccggcacgccauggaggagcugccggacaccaucgagacucugaugcuccuggccuuaaucgccguccucaccgggggcgugacccuguucuuccugagcgggaagggccucggcaagaccuccaucgggcugcugugcgucacggcgagcuccgcccuccucuggauggccagcguggagccccacuggaucgcugccagcaucauccuggaguucuuccucaugguucugcugauccccgagccggaccgucagcgcacaccccaggacaaccaacucgcguacguugugauuggccugcuguucaugauccucaccguggccgccaacgagauggggcuucuggaaaccacgaagcgagaucucggcaucgggcaugucgcagccgaaaaucaucagcacgcgaccaugcuggacguggaccugcggccggccagcgccuggacccucuacgcuguggcgaccacgguaaucacgccgaugaugcgccacaccaucgagaacaccacggcgaacaucucccugaccgcgaucgccaaccaagcagcgaucuugaugggccucgacaagggauggcccaucaguaagauggacaucggagugccccugcuugcgcuaggcugcuacucccaagugaacccccugacccugaccgccgcuguccucaugcugguggcccauuacgcgaucaucgggccuggccugcaggccaaggccacgcgcgaggcccaaaaacggacagccgcgggcaucaugaagaaccccaccguggacggcauugucgccaucgaccuggaccccguaguguacgacgccaaguucgagaaacagcuggggcagaucaugcugcucauccugugcaccagccaaauccuacucaugcgcacgaccugggcccugugugaguccaucacccuagccaccgggccacucacgacgcuaugggagggcagcccggggaaguucuggaacaccacuaucgcggucaguauggccaacaucuuccggggcucguaccuggccggcgcgggguuggcuuucucccugaugaaaagccugggcgggggccgccgggguacaggugcgcaaggagagacccucggggagaaguggaagcgccagcuaaaucagcuauccaagccugaguucaacaccuacaagcgguccggcaucauggagguggaccgcucugaggccaaggagggacucaagagaggggagaccaccaaacacgccguaagccgggguacggccaaacuucggugguucgucgagagaaaccuggugaaacccgaaggcaaggugauagaccucgggugcggucggggcgggugguccuacuacugcgcgggacugaagaaggucaccgaggugaagggguacaccaagggcgggccaggccacgaggagccuauaccaauggccaccuacggcuggaaccugguuaagcugcacuccgggaaggacgucuucuucaugcccccggagaagugcgacacgcuccugugcgacaucggcgagagcuccccgaacccaaccaucgaagaggggcgcaccuuacgggugcucaaaaugguggagcccuggcugcgcgguaaccaguucuguauaaagauccucaaccccuauaugccgagcgucguagagacccucgaacagaugcagcggaagcauggugggaugcuggugcgcaacccacugucccgcaacucuacgcacgagauguacugggucuccugcggcaccgggaacaucgugagcgcggugaacaugaccucccgaaugcuccuaaaccgcuucacaauggcccaccggaagcccacguacgagcgugacgucgaccucggcgccggcacccggcacgucgccguggagcccgaggucgcgaaccucgacauuauugggcagcgaaucgagaacaucaagaaugagcacaagagcaccuggcacuacgacgaggacaacccguacaagaccugggccuaucacggcuccuacgaggugaagcccagcgggucugcuaguucgauggugaacggcguagugcgguugcugacgaagccaugggacgucauccccauggugacccagaucgccaugaccgacaccacgccauucgggcagcagcgcguguuuaaagaaaaggucgacacccggacuccccgggcuaagaggggcacuacgcagauaauggaggugaccgccaaguggcucuggggcuuccugagucgcaauaaaaagccccggaucugcacccgcgaggaguucacccggaaggugcgcagcaacgccgcuaucggggccgucuucguggacgaaaaccaguggaauagcgcgaaggaggccguggaggacgagcgguucugggaccucguccaucgcgagcgggagcuccacaagcaaggcaaaugcgcgacgugcguguacaacaugauggggaagcgcgagaagaaacucggcgaguucgggaaggccaagggcagccgcgcgaucugguacauguggcugggcgcccgcuuccucgaguuugaggcgcugggguucaugaacgaagaccacugguuuucccgggagaacagccuuuccgguguggagggagaagggcuucacaaguugggauauauccugcgugacauuagcaagauaccgggcggcaacauguacgccgacgacacugcugggugggacacccgcaucacggaggacgaccuccagaacgaggcgaagaucacugacaucauggagcccgaacacgcccugcuggccaccuccaucuucaagcucaccuaucagaacaaggucgugaggguacagcgcccugcaaagaacgggaccgucauggacgucaucagucggcgggaccaacgaggguccggucagguuggaacuuacggacugaacacuuucacuaacauggaaguccagcugauccgccagauggagagcgaaggcaucuuccuaccguccgagcuggagaccccgaaccuggccgagcgcgugcucgacuggcuggagaaacacggggcggaacgccugaagcggauggcuaucagcggcgaugauugcguggucaagccuaucgacgaccgcuucgccacagcacucacggcccugaacgacauggggaaggugaggaaggacaucccucagugggagcccuccaagggauggaaugacuggcagcaagugccguucugcagccaccacuuccaccagcugaucaugaaggacggccgcgagaucguugugcccugccggaaccaggacgagcuuguggggcgcgcgcgggugucccagggcgccggguggagccugcgcgagaccgccugccugggaaaaagcuacgcccagauguggcagcucauguacuuccaccggcgcgacuuacgguuggcugcgaacgccaucugcagcgccgugcccguggauuggguccccaccucccgcaccacguggucgauacacgcccaccaccaguggaugaccaccgaggacaugcucagcguguggaaucgcguauggaucgaggagaaccccuggauggaggacaagacccacgucucuaguugggaggaggugcccuaucuggggaagcgggaggaccaguggugcgggucacugauuggccucacggcgcgcgcaaccugggccaccaacauccagguggccaucaaccagguacggcgccugaucggaaacgagaacuaccuggacuacaugaccaguaugaagcgguucaaaaacgaauccgacccugagggcgcccucugguga

SEQ ID NO: 23976 - RNA, 9879 nt, Artificial Sequence
  derived and/or modified CDS sequence (opt11) from DENV-1__KF973471__SS-prME
agcgugaccaugcugcucaugcugcugcccaccgcauuggccuuucacuugaccacccggggcggggagccccacaugaucgugucuaagcaagagcguggaaagagcuugcuguucaagaccagugccggggugaauauguguacccugaucgcgauggaucucggagagcucugcgaggacacgaugaccuacaagugcccccagaucaccgaggccgagcccgaugacguugacugcuggugcaacgcuaccgacacgugggugaccuacgggaccugcagccagaccggcgagcaucggcgggacaagagauccguggcucuggcgccacacgugggcuuggggcucgagacccggaccgaaaccuggaugagcagcgagggcgccuggaaacagauucagcgcgucgagaccugggcccugcgccacccaggguucaccgucaucgcccuguuucucgcgcacgccaucggcaccagcaucacccagaaaggcaucaucuucauccugcugauguuagugacccccucaauggccaugcgcuguguagguaucggcaaccgggacuucguggagggucugagcggcgccacguggguggacgucgugcuggagcacggguccugugugaccacuauggccaagaacaaacccacccucgauaucgagcugcugaagacggaggucaccaaccccgcgauccucaggaaacuguguaucgaggccaagaucagcaauaccaccacggacucacggugccccacacagggcgaggccacccugguggaggagcaggaugcaaauuuugugugccgcaggacuuucgucgacaggggcugggggaacggcugcggccucuuugguaaggggagccugcugacgugugccaaguucaagugcgugacuaagcucgagggcaagaucgugcaguaugagaaccuaaaauauuccguaaucgugaccguucacaccggggaccagcaccaggucgggaaugaaacgaccgagcauggcacaaucgcgacaaucacgccccaggcccccacgagcgagauccagcuaaccgacuacggggcccucacccucgacugcucuccccggaccggccuggacuuuaacgagaugguacuccugacgaugaaagagaaguccuggcugguccacaagcagugguuucucgaccugccccugcccuggaccuccggggccucgaccagccaggagaccuggaaccgccaggacuugcuggugacguucaagaccgcgcacgcgaagaagcaggaggugguuguccugggcucacaggagggcgcgaugcauaccgcccucaccggggccacggagauacagaccagcggcaccaccacgaucuucgccgggcaccuaaagugccggcugaagauggacaagcucaccuuaaagggaaccuccuacgugaugugcaccgggucuuucaaguuggagaaggagguagcugagacucagcacgguaccgugcuggugcagguaaaauacgagggcaccgacgcccccugcaagauccccuucuccacccaggacgagaagggggugacgcagaacggacgcuugaucaccgcaaacccgaucgugaccgacaaggagaaacccgucaauaucgagaccgagccgccguuuggggagagcuacaucguggugggcgccggcgagaaggcgcugaagcucuccugguucaagaaggggagcuccaucggcaagauguucgaggccaccgcacgcggggcccggcggauggccauucucggcgacaccgcgugggacuucggcagcauaggcggagucuucaccuccguugggaagcuggugcaucaggucuucggcaccgccuacggggugcuauucagcggcguguccuggacuaugaaaaucgggaucggcaucuuacugacaugguuaggccucaacagccgcuccacgagccuguccaugaccugcaucgccgucgguauggugacgcuguaccuaggggugaugguccaggccgauagcgggugcgugaucaauuggaagggucgcgagcugaaguguggguccggcauuuucgugaccaacgagguccacaccuggaccgagcaguacaaguuccaagccgacagcccgaagcggcugagcgcggccaucggcaaggccugggaggaggggguuugcggcauucggagugccacccggcucgagaacaucauguggaagcagaucagcaacgagcugaaccacauccuguuagaaaacgacaugaaguucacggucgucgucggggacgccaacggcauccucgcccagggcaagaagaugauccgcccccagcccauggaacacaaguacuccuggaaguccuggggcaaggccaagaucaucggcgccgacauccagaacaccaccuucaucaucgaugggcccgauaccccugagugucccgacaaccaacgggccuggaacaucugggaggucgaggacuacgguuucggaauauucacgaccaacaucuggcugaaacuccgcgauucuuacacucaaaugugugaccaccggcugaugucugcggccaucaaggauuccaaggccguccacgccgacaugggcuacuggaucgagucugaaaagaacgagacauggaaacuagcccgcgcguccuucaucgaggugaagacgugcaccuggccaaaaagccacacccucuggucuaacggggugcuggagagcgagaugaucauacccaagaucuacgggggcccgauuucccaacacaacuaccggcccggguacuucacccagacggccggcccuuggcaccuggggaagcucgagcuggauuucgaucugugcgagggcaccaccguggugguggacgaacacugcggaaaccgcggcccgucucuccggacaacgaccgucaccggcaagauaauacacgagugguguugccgcuccugcacccugccgccuuugcgguuccgcggagaggacggcugcugguacgguauggagauccgaccagugaaggagaaagaggagaaccucgugcgcagcauggucucggccggcagcggagagguggacagcuucucccuggggauccuaugcgcaagcauuaugaucgaggaagugaugcggucccguuggagccggaagaugcuuaugacgggcaccccggccguguuucuguuguuaaucauggggcagcugaccuggaacgaccugauccgcuuauguaucauggugggcgcgaacgcauccgaccguaugggcaugggcaccacguaccuggcccugauggccaccuucaaaaugcguccaauguucgccgugggccuccuguuccgccgccugaccagccgcgagguccuccugcugaccaucggacucaguuugguggcaagcguggagcugcccaauuccuuagaagaacuuggcgacgggcuggccaugggcauuaugaugcucaagcuguugacggaguuccagccccaucaguuauggacaacccugcugucucucaccuucaucaagaccaccuuaucccuggacuacgccuggaagaccacggccauggcguuaagcaucaucagucuguucccgcucugucucagcacaaccagccagaagaccacguggcugcccguccuguugggcagcuucggcugcaagccauugaccauguuucugaucacggagaacaaaauuugggggagaaagagcuggccccucaacgaggggauuauggcgauugggaucgugagcauccugcuuagcucucuucugaagaacgacgucccgcuagcugggccccucaccgccgggggcaugcugaucgcuugcuacgugaucuccggguccagcgcggaucugucccucgagaaggccgccgaggugucgugggagcaggaggccgagcacuccgguacgucgcacaacauccuggucgagguccaggacgacgggaccaugaagaucaaggaugaggagagggacgauacgcugacaaucuuacugaaggcaacccugcucgcgguguccggcguguaccccaugucgauucccgccacccuguucgugugguacuucuggcagaagaagaaacagcgguccggggugcugugggacacgccauccccgcccgaggucgagagagccgugcucgacgacggcaucuaccggauccuacagcgcggccugcuggguaggucacaggugggcguggggguguuccaggauggcguguuccauaccauguggcacgucaccagaggggcagugcucauguaccaggggaagcggcuggagcccucgugggcgucggugaagaaggaccugauuuccuauggcgggggcuggcgcuuccaggggucguggaauaccggcgaggagguccaagugauagcgguggagccggggaagaaccccaagaacguccagacgacccccggcaccuucaagacccccgagggcgaggugggggccauugcccucgauuucaagccgggcacuagcgggucccccaucgucaaccgggaggggaagaucgucggccuguacggaaacggcguagucaccaccagcgggaccuaugucagugccaucgcgcaagcgaaggccagccaggagggcccccugccggagaucgaggacgagguguucaagaagaggaacuuaacgaucauggaccugcaccccgggaguggcaagacccggcgcuaccugcccgccaucgugcgggaggccaucaagcguaagcuccggacccugauccuggcuccgacacgcguuguagcgucagagauggccgaggcucucaagggcaugccgauccgcuaccagacgacagccgucaaguccgagcacaccggccgggaaauugucgaccuaaugugccacgcuacguucacgaugcgccugcucucccccgugcgcgugcccaacuacaacaugauaaucauggaugaggcccacuuuaccgacccagcgagcauagccgcuagagguuauaucuccacccgggucgggaugggcgaggccgccgccaucuucaugacugcgacgccgccagggucaguggaggccuucccgcaguccaacgcugucauccaggacgaggagcgcgacauucccgagcggagcuggaacuccggcuacgacuggauaacagacuucccgggcaaaaccguaugguucgugcccagcaucaagucagggaacgacaucgccaacugccugcgcaagaacggcaagcgggugauccaacugagccgcaaaacuuucgacacggaauaucaaaagaccaagaacaaugauugggacuacgucgugaccaccgacaucuccgagaugggggccaacuuucgggccgacagagugaucgacccccggcgcugccucaagcccgucauccuuaaggacgguccggagcgggugauccuggcggggcccaugccuguaacagucgcaagcgccgcgcaacgccggggccgaaucgggcggaaucagaacaaggaaggggaccaauacguguacaugggccaaccccucaauaacgaugaggaccacgcccacuggaccgaggcgaagaugcugcuggacaauauaaauacuccggaagggaucaucccggcucucuucgagcccgagcgcgagaaguccgccgcaaucgauggcgaguaccgcuuacgcggggaggcccgcaaaaccuucguagagcuuaugcggcgaggcgauuuacccgucugguugagcuauaagguggcgucagagggcuuccaguacagcgaccggcgcuggugcuucgacggggaacggaacaaccagguccuagaggagaauauggacguggagaucuggacgaaggagggggaacgcaagaagcuccggccgcgcuggcuggacgcccggacguacucugacccacuggcccuccgcgaguucaaggaguucgccgcggggcgccgcagcgugagcggcgaucugauccuggaaauaggcaaacucccccagcaucugacucugcgggcccagaaugcccuagauaaccuggucaugcugcauaacuccgagcaaggcgguaaggcuuaccgucaugccauggaggagcuccccgacaccaucgagacccugaugcugcuugcgcugaucgccgugcugaccggcggagugacccucuucuuccugagcgggaagggguugggcaagaccuccaucgggcuccugugcguuaccgccagcucugcccugcucuggauggccagcguugagccgcacuggaucgcggccuccauuauccuggaguucuuccugaugguccuccugauccccgagcccgaccggcaacgcacgccgcaggauaaccaguuagccuacgucgugauaggccuccuguucaugauccugacaguggcggccaacgagaugggguuacuggagaccaccaagaaggaccugggcaucgggcacgucgcggccgagaaccaccagcacgccacgaugcucgacguggacuuacggcccgccagcgccuggacccuguaugcgguggccacaaccgucaucacgcccaugaugcgccauacuaucgaaaacacuaccgccaacauuucgcucacggcgaucgccaaccaagcggcuauccugaugggccucgacaagggcuggccaaucagcaagauggacauuggggugccgcuccuggcccugggcugcuacagccaggugaaucccuugacucucaccgccgcaguccugaugcugguggcucacuacgccauuaucgggcccggucugcaggccaaggcaacgcgagaggcacagaagcggacggccgcggguaucaugaaaaaccccaccguggauggcaucgucgccaucgauuuagacccggugguguacgacaccaaguucgagaagcagcucggccagaucaugcugcugauccucugcaccagccagauccugcucaugcgcacaaccugggccuugugcgagagcauuacccuggcgaccgggccacugacgacccucugggaaggcagcccagggaaguuuuggaacaccaccaucgccgucaguauggccaacaucuuccggggcucguacuuagccggcgccgggcuggcguucucgcucaugaagucccugggcgggggucgucgggguacuggcgcccagggggagacccugggggagaaguggaagcgccagcucaaccaacuuaguaagagcgaguucaacaucuacaagcggucuggcaucauggagguggaccgcuccgaggccaaggaggggcucaagagaggcgagaccaccaagcacgcugugucacgcgggacugcgaaguugcggugguucguggagcgcaaccuggucaaacccgagggaaaggugaucgaccugggcugcgggcguggcgggugguccuacuacugcgcgggccugaagaagguuacggaggugaagggguacacaaaaggcggcccgggccaugaggagccuauccccauggcaaccuacggcuggaaccuugugaagcuccacucggggaaagacgucuucuucaugcccccggaaaagugcgauacacuguuaugcgacaucggcgaguccucacccaauccaacgguggaggaggggcguacccugcgagugcugaaaaugguugaacccuggcuuaagggcaaccaguucugcaucaagaucuugaacccguacaugcccuccgugguggagaccuuagagcagaugcagcguaaguacggcgggaugcucguccggaacccccugagccgcaacuccacccacgaaauguacugggugaguugcggcacggggaacaucgugagugccgucaauaugaccagcaggauguuacuaaaccgcuucaccauggcccaucggaagcccaccuacgaacgcgacguggaccuuggcgcgggcacgcgccacguggccgucgaaccagagguugccaaccuggacaucaucgggcagaggauagagaacaucaaaaacgagcacaaguccaccuggcacuacgacgaggacaaucccuacaaaaccugggccuaccacggcagcuacgaggugaagcccuccgggagcgccucgagcauggucaacggcgugguacgccuucugaccaagcccugggacgucaucccgauggugacucagaucgcgaugacggacaccacccccuucgggcagcagcgcgucuucaaggagaaaguggacacgcgcacgccccgcgccaagcgcggcaccacccaaaucauggaggugacagccaaguggcuguggggcuuccucucccgaaacaagaagccgcgcaucugcacccgagaggaauuuacaaggaagguccgaagcaacgccgccaucggggcgguguucgucgacgaaaaccaauggaacagcgcuaaggaggcagucgaagacgagcgcuucugggauuuggugcaccgggagagagagcugcauaagcagggcaagugcgcgaccugcguguacaacaugauggggaagcgggaaaagaagcucggcgaguucgguaaggcaaaggggucccgagcaaucugguacauguggcugggcgcccgguuccucgaguucgaggcccucggauucaugaacgaggaccacugguucagcagggagaacucccugagcggcgucgagggcgaggggcugcacaaacucggguacauccugcgggacaucuccaagaucccugggggcaacauguacgccgacgacacggcgggcugggacacccgcauaaccgaggaugaccuccagaacgaggccaagaucaccgacaucauggagcccgaacacgcccuccuugcgacguccaucuuuaagcucaccuaccagaacaagguagugcggguccagaggccggccaagaacggcaccgugauggacgugauuucccgccgggaccaaagggggagcggccaggugggcaccuauggucucaacacguucaccaacauggaggugcaacugauccggcagauggaguccgagggcaucuuucugccgagcgagcucgagacacccaaccuggcggaacgcguguuggacugguuggagaagcauggggccgagcggcugaagcgcauggccaucaguggcgacgacugcgucgucaaacccauagacgacagguucgccaccgcccugaccgcgcucaacgacauggggaagguucgcaaggacaucccccagugggagccgagcaagggguggaacgacuggcagcagguccccuucugcucccaccacuuccaccagcugaucaugaaagacggccgggagaucgucgugcccugccgcaaccaggacgaauuagucggacgggcccgcguuagccagggcgccgguuggucccucagagagacggccugccugggcaagagcuacgcccagauguggcagcugauguacuuccaccgccgggaccuccgccucgcggcgaacgccaucugcucagcggugcccguggacugggugccgaccagccggacuacuuggagcauacaugcgcaccaccaguggaugacgaccgaggacaugcuguccguguggaaccgcgucuggaucgaagagaacccuuggauggaagacaagacccacguaucauccugggaagaagugcccuaucucgggaagcgugaagaccaguggugcggcagccugaucggcuugaccgcucgcgccacaugggccaccaacauccagguagcaaucaaccaggugcgccggcucaucggaaacgagaacuaccucgacuacaugacgaguaugaagcgcuuuaagaacgagagcgaccccgagggggcgcucugguga

SEQ ID NO: 23977 - RNA, 9879 nt, Artificial Sequence
  derived and/or modified CDS sequence (opt11) from DENV-1__KF973472__SS-prME
agcguuaccaugcuccucauguuacuccccaccgccuuagcauuucaccuuaccacccggggcggggaaccucacaugauagucagcaagcacgaacggggcaagucauuauuguucaagaccucuaccgggguaaauaugugcacgcugauugccauggacuuaggcgagcucugugaggauacuaugaccuauaagugcccccgcauuaccgaggccgagccugacgacguggacugcuggugcaacgccacggacacaugggugacauaugggacguguagccagacgggcgagcaccggcgcgacaagcgguccguggcucuggcgccccacguggguuuggggcuugagacccggacggaaaccuggaugagcagcgaaggcgccuggaagcaaauccaacgggucgaaacaugggcccuacgccaccccgguuuuacgguuaucgcccuauuccucgcccacgcgaucggcaccucaaucacccaaaaggggaucauauuuauccugcugaugcucgugacucccucuauggccaugcgcugcgucgguaucggcaaccgcgacuucguggagggguugucgggcgccacauggguggacgucgugcuggagcaugggucaugcguuaccacuauggcaaagaacaaaccgacccucgacaucgagcugcugaagacggaggucaccaaucccgccgugcuccggaaacuuugcaucgaggcgaagauauccaacacgacuaccgauucccgcugcccgacccagggcgaagccacccugguugaagaacaggacgccaacuucguuugcaggcguacgcucguggaucggggcugggggaacgguugcggucucuucgggaaagggagcuugcugaccugcgccaaauucaagugcgucacaaagcuggagggcaaaaucguccaauacgaaaaccugaaguacagcguaaucgucacgguccacacgggggaucagcaccaaguggggaacgaaaccaccgaacacgggacuaucgcaaccaucacgccucaagcuccaaccuccgagauccagcuaaccgacuacggggcacuggcccuggacugcucaccccggaccggccucgauuucaacgagaugguccuucugacaaugaaggaaaaguccuggcucgugcacaagcagugguuccuugaucugccacuccccuggacauccggggccagcaccagccaggagaccuggaaccggcaggaccugcuugugacauucaagaccgcccaugcgaagaagcaggaggucguggugcucggcucccaggagggcgccaugcacaccgcccugacaggugccacggaaauucaaaccagcggcacgaccacgauauucgccgggcaccugaagugucgcuuaaaaauggacaagcugacucugaagggcacuagcuacguaaugugcaccgggucauuuaagcuggagaaggaggucgcggagacccagcacggcaccguccuaguacagguaaaguacgaaggcacggacgcccccugcaagaucccauucuccacccaagaugagaagggugugacgcagaacggccggcugauuacagccaacccgaucgucaccgacaaggagaagcccguaaacaucgagaccgagccgcccuucggggagagcuacauuguggucggcgcuggggagaaggcgcugaaacuuucuugguucaagaaagguagcuccauuggcaagauguuugaagccaccgcccguggggcccggcggauggcgauucugggcgacaccgccugggacuucgggagcaucggcggcguguucacuagcguggggaagcugguccaccagguuuucggcaccgcuuacgguguccucuucagcggcgugucuuggacgaugaagauaggcaucggcauccugcugacuuggcucggccugaacagccgcucuaccagccuaagugugacaugcaucgccguggggauggucaccuuguaccugggggugauggugcaggccgacucugggugcgucaucaacuggaagggccgggagcugaaguguggguccggcaucuucguuaccaacgaggugcauacuuggaccgagcaguacaaguuucaggcugacucacccaagcgccucagcgcggcuaucggcaaagcaugggaggagggggucugcggcauacggucagccacucgacucgagaacaucauguggaaacagaucagcaaugagcugaaccacauccuccuggaaaaugacaugaaguucacggugguggucggagaugccaacggcauccuggcgcaagggaagaagaugauccggccccagccaauggaacacaaguacucuuggaaaagcuggggaaaggccaaaauaaucggcgcagacauccagaacaccaccuuuaucauagacgggcccgauaccccugagugccccgacgaccagcgagccuggaacaucugggaaguggaggauuacggcuucgggaucuucaccaccaacaucugguugaagcugcgggauuccuacacacagaugugugaccaucgccugauguccgcggcuaucaaggacuccaaggcugugcacgccgacaugggcuacuggaucgagucugagaagaacgagaccuggaagcucgcacgggcguccuucaucgaggucaagacuugcaccuggcccaagagccauacccuguggucuaauggcgugcuggagagcgagaugaucauucccaagaucuacgggggccccaucucgcagcacaacuaccgccccggguacuuuacucaaaccgccgggcccuggcacuuaggaaaguuagaacuggacuucgaccucugugagggcacaacggucgucguggacgaacacuguggaaaccgggggccgagccuacgcaccacgaccgugaccgguaagaucauccacgaauggugcugccgguccugcacgcugccgccccuaagauuucgcggugaagacggcugcugguacgggauggagauccgccccgucaaagagaaggaggagaaucuggugcggucgauggugagcgccggcagcggcgaagucgacucuuuuucgcucgggauccuuugugugagcauuaugaucgaggaggugaugagaucccgcuggucuagaaagaugcugaugacgggcacauuggcugucuuccugcugcugaucauggggcagcucacauggaacgaccugauacgccuuugcaucaugguaggcgcuaacgccuccgaccggauggggaugggcaccacguaccucgcccugauggccacuuucaaacugcgccccauguucgccgugggcaucuuguuucggcgccugacgucccgggagguccuguuguugaccaucggguuaagccucguggcaagcguagaguuaccaaacucccuggaggaacucggagaugggcuggcaaugggcaucaugauguuaaagcuccugacggaguuucagccccaccagcuauggacgacccuccugagccugacguucauccgcacgacccucucccucgauuacgccuggaagaccaccgcuauggcccugagcauugucucacucuuuccccugugcuugagcacgaccucccagaagaccaccuggcuuccggugcugcugggcagcuucggcugcaagccccuaaccauguacuucaucacggagaacaaaaucuggggccggaagucguggcccaucaacgaggggauuauggcuauuggcauugucagcauccugcugucuagccuccugaagaaugacgugcccuuggccgggccucucaucgcuggcggcaugcugaucgccugcuacgucaucagcggcuccucugccgaccucucccuagagaaggcggccgaggucagcugggaacaggaggcagagcacuccggaaccagccacaacauccuggucgaggugcgcgacgacggaacaaugcgcauuaaggacgaggagaaggacgacacacuaacgauccuccugaaggccacccugcucgcagucucaggcguguaucccaugagcauacccgccacccuuuucgugugguacuucuggcagaagaagaagcagagauccggcguccugugggacacccccagcccgcccgagguggagcgagcagugcuggacgauggaauuuacaggauccugcagaggggccuacuggggcgcucccaagucggcguggggguguuccaagacggcgucuuccacaccauguggcacgugacccgaggggccguacucauguaccagggaaagagacuggagcccagcugggccuccgucaaaaaggaccugaucagcuacggggguggcuggcgguuucagggguccuggaacaccggcgaggaaguacaggugaucgccguugagcccgggaaaaacccgaagaacgugcaaaccacuccgggcaccuucaagacccccgagggcgaggugggggcuaucgcgcucgacuucaagcccgggacguccgggagccccaucgucaaucgcgaaggcaaaaucgugggccuguacgggaacggcguggucacgaccagcgggaccuacguguccgcuaucgcccaggccaaggcaucacaggagggcccucugcccgaaaucgaggacgagguuuuuaagaaacggaacuugacuaucauggaccuacacccagggucaggcaagacgagacgguaccugcccgccaucguccgcgaggccaucaagcgcaagcugcgcacccugauccuggcccccacucgcgugguggcguccgagauggccgaggcccuaaagggcaugcccauccgguaucaaaccacggccgucaagagcgagcacaccggacgcgagaucguggaccugaugugccacgccaccuucacaaugcggcugcucucaccggugcgcguccccaacuacaacaugaucauuauggacgaggcacacuucacugaccccgcgagcaucgccgcccggggcuacaucucuacccgcguggggaugggcgaggcggcggccaucuucaugacugccaccccacccgggagcguggaggccuucccccaguccaacgccgugauccaggacgaagaacgcgacauccccgaacgcagcuggaacuccggcuacgacuggaucacugacuucccgggcaagaccgugugguuugugcccagcauaaaguccgggaaugacaucgccaacugcuugcggaagaacggcaagcgcgucauccaacugucacggaagaccuucgacaccgaguaccagaagacuaagaacaacgacugggauuacguggugaccacggacaucucggagaugggagcuaacuuucgcgccgaccgggucaucgacccccgccggugccucaagccagucauacugaaggacggcccugagcgcgugauccuggccgggccgaugcccgucaccguggcgagcgccgcccaacggcgcggccgaaucggccggaaccagaauaaggagggggaccaguacgucuacauggggcaaccucucaacaacgacgaggaucacgcccacuggacggaggcuaagaugcuguuggauaacaucaacacccccgaggggaucauaccggcacucuucgagccagaacgcgagaaaucggccgccaucgauggcgaauaccggcuaagaggggaagcccggaaaaccuucguugagcuuaugcgccggggugaccuccccgucuggcugagcuacaaggucgccuccgagggcuuccaauacucagacagaagguggugcuucgacggagagcgcaauaaccaggugcuugaggagaacauggacgucgagaucuggacuaaggagggcgagcggaagaaauugcgccccagguggcuggacgcgcguaccuacucugacccguuggcccuccgggaguucaaagaguuugccgccgggcgccggucggucagcggcgauuugauccuggagaucgguaagcucccccagcaccugacgcugcgugcccaaaacgcgcucgacaacuuggugaugcugcacaauuccgagcagggcgguaaggccuaccggcaugcuauggaggagcuccccgacaccaucgagacguugaugcugcucgcccugaucgcgguucugaccgggggcguuaccuuguucuuccugucggggaagggccuuggcaagaccucgaucggucuccugugcgugaccgcaagcuccgcacuucucuggauggccagcguggagccccacuggaucgccgcguccaucauccuggaguucuucuuaaugguucuccugaucccagaacccgacagacagcggacgccgcaggacaaccagcuagccuacguggugauugguuuacuguuuaugauccuuacagucgccgcgaacgagauggggcuacuggagacaacgaaacgugaccugggcaucgggcauguagcggcggaaaaccaucagcacgccaccaugcucgacguggaucugcgcccggcuuccgccuggacucucuacgccgucgcuaccacggugaucacccccaugaugcggcauacgauugagaacaccaccgccaacauauccuuaaccgccaucgccaaccaggccgcuauccugaugggccuggacaagggauggcccaucaguaagauggacauuggcgugccccuccuggcucugggcugcuacucccaggucaacccgcugacgcugaccgccgccgugcugaugcucgucgcgcacuacgccauaaucggucccggccugcaagcaaaggccacccgcgaggcccagaagagaaccgcggcugggauuaugaagaaccccacggucgacgggaucguggcgaucgaccuggaccccguagucuacgaugccaaguucgagaagcagcucggacagauaauguuacugauucugugcaccagccagauacugcugaugcgcacuacuugggcccucugugaauccaucacgcuggcgaccggaccucugacgacccucugggagggcagcccagggaaguucuggaacacaaccauugcuguguccauggccaacauuuuccggggcagcuaucuggccggcgccggccuggcguucucccucaugaagucccugggcggagggcgacgggggaccggcgcccagggcgagacgcugggggagaaguggaaacggcaauugaaucagcuguccaaacccgaguucaacacguacaagcggagcggcaucauggaaguggaucgcucggaagccaaagaggggcugaagcggggugagaccaccaagcacgccgucucgcgcgggaccgccaagcuccgcugguucguggagcgcaaccuggugaagcccgagggcaagguaaucgaccuaggaugcgggcgggguggguggagcuauuacugcgccggucuaaagaaggugaccgaggugaagggguacacuaagggcggcccggggcacgaggagccaauccccauggccacguacggcuggaaccuggucaaacugcacagugggaaggacguguucuucaugcccccggagaagugcgacacccugcucugcgacaucggugaaagcaguccgaaccccacuaucgaggaggggcgcacgcuaagagugcugaaaauggucgagcccuggcuccgugggaaccaguucugcaucaagauccugaacccguacaugccaagcgucguggagacccuggaacagaugcagcggaagcacggcggaaugcuuguccgcaacccccugucccguaacucuacccaugagauguacuggguguccugcggcaccgguaacaucgugucggcgguaaauaugacgucccggaugcugcuaaaccgcuucacuauggcccaccguaagcccaccuacgagcgcgacguggaccugggcgcaggcacacgacacguggccgucgagccggaggucgcgaaccuagacaucaucgggcagagaaucgaaaacaucaagaacgagcauaaaagcacauggcacuacgacgaggacaaccccuacaagaccugggccuaccacggcuccuacgaggugaagcccagcgggagugcgucuaguaugguaaacggagugguucgauuacugaccaagcccugggauguaauuccuaugguaacccagaucgcgaugacagauaccacccccuucgggcagcagcgugucuuuaaggagaaaguggacaccaggacgcccagggccaagcgaggcacgacccaaaucauggaggugacagccaaguggcucuggggcuuuuugagccgcaacaagaagccgcggaucuguacgagggaggaguuuacccggaaggucagaucaaacgccgccauuggugcgguauucguggacgagaaccaguggaauagcgccaaggaggccgucgaggacgagcgguucugggaucuggugcaccgugagcgggagcuccacaagcagggcaagugcgcaaccugcguguauaacaugauggggaagcgcgagaagaagcucggagaguucgggaaggcgaaaggcucgcgcgccauuugguacauguggcugggcgcgcgcuuccuugaguucgaggcccuaggguucaugaacgaggaccauugguucucucgcgaaaacucccuguccggcguagagggggagggcuuacacaagcucggguacauccugcgggacaucagcaagaucccuggagggaacauguaugccgacgacaccgcuggcugggacacgcgcaucaccgaggaugaccugcagaacgaggccaagaucacagacaucauggagcccgagcacgccuugcuggccacaaguaucuucaagcugacguaccagaacaaggucguacggguccagcgccccgcaaagaacggcaccgugauggacgugauaagccggcgcgaccagcggggaucggggcagguagggacuuacgggcucaauaccuuuacgaacauggaggugcagcuaauccggcaaauggagagcgagggcaucuuccugccguccgagcucgagacccccaaccuggcggagcggguccuagacuggcucgagaagcacggggcggaaagacuuaagcggauggccaucagcggggaugacugcgucguuaagccgaucgacgaccgcuucgcuaccgcccugaccgcgcucaacgacauggggaaagugcggaaggacaucccacagugggagccguccaaaggcuggaacgacuggcagcagguccccuucugcucacaccacuuccaccaauuaaucaugaaagacggccgcgagauaguaguccccugccguaaccaggacgaacugguagggcgcgcccgcgugucgcagggcgccggguggucgcuccgcgaaaccgcgugcuuaggcaagucauaugcacagauguggcaacugauguauuuccacaggcgagaccuccgccuggcggccaacgccauuugcagcgccgugcccgucgauugggucccaacgucccggaccaccuggaguauccacgcgcaucaccaguggaugacaacggaggauaugcugagcguuuggaaccgugucuggaucgaggagaaccccuggauggaggacaagacgcauguguccagcugggaagaagugccguaccuagggaagcgggaagaccaguggugcggcucuuugauaggccugacagcccgagcgacaugggccacaaacauacaggucgccaucaaccagguacggcgauuaaucgggaacgagucauaccuggacuacaugaccuccaugaagcgguucaagaacgagucggaccccgaaggcgcgcuaugguga

SEQ ID NO: 23978 - RNA, 9879 nt, Artificial Sequence
  derived and/or modified CDS sequence (opt11) from DENV-1__KF973474__SS-prME
agcgugacgaugcucuuaaugcugcuccccaccgcccucgcauuccaccugaccacccgcggcggggagccgcauaugauagugagcaagcaugagaggggcaagucccuucuguucaagaccagcaccggggugaacaugugcacucucauagccauggaccugggcgagcucugcgaggacacgaugaccuacaagugcccgcgcaucacggaggccgaacccgacgacguagacugcuggugcaacgccacggacaccugggugaccuacgggaccuguucgcagacgggcgagcaucggcgcgacaagcgguccguagcuuuggcgccccacgugggccuggggcuugagacccgcaccgaaacauggaugagcagugaaggcgccuggaagcagauccagcgggucgagacgugggcccugcgccaccccggguucaccgugaucgcccuguuucucgcccacgcgaucggcaccagcaucacccagaaggggaucauauucauccugcugaugcucgugacgcccuccauggccaugcggugcguuggcaucggcaaucgagauuucgucgagggauuaagcggcgccacuuggguggacgucguccuggagcacggguccugcgugaccacuauggccaaaaacaagcccacccucgacauugagcugcugaagacggaggucaccaaccccgccguacuccgcaagcugugcaucgaggcgaagaucagcaacaccacgacugacucccgcugcccgacccaaggugaggccacccugguggaggagcaggaugccaacuucgucugcaggcgcacgcucguugacagaggcugggggaacgguugcggguuguuuggcaaggggagccugcugacaugcgccaaguucaaaugcgugaccaagcuggaggggaagaucguccaguacgagaaccugaaguacuccgugaucgucacaguccacacgggugaccagcaccaggugggcaacgagaccaccgagcacggcaccaucgccacaaucacgccacaggcacccacgagcgaaauccagcuuaccgacuacggggcccucgcccuggacugcagcccccggaccggccuugacuucaacgagaugguccugcugacgaugaaggagaagucguggcucgugcacaaacagugguuccuggacuugccccucccguggaccuccggggccagcaccagccaggagaccuggaacaggcaggaucugcuggugaccuuuaagacagcccacgcgaagaagcaggaggucguggugcucggcucccaggagggcgccaugcacacugccuuaaccggggcaacggagauccagaccagcggcaccacgacaauuuucgccggccaccugaaaugccgccucaaaauggacaagcugacccugaagggaacgucuuacgucaugugcaccgggagcuuuaagcucgagaaggagguggcggaaacgcagcacggcacagugcucguccaggugaaguacgagggcacugacgcucccugcaagaucccguucuccacucaggacgaaaagggggugacacagaacggucggcuuaucacagcuaacccgaucgucacugauaaggagaagcccgugaacaucgagaccgaaccgcccuucggugagagcuacauaguggucggcgccggggaaaaggcgcugaaacuguccugguucaagaaggggagcuccaucggaaagauguucgaggccacggcccgcggcgcccgacgcauggccauccugggcgacaccgcgugggacuucgggucuaucggcgggguguucacauccguggggaagcugguacaccagguguucggcaccgccuacggcguacucuucuccggcgucuccuggacgaugaagaucgggaucggcauccuguugaccuggcugggccugaacagccgcuccaccagccuguccaugaccugcaucgccguggggauggugacucucuacuugggcgucauggugcaagccgacucugggugcgugauaaacuggaagggccgggagcugaagugcgggaguggcaucuuugucaccaacgaggugcacaccuggacggagcaguacaaguuccaggccgacagcccgaagcgccuuagcgcugccaucggcaaggcgugggaggagggggugugcgggaucaggagugccacgcgccucgagaacaucauguggaagcagaucuccaacgagcugaaccacauccuccuggagaacgauaugaaauucacggucguggugggagaugccaacggcauccuagcgcagggcaagaagaugauucgaccccagcccauggagcacaaguacuccuggaaguccuggggcaaggccaagaucaucggcgccgacauccagaacaccaccuucaucauugacgggcccgauaccccggagugucccgacgaccagcgcgccuggaacaucugggagguagaagacuacggcuucgggaucuucacgaccaacaucuggcucaaacugcgcgacuccuacacccagaugugcgaccaccgccugaugagcgcagccauuaaggauuccaaggccgugcaugccgacaugggcuacuggaucgagagcgagaagaacgaaaccuggaagcuggcccgggcuuccuucaucgaagugaagaccuguaccuggcccaagagccacacccugugguccaauggcguccuggagagcgagaugaucauccccaagaucuacggaggcccgaucucccagcacaacuaucgccccggguacuucacccagacggccgggcccuggcaucucgggaagcuggaacuggacuucgaucuuugcgagggcaccaccgucgugguggaugagcauugcggcaaccgugggccgagccugcgcaccaccaccgugaccgguaagauaauucacgaguggugcugccgguccugcacucugccgccccuccgcuuccgaggggaggacggcuguugguaugggauggagaucaggcccgugaaggagaaggaggagaaccugguacggagcaugguguccgccggcagcggcgagguggacagcuucucccuggggauccuaugcgucagcaucaugaucgaggaggugaugcgcucucgcuggucucgcaagaugcuaaugaccggcacccuggccguguuccuccuacugaucauggggcagcucaccuggaaugaccugauccgccugugcaucauggucggcgccaacgcguccgacaggauggggaugggcaccacguaccucgcccugauggccaccuucaaacuacgcccgauguuugccgucggcauccuuuucaggcgccugacaucacgggaggugcugcuacugaccaucggguuaucccucgucgccagcgucgagcugcccaacucccuugaagagcuaggcgacggacuggcgaugggaauaaugaugcugaagcuccuaacggaguuccagccacaccagcuguggacgaccuugcugagccugaccuucaucaagacgacccucucccuggacuacgccuggaaaaccacagccauggcccugagcaucguuucucucuuuccccugugccuaagcacgaccucccaaaagaccacauggcucccgguguuacucggcagcuucgguugcaagccccucacgauguaucugaucacggagaacaagaucuggggccgcaaguccuggcccaucaacgaggggaucauggcgaucggcaucgugagcauccugcuuaguagccugcugaagaacgaugucccccucgcggggccgcugaucgcuggcgguaugcugaucgccugcuacgugaucagcgggucuagcgccgaccucucccuggagaaagcggccgaggugagcugggagcaggaggccgagcacuccggcaccagccacaauauccuggucgaggugcaggacgacgguaccaugcggaucaaggacgaggagaaagacgacacccucacgauccugcugaaggccacccuccuagccguguccggggucuaccccaugagcauccccgcgacccuguucgugugguacuucuggcagaagaagaagcaacgcuccggggugcugugggacacccccucaccgccagaggucgagcgggccgugcucgacgauggcaucuacaggauccugcagcggggacugcuaggccgaagucaggugggcgucgggguguuucaggacggcguguuccacacgauguggcacgucacccgcggcgccguguuaauguaccaaggaaagcgccuggagcccagcugggccuccgucaagaaggaccucaucuccuacgggggcggcuggcgguuccagggguccuggaacaccggcgaggagguccaggugaucgccguggagcccgggaaaaauccgaaaaacguacaaacuacacccgggacuuucaagaccccggagggagaggugggggcgaucgcguuggacuucaagcccgggaccagcggguccccgaucgugaaccgcgagggcaagauagugggccuguacgggaauggcguggugacgacuagcgggaccuacgucuccgccaucgcccaggcgaaagcgagccaagaaggcccccugccagagaucgaagacgagguguucaagaagcggaaucugaccaucauggaccugcacccggggagcggcaaaacgcgccgguaccuccccgccaucgugcgcgaggccaucaagcggaagcugcgcacccugauccucgcuccgacccgcgucguggcaagugagauggccgaggcacugaagggcaugccggugcgguaucagaccacggcugucaaguccgagcauaccgggcgcgagauagucgaucuaaugugccacgccaccuucacaaugcggcuucuuucuccggugcgcguccccaacuacaacaugauuaucauggaugaggcgcacuuuacggaccccgccagcaucgccgcgcggggcuacaucuccacccgcguggggaugggcgaagccgcggccaucuuuaugaccgcuacuccgcccgggagcguggaggcuuucccccaauccaacgccgucauucaggacgaagagcgggacauccccgaaaggagcuggaacuccggcuacgacuggaucacggacuucccgggcaaaaccgugugguucgugccuagcaucaaguccgggaacgacaucgcgaacugucugagaaagaacggcaagagggucauccagcugagcagaaagacauuugauaccgaauaccagaagacgaagaacaacgacugggauuaugucgugacuacugacaucuccgagaugggggccaacuuucgcgccgaccgggucaucgacccgcgccggugcuugaagcccgugauucuuaaagacggcccggagcgcgugauucucgccggcccgaugccuguaacgguggcgagcgccgcccagcggcggggccggaucggccgaaaccagaauaaagagggagaccaguacgucuacaugggccagccacugaauaaugacgaagaccacgcccacuggacggaggccaagaugcugcucgacaacaucaacacacccgaggggaucauuccggcguuauucgagcccgagcgugagaaguccgccgcgaucgacggcgaguaucggcugcgcggcgaggcccggaagaccuucguggaacucaugcgccggggcgaccuuccuguguggcuaagcuacaaggucgccuccgagggcuuccaguacagcgaucgucggugguguuuugacggggagcgcaacaaccagguguuggaggagaacauggacguggaaauuuggacaaaggagggcgagcggaagaagcugcgcccgcggugguuagacgcgcguaccuacagugacccacucgcacugcgugaguuuaaggaguucgccgccgggcgccggagcgucagcggcgaccugauccucgaaaucggcaaacugccccagcaccugacgcuccgcgcccagaacgcguuggauaaccuggugaugcuccacaacuccgagcagggcggcaaggccuaccgacacgccauggaagagcugcccgacacuaucgagacccugauguugcucgcccugaucgccgugcucacagguggugucacgcuuuucuuccucagcggaaagggccucggcaagaccuccauagggcuucugugcgugacggccaguuccgcccuucucuggauggccagcguugagccccacuggaucgcugcguccaucauucuggaguuuuuccucaugguguuacugaucccggaacccgaccgccagcggacgccacaggacaaccagcucgcuuacguggugaucggccuguuauucaugauccucacggucgccgccaaugagauggggcugcuggagaccaccaagcgcgaccuuggcauaggucacguggcggcggagaaccaccagcacgccacuaugcuggacguggaccugagaccggccuccgccuggacucucuaugccgucgcgaccaccguaauuacucccaugaugcgccacacgauugagaauaccaccgcaaacaucucccuaaccgccaucgccaaccaagccgcgauccugaugggcuuggacaagggcuggccuaucagcaagauggacaucggggugccccugcuggcccucggcugcuacucacaggugaacccucugacgcugaccgccgccgugcuaaugcugguggcgcacuacgccaucaucggacccggccugcaggccaaggccacccgcgaggcccaaaagcgcaccgcagccggcaucaugaaaaaccccacggucgacggcaucguugccaucgaccucgaccccguugucuacgacgccaaguucgagaagcaacugggucagaucaugcugcucaucuuaugcaccagccagauacugcucaugcgcaccaccugggccuugugugaguccaucacgcuggccaccggaccgcucaccaccuugugggagggaagccccggaaaguucuggaacacgaccaucgccguguccauggcuaacaucuuccggggcagcuaccuugcgggagccggccuugcguucucccugaugaagucccugggagggggccgccgggggacuggcgcgcagggcgaaacccucggggagaaguggaaacgccagcugaaccagcuguccaagcccgaguucaacacguacaagcggucgggcaucauggagguggaccgcagugaggcgaaggaagggcucaaaaggggcgagaccaccaagcacgcugucucgcgcgggaccgcgaagcugcggugguucgucgagcgcaaccuggugaaacccgagggcaaggugaucgacuugggcugcgggagaggugguuggagcuacuacugcgccgggcucaagaaggugaccgaggugaagggguacacgaagggcgguccgggacacgaggaacccauccccauggcaaccuacggguggaaccucgucaagcugcacagcgggaaggacguguucuucaugcccccggagaagugcgacacccuccugugcgacaucggcgagagcuccccuaaccccacuaucgaagaggggcgcacgcugcgggugcucaagauggucgaacccugguugcgcggcaaccaguucugcaucaagauccugaacccguauaugcccagcgugguggagacccucgagcaaaugcagcggaagcacggagggaugcugguccgcaaccccuugucccggaacagcacccacgagauguacuggguguccugcgguacggggaacaucguaagcgccgucaacaugacgucccgcaugcuccugaaccgcuucaccauggcccaccggaagcccacuuacgagcgcgacguugaccugggcgcuggcacccgccacgugacgguugagccggagguggcaaaucucgacaucaucgggcagcgcauugaaaacauaaagaacgagcauaagagcaccuggcacuacgacgaagacaaccccuauaagaccugggccuaccacggcucauaugaggugaaaccgagcggauccgccucguccauggugaacggcgugguccggcugcugacaaagcccugggacguuauaccgauggugacgcagaucgccaugaccgacacaacccccuucgggcagcagcgcgucuucaaggaaaagguggacacgcggacgccccgugcgaagcguggcaccacccaaaucauggagguaacggccaaguggcuauggggguuccucucaaggaauaagaaaccuaggauuugcacccgagaggaguucacccgcaagguacgcucaaacgcagccauaggggcgguguucguggacgagaaccaguggaauagcgcgaaagaggcagucgaggaugagcgguucugggaccuggugcaccgcgagcgggaauuacacaagcagggcaagugcgcgacguguguguacaacaugaugggaaagcgagagaagaagcugggugaguucgggaaagcaaagggaagccgggccaucugguauauguggcugggcgcccgcuuucucgaguucgaggcacugggguucaugaacgaggaucauugguucucccgggagaauucgcuguccggcgucgaaggcgagggccuccacaagcugggguauaucuuacgcgacaucagcaaaauccccggagggaacauguaugccgacgacacagccgggugggacacacgcaucacagaggacgaccuccagaacgaagcgaagauuaccgacaucauggagcccgagcaugccuugcuagccacaagcaucuucaagcucacauaccagaacaagguggugcggguccaacgucccgccaagaauggcaccgugauggacgugaucucacggcgggaucagaggggguccggccagguuggcaccuacgggcugaauacguucacaaacauggaggugcagcugauccgccagauggaaagcgaagguaucuuucucccgucagagcuagagacucccaaucuggccgagcgagugcucgacugguuagagaagcacggggcggagcgcuugaagcguauggccaucagcggcgacgacugcgucgugaagccaaucgacgaccgcuucgcaaccgcccucacggcccuaaacgacauggggaaggugagaaaggacaucccccaaugggagccauccaagggcuggaacgacuggcagcagguacccuucugcagccaccauuuccaucaacugauuaugaaagacggacgagagaucguggugcccugccggaaucaagacgagcuagucgggcgcgcgcgggucucccagggcgccgguuggagccugcgcgagacggccuguuugggcaaguccuacgcccagauguggcagcucauguacuuccaccggcgugaccuccggcuggccgcgaaugccaucugcagcgccgugcccgucgacugggugccgacaucccgcaccacuuggagcauccacgcccaccaccaguggaugacgaccgaggacaugcucagcguuuggaauagggucuggauagaggagaaccccuggauggaggacaagacccacgugaguagcugggaagagguacccuaccuagggaagcgggaggaucagugguguggcucccugauuggccuaacugcgcgugccacgugggccaccaacauccaggucgcaaucaaccaagugcggcggcucaucgggaacgagaauuaccuagacuacaugaccucaaugaaacguuucaagaacgaguccgaccccgagggcgcucuuugguga

SEQ ID NO: 23979 - RNA, 9879 nt, Artificial Sequence
  derived and/or modified CDS sequence (opt11) from DENV-1__KF973475__SS-prME
agcgucaccaugcugcucaugcugaugcccaccgcccuggccuuccaccuaacgacgcgcggcggggaaccgcacaugaucgucuccaagcacgagcgggggaaggcgcugcuguucaagaccagcaccggggugaacauguguacucucaucgccauggaccucggcgagcugugcgaggacaccaugaccuacaagugcccccgcauaaccgaagcagagcccgacgauguggacugcuggugcaaugccacggacacaugggucaccuaugggaccugcucccagacgggcgaacaccggcgcgauaagcggaguguggcccucgcgccccacguaggccuggggcuggagacucgcaccgagacuuggauguccagugaaggcgccuggaagcagauccagcgggucgagacaugggcccuucgccacccgggguucaccgugaucgcccuguuccuggcgcacgccaucggcaccuccauaacccagaaggggaucaucuucauucuccugaugcuggugacucccucuauggccaugcggugcgucggcaucggcaaccgcgacuuuguggaggggcucuccggcgccaccuggguggacgucgugcuggagcaugggagcugcgugaccaccauggccaagaacaaacccacgcuggacaucgagcuccugaagaccgaggucacuaacccagcgguccuccggaagcuuugcaucgaggcuaaaauuuccaacaccacgaccgacagccgcugcccgacccagggcgaggccacccugguugaggagcaggacgccaacuucgucugccggaggacguucgucgaccggggcuggggaaacggcugugggcuguucggcaaggggucccuucugaccugcgccaaguuuaagugcgugacgaagcuggaggggaagaucguccaauacgagaaccucaaguacagcgugaucgugaccguccacacgggcgaccagcaccagguggggaaugagaccacggagcacggcaccaucgcgaccaucacgccccaagcccccaccuccgagauccaauuaacugacuacggggcccugacccucgacugcagccccagaacgggccuggacuucaacgagaugguacugcucaccaugaaggagaaauccugguuggugcacaagcagugguuccuggaccucccgcugcccuggaccagcggagccuccaccagccaagagacauggaaccggcaggaccugcucgugaccuucaagacagcccacgcgaaaaagcaggaggucguggugcugggcagccaggagggcgccaugcacaccgcccugacgggggccaccgagauccagaccuccgggaccacuaccaucuucgccgggcaccucaaaugccgccugaagauggacaagcugacccucaagggcaccagcuacgucaugugcacuggguccuucaagcuggagaaggagguggcggaaacccagcacggcaccgugcugguccaggugaaauaugagggcacagacgcccccugcaagaucccuuucucuacgcaggacgagaagggggugacccagaacggccgguuaaucaccgccaauccgaucgugacugacaaggagaaacccgugaacaucgagacggagccccccuucggggaguccuacaucguagucggcgcaggcgagaaggcgcucaagcugagcugguucaagaagggguccagcaucggcaagauguucgaggccaccgcccgcggggcccggcgcauggccauccugggcgacaccgcgugggacuucgggagcaucgguggcguguuuaccagcguggggaagcuaguccaccagguguucggcacggcuuacggugugcucuucucgggugucagcuggaccaugaagaucgggaucggcauucugcuuaccuggcugggcuuaaacucccgcagcaccucccucuccaugacgugcauagccgucgggaugguuacguuauaccuuggcguaauggugcaggccgacuccgggugugugauaaacuggaaggguagagagcucaagugcgggagcggcaucuucguaaccaacgaagugcacacuuggaccgagcaguacaaguuccaggcggacaguccgaagcgccugagcgcggccaucggcaaggccugggaggaaggggugugugggauucggagcgccacucgcuuagagaacaucauguggaagcagaucuccaacgaacucaaccauauccugcuggagaacgggaugaaguucaccgucguggugggcgacgcgaacgggauccuagcgcaggggaagaagaugauccggccccagccaauggaacacaaguacagcuggaaguccuggggcaaggccaagaucaucggggccgacauccagaacaccaccuucauuaucgacggcccagacacgccggagugccccgacgaccagagagccuggaacaucugggaggucgaggacuauggguucggcaucuuuaccaccaacaucuggcugaagcugcgggacagcuacacccagaugugcgaccaccgacucauguccgcggcgaucaaggacagcaaggccgugcacgccgacaugggcuacuggauugaguccgagaagaacgaaacguggaagcuggcucgggcuagcuucaucgaggugaagacaugcaccuggcccaagucccacacccuguggagcaacgguguccucgaguccgagaugaucauccccaagaucuacggcgggccgaucagucagcacaacuaucgccccggcuauuucacgcagaccgccgggcccuggcaccuggguaagcuggagcucgacuucgaucugugcgagggcaccaccgugguggucgacgaacacugcgggaaccggggaccgagucugcguacgaccaccgucacagggaagaucauccacgaguggugcugccggagcugcacacuacccccccugcgcuuccggggcgaggacgguugcugguacgggauggagauucgccccgugaaggagaaggaggagaaccuggugagaucuauggugucugcgggcuccggggagguugauagcuucucucucggaauccugugcgucucuaucaugauugaggaggugaugcgcagccgguggucccgcaagaugcuuaugaccgggacccucgccguguuccugcugcucaucaugggccagcucacguggaaugaccugauccgcuuguguaucauggucggggcaaacgcgagcgaccggaugggcaugggcacgaccuaucuggcccucauggccaccuucaagaugagacccauguuugcugugggcauccucuuccggcgccugaccucccgggagguacugcuccugacgaucgggcugagccucgucgccucuguugagcugcccaacagccucgaggaacucggggacggucuggccaugggcauuaugaugcugaagcuccugacagaguuccaaccacaccagcuguggacaacccuccugucgcugacguucaucaagaccacccucagccuggacuacgccuggaagaccacggccauggcgcuguccaucgucucuuuguucccccuguguuugucaaccaccucgcaaaagaccaccuggcucccugugcugcuggguuccuucgguugcaagccccucacgauguucuugaucaccgagaacaagaucugggggcgcaagagcuggcccauaaacgagggcauuauggcaauaggaauaguguccauccugcuuagcagucugcugaagaacgauguaccccucgccggcccgcuuaucgccggcgggaugcugaucgccugcuacgugaucagcggcagcuccgccgaccucucccuggaaaaggcggccgagguguccugggagcaggaggccgagcacagcgggacaucccacaacauccuggucgaggugcaggacgauggcaccaugcggaucaaagacgaggaaaaggacgacacgcucaccauccuacugaaggccacccuccuagccgugagcggagucuaccccauguccauucccgcgacccuguucgugugguacuucuggcagaagaagaagcagcgcucuggagugcucugggacacucccuccccgcccgaggucgagagagccgugcuggacgauggcauauaccgcauccugcagcgggggcuccugggccgaagccagguggggguaggaguguuccaagacgggguguuccacaccauguggcacgucacccgcggcgccgugcugauguaccagggcaaacgccuggagccguccugggccagcgugaagaaggaucucaucuccuacggggggggguggcgguuccagggcagcuggaacaccggggaagagguccaggugaucgcgguggagcccggcaagaacccgaagaacguucagacgacccccggcaccuucaagacuuccgaaggagaggugggggcgaucgcccuggacuucaagccggggacuagcggcucccccaucguuaauagagagggcaagaucguggggcuguacggcaacggaguggugaccacgagcggcaccuacgucuccgccaucgcccaggcaaagacgagccaagaggggccgcucccagagauagaggacgagguguucaagaagcggaaccugacuauuauggaccugcacccaggcagcggaaaaacccgccgguaccucccggcgauaguccgcgaggccaucaagcggaagcugcgcacccugauccucgcgcccacgcgugugguggcguccgagauggcggaggcccugaaggggaugcccauccgguaccagaccaccgcggugaagucugagcacaccggccgcgagaucgucgaucugaugugccacgccacguuuaccaugcggcuacugucccccgugagggugccgaacuacaacaugaucaucauggacgaggcccauuucaccgaccccgcgaguaucgccgcccggggguacaucuccacccgcgucggcaugggggaagcggcugcgaucuucaugacggcgacccccccugguagcguggaagcuuucccacaguccaacgccgugauccaggaugaggagcgugacaucccugaaagaucguggaacuccggcuacgacuggaucaccgacuuccccgggaagacggucugguucgugcccagcaucaagucgggcaacgacaucgccaacugccugcgaaagaacgggaagcgugugauucagcucagccggaagacguucgacaccgaguaucagaagacaaagaauaacgacugggacuacgucgucaccacggacaucucggagaugggcgcgaacuuccgcgccgaccgggugaucgacccgcgccggugccugaagcccgugauccugaaggacgggcccgagcgcgucauccucgccggccccaugccggugaccgucgccagcgcggcccagcggcgcggccggaucgggcgcaaccaaaacaaggagggcgaccaguacguguauauggggcagccccugaacaacgacgaggaucacgcucacuggaccgaagccaagaugcugcucgacaacauuaacacccccgagggcaucauccccgcacuguucgagcccgaacgcgagaagagugcggccaucgacggcgaguaccggcugcgcggcgaggcgcggaaaacauucgucgagcucaugcgccgcggcgaccugcccguguggcuaaguuauaagguugccuccgagggguuccaguacagcgaccgucgguggugcuucgacggcgagcgcaacaaccagguccucgaggagaacauggacgucgagaucuggacgaaagagggcgaacggaagaagcugagaccccgguggcuagacgcgcgaaccuacuccgacccccucgcgcugcgugaguucaaggaguucgcggcaggccgcagaagcgugagcggugaccugauccucgaaaucgggaagcugccgcaacaccugacccugcgcgcccagaaugcccuggacaaccuggucaugcuccacaauuccgagcaaggcgggaaggcguacagacacgccauggaggagcugcccgacacgaucgagacguuaaugcuccucgcccugaucgcugugcuaacuggcggcgugacccuguucuuccuaagcggcaagggccucgggaagaccuccaucggccuguugugcgucacagcgucguccgcccuccuguggauggccagcguggaaccccacuggauugccgccucuaucauucuggaguucuucuugauggugcugcugauccccgagccggaucgccaacggaccccccaggacaaccaguuagcguacgucgucaucggccuucuguucaugauccucaccguggccgccaacgagaugggccugcuggagaccacgaagcgggaccucgggauaggccacgucgccgccgagaaccaccagcaugcuacgaugcuggacguggaccugcggcccgcaagcgcguggacccucuacgcgguggccaccacggucaucaccccgaugaugcgccacaccaucgagaacaccacggcgaacaucucgcugaccgccauugcgaaccaggccgcuauacugaugggccucgacaagggguggccaauaagcaagauggacaucggcgugccacugcuggcguuaggguguuacucccaaguuaauccccugacccugaccgccgccguacucaugcugguggcccacuacgcgaucauuggcccggggcugcaggccaaggccacgagagaagcccagaagcggaccgccgcuggcaucaugaagaaccccacuguggacggcaucguggccaucgaccucgaccccgugguguacgacgccaaguucgagaagcagcuggggcagaucaugcuccuaauccugugcaccagccagauccugcucaugcgcacgacuugggcccugugcgaguccaucacccucgcaaccggcccgcucacgacccugugggaggggucaccgggcaaguucuggaacaccacgauugcugucuccauggcgaacauuuuccgggguagcuaccuggccggggcuggccucgccuucucccugaugaagagccuggggggcgggcgccggggcaccggcgcgcagggggagacccucggcgagaaguggaagcgccagcugaaucagcuguccaagcccgaguucaacaccuacaagaggagcgggauaauggagguggaccgcuccgaggccaaggagggccuuaagaggggggagaccaccaagcacgccgugucgcgcggcacggccaaacugcggugguucgucgagcgcaacuuggugaaacccgagggcaagguaaucgaccucgggugcggucgggggggcuggagcuacuacugcgcggggcugaagaaggucaccgaggugaaaggcuacaccaagggcggaccgggccacgaggagccgauccccauggccaccuacggguggaaccuggugaaacugcacucuggcaaggacgucuucuucaugccccccgagaagugcgacacgcuucugugcgacauaggggagagcuccccgaaccccaccauugaggagggccgcacccuuagagugcucaagaugguggagccuuggcugcgcggaaaccaguucugcauaaagauccugaaccccuacaugccgucagucguggagaccuuggagcagaugcagcggaagcaugggggcaugcuggugcgcaacccccugucccggaacagcacgcacgagauguacuggguauccugcgggacgggcaacaucgugagcgccgugaacaugacgucccgcaugcuguuaaaccgcuucacaauggcccaccggaagcccacguacgagcgcgacgucgaucugggcgccggaacccgccauguggcgguggagcccgagguagccaaccucgauaucauaggccagcgcaucgagaacaucaaaaacgagcacaagagcacauggcacuacgacgaggacaacccguacaagaccugggccuaccacggguccuacgagguuaagcccagcggcuccgccagcuccauggugaacggggucguccggcugcugacuaagcccugggaugucauccccaugguuacccagauagccaugaccgacaccacgccguucggacaacagcgaguguuuaaggagaagguggauacccggaccccccgcgcgaagcggggcaccacgcagaucauggaggugaccgccaaguggcucuggggguuucucagccgcaacaaaaaaccccggaucugcacccgcgaggaguucacgcggaaggugcgcuccaacgcggccaucggcgccgucuucguggacgagaaccaguggaacagcgcgaaggaagcaguggaggacgagcgguucugggaccugguccaccgcgagcgggagcuccacaaacaggggaagugcgccacgugcguguacaacaugaugggcaagcgcgagaagaagcugggugaguucggcaaggccaagggcagccgggcgaucugguacauguggcugggggcacgcuuccucgaguucgaggcccugggcuucaugaacgaggaccacugguucucccgggagaacagccucuccgggguggagggcgaggggcuccacaagcugggcuacauccugcgcgacaucagcaagaucccaggcggaaacauguacgccgacgacaccgccggcugggacacccgcaucaccgaggacgaccuccagaacgaggcgaagaucacggacauuauggagccugagcacgcccuguuggccacgaguaucuucaagcuaacauaccagaacaagguaguucgggugcagcgccccgccaagaacggaacugucauggacgucauaagccggcgcgaccagcggggcuccggccagguugggacguacggccugaacaccuucaccaacauggaggugcagcugauccgucagauggagagcgaggggaucuuccuccccuccgaacuggagaccccgaaucuggccgagcgcgugcucgacuggcuggagaagcacggcgcggagcgccugaagcgaauggccaucagcggggacgacugcguggucaagccuaucgaugaccgcuuugcgaccgccuuaacggcccugaaugacaugggcaaggugcggaaggacaucccccagugggaacccuccaagggauggaacgauuggcagcaggugccguucugcagccaccauuuccaccagcugaucaugaaagaugggagggagaucguagugcccugccgaaaccaggaugagcucgugggccgcgcgcgggucucccagggggcuggcuggagccugcgcgaaacugccugccuggggaaguccuacgcccaaauguggcaguugauguacuuccaucggcgcgaccuccgacuugccgcgaacgccaucugcagcgccgugcccguggacuggguccccacaagucgcaccacguggagcauccacgcccaccaccaauggaugacaacggaggacaugcucagcguguggaaccgcguguggaucgaggagaacccguggauggaggacaaaacccacguuuccagcugggaggaggugcccuaucugggcaagcgggaagaccaguggugcggcucccugaucgggcugacggcgcgcgccaccugggccaccaacauccaaguggccaucaaccagguccggcgccugaucgguaacgagaacuaccuagacuauaugacaagcaugaaacgguucaagaacgaguccgaccccgagggggcccucugguga

SEQ ID NO: 23980 - RNA, 9879 nt, Artificial Sequence
  derived and/or modified CDS sequence (opt11) from DENV-1__FJ898448__SS-prME
ucagucaccaugcuguuaaugcucuugccuaccguacuuacauuccaccugacgacccguggcggcgaaccccacaugaucgugagcaagcaggagcgaggcaagagccugcuauuuaagacuucggcuggagugaacaugugcacgcuuauagcgauggaccuuggcgaacucugugacgacacaaugacauacaagugcccccgcauuaccgaaacugagcccgaugacguagacuguuggugcaacgccacagagacaugggucacauaugggacguguagccagacgggagaacaccguagagacaagagaucuguugcacuagccccacauguaggccugggacucgagacuaggaccgaaacguggaugagcagcgagggcgcguggcgccagauacaaaaagucgaaacaugggcccucaggcacccaggcuucacggucaucgcucucuuccuagcgcacgccauuggcacaagcaucacccaaaagggcaucaucuucauacuccuuaugcucguaacuccaucgauggcaaugcggugcguaggaaucgggaaccgggacuucguagaggggcucaguggugcuacauggguagauguaguccucgaacauggcagcugcgugacaaccauggcaaaggacaaaccgacccuggacauagaacuacucaaaacggagguuaccaacccagcaguucucagaaagcugugcauugaggcuaaaaucagcaacacgacaaccgacaguagauguccuacccaaggugaagcgacacuuguagaagaacaggacaccaauuuugucugccgacgcacauucguagaccgcggcuggggcaacgguugcggccuauucggaaagggcuccuuaaucacuugugccaaguucaaaugcgugacuaagcucgagggaaagauagugcaauacgaaaaccugaaguacagcgucauaguaacugugcacaccggagaccagcaucaggucgggaacgaaacgacagaacacgguaccauagcaaccauaaccccgcaagcacccaccuccgaaauccaacucacagacuacggcgcccuaacgcucgacugcagcccccgaaccgguuuagacuuuaacgaaaugguguuacuaaccaugaaagaaaagucauggcuaguccacaaacagugguuccuagauuuaccacuccccuggacgaguggugcgagcaccucucaagaaaccuggaaccgacaagaccuccuggucacauucaaaaccgcccaugcgaaaaaacaggagguaguaguacuaggcucccaggagggcgcgaugcacacagcacuaacgggagcgaccgagauccaaacaucaggaacaacgacgauuuucgccggacaccucaaaugcagacucaagauggacaagcucaccuuaaaagggaucagcuacguuaugugcacaggaaguuucaagcuugaaaaggaagucgcggagacccaacacggaaccguacugguucaagucaaauacgaagguacugacgcuccaugcaaaaucccguucagcagccaagaugaaaaggguguaacgcagaacgggaggcugguuaccgcgaaucccaucguaaccgacaaagaaaagccagucaacaucgaagccgaaccgccauucggggaguccuacaucgucgugggggcgggagaaaaggcgcugaagcucuccugguuuaaaaaaggcuccuccaucggaaaaauguuugaagccacugcgaggggggcccgaagaauggccauccucggcgacacugccugggacuucggcuccauaggcgguguauucacuagcguaggcaagcuggugcaucaaauauuugggacggcauacgggguguuauucaguggcguguccuggacaaugaagauagguauuggaauccuacuaacuuggcuaggacugaacucgcggagcacuucccuguccaugacuugcauugcggucggaaugguaacacuauaccucggaguaauggugcaagcagacagcggcugugucauuaacuggaaggggcgagagcuaaaaugcggaucaggcauauucgucaccaacgagguacacacguggacagaacaauauaaguuccaagcugacucaccgaaaaggcucagcgcagccauugguaaagcgugggaagagggcgucugcgggaucaggagugcaacucggcuagagaacauaauguggaaacaaauauccaacgaacucaaccacauacugcuagaaaaugacaugaaauucaccguagugguaggggacguuaguggaauccucgcgcaaggcaaaaagaccauccguccgcagccaauggaacacaaauacagcuggaagucgugggggaaggcgaagaucauaggagcggacguacaaaacacgacguucauaauagacggacccaacacaccagaauguccagacgaucaacgagccuggaacaucugggaaguagaggacuacggauucggcaucuucacgaccaacaucuggcuaaaauuacgagacucguacacacaagugugcgaccaucggcucauguccgcggccaucaaggacagcaaagcagugcacgcagacaugggcuacuggauugagucagagaagaaugaaacuuggaagcucgccagagccucguucauagaagugaaaaccugcgucuggccaaaaucacacacccuauggucaaaugggguccuagagagugaaaugaucauaccgaaaauauauggggggccaaucucacagcacaauuauagaccgggcuacuucacacagacggcgggacccuggcaccuuggaaaacucgagcucgacuuugaccucugcgaggggacgacaguagucguggacgaacacugcggaaauagggguccgagucuccgaacgacgaccguaacuggcaaaauaauccacgaaugguguugccgcuccugcacacucccuccgcuaagguucaaaggcgaagacggcugcugguacggaauggagauuagaccgguuaaagaaaaagaagagaaccuagucaagaguauggugagcgcgggaaguggcgagguggauucauucagccuuggauuacuuugcaucaguaucaugaucgaagaggugaugcgaucaagauggucucgcaaaaugcuaaugaccgguaccuuagucguauuccuucuucuaacccugggacaacugacauggaacgaccucauacgccuguguaucauggucggcgcuaaugccucagacaacaugggaaugggcacaacuuaccuugcacuaauggcuaccuuccggaugcgccccauguucgcagugggccuacucuucaggcgucucacgagccgagaggugcuccuccuaacuguuggacugagccugguugcgucgguugaguuaccuaauucgcuggacgaacucggcgacggacuggcaauggggauaaugauccuaaaacugcucacggacuuccaaagccaccaacugugggcgacauuacuuucucugaccuucgugaaaacaacacucagccuucauuaugccuggaaaaccauggcaaugauccuauccaucguaaguuuacugccgcuaugccucagcacgacaucccaaaaaaccaccuggcucccaguacuuuugggaagucuuggcugcaaaccgcucaccauguuccugauuacggaaaauaaaauauggggacgaaaguccuggccccuuaacgaaggaaucauggcaguaggcauaguaagcauacuauuaagcagucuccugaagaacgacguuccacuugcaggacccuugaucgcuggagggauguuaaucgccugcuauguuauaaguggcucaucagcagaucuaagucuagagaaagccgcuaagguaucaugggaggaagaggcagaacacagcggugccucccacaauauacugguagaaauccaagacgacggaacgaugaaaaucaaagaugaagagcgggacgacaccauaacaauacugcucaaggccacccucuuagcgaucuccgggguguacccgaugagcauacccgcgacccucuucguuuggcacuucuggcaaaagaagaagcaacgaaguggagucuuaugggacacaccauccccaccagagguagagaaggcuguuuuagacgacggaaucuaccgcauccuccagcgaggacuccuaggacguucacaggucggcguaggagucuuucaagaaggagucuuucacaccauguggcauguaaccagaggcgccguacucauguaccaagguaaacgccuagagccguccugggccagugucaaaaaagauuuaauuucguacggaggggguuggagguuucagggaagcuggaacaccggagaggaagugcaagucaucgcagucgaaccagggaagaauccaaagaacgugcaaacggcacccggcacuuucaaaacgagcgagggggaaguaggugcaauagcauuggacuucaagccgggcaccagcgggagcccuaucguaaaucgagaaggcaaaauagugggacuguacgggaacgguguagucacaacgucgggcacauacguaucagccaucgcacaagcuaaagcgucgcaagaaggcccccuacccgaaauagaggacgagguauuucggaaacgaaaucugacuauaauggauuuacaucccggcucaggcaaaacacgucgguaccuaccggccauugucagagaggcaaucaaacguaagcuaaggacacucguacuggcuccgaccaggguaguugcaagugagauggcagaggcucucaaagguaugcccauacgauaccaaacuaccgcgguuaaaucagaacacaccggcaaggagauuguggaccugaugugccacgcuaccuuuacaaugagacugcuaagcccagugcgagucccgaacuauaacaugauuauaauggaugaggcccacuuuacagaucccgcaagcauagcggcccgagguuacauaagcacccggguaggaaugggggaggcagccgcuauuuucaugacggcgacaccgccaggcucagucgaggcguucccgcagagcaaugcaguuauccaagacgaagaaaaagacauuccagagcgcucguggaacagcggauacgacuggauuaccgacuuccccggaaagaccgugugguucguucccaguauaaaaaguggcaacgacauagcaaacugccuccggaagaacggaaaacgagucauacaacuuagucgcaagacuuucgauacggaguaccaaaaaacaaaaaacaaugauugggacuacguggucacaacagacaucagcgagaugggagccaacuuuagagcugaucgaguaauagacccccgccgaugccuaaaaccugucauacucaaagauggccccgagcgaguaauccuagcggggcccaugccggucaccguugccagugcagcccagcggagagggaggauagggcggaaccagaacaaggaaggagaucaguacaucuauaugggccagccccuaaacaacgacgaggaccacgcccacuggaccgaagcgaagaugcugcuagauaauauaaacaccccagagggaauuauaccagcgcucuucgagccggaaagagagaaaucggccgcaauagacggagaauauaggcuacgcggggaagcgcgaaaaacauucgucgaguuaaugcgucgaggagacuugcccguauggcuauccuacaaagucgccagcgaagguuuccaauauagcgaccgccguugguguuuugauggcgaacgaaacaaucaagucuuagaagaaaacauggacguagaaauuuggaccaaagagggugagcguaaaaaacucagaccacguuggcuggacgccaggaccuacuccgacccccuagcguuacgagaguuuaaagaauucgcugccgggcgccggagcgugagcggagaccuuauucuugagaucggcaagcucccucagcaccugacgcagagagcacaaaaugcacucgacaaccuagugaugcuccacaacagcgagcaaggcgguaaggcguaccgccaugcgauggaggaacuaccugauacgauagaaacaauaaugcuacuagcccucauagcaguucuuacaggcggagugacauuguuuuuccuauccggcagaggccugggaaaaaccaguaucgggcuacuaugugugacauccucuagugcacuacucuggauggcguccguggaaccgcacuggauugcggcuaguaucauacucgaauuuuuccucaugguacuacuaaucccagaacccgaccgacaaaggacaccgcaggauaaucagcuagcauacguugugauaggacuauuauuuaugauccuuacaguagccgcgaacgagaugggauuacucgaaacaaccaaaaaagacuuagggaucggccacgccgcagccgaaaaucaccaccacgcagccaugcuagacguggacuuacacccagcgagcgcuuggacgcuguacgcagucgcaacaaccauuaucacaccaaugaugcgucacacgauagaaaacacuacggcuaacaucagccugacugcgauagcgaaccaagccgcaauacucaugggacuggacaaaggauggccaaucucaaaaauggacaucggcgugccacugcuagcacugggcugcuacagccaggugaauccacucaccuuaacugcggcaguccugauguuaguggcccacuacgcaaucauaggcccgggacuacaagcgaaagcaaccagggaggcacaaaaacgaaccgccgcgggaauaaugaaaaauccaaccgucgacgggaucguagcuauagaucuggacccagucguuuaugaugcgaaauucgaaaaacagcuaggacagauaaugcuccuaauauugugcacgucucaaauacuacucaugcgaaccacaugggcucuaugugaauccauuacguuggcaaccggaccccugacaacccugugggagggaucccccgggaaguucuggaacacgacgaucgcgguaucaauggccaauaucuuccgagggucguaccuugcuggggcaggcuuggccuucucccuaaugaaauccuugggaggcggacgcagggguacgggagcucaaggagaaacccuaggagagaaauggaaacgacaacucaaccaguuguccaaaagugaauuuaacaccuacaagagaucagggaucaucgagguagacaggucugaggcgaaagaaggacucaagaggggagagaccacaaaacaugcagugucacgggggacugccaagcuaagaugguucguagagaggaacuuaguuaagccugaaggaaagguaauagaccuaggcuguggccgaggcggauggucauacuacugugccggacuuaaaaaagucacagaagugaaaggguacaccaagggagggccggggcaugaagagcccaucccaauggcaacauauggcuggaaccuggugaaauuacacagcggaaaggacgucuucuuuauuccaccagagaagugcgacacguuauuaugcgacauuggagaaagcucacccaaccccacgauagaggaagggcggacacuacgcguccucaaaaugguugagcccuggcuucgcggcaaucaauuuugcauaaaaauauuaaacccguacaugcccucugucgucgaaacccucgagcaaaugcagcggaaacaugggggaaugcucguacgaaacccucucagccgcaacagcacacacgagauguacugggucuccugcgggacaggcaacaucgucagcgccgucaacaugacaaguaggaugcuacuaaacagguucaccauggcgcaccgcaaaccgacauacgagcgagauguugaucugggcgcagggacaaggcacguagccgucgaacccgaggucgccaacuuggacauaauuggacaacgaaucgaaaacauaaaaaaugaacacaaaagcacuuggcauuaugaugaagacaacccguacaagacaugggcauaucaugggucauacgaagugaaacccagcggaucugcgucuucuaugguaaacggaguuguacgacuccucaccaagccaugggauguaauaccgaugguaacacagaucgccaugacggacacuacgccauucggacaacaacguguauucaaagagaaagucgauaccaggacuccgaaggcgaaacgcgggacugcucaaauaauggaagucacagccaaaugguuauggggguuccucagccgaaacaaaaaacccaggauaugcacgcgagaagaauucacccggaagguacgcagcaaugcagcuauaggggcggucuucguggacgaaaaucaauggaauucagccaaagaagcggucgaggacgaaagguucugggaccuggugcgacgagaacgagaacuccacaagcagggcaagugcgcgacaugcguuuacaauaugaugggcaagcgagagaaaaaauuaggcgaauucggaaaagcgaagggaagccgagccauuugguacauguggcuaggcgcccgguuucucgaguucgaagcccuaggcuuuaugaacgaggaccacugguuuagucgggagaacagccugagcggggucgaaggggaaggacuucacaagcucggcuacauucugagggacauuaguaaaauaccaggcggcaauauguacgcagacgauacagcagguugggacacacgaauuacggaagacgauuuacaaaacgaggcaaaaauaacggacauuauggaaccagaacacgcauugcuagcgaccuccauauucaagcuaacauaccaaaacaaagucguccgcguucaacgcccggcgaagaacggcacaguaauggacgucauuuccagaagagaucagcgagggagcggacaaguugggaccuacgggcugaacaccuucacgaacauggaagcacagcuaauaagacagauggaaagcgagggaauuuuuucgcccuccgagcuagaaacgccuaaucuggccgggaggguacuagacuggcucgaaaaacauggaacugagcgucuccgccgaauggccauaagcggcgaugacugcguuguaaaacccauagacgacagauuugccacagcccucacagcccuaaacgacauggguaaaguccguaaagauauaccacaaugggaacccucaaaaggguggaacgauuggcaacaaguuccauucugcagccaccauuuucaccagcuaauaaugaaagauggucgagagauuguaguccccugucguaaccaagacgaacucgugggacgcgcgcgcgucucgcagggagcuggguggagccugagggaaaccgcaugccuaggaaaaaguuaugcccaaauguggcaacuaauguacuuucaccgccgagaccuacgacucgcggcgaacgccauuuguagugcaguaccgguagauugggucccaacgagccgaaccacguggagcauacacgcccaccaucaauggaugaccacagaggacaugcugagugucuggaaucgcguguggauagaagaaaacccguggauggaagauaaaacccacguaagcucgugggaggacgucccguaccucgggaagcgagaggaucagugguguggcucgcuaauaggacucacggcgcgggcaacaugggcgacgaacauacaagucgcaaucaaccaagugcgccgacugaucggaaaugaaaacuaccucgacuacaugacaucaaugaagagauuuaaaaacgaauccgaccccgaaggagcgcucugguaa

SEQ ID NO: 23981 - RNA, 9879 nt, Artificial Sequence
  derived and/or modified CDS sequence (opt11) from DENV-1__GQ868602__SS-prME
agcguuaccaugcugcucaugcugcugcccacagcucucgccuuccaccugaccacccguggcggggaaccucacaugaucguaagcaagcaggagcggggcaagagccuccuguucaagacaagugcugggguaaacaugugcacccugaucgccauggaccugggcgagcucugcgaagacaccaugacguacaagugcccgcgaaucaccgagaccgaacccgacgacguggacuguuggugcaaugccaccgagacguggguaaccuaugggaccuguagccagaccggcgagcaccggcgcgacaagcguuccguggcccucgcuccccacguuggccuggguuuggaaacccgcacugagaccuggaugaguuccgagggggcguggagacagauccagaagguggagaccugggccuuaaggcaucccggguucaccguaauagcccuguuccucgcccacgcgaucgggacgaguaucacccaaaaggguaucaucuucauccugcucaugcucgugacgcccuccauggccaugcggugcgucggcauuggcaaccgugacuucguggaggggcugagcggggcaaccuggguggaugucguacuggagcacggguccugcgugaccaccauggcuaaggacaagcccacucucgacaucgagcugcugaagaccgaggucaccaaccccgcggugcuucggaaguugugcauagaggcgaagaucagcaacaccacgacggauucccgcugccccacccagggcgaggccacccugguagaggagcaggacacgaacuucgucugccgucgaacauuuguggaucggggcugggggaacgggugcggccuguucggcaaggggucguuaaucacgugcgccaaguucaagugcgugacuaagcuggagggcaagaucguccaguacgagaaucucaaauacuccguaaucguuacgguccacacgggcgaccagcaccagguggggaaugaaaccaccgagcaugggaccacggccacgaucacgccccaggcgcccaccagcgaaauccagcugacggauuacggggcguuaacccucgacuguucaccccggacuggccuggacuucaacgagaugguacugcucaccaugaaagagaaauccuggcuaguccacaagcaaugguuccuggaccucccgcuacccuggacguccggagcgagcaccagccaggagaccuggaaccggcaggacuuguuagugaccuucaagaccgcacaugccaagaagcaggaggugguagucuuagguucccaggagggggccaugcacaccgcgcugacaggggccacggagauccaaacgagcgguaccaccacuaucuucgccgggcaccuuaagugccgccugaaaauggacaagcuuacucucaagggcguguccuacgugaugugcaccgggagcuucaagcuggaaaaggagguggccgagacgcagcacggcaccgugcuggugcaggucaaguacgagggcacggaugcccccugcaagauccccuucucuagccaggaugagaagggagucacacaaaacggccggcugaucacggcgaacccgaucgugacggacaaggagaagccggugaacaucgaggccgagccgcccuucggagagaguuaccucguaguaggugcaggcgagaaggcccugaaacucucaugguucaagaaagggucaaguaucggcaagauguucgaggcgaccgcaaggggggcccggcgcauggccauucucggcgacaccgccugggacuucgguuccaucggcggcguguucacgagcgucgggaagcugauccaucagaucuucggcaccgcguacgggguguuguuuucaggagugaguuggacgaugaagauugggaucgggauucuccugaccugguugggucucaacagccgcagcaccuccuuaucuaugacaugcaucgccgucgggauggugacgcuguaccucggcgugaugguccaggccgacuccggaugcgugaucaacuggaaaggucgggagcugaagugugggucgggcaucuuuguuaccaacgagguucauaccuggaccgagcaguacaaguuccaggccgacagcccaaaacgccuguccgccgcgaucggcaaggccugggaggagggggugugcggaaucagaagcgcaacccgccucgagaacaucauguggaagcaaaucuccaacgaacugaaucacauccuucuggagaacgauaugaaguucacggugguugugggggacgugaacggcguccuggcccagggaaaaaagaugauccgcccucagcccauggaacauaaguacagcuggaagagcuggggcaaggccaaggugaucggagcggaugugcagaacauaaccuucaucaucgacgggcccaacaccccggagugccccgacgaccagcgcgccuggaauaucugggaggucgaggauuacggauucgggaucuucaccacgaacauuuggcucaagcuccgggacagcuacacccaagugugcgaccaccgccugauguccgccgccauaaaggacagcaaggcuguccaugcugacaugggauacuggauugaauccgaaaaaaaugagaccuggaagcugacucgggccagcuucaucgaggucaagacgugcaucuggccgaagucccacacccucuggaguaacggcgugcuagaguccgagaugaucauccccaagaucuacggggggccgaucucacaacacaacuaccgcccaggguauuuuacccagaccgcuggucccuggcaccuagggaaacucgagcuggacuucggccucugcgaaggcacaaccguggucguggacgagcauugugggaaucggggaccgucucuccgcaccaccacggugaccggaaagaucauccacgaguggugcugccggucaugcacccugccgccccugcgcuucaagggcgaggacggaugcugguacggcauggagauucggcccgucaaagagaaggaggagaaccucgugaaauccauggugucagccggcagcggggagguugacuccuucagccucggccugcucugcaucuccaucaugaucgaggaggugaugcgcagucgguggagucgcaagaugcucaugaccgggacgcuggcggucuuucuccugcugaucaugggucaacucacguggaacgaccucauucgacugugcaucauggucggagccaacgccagcgacaagaugggcaugggaacaaccuaccucgcccugauggcaacguuccgcaugcgaccgauguuugccgugggguuacuguucagacgccuaaccucccgggaaguccugcuccugaccgucgggcugagccucguugccucggucgagcugcccaacagccuggaggagcucggggauggccuggccaugggaaucaugaugcugaagcuucugaccgauuuccagucccaccaguugugggccacgcuccuaucucugaccuucgugaagacaaccuuuucgcuccauuacgccuggaagacaauggcgaugauccugagcaucgugagucuguuuccccucugucuuucgacuaccagccagaagaccacguggcuaccgguccuccuggggagccugggcugcaaaccgcucaccauguuccugauaacagagaauaagaucuggggccgcaaguccuggccccucaacgaggggaucauggccgugggcaucguaagcauccuucugagcucauuauuaaagaacgacguccccuuagcgggcccccugaucgccgggggcaugcucauagcgugcuacgugaucaguggcagcagcgcggaccugucacuggagaaggccgcugaggugagcugggaagaggaggccgagcauuccggggcaucacacaacauacucgucgaggugcaggacgacggcaccaugaagaucaaggaugaggaacgggacgacacccugaccauccuguuaaaggccacucuguuagccaucuccgggguguacccgaugagcauccccgcuacccucuucgucugguauuucuggcagaagaagaagcagcgcuccggggugcuuugggacacccccagcccuccggaaguugagcgggcgguccuagacgacggcaucuaccgcaucuuacagcgggggcucuugggcaagucccaggugggagugggcguauuucaggagggcguguuucacacgauguggcacgugaccaggggcgcgguacugauguaccagggcaagcggcucgaacccucuugggcauccgucaagaaggaccugaucucguacgggggaggguggcgcuuucagggcuccuggaauaugggggaggaagugcagguuaucgcuguugagcccggcaaaaacccaaagaacgugcagacggcacccggcaccuucaagacgcccgagggcgaggucggcgccaucgcgcuggacuuuaaacccgggacuagcgggucgcccaucgugaaccgggagggaaagauaguggggcucuacggcaaugggguagugaccacaagcgguacauacgugucggcuaucgcccaggccaaggccucccaggagggcccucugcccgagaucgaggacgagguauuccggaagcggaaccugaccauaauggaucuccauccuggcagcggcaagaccagacgguaccugccagcgaucgugcgcgaagccaucaaacggaagcugagaaccuuggugcucgccccaacgcggguaguggccagugagauggcggaggcccuaaagggcaugccgaucagguaucaaaccaccgccgucaagagcgaacacaccggcaaagagaucgucgaccucaugugccaugcgacuuucaccaugcgucugcugucccccgugcgggugccgaacuacaauaugaucaucauggaugaggcccacuucacugaccccgcaagcauagccgcccgcggguacaucuccacacgggucggcaugggggaggccgccgcgaucuucaugacagccaccccgcccgggagcauggaagccuucccacagaguaacgccgccauucaggacgaggagcgagacauccccgaacggagcuggaauuccggauacgacuggaucaccgacuuucccgguaaaacugugugguucgugccuagcauuaagagugguaacgacaucgcgaacugcuuacgaaagaacgggaagcgggucguacagcugagccggaagacguucgacaccgaauaucagaaaaccaagaauaacgauugggacuacguugucaccacggacaucuccgagaugggcgcuaacuuccgggccgaucgaguaauugauccgcggagaugucugaagcccgucauucucaaggauggccccgagcgcgugaucuuggccggccccaugccggugaccgucgcgagcgcggcacagcgccgcggccggauugggaggaaccagaauaaagagggagaucaguacaucuacaugggccaaccccugaacaacgacgaggaccacgcccacuggacugaagccaaaauguugcuggacaauaucaacacccccgaagggaucauccccgcgcuguucgagccggagcgagaaaaguccgccgccaucgacggggaguaucggcuacggggugaagcacgcaagacauucguggaguugaugcggcgcggggaucugccugucuggcucagcuacaaggucgccucugagggguuccaguauagcgacagacgcuggugcuucgacggcgagaggaacaaccaggugcugcucaaaaacauggacguggagaucuggaccaaggagggggagcgcaaaaaacuccggccccgcugguuggacgcccgcaccuauagcgauccccuggccuuacgcgaguuuaaggaguucgcggccggccggcgauccgucucuggugaccugauucuggagaucgggaagcucccgcaacaucugacccagcgggcacaaaacgcgcuggauaaucuagugaugcugcacaacuccgagcaaggcggcaaggcuuaccgccacgccauggaggagcuacccgacacgaucgagacccucaugcuccuggcccucaucgcggugcugaccgguggggucacgcucuuuuuccucagcggacgcggcuuagggaagacauccaucggucugcucugugugauggccagcuccgcccugcuguggauggccagcguggaaccucacuggauugcagcaaguaucauucucgaauucuuccugaugguccuguuaauccccgagccugaccgccagcggacgccccaggauaaccagcuggcauacguggugaucgggcuccuguucaugauccugaccgucgcagcgaacgagaugggguuacuugaaaccacaaagaaggaccugggaaucgggcauguugcagcggagagucaccaccacgccgcgauguuggacgucgaucuucaccccgccuccgccuggacgcuguaugcggucgcaaccacgaucaucaccccgaugaugcgccacaccaucgagaacaccaccgccaacaucaguuugaccgccaucgccaaccaggcugccauccucaugggcuuagacaaaggguggcccauuuccaagauggauauuggcguaccccugcuagcccuggggugcuacagccagguuaauccccugacgcucacugccgcgguccugaugcucguggcccacuacgcuauaaucggcccggggcugcaggccaaagccacucgggaggcgcagaagaggaccgcugccggcauaaugaaaaaucccacaguggacggcaucguugccauagaucucgacccaguaguguacgacgcgaaguucgagaagcaguuaggacagauuaugcugcugauccuuugcaccucccagauccuccugaugcguaccaccugggcauugugcgagagcaucacguuggccaccggcccgcugaccacccugugggaggguuccccgggaaaguucuggaacacgaccauugccguuagcauggcgaacauuuuccgcggcucguacuuggccggggcgggacuggccuucagccuaaugaagagucuugggggcgggcgccggggcaccggggcccagggcgaaacuuugggcgagaaauggaagcgccagcugaaccagcucucaaagagcgaauucaacacguacaagcgguccgggaucaucgaaguggacaggucggaggccaaggaaggccugaagcgcggcgagaccaccaagcacgcugugucccgcggcaccgccaagcugcggugguucgucgaacgcaaccugguuaagcccgagggcaaagugaucgaccucggaugcggccgcggcggguggagcuacuacugcgccgggcuuaagaaggucaccgagguuaagggguauaccaagggcgggcccggccacgaggagcccaucccgauggccaccuacggguggaaccuggugaagcucuacuccggcaaagacgucuucuucacuccgcccgagaaaugcgacacgcugcugugcgacaucggggagagcucgcccaacccgaccaucgaggagggcaggacccuccgggugcugaagauggucgagcccuggcugcgcggcaaccaguuuugcaucaagguacucaaccccuacaugcccagcgugguggagacucuggagcagaugcagcgcaaacacgggggcaugcugguccgaaauccccucucucggaacagcacgcacgagauguacuggguguccugcggcacgggcaauaucgugagcgcgguuaacaugaccucccgcaugcugcuuaaucgguucaccauggcucaccgcaagcccaccuacgagagagacguagaccugggagccggaacgcgcaauguggccgucgagccggagguggccaaucuugacauuaucggacagaggauugaaaacaucaagaaugagcacaagagcaccuggcacuacgacgaagacaacccauauaagacuugggccuaccacgggucuuaugaggucaaaccgagcggcuccgcgagcagcauggugaauggagugguccggcugcucaccaagcccugggaugugauccccauggugacgcagaucgcgaugaccgacaccacccccuucggccagcagcgcgucuucaaagagaagguugacacccggacuccuaaggccaagcgcggcaccgcccaaaucauggaagugacggcccgguggcuguggggguuuuuguccaggaacaagaagcccaggaucugcacgcgcgaggaguuuacgagaaagguccgcagcaacgcagccauuggagcgguguuuauugacgagaaccaguggaacuccgccaaggaggcggucgaggacgaacgguucugggaccucguccacagagagcgggagcugcacaagcaggggaagugugcgacgugcguauacaacaugaugggcaagcgcgagaagaaguugggggaguucgggaaggccaaaggcagccgggccaucugguacaugugguuaggugcccgguuucuggaguucgaggcgcugggcuucaugaacgaggaccacugguucucccgggagaauagccugucagggguggagggugagggacugcauaagcucgguuauauccuccgcgacaucucgaagauacccggcgggaacauguacgccgacgauaccgccggcugggacacgcggaucacggaagacgaccugcagaacgaggccaagauuaccgacaucauggagccggaacacgcccugcucgcgaccuccaucuucaaacugacauaccagaacaaggucguuagagugcagcgucccgcgaaaaacgggaccgucauggauguaaucagcagaagagaccagcggggcucuggccagguagggaccuauggccugaacaccuucacgaacauggaggcccagcucauccgacagauggaaagcgagggcaucuuccugcccuccgaauuggagaccccaaaccucgcagaacgggugcuggacuggcuggagaagcacggcaucgaacgacucaaacggauggccaucucgggggacgacugcguggucaagcccaucgacgaucgcuuugcgaccgcccucaccgcccugaacgauauggggaagguccggaaggacauuccgcagugggaacccuccaaaggauggaaugauuggcagcagguccccuucugcagccaccacuuccaccagcucauuaugaaagacggccgcgagaucguggucccgugccggaaccaagacgagcugguaggccgcgccagggugucccaaggugcgggcuggagccugcgcgagacggcgugucugggcaaaucguacgcccagauguggcagcugauguacuuccaucggcgcgacuuacgucuugccgccaacgcgaucugcuccgccguccccguugacugggugccgaccagccgcaccaccugguccauccacgcccaccaccaguggaugacgaccgaggacaugcuguccgucuggaaccggguguggauagaggaaaaccccuggauggaggacaagacccaugucuccaguugggaggauguuccguaccuggguaaacgggaggaucaguggugcggcucccucaucgggcugaccgcccgggcgacgugggcaacgaacauccaaguggccaucaaccaggugcgccgccugaucggcaacgagaacuaucuagacuacaugaccucuaugaagcgguucaagaacgaaaaugaccccgagggagcccugugguga

SEQ ID NO: 23982 - RNA, 9879 nt, Artificial Sequence
  derived and/or modified CDS sequence (opt11) from DENV-1__KF921911__SS-prME
agcgugacuaugcugcucaugcugcuacccaccgcccucgccuuucaccugacuaccaggggcggggagccccacaugaucgucucaaagcaggaacggggcaagagccugcuguucaagaccagcguggguaucaauaugugcacccugaucgcgauggaccugggcgagcucugcgaggacaccaugaccuacaagugcccccggaucaccgaggcggagccggaugacguugacugcuggugcaaugccaccgacaccugggucaccuacggcaccugcagccagacaggcgagcaccggcgcgacaagcgguccguugcccuggcgccucacgugggccuggggcucgagacgcggaccgagaccuggaugagcuccgagggcgccuggaaacagauacagaaggucgaaaccugggcccugcggcaccccgguuucaccgugaccgcccuauuccucgcccacgccaucggcaccagcaucacucagaaggggauaaucuucauauugcugaugcuagugacgccuagcauggccaugcgcugcgucggcauaggcaaccgggacuucgucgaggggcugagcggcgccaccuggguggacgucguguuagagcacggguccugugugaccaccauggccaaagauaaacccacgcucgacaucgaguugcuaaagaccgaagucacaaacccugccguacuccgcaagcugugcaucgaggcgaagauuagcaacaccacgaccgacagucgguguccgacccagggagaggccacccugguggaggagcaggacagcaacuucguuuguaggaggaccuuuguagaccgugggugggggaacggcugcggucucuucggaaaggggucccugcugaccugcgcgaaauucaagugcguuacaaagcucgagggcaaaaucguccaauacgagaaccugaaguauagcgugaucgucaccguccauacgggcgaccagcaccagguggggaacgagaccaccgaacacggcacaaucgcgaccaucacgccucaggccccaacaagcgagauccaguuaaccgauuacggggcguugacccuggacuguagcccccgcacgggacuggacuucaacgagaugguccuacugaccaugaaggagaaguccuggcucgugcacaagcaaugguuccucgaccuuccgcugcccuggaccagcggggccagcaccagccaggagacguggaaucgccaggaucuccugguaaccuucaagaccgcccacgccaagaagcaggaaguagugguucugggcagccaggagggcgccaugcauaccgcguuaacgggggccaccgagauccagaccuccggcaccacgaccaucuuugccgggcaccugaagugccgccugaaaauggacaagcugacacuuaagggcaugucuuacguuaugugcaccggguccuucaagcucgagaaggagguggccgaaacgcagcacggcacggugcugguccaagugaaauacgaggguacggacgcccccugcaagauucccuucucggcgcaggacgagaagggggugacccagaacggccgucucaucacggccaauccgauagucaccgacaaggagaagcccgugaacaucgagaccgagccgcccuucggggaguccuacaucgugauuggcgccggcgaaaaggcccugaagcugagcugguucaagaaggguucuagcauaggcaaaauguucgaggcuaccgcccgcggagcgcgacggauggccauccucggcgacacggcuugggacuucggcuccaucggcggcgucuucaccagcguggggaagcuggugcaccagguuuucggcgcggccuacgggguucuguuuuccggcgugagcuggacgaugaagauugggaucggcauccuccuaaccuggcugggccucaacucccggagcacgucccugucuaugaccugcauagccgucgguauggucacacuguacuugggcgugaugguccaggcggauuccgggugcgucaucaacuggaagggacgcgagcucaagugcgggaguggcaucuucgugaccaaugagguccacacguggaccgagcaguacaaguuccaggccgacagcccgaagcggcugagugcugccaucggaaaggcuugggaggaaggggugugcgggauccgcagugccacccgccucgagaacaucauguggaagcagaucucgaacgaauugaaucacauccuccuggagaacgacaugaaguucaccguggucgugggggacgccaacggcauccuggcgcaggggaagaagaugauccggccccagcccauggagcacagguacagcuggaaaagcugggguaaggccaagaucauaggcgccgacauccagaauaccacguucaucaucgacgggcccgacaccccggagugucccgaugaucagcgggcguggaacauuugggagguggaggacuaugguuucgggaucuucaccaccaacaucuggcugaagcuccgggacagcuacacucagaugugcgaccaccgccugaugucugcggcuaucaaggacagcaaggccguccaugccgacaugggguacuggauagagucggagaagaacgagaccuggaagcuggcuagagcaucguucauugagguaaaaacgugcauauggcccaagucccacacccucuggagcaacggcguguuggaguccgagaugauuauccccaagaucuacgggggcccgauuagccagcacaacuaccgccccggguacuuuacgcagaccgccggcccuuggcaccuggggaaacucgagcuagacuucgaccucugcgagggaaccaccgucgugguggaugagcacugcggcaacagagggcccucccugcgcacgaccaccgucaccgguaagaucauccacgaauggugcugucggagcugcacgcugccgccgcugcguuucaggggcgaggauggcugcugguacgggauggagauucgccccgugaaggagaaagaggaaaaccuagugcgguccauggucuccgccggcagcggcgagguggauuccuucagccuugggauacugugcguguccaucaugaucgaagaggucaugcgcucucgguggaaccgcaagaugcucaugaccggcacccuggccguauuccuguuacugaucauggggcagcugacguggaaugaccucauccgccugugcaucauggugggcgccaaugcguccgaccggauggggaugggcacgaccuaccuggcccucauggccaccuucaaaaugcgcccuauguuugcagucggccugcuguucaggcgucuaaccucucgcgaggugcuacugcucacgaucggccugucccugguggccagcguagagcucccaaacucccuggaggaguuaggcgaugggcuagcgaugggcaucaugaugcugaagcugcucacggaauuucagccccaucagcuguggaccacccugcucagccugacguucaucaagaccacccugucccucgacuacgccuggcgaaccauggccaugguucugagcaucgucucccuguucccccucugccugagcacgaccucccagaagaccacauggcugccgguguuacugggcagcuucgggugcaagccccugacgauguuccucaucaccgagaacaagaucuggggccggaaguccuggccccugaaugaaggcaucauggcuaucggcaucgugucgauccugcucuccagccugcuaaagaacgacgucccccucgcggggccgcugaucgcggguggaaugcuuauugcaugcuacgugauuagcggguccagcgccgacuugucuuuggagaaggccgcggaggugagcugggaagaggaggccgagcauuccggcaccagccauaacauccuggucgaggugcaggacgacgggaccaugaagauaaaggacgaggagcgcgacgacacgcucacgauccugcugaaggccacccuccuugccgugaguggcgucuaccccaugagcauucccgcuacucuguucgugugguacuucuggcaaaagaagaagcagcggagcggggugcucugggacacccccucuccgcccgaggucgagcgcgcggugcuggacgacggcauauaccggauccugcaacgcggacugcucggacggucccaggucggagucgggguguuccaggacggcguguuccacacgauguggcacgucacccgaggcgccgugcugauguaccagggcaagcggcuggagccuagcugggcuuccgugaaaaaagaccucauaagcuacggggggggcuggcgcuuccagggcuccuggaacaccggcgaggagguacaggugaucgccguggagccggggaagaacccuaagaacguccagaccacccccggcaccuucaagacaccagagggcgagguuggggccaucgcgcuggacuucaagcccggaacgagcgguucgccgaucgucaaucgugagggcaagaucgucucucuguacggcaacggugugguuacgaccaguggcaccuacgugagcgccaucgcccaggccaagacaagccaggaagggccccuacccgaaaucgaggacgagguguucaagaaacgcaaccugacgaucauggaccugcacccgggcuccgggaaaacccggcgcuaccuccccgccaucgugcgggaggcaaucaagagaaagcugcgcacccugauccuggcacccacccgggucguggccagcgaaauggccgaggcguuaaagggcaugcccauacgguaucagacgaccgcagucaaguccgagcacaccgggcgggagaucgucgaccugaugugccacgccaccuucacgaugcgauugcugaguccgguccgcgugcccaacuacaacaugauuaucauggacgaggcgcacuuuaccgacccugcguccauugcggcccgcggguacaucaguacccgugucggcaugggggaggccgcggccaucuucaugaccgcuacgcccccgggcuccguagaggcguucccccaaagcaacgccgugauccaagacgaggagcgcgacaucccggagcgguccuggaacagcggguacgacuggaucacugacuuccccggcaagaccgucugguucgugccgucgaucaagagcgggaacgauaucgccaacugccugcgcaagaacggaaaacggguuauacagcucucccguaagaccuucgacacggaguaucagaagaccaagaacaacgacugggauuacguugugaccaccgauaucagcgagaugggcgccaacuuccgggcggacagggugaucgauccucggcgcugccuuaagcccgucauucugaaggacgggcccgagcgcgugauccuugccggcccgaugcccgugacggucgccuccgccgcgcagcgccgggggcgcaucgggcgcaaccagaauaaggagggcgaccaguacgucuacauggggcaaccguuaaacaaugacgaggaccacgcccacuggacggaggcgaagauguuacucgacaauauaaauacacccgagggcaucaucccggcccuguucgaacccgagcgggagaaauccgccgcgaucgacggggaguaccgccugcggggcgaggcccgcaagaccuucgucgagcuaaugcggcgcggggaucugccaguguggcuguccuacaagguggccucggagggcuuccaguacucggaccggcgcuggugcuucgacggcgagcgcaacaaucaggugcucgaggagaacauggacguggagauuuggacaaaggagggggagcgcaagaagcuucggccccgcuggcuggaugcccgaaccuacagcgacccgcucgcccugcgcgaguuuaaggaguucgcggccggccggcgcuccguguccggagaccugauccucgaaaucggaaagcucccccaacacuugacucuccgugcccagaacgcucuggauaaccugguuaugcuccauaauagcgagcagggcgguaaggccuaucggcacgcgauggaggagcugcccgacaccaucgagacccugaugcuccuggcacuaaucgccgugcucacggggggcgugaccuuguucuuccuguccggcaagggacucggcaagaccagcaucgggcugcuaugcgucauggccaguucggcgcuccuguggauggccaauguggagccucacuggaucgccgccuccaucauccuugaguucuuucucauggugcugcugaucccggagcccgaccggcagcgcacgccccaagacaaccagcucgccuacgucgugauagggcugcuguucaugauccucacgguggcggccaacgagaugggccugcuggagacaaccaagaaggaccucgggaucggccaugucgccgcggagaaccaacaccacgccacgaugcuggacguugaccugaggccagcgagcgccuggacgcucuacgccguggccaccacagucaucacccccaugaugcgccacaccaucgagaacaccaccgccaacaucagucugaccgcgaucgccaaucaggcugcuauccugauggggcucgacaagggcuggcccaucagcaagauggacauuggcgugccacugcuggcccuaggaugcuacucucaggugaacccgcugacgcugacggcggccguccuaaugcugguggcccacuacgcaaucaucggaccggggcuucaagcgaaggccacucgcgaggcccagaagcggaccgccgccgguaucaugaagaaccccaccguggacgggauugucgcgaucgacuuagaccccgugguguacgacgccaaguucgagaaacagcuggggcagauaaugcugcucauccuaugcacgucgcaaauccugcucaugcgcaccacgugggcucugugcgaauccauaacgcuagccacuggcccacucaccacccugugggagggcagccccggcaaguucuggaacacaaccaucgccgugaguauggcgaacauuuuccgggggaguuaccuggccggcgccggccucgccuucucccugaugaaaucccuagggggcggucgacgggggaccggggcccaaggcgaaacccucggcgagaaauggaagcgccagcugaaccagcuguccaaaagcgaguucaauacguacaagcggagcgggaucauggagguggaccgcuccgaagcuaaggagggcuugaagcgcggugagaccaccaaacaugccgucagccgcggcaccgcuaagcugcguugguucgucgagcggaaccuaguaaagcccgaggguaaggucaucgacuuaggcugcggacgcggcgggugguccuacuauugcgccggucucaagaaggucacggaggugaagggguacaccaagggcgggcccggccacgaagagccgauccccauggcgaccuacggguggaacuuggugaagcuguacagcggaaaggacgucuucuucacgccccccgagaagugugauacccuccugugcgacaucggcgaguccagcccgaaucccacaaucgaggagggccgcacccugcggguacucaagaugguggagcccuggcuacgcgggaaccaguucugcauuaaaauccugaaccccuauaugccguccgucguggagacccuggagcagaugcagcggaagcaugggggcaugcugguccgcaacccacugagccgaaauuccacccacgagauguacugggugucuugcggcacgggcaacaucguauccgccgugaacaugaccagccgcaugcuucugaaccgguucaccauggcgcaccggaagccgaccuaugagcgcgacgucgaccugggggccggcacacggcacguggccguggagcccgagguugcgaaccucgacauuaucggucagcguaucgaaaauaucaagaacgagcacaaauccaccuggcacuacgacgaggacaacccuuacaagaccugggccuaccaugggagcuacgaggugaagcccuccggcagcgccuccagcauggugaauggggucgugcgguuacugaccaagcccugggacgucauucccauggugacgcagaucgccaugaccgacaccaccccuuucggccagcagcgcguguucaaggaaaaagucgacacccggacgccacgggccaagagggggaccgcgcagauuauggaggugacggccaaguggcucuggggcuuccugucccgcaacaaaaaaccgcgcaucugcacacgcgaggaguucacccggaaggugcgcagcaacgcggccaucggggccgucuucgucgaugagaaccaauggaacucugcuaaggaggccguggaagacgagcgcuucugggaccuggucuaccgcgagcgggaguuacacaagcaggggaagugcgcgacuugcguguacaacaugaugggcaagcgcgagaaaaagcugggagaguucggaaaggccaaggggagccgggcgaucugguacauguggcugggcgcccgguuccucgaguucgaggcccugggcuuuaugaacgaggaucauugguucagccgggagaacuccuuuagcgggguagagggagaggggcugcacaagcucggcuacauccugagagacaucuccaagauucccgggggcaacauguacgcggacgacaccgccggcugggauacgagaaucaccgaggacgaccugcagaacgaggcgaagaucaccgacaucauggagcccgagcacgcucuacuggccacaagcaucuucaaacugacguaccagaacaagguggugcggguucaacgcccagccaaaaacgggaccgucauggacgugaucucccgucgagaccagcggggaucuggccagguggguaccuacggccucaacaccuucacgaauauggagguacagcucauucgccaaauggaaucugagggcaucuuccuccccagcgagcucgagaccccgaaccuggccgagcgaguccuggacuggcucgaaaagcacggcacugagcgccucaagcguauggccaucuccggggacgacugcguggucaaacccguggacgaccgcuucgcgaccgcucugaucgcccucaacgacaugggcaaggugcggaaagacaucccccagugggagccaucaaagggcuggaaugacuggcagcaggucccguuuuguucccaccacuuucaccaguuaauuaugaaggacggccgcgagaucguggugcccugccggaaccaggacgaacugguggggcgcgcccgggugagccagggcgcgggcugguccuugcgagagacggccugccuggguaaaagcuacgcccagauguggcagcugauguacuuccacaggcgcgacuuacggcuggccgccaacgcgaucugcuccgccgugcccgucgauugggugcccaccagccgcaccaccuggagcauccaugcacaccaccaguggaugaccaccgaggacaugcuguccguuuggaaccgcgucuggauagaggagaacccuuggauggaagacaagacccacgugagcucgugggaggaggugccguaccucggcaagcgggaggaccaguggugugggucgcugaucggccugaccgcccgcgcgaccugggcaacuaacauccaggucgccauuaaccaggugcggcgccucaucggcaaugagaacuaccuggacuacaugacauccaugaagcgguucaagaacgagagcgaccccgagggagcacucugguga

SEQ ID NO: 23983 - RNA, 9879 nt, Artificial Sequence
  derived and/or modified CDS sequence (opt11) from DENV-1__KJ189350__SS-prME
agcgugaccaugcugcucaugcugcugcccaccgcccucgccuuucaucugacuacccgcggcggggagccgcauaugauagucuccaagcaggaacggggcaagagccuguuguucaagaccuccgcgggggugaacaugugcacccucaucgccauggaccuuggcgagcucugcgaggacacgaugaccuauaagugcccccgcaucaccgaggccgagcccgacgacguggacugcuggugcaacgccaccgauacgugggucaccuacgggacuugcagccagaacggcgagcaccggcgcgagaagagauccguggcccuggcgccccacgugggccucgggcucgagacucgcacggaaaccuggaugagcuccgaaggcgccuggaagcagauccagcgggucgaaaccugggcccugcgccacccgggcuuuaccgugaucgccuucuuccuggcgcacgccauuggcacgagcaucacucagaaggggaucauauucauccuccugaugcuggugacucccuccauggccaugcggugcgucggcaucgguaaccgcgacuuuguggaggggcucagcggcgcuaccuggguggacgucgugcuggagcacggcuccugcgugacgaccauggccaagaacaagcccaccuuggacaucgagcuccugaagaccgaggucacgaacccugcggugcugcggaagcucugcaucgaggccaagauuaguaacacaaccaccgacucccgcugcccgacacagggcgaggcuacccugguggaggagcaggacgccaacuucgucugccggcgcaccuucguggaccgggggugggggaacggcugugggcuuuucggcaaggggagccucuugacgugcgccaaguucaagugcgugacgaagcuggagggcaagauaguccaguacgaaaaucucaaguacuccguuaucgugacaguacacaccggcgaccagcaccagguggguaacgagaccacggagcacggcaccaucgcgaccaucacgccccaggccccuaccagcgagauccagcugaccgacuacggggcccugacgcucgacuguucuccccgcaccggccuggauuucaacgagaugguccugcuaaccaugaaggagaagaguuggcuggugcacaagcaaugguuccuggacuuaccgcugcccuggacgagcggggcuagcaccagccaggagaccuggaaccggcaggaccugcucgugaccuucaagacggcccacgcgaagaagcaggaggucguggugcugggcucccaggagggcgccaugcacaccgcccuuacaggggccaccgagauccagacgaguggcaccaccacaaucuucgccggccaccucaagugccgccugaagauggacaaacuuacgcucaagggcauguccuacgugaugugcaccgggagcuucaagcuggaaaaggagguggcggaaacccagcacggcacaguucugguccaggugaaguacgaggggacggacgcccccugcaagauccccuucuccacccaggacgagaagggggugacccagaacggucggcugaucaccgccaauccgaucgucacggacaaggagaagcccgugaacaucgagaccgagccacccuucggggagagcuacauagugguaggcgccggggagaaggcccucaagcucuccugguucaaacgcgggucuuccaucggcaagauguucgaggccaccgcucggggagcccgccgcauggccauccugggcgacaccgccugggacuucgggagcauuggcgguguguucacguccguugggaagcucguucaccagaucuucggcaccgcauacggcgugcuguucagcggcguguccuggaccaugaagaucgggaucggcauccugcucaccuggcuggggcugaacagccgguccacgagcuuguccaugacaugcaucgcugucggaauggugaccuuauaccucggagugaugguccaggccgauagcgggugcguuauaaacuggaagggacgcgagcucaagugcggguccggcaucuucgugacuaacgagguccacaccuggacugagcaguacaaguuccaggccgacagcccuaagcggcugagcgcggccaucggcaaggccugggaggagggggugugcggcauccgcuccgccacccggcuggagaacaucauguggaagcagaucucaaacgaacucaaccacauccuacuggagaaugacaugaaguucaccguuguagugggggacgcuaaugguauccucgcgcaggggaagaaaaugauucgcccccagcccauggagcacaaguacuccuggaaaagcugggguaaggccaagaucaucggcgccgacauccagaacaccacguucaucaucgacgggcccgacaccccggagugccccgacggccagcgggccuggaacauaugggagguagaggacuacggguucggcguauucaccaccaacaucugguuaaaguuacgcgacaguuacacgcagaugugcgaucaccggcugaugagcgcggccaucaaggacucaaaggccgugcacgcagacaugggcuacuggauugagagcgaaaagaacgagaccuggaagcuggcccgcgcguccuucaucgaggugaagaccugcaccuggcccaaaagccacacgcugugguccaacgggguccucgagagcgagaugauaauccccaagaucuauggagggcccauaucccagcauaacuaucggcccggcuacuucacccagacugccgggcccuggcaucuaggaaagcuggaguuagacuuugaccugugcgagggcacaacagugguugucgacgagcacugcggcaaucgcggcccuagccugcggaccaccaccgugacggguaagaucauccacgaguggugcugccgcuccugcacccuaccaccccuucgguuccgcggcgaggacgggugcugguacggcauggagaucaggcccgugaaggaaaaggaggagaaccugguccgcagcaugguguccgccgggagcggggagguggauagcuucucucucggcauccuguguguuagcaucaugaucgaagaggugaugcgcucccgauggucuagaaagaugcugaugaccgggacccucgccguguuccuucugcucaucaugggccagcugacguggaacgaccugaucaggcucugcaucauggugggagccaaugccucugaccgcaugggaaugggcaccaccuaccuggcccuuauggccaccuuuaagaugcggccaauguucgccguggggcucuuauuccgucggcugacgagccgcgagguucuccugcuaacgaucggccucucgcuggucgcgagcguggagcuacccaacucccucgaggagcugggggacggccuggcgaugggcaucaugaugcucaagcuguuaaccgaguuccagccccaccagcucuggaccacucuacugagccucaccuucgucaagaccacccugucccuggacuacgccuggaagacgaccgccauggcccugagcaucguuucccuguucccccugugccucagcaccaccucacagaagacgaccuggcugccggugcuccucgggucguucggcugcaagccccugaccauguuccugaucaccgagaacaagaucugggggcggaaguccuggccccucaaugagggcaucauggcuauagggaucgucagcaucuugcuguccagccuccugaagaacgacgucccucucgccggcccgcuaaucgccggcgggaugcugaucgccugcuacgugauaagcggcuccagcgccgaccugucccucgagaaggcggccgaggucagcugggagcaggaggccgagcacuccggggcaagccauagcauccugguggaggugcaggacgauggcaccaugaaaaucaaagacgaggagcgcgacgacacacugaccauccuccugaaagccacccugcucgcggucagcgggguguaccccaugaguauacccgccacgcuguucgugugguacuucuggcaaaagaagaagcagcggagcggcguccugugggacacgccuagcccuccagagguagaacgcgccgugcucgacaauggcaucuaccgaauccugcagcgcggacugcuaggcaggagccaggucggggugggcguguuccaggacggggucuuccacaccauguggcacgugacacggggcgcugugcucauguaucagggcaaaaggcuggagcccuccugggcuagcguaaagaaggaccugaucuccuacgggggcggguggcgguuccagggcagcuggaacaccggggaggagguacaggugauugcggucgagcccggcaagaacccgaaaaacgugcagacgacucccggcaccuucaagacccccgagggggaggucggcgccaucgcgcucgacuucaagccggggacgaguggcagcccgaucguaaaccgggagggcaagaucguggggcuguacggaaacgggguggucaccaccuccggcaccuacgugucggccaucgcccaggccaaggcgagccaggaggggccccugcccgagaucgaggacgagguguucaagaagcguaaccucacgaucauggaccugcacccgggcuccgggaagacacggcgcuaccugcccgccaucguccgggaggccaucaagcgcaagcuccgcacccugauacuggcgcccacccggguggucgccagcgagauggccgaggcacucaaggggaugcccauccgcuaccagacgaccgccgucaaguccgagcacaccggccgggagaucgucgaccugaugugccacgcgaccuuuacgaugcgccugcucagcccggugagaguucccaacuacaacaugaucaucauggacgaggcucacuucaccgaccccgccuccaucgccgcccgcggguacauuaguacccgggugggcaugggugaggcggccgccauauucaugaccgccacucccccgggcuccguggaggccuucccccagucuaacgcggucauccaggaugaggagcgcgacauccccgagcgguccuggaacagcggcuacgacuggaucaccgacuucccggggaagaccgugugguucgugcccuccaucaagagcgguaacgacauagccaacugccugcgcaagaacgggaagcgggugauacagcugucccgcaagaccuucgacacggaauaccagaagacaaagaacaaugacugggacuauguggugacaaccgacaucagcgagaugggcgccaacuuccgggccgaccgcgucaucgacccgcggcgcugccucaagcccgugauccugaaggaugggcccgagcgggugauucuggcgggcccuaugcccgugacagccgccuccgccgcccagcgucgggggagaaucgggcgcaaccagaacaaggagggcgaccaguacguguacauggggcagccccucaauaacgacgaggaccacgcgcacuggaccgaggcaaagaugcugcuggacaauaucaacaccccggaaggcaucauuccugcccucuuugagcccgagcgagagaaaagcgcagccauugacggggaguaucgccugcguggagaagcgcgcaaaacuuucgucgagcugaugcggcgcggggaccuccccgugugguuauccuacaagguggccuccgagggguuccaguacuccgaucggcguuggugcuuugacggcgagcggaacaaccagguccuggaggagaacauggacguggagaucuggacgaaagagggggagcgcaagaagcuccggccccgcuggcuugaugcccgcaccuacucagacccgcuugcccuucgcgaguucaaggaguucgccgcgggccgucgcagcguguccggcgaccuaauccuggagaucgggaagcucccccagcaccugacccugcgggcccagaacgcccucgauaaucuggucaugcugcacaacagcgagcagggcgggaaggccuaccgccacgcgauggaggagcuccccgacaccauagagacccugaugcugcucgcccugaucgccguccugacgggaggggugaccuuauucuuccuaagcgggaagggccuggggaagacuagcaucggucuccuuugcgucaccgccuccagcgcacugcucuggauggcguccguggagccacacuggaucgccgccagcaucauccuggaguucuuccugaugguccuccugaucccugagcccgaucggcagaggacuccccaggacaaccagcuggccuacgucgugaucggccuccuguuuaugauccugaccguggccgccaaugagaugggccuccuggagaccacaaagaaagaccuggggaucggcuacguugccgccgagaaccaccagcacgcaaccaugcucgauguggaccugcaccccgcuucggcguggacccuguacgccguggccaccaccgucauaacgcccaugaugcggcacaccaucgaaaacaccacugccaauaucagccucacagccaucgcgaaccaggcugccauccugaugggccuggauaagggguggcccaucucaaagauggacaucggcgugccccuccuggcccuaggguguuacagccaggugaacccgcuuacccugaccgcggccguccugaugcucgucgcucacuacgccaucauaggccccgggcugcaggccaaggcgacccgcgaggcccaaaagcgcacggccgcaggcauuaugaagaaccccaccguugacggcaucgucgccaucgacuuagaccccgugguguacgacgcgaaguucgagaagcagcucgggcaaaucaugcuucugauccucugcaccagccagauccugcugaugcggaccacgugggcccugugcgagagcaucacccuggccaccggcccgcugaccacgcucugggaggggucccccggcaaguucuggaacaccaccauagccgucagcauggccaacaucuuccgcggcagcuaccuggcgggggccggccuggcauucucccucaugaagucucugggcggcgggcggcgaggcaccggcgcccaaggggagacgcugggcgagaaguggaaacggcagcucaaccagcugagcaagagcgaguucaacaccuacaagcguuccgggaucauggagguagaccggagcgaggcaaaggaaggccugaagcgaggggaaaccaccaagcacgcuguuucccggggcacggccaaacuccgcugguucguagaacggaaucuggugaagccagaaggcaaggugaucgaccuggggugcggucgggguggauggagcuacuacugugcugggcugaaaaaggucacugaggucaaaggcuacaccaagggcgggcccggccacgaggagccgauuccgauggcaaccuacggguggaaccucgugaagcugcacuccggaaaggacguguucuuuaugccacccgaaaagugcgacacccugcucugcgacaucggggagucauccccgaaccccacgauagaggagggaagaaccuugagagugcugaagaugguggagcccuggcucagaggcaaccaguucugcaucaagauccugaaccccuacaugccaagcguugucgagacacuggagcgcaugcagcggaagcacgggggcauguuagugcgcaaccccuuauccagaaacagcacccacgagauguacugggucuccugcggcaccggcaauaucguaagcgcgguaaacaugaccucccgcaugcugcuuaaccgcuucacuauggcccaccggaagcccaccuacgagcgcgacgucgaccugggggccgggacgcggcacguggccguggagcccgaggucgccaaccuggacauaaucggccagcgcauagaaaauaucaagaacgagcacaagucuaccuggcauuacgacgaggacaacccuuacaagaccugggcguaccacgggagcuaugaggugaagccuagcggcuccgcuagcucaauggugaacgggguagugcggcuccugaccaagcccugggacgucaucccgauggugacccagauagccaugaccgauaccaccccguucggccagcagcgcguguucaaggagaagguagacacgcggacaccccgcgccaagcggggcaccacucagaucauggaggugacggccaaauggcuguggggcuuucucagccgcaacaagaaaccccggaucugcacccgggaggaguucacccggaaggugaggagcaacgcugcgaucggcgccgucuucguggacgagaaccaguggaacuccgccaaggaggcaguggaggacgagcgguucugggaccugguccaccgcgagcgggagcugcacaagcaggggaagugcgcaaccugcguguacaauaugauggggaagcgcgagaagaagcucggggaguucggcaaggccaagggaucacgggccaucugguacauguggcugggagcccgcuuccuggaguucgaggcccucggguucaugaacgaagaccacugguucucccgggagaacagccuguccggcgucgagggagaggggcugcacaagcucggcuacauccugcgcgacaucagcaagaucccgggcggaaacauguacgccgaugacacugccggcugggacacccgcgucaccgaggacgaccugcagaacgaggccaagaucacagacaucauggagccagaacacgcgcuccuggcgacguccaucuucaagcugaccuaccagaacaagguggugcggguccaacgaccagccaagaacgggaccguaauggacgugaucagccggcgcgaccagcggggcaguggccaggucgggaccuacggccucaacacguuuaccaacauggagguccagcugauucgccagauggagagcgaggggaucuuccugcccuccgagcucgagaccccgaaccucgcagagcgggccuuggacuggcucgagaagcacggggccgaacgucugaagcggauggcgaucagcggggacgacugcguggucaagccuauugacgaccgcuucgccaccgcccugacggcccucaaugacaugggcaaggugcggaaggacauaccccaaugggaacccuccaaggguuggaacgacuggcaacaggugccguuuugcucccaccacuuccaucagcugaucaugaaggacggccgcgagauugucgugcccugccggaaccaggacgagcuggugggccgagcucgggucucccagggggccggauggagccuucgcgagaccgcgugccuggggaaguccuacgcacagauguggcagcugauguacuuccaccggcgcgaucuccgucuggccgcgaacgcaaucugcagcgcggugccugucgacuggguccccaccagccgcaccaccugguccauucaugcccaccaccaguggaugacgacagaagacaugcugagcguuuggaaccgcguauggaucgaagagaacccguggauggagaacaaaacccacguguccagcugggaggaggugcccuaucucgggaagcgagaagaccagugguguggcucacugaucggguugaccgcucgggccacgugggccaccaacauccagguggccauaaaccagguccggcgccuaaucggcaacgagaacuaucuggacuauaugaccagcaugaagcgguucaagaacgagucugacagcgagggggcccugugguga

SEQ ID NO: 23984 - RNA, 9879 nt, Artificial Sequence
  derived and/or modified CDS sequence (opt11) from DENV-1__KJ189351__SS-prME
aguguuaccaugcuucugaugcuacugccaacaguacuggcuuuccaccucaccacccgcggcggggaaccgcauaugauaguuucaaaacaagaaaggggcaaaucccuccuauuuaaaaccagugcuggaguaaacauguguacacucauagcgauggaccucggagaacuuugcgaagacacgaugacauacaaaugcccccggaucacagaagcggaaccugacgacguggacugcuggugcaacgccaccgacacaugggugacguacgguacguguucgcaaacaggcgaacaccggcgagagaagcguuccguagccuuagcuccccacgugggccugggccuagaaacaaggacagaaaccuggauguccucggagggggccuggaaacaaauacaacgggucgagacaugggcgcugagacaccccggcuucaccguaauagcauucuucuuagcgcacgcaauagggacauccauaacgcaaaagggaauaauauuuauacuccugaugcuuguaaccccaucaauggcaaugcgaugcguagggauugguaaccgcgacuucguggaaggccugagcggcgcgaccuggguggacgucguacucgaacauggauccugugugacgacuauggcgaaaaacaaaccgacacuagacaucgaacuacucaaaaccgaggucacaaacccggcuguauuaagaaaacucugcauagaagccaagauaucaaauacuaccacggacucgcgguguccgacacaaggagaagcaacccuggucgaggagcaagacgccaacuucgugugcaggcgaacauuugucgaccgaggcuggggcaacggauguggacucuuuggaaaaggcucccugcuaacgugcgcaaaguuuaagugcgucaccaaauuggaagguaaaauuguccaguacgagaaccucaaauacucagugauugucacuguacacaccggagaucaacaucaaguaggaaaugagaccacagagcaugggacgauagcaacgaucacgccccaggcgccgaccuccgagauacaacucacggacuauggggcacugacgcuggauugcucgccacgaaccggcuuagacuuuaacgagaugguccugcuaaccaugaaagagaaaagcuggcuaguacauaaacaaugguuccuagaccucccacugccauggacucccggcgcgucaacaagucaggagaccuggaaucgucaggaccuucuagugacauuuaaaaccgcgcacgccaagaaacaagaagucgugguuuuaggaucccaagaaggagccaugcacacggcacucacaggggccaccgagauacaaacaucggggacaaccacuaucuucgccggucaccugaaaugucgucucaagauggacaagcucacccuuaagggaaugagcuacguaaugugcacgggaucauuuaaacuggaaaaagaggucgcggaaacccaacaugguacagugcucguccagguaaaauacgaaggcaccgacgcaccgugcaagaucccuuucagcacgcaggacgagaaagguguaacccagaaugggcgcuugauaaccgcaaaucccauugucacggacaaggaaaaaccagucaacaucgaaacagagccgccguucggugaguccuacauaguagucggcgcuggagagaaggcccucaagcucaguugguucaagaggggaucuucaauagggaaaauguucgaggcaacggcgcggggcgcccggcguauggccauacuaggggauaccgcaugggacuucggcuccaucggcgggguauucaccagcguuggcaagcuggugcaccaaguuuucggaacagcguacgggguccuauucagcggcguguccuggacuaugaaaauaggcauuggaauacuacuuacauggcuaggccugaacucccguuccacaucacucucgaugacgugcauagccguugguaugguaacccucuaucuagguguuaugguacaggccgacucaggguguguaaucaacuggaaagggcgcgagcuaaaaugcggcagcggaaucuucgucacaaaugaaguccacaccuggaccgaacaauacaaguuccaggcggacagcccgaaacggcuaagcgccgcgauagguaaagccugggaagagggcgugugugggauacggucggcuacacggcuagaaaacauaauguggaaacagaucagcaacgaacucaaccacauccuccuagaaaacgauaugaaguucacggugguaguaggugacgcaaacggaauccuagcccaggguaaaaagaugauccgaccccagccgauggagcacaaauacaguuggaaaagcugggggaaagcgaagauuauaggagcugacauccaaaacacgacauucauuaucgacggccccgacacgccagaaugccccgacggccaacgcgcauggaacauuugggagguagaggacuacggauucgguguguucacaaccaacaucuggcucaaauuacgagacucuuacacacagaugugcgaccaccgguugaugucagcugccauuaaggacucgaaggccguucacgccgauaugggauacuggauagaaucagagaaaaaugagacauggaagcuggcaagagcguccuuuaucgaaguaaagacuuguaccuggccaaaaagucacacacuuuggaguaauggggugcuagagagcgaaaugaucauccccaaaauauauggaggaccgaucagucagcacaacuaccguccgggcuacuucacgcaaacggccgggccuuggcaccuaggcaaacucgaacuggauuucgaccuaugcgaaggaacgacgguuguaguggacgaacacugcgguaaccgaggcccgagccuucggacgacuacggucacugguaaaauaauccacgaaugguguugccguuccugcacucugccaccccugagauucaggggagaagauggauguugguauggaauggaaauaaggccaguaaaagaaaaggaagagaaucuaguccggucaaugguaagcgcuggcagcggcgaagucgauuccuucuccuugggcauacuauguguguccauaaugauagaagaaguaaugagaagccgcuggagucgcaaaauguuaaugacuggaacccucgccgucuuccugcugcuuaucaugggacagcuaacguggaacgaccugacuaggcugugcaucauggugggagccaacgcguccgaucgcaugggaauggggaccacguacuuagcacucauggcgaccuucaaaaugcgcccaauguucgccguaggccuccucuucagacggcucacuucgcgggaagugcuacuacucaccauaggcuugagcuuaguagcgucgguagaacuaccaaauucacucgaagaacuaggcgacggauuggcgaugggcauaaugaugcugaagcugcugacggaguuccaaccccaccagcuguggacaacucuauugucacuaacauucgucaaaacaacucucucgcuagacuacgcguggaaaaccaccgcgauggcacuuagcauaguauccuuauucccccucugccugagcacgacgucacagaaaacgacaugguuaccuguucuacuuggauccuucgggugcaaaccacuuacgauguuucucauagcagaaaaccgaauauggggucgcaaaucauggccauuaaaugaaggaaucauggccauaggcauaguaagcauacugcuuagcucccuccucaaaaacgacguaccauuagccggaccucugaucgcgggaggcaugcuaaucgccugcuacguaauaucaggguccagcgcggaucugucccuugagaaagccgcggaggucuccugggaacaagaggcggagcacagcggcgcaucacauagcauucuaguagaagugcaagacgacgguaccaugaaaaucaaggaugaagaacgagacgacacgcucacaauucuacucaaagcaacccuacucgccgugucggggguguacccuaugaguauaccugcaacgcuguucgugugguacuucuggcagaaaaagaaacagcgaucgggcgugcugugggacaccccuagcccaccagagguggagcgugccguccucgacaacgggaucuacagaauccugcaacgaggcuuauuaggcaggagccaaguggggguuggaguauuucaagacgggguuuuccacacaauguggcauguuacgcgcggcgcggugcugauguaccaaggaaaaagacuagaacccagcugggcuucggucaagaaagaccuaauuucuuauggcggaggcuggcgcuuccaaggaucguggaacacgggcgaagagguccaaguaauagccguagaaccaggcaaaaaccccaaaaacguccaaaccacuccaggcaccuuuaagaccccagagggagaaguuggagcaauagccuuagacuuuaaacccggcaccagcgggagucccaucguuaaccgcgagggaaagauugucggacuauacggaaacgggguugucaccacgucuggcacguaugucuccgcaauugcccaagcgaaggcaagccaagaagggccgcucccagaaaucgaagacgaaguguucaagaaacggaaucugacaauaauggacuuacaucccggaagcgguaaaacgcgccgcuaccuuccagccauaguccgggaggcgaucaaacgaaaacuuagaaccuuaaucuuggcucccacacgagugguagccucagagauggccgaggcacuuaaaggcaugccuauccgcuaccagacaacggcaguaaaaagcgaacacacaggcagggaaauaguagacuuaaugugccacgccaccuuuacaaugagacugcugucccccguccgggugcccaacuacaauaugauuaucauggacgaagcgcacuucaccgaccccgccaguauagccgccagaggguacauauccacgagagucggcaugggggaagcagccgcaaucuuuaugacggcaacacccccggguucagucgaggcauucccgcaaagcaacgcgguaauucaagacgaagaaagagacauuccagagcggaguuggaacaguggauaugauuggauuacggacuuucccggcaaaacagucugguucguaccaucgauaaaaagcggaaacgauaucgcaaacugccuacggaaaaacggaaaaagagugauacagcucuccaggaagaccuucgacacugaauaucagaaaacuaagaacaacgacugggauuacguaguuacaaccgacaucuccgaaaugggggccaacuuccgagccgaccgcguaaucgacccgcgacgaugccugaagccagugauacugaaagacggaccagaaagggucauacuggcgggaccuaugccgguaacaguggcgagcgccgcgcagaggcggggacgcauaggcagaaaccaaaauaaagaaggagaccaguacgucuacaugggccaaccacugaacaacgaugaagaucacgcccacuggacagaagcaaagaugcuccuggacaauaucaauacacccgaagguauaauaccagccuuguucgagccagaaagagagaaaagcgccgcaauugacggggaauaucguuugcgcggugaagcuagaaagacauucgucgaguuaaugagacggggugaccuuccaguguggcucagcuacaaagucgcuuccgaaggauuccaauacuccgacaggcgcuggugcuuugacggagaacgcaacaaccagguucucgaggaaaacauggaugucgaaauuuggacaaaggaaggagaaaggaagaaacuacgcccaagauggcuagaugcccggaccuacucagacccgcuagcacuucgggaguuuaaagaguucgcggcggggcgucgcucggucucaggcgaucucauccuugaaaucgggaaguuaccacagcauuugacucuccgggcacaaaacgcucucgauaaccuagugauguuacauaacagcgaacaagggggaaaagccuaccggcacgccauggaagaguugccagauacgauagaaacccugauguuacuagcacuaaucgcgguucucacgggaggcguaacacuuuucuuucuaucaggaaagggacuuggcaagacaucaauaggacuacuaugcgugaccgcgaguucggcucuccucuggauggccucagucgaaccccacuggauagccgcuucgaucauccuagaguucuuccucaugguacugcucaucccagaacccgaucgccaacgaacaccgcaggauaaccagcuugcauacguaguuaucggacuccuauucaugauacucacaguagccgcaaacgagaugggccuacuagaaaccaccaagaaagaccucggaauaggguaugucgccgccgaaaaccaccaacacgcgacaaugcuugacguggacuuacaucccgccucagcguggacuuuguacgcuguagcgacgacagucauaacaccaaugaugcgacauacuaucgagaauacgacagcgaacauaagccugacggcgauagcgaaccaggcggccauacucaugggacuagacaaaggauggcccauaaguaaaauggacauugggguaccucuccucgcccuaggauguuauucucaaguaaacccgcuaacacugacggccgcaguccuaaugcuggucgcacacuacgccauuauagggcccggucuacaagcaaaggcgacuagagaagcucagaaaaggaccgccgcuggaaucaugaaaaacccgaccguugaugguauaguagcgaucgaccucgaccccguaguguacgacgcaaaguucgaaaaacaacuagggcagaucauguugcuaauucucuguacaucccagauccuccugaugagaacaaccugggcgcugugcgaaagcaucacauuggcuacuggcccccuaacuacccugugggaaggguccccuggcaaauucuggaauaccacuaucgcaguaagcauggccaauauauuuagaggcaguuaccuagcgggcgccggccuugccuucucccucaugaagagucuaggcggcggacggcggggcacaggggcacaaggggaaacuuuaggagaaaaguggaaaaggcaauugaaucaacuaagcaaaucagaguucaauaucuacaagagaucagggaucauggaaguagauagaagcgaagcaaaagagggauugaagagaggggaaaccaccaagcacgcugucucccgcgguaccgcgaaacuccgaugguucgucgaaaggaaccuagucaaacccgaaggaaagguaauagacuugggcuguggacguggaggauggagcuacuauugcgcagggcucaagaaaguaacagaagucaaaggguacacaaaaggcggacccggacaugaggagcccaucccaauggcaacguauggauggaaccuagugaaacuccacucgggcaaggacguauucuucaugccgccagaaaagugugacacgcuucugugcgacauaggagaauccaguccgaauccaacaaucgaggaaggacgaacccuccgaguguuaaaaaugguagaaccauggcugcgagggaaccaguucugcgugaagauucucaacccguacaugccauccguuguagaaacccuggaaaggaugcagcgcaaacaugguggcaugcucguccgcaacccccuuucccguaacucaacccacgagauguauuggguuucaugcggcaccgggaauauagugucagccgucaacaugacuucccggaugcuccuaaacagauucacuauggcccaucggaagcccaccuacgaaagggacguugacuugggugcaggaaccagacauguagcgguugagccugagguugcuaaccucgacauaauagggcagcgaaucgaaaauaucaaaaaugagcauaaauccaccuggcauuaugaugaagacaauccguauaagacaugggccuaccauggauccuacgaaguuaaaucuagcggcucagcuagcuccaugguaaacggagucgugcgccugcuaaccaagcccugggaugugauaccgauggucacccaaauagcaaugacagauacuacccccuucggccaacaaagaguuuuuaaggaaaagguggacacuagaacgccacgagcgaaaaggggaaccacucagauaauggagguaacagccaagugguuauggggguuccugucgcgaaacaagaaaccacggauauguacccgggaggaguuuacgcgcaagguacgaagcaacgccgccaucggagcggucuuugucgacgagaaccaauggaacucggcgaaagaagcaguugaagaugagcgcuucugggacuugguacaccgggagagggaacuccacaaacaggggaagugcgcaacaugcguauauaacaugauggguaaacgggaaaagaagcugggggaauuugggaaggccaaagggagcagagcuauaugguauauguggcuaggcgccagauucuuagaguucgaagcacuuggcuucaugaacgaagaccacugguuuagucgcgagaacucucucucggggguggaaggcgaaggccuccacaagcuaggauacauacuccgugacaucucuaaaauccccggugggaacauguacgccgaugacacggcgggaugggacacacgaauaacugaagacgaccuucaaaacgaggcgaaaauuacugacaucauggaaccagaacacgcccuacucgccacgucaaucuucaaauuaacauaccaaaacaaaguagugcggguccagcgacccgcgaaaaacggcacaguaauggaugugauaagucgccgcgaccagaggggaucaggccaagucggaaccuacggacugaacaccuucaccaacauggagguccagcucauccgacaaauggaauccgaaggaauauuccuaccuagcgaacuugagacaccgaaccuggccgaaagagcccucgacuggcucgaaaaacacggagcagagcgacucaaacgaauggccaucagcggcgacgacugcgucgugaaacccauagaugaccgauucgcgacagcccuaacagcacuaaacgauauggggaaggugaggaaagacauaccacaaugggaaccaucaaaaggguggaacgacuggcagcagguacccuucugcagucaccacuuucaucaacucaucaugaaagacggacgagaaaucguagucccuugucgcaaccaagacgaauugguuggccgggcuagaguaucgcagggugccggauggucacucagggagacugcaugccuggggaaguccuacgcccagauguggcaacuaauguacuuccaccgaagggaccuaaggcucgcagccaacgcaauuugcuccgcagugcccguagacugggugccgacgagccgcacaacguggucaauacacgcccaccaccaauggaugacgacagaagacaugcucucgguuuggaaccgcguuuggaucgaggaaaacccguggauggaagacaaaacccacguaagcaguugggaagaaguuccuuaccuaggaaaacgagaagaucaauggugcggcucgcuuauuggucugaccgcucgagcgaccugggcgacgaacauucagguugccauaaaccaaguaagaaggcucauaggaaacgaaaacuacuuagacuacaugacgagcaugaaacgcuucaaaaacgaaucagacuccgagggagcucucugguag

SEQ ID NO: 23985 - RNA, 9879 nt, Artificial Sequence
  derived and/or modified CDS sequence (opt11) from DENV-1__KJ189352__SS-prME
uccgugacgaugcugcucaugcugcugccgacugcccucgccuuccaucuuaccacccggggcggugagccccacaugaucgugucaaaacaggagcggggcaagagccuccuguucaagacuuccgccggggucaacaugugcacccugaucgccauggaccugggcgaguuaugcgaggacacuaugaccuauaagugucccagaaucacagaggccgaacccgacgauguggacugcuggugcaacgcgacagacaccugggugacguaugggaccugcucacaaaccggugaacaccggcgggagaagcguuccguggcguuggcgccucaugucggccuggggcucgaaacccgaaccgagaccuggaugagcagugagggcgccuggaagcagauacagcgggucgagaccugggcccugcgccaccccgguuucacuguuaucgccuucuuccuugcgcacgcgaucggaaccaguaucacgcagaagggcauuaucuucauccuccugaugcuggugacccccuccauggccaugcggugcgugggcaucgggaaccgcgacuucguggaggggcucagcggcgccacguggguggaugucgugcuugagcacgggucgugcguuaccacaauggcgaagaacaagcccacacuggacaucgaauuacugaagacggaggucacgaaccccgcgguccuucggaaacugugcaucgaagccaagaucagcaauaccacgacggauucccgcugcccaacccagggcgaggcuacccugguggaggagcaggacgccaauuucgucugccgucgcacuuucguggaccggggaugggggaacggcugcggccuguucggcaaggggucucuccugacgugcgccaaguucaagugcgugaccaagcuggagggaaagauuguucaauacgaaaaucucaaauacagugugaucgugaccgugcacaccggcgaccagcaccaggugggaaacgagaccacggagcauggcaccauugcgaccaucacuccccaggcacccacgagcgagauucagcugaccgauuacggugcgcuuacccuggauugcagcccgcgcacaggccuggacuucaacgagaugguccuucucacgaugaaagagaaguccugguuagugcacaagcagugguuucuggaucucccuuugcccuggaccuccggcgccagcaccagccaggagaccuggaauagacaagaccugcucgugacguucaagaccgcccaugcgaagaagcaggaggucgucguacuggggagucaggagggagccaugcauaccgcccuuaccggggcaacggagauccagacgaguggaaccaccacgaucuucgccggacacuugaagugcaggcugaagauggacaagcugacccucaaaggcauguccuacgucauguguacugggucauucaaguuagagaaggagguagcggaaacccaacacggcacggugcugguacaggugaaauacgagggcacggaugcgccgugcaagaucccuuucucuacccaggacgagaagggcguuacgcagaauggccgucugaucaccgcgaacccgaucgucaccgacaaggagaagcccguuaacaucgagaccgaaccucccuucggggagagcuacaucgucguuggcgccggcgagaaagcgcucaaguuauccugguucaagcgcgggagcuccauuggaaagauguucgaggcaaccgcccgcggggcccgccgcauggccauccucggugauacugcgugggacuucgggagcauuggggggguguucaccagcguugggaagcucguucaucagauuuucggcaccgccuauggugugcuguucagcggcgugaguuggaccaugaagaucggcaucgggauccuguugaccugguuaggccugaacagccggucaaccagccuuagcaugaccugcaucgcaguggggauggugacucuguaccugggcguuaugguccaggcugauagcggcugcgucaucaacuggaagggccgcgagcucaagugcggauccggcaucuucgucacgaacgaggugcacaccuggaccgaacaguacaaguuccaggcggacucgccuaagcggcugagugcggccaucggcaaggcuugggaggaaggggucugcgguaucagauccgccacccgucuggagaauauuauguggcgccagaucagcaacgaacucaaucacauccuguuggagaaugacaugaaguuuaccguugucgucggggacgccaacggcauccuugcgcaggggaagaagaugauccguccccagccuauggagcacaaauauucguggaaguccuggggcaaagccaaagugaucggagcugacauucagaacacgaccuucauuaucgacgggccagauaccccggagugccccgacggccaacgggccuggaacaucugggaaguggaggacuacggcuuuggaguguuuaccacuaacauaugguugaagcugagggacuccuacacccagaugugcgaccaccgccucaugagcgccgccaucaaggauucgaaggcagugcacgccgacaugggcuacuggauagaaagcgagaagaacgagaccuggaagcuggcccgggcuagcuuuaucgaggucaaaaccugcacguggccuaagucgcacacacugugguccaacggggugcucgagucggagaugaucauuccgaagaucuacggcgggccgauuucgcagcacaacuaccguccgggcuauuucacccaaaccgccgggcccuggcaucugggcaagcuggagcucgacuucgauuuaugcgaggguaccaccguggucgucgacgagcauugugggaaucggggcccgagccugagaaccaccaccgugaccggcaagauuauacacgaguggugcugccgauccugcacgcucccgccccugcgcuuccggggcgaggacggguguugguacggcauggagauccgccccgucaaggagaaggaggagaaccugguacgguccauggugucagcaggcagcggggagguagauagcuucucccucggaaucuuguguguaagcauaaugaucgaggagguaaugcgcucccgcuggagucggaagaugcugaugacuggcacacucgccgucuuccugcugcucauaaugggccaacugacuuggaacgaccugauccgacucugcaucauggugggggcgaaugcauccgaccggaugggcaugggcaccaccuaccuggcgcugauggcaaccuucaagaugcgcccaauguucgccguggggcuccuuuucagacgcuuaaccagccgggagguucuccuguuaaccaucggcuuaaguuugguugcgagcgucgagcugcccaacucccuagaggaacugggggacggccuggcgaugggcaucaugaugcucaaacugcuaaccgaguuccaaccacaccaacuguggacgacccugcuaagccuuacuuucgugaagaccacgcuguccuuagauuacgccuggaagacuaccgccauggcgcuaagcaucgugucccuguucccucuaugcuugucgacgacgucgcagaagaccacguggcugccgguucuucucgggagcuucggcugcaagccccugaccauguuccugaucaccgagaauaaaauuugggggcgaaaauccuggccccucaacgagggcauaauggcgaucgggaucguaagcauccugcucuccucccuccucaagaacgacguuccccuggcuggcccgcucaucgcaggcgggaugcugaucgcaugcuacgucaucagcggcuccagcgccgaccucagccuugagaaagcagcggaggugucgugggagcaggaggcugaacacuccggggcuucgcacuccauccuagucgagguacaggacgacggcacgaugaagauaaaagacgaggagcgagacgauacccugaccauccuccugaaggcaacucuccucgcugugagcgggguguaccccauguccaucccugccacccuuuuugucugguauuucuggcagaagaagaagcagagauccggaguacucugggacacccccuccccgccagagguggagagagccguccucgacaacggcauauaccgcauccugcagcgcgggcugcugggccgcagccaggugggggugggcgucuuccaggacgguguauuccauaccauguggcacguuacgcggggcgccguccucauguaccagggcaagcgccuggaacccuccugggccagcgugaagaaggaccugaucaguuacggcggaggguggcgguuccagggcucauggaacaccggggaggaggugcaggucauugcgguggagcccggaaagaauccgaagaacgugcaaacgacccccgggacuuucaagacgcccgaaggcgagguuggcgccauugcccucgacuucaagcccgggaccuccggcuccccgaucguuaaucgcgagggcaagauuguggggcucuacggaaacgggguugugaccaccuccggcacuuacgugagcgcaaucgcgcaggcaaaggccagccaggaggggccccuccccgagauugaggacgagguuuucaagaagcggaaccucaccauuauggaccugcacccgggauccggcaagacccgccgauaccuacccgccaucgugcgagaggccauaaagcggaagcuccgcacccugauccuggcgccaacgcgcguggucgccuccgaaauggccgaggcccucaaggguaugccgauccgguaccagacaaccgccgugaaguccgagcacacggggcgcgagaucguggaccugaugugccacgcgacguucaccaugcggcugcucagcccuguccgcgugccgaacuacaacaugaucauaauggacgaggcacacuuuacugaccccgccaguaucgcagccaggggauacauuucaacccgcguggguaugggagaagcggcugcuaucuucaugacggccacgccgcccgguagcgucgaggcguucccccagaguaacgcggugauccaggacgaagagagggacauccccgagagauccuggaacaguggcuaugacuggaucacggacuucccggggaaaaccgugugguuuguaccaucgauuaaaagcggcaaugacaucgccaacugccugcguaagaacgggaaacgggugauucagcuguccagaaagaccuucgauaccgaguaccagaagacgaagaacaacgacugggauuacguggucacuacggacaucagcgagaugggcgccaacuuccgcgcggaccgggugauugacccgcgacggugccucaagcccgugauucuuaaggacgggccggagcgagucauccuggcgggcccgaugcccgugacggccgccuccgccgcacagcggcgcggccgcaucgggcggaaccagaacaaggagggcgaccaguacgucuacauggggcagccccucaauaacgacgaggaccacgcgcacuggaccgaggcuaagaugcuccuggauaacaucaacacccccgagggcaucaucccggcauuauucgagccggagcgcgagaaauccgcggcuauagauggggaauaccgguugcguggggaggcgcgcaagacauucgucgaacugaugcgccggggcgaucugccuguguggcuguccuacaaggucgccucugagggguuccaauauuccgaccgccgguggugcuucgauggcgaacgcaauaaccaggugcuggaggagaacauggacgucgagaucuggaccaaagaaggugagcggaaaaagcuccgcccccgguggcuggacgcccgcaccuacagcgacccacuggcccuacgggaguucaaggaguucgccgcuggucgccggagcgucucaggcgaccugauccuggagaucgggaagcucccgcagcacuugacccugcgcgcccagaaugcccuggacaaucuggugaugcugcacaauagcgagcagggcgggaaggcguaccggcacgcaauggaggaacuccccgauaccaucgagacguuaaugcugcucgcacuaaucgcgguguuaaccggaggggugacccuuuuuuuccuauccgggaagggccuggggaagaccagcauuggccuucugugcgugacggccucuagcgcccuucucuggauggcuuccguggagccccacuggauugccgcgagcaucauucuggaauucuuccuuaugguacuacugaucccugaaccagacagacaacggacgccccaagacaaccagcuagcauacguagugaucgggcucuuauucaugauccugacgguagcugcgaacgaaaugggccuccuagagacaacgaagaaggaccuaggaaucggcuacguugccgccgagaaccaucagcaugcuaccaugcuugacguggacuuacacccggccuccgcguggacccuguacgcagucgccaccaccguuaucaccccaaugaugcggcauacuaucgaaaacaccacggccaacauaagccucacggcgaucgccaaccaagccgcaaucuuaaugggccuggacaagggguggccgaucuccaagauggacaucggcgugccauuacuggcccugggguguuacagccaggugaacccucucacacugacugcggcagugcugaugcucguggcacacuacgcaauuaucggccccggucugcaggccaaggcgacgcgcgaagcccagaaacggaccgccgccggcaucaugaagaaccccaccgucgauggcaucguggcuauugaccuggaccccguggucuacgacgcgaaguuugagaagcaacucgggcagaucaugcugcugauccucugcaccucgcagaucuugcuuaugcgcacgaccugggcgcucugcgagagcauaacucuggccaccggcccauuaacuacccucugggagggcuccccugguaaauucuggaacaccaccaucgcggugaguauggccaacauauuccggggcuccuaccuggcgggggccgggcuggccuucucccucaugaagucccucggcggcggccgccggggcacgggugcccagggggagacucugggagagaaauggaaaaggcagcucaaccagcugagcaaaagcgaauucaacaccuacaagcgguccgggauuauggaaguugacagaagugaggcgaaagagggccuuaagcgcggggagaccacgaagcacgccguuucgcgcgggacugcaaagcuccggugguucguggagaggaaccuggucaagcccgaagggaaagucaucgaccuggggugcggucgggggggcuggagcuacuacugcgccgggcugaagaaggugaccgaggucaagggcuauacuaagggcgggccgggucacgaggagccgauccccauggccaccuacggguggaacuuaguaaagcugcacucggguaaggacguauucuuuaugccgcccgagaaaugcgacacucugcucugugacaucggggaguccucccccaaccccacaaucgaggagggccgcacccugagagugcuaaagauggucgaacccuggcuccgcggcaaucaauuuugcaucaaaauccugaauccuuacaugccaucggugguggagacccuggagagaaugcagcgcaagcaugguggcauguuaguccguaacccccugucccgcaacagcacgcaugagauguacuggguauccugcgggacaggcaacauaguaagcgcugucaacaugaccucucgcauguugcuaaaccgguuuaccauggcccaccgaaagccgacguacgagagagacguggaccugggggccgguacccgccaugucgccguugagcccgagguggccaaccuagacauaaucggccaacggaucgagaauaucaaaaacgagcacaaaagcaccuggcauuacgacgaagacaacccguacaagacgugggcguaccacgguuccuacgaggugaagcccagcggcuccgcaagcucgauggucaacggggugguccgacuccugacaaaaccgugggaugugauccccauggugacccagaucgcuaugaccgauacaacgccuuucggucagcagcgugucuucaaggagaaaguggacacccggacgccccgugcaaagcgaggcacgacgcagauaauggaggugaccgccaaauggcuguggggcuuccuaucccgaaacaagaagccccgcauaugcacccgggaggaguucacgcgcaagguucggagcaacgcggccaucggugccguguucgucgacgagaaccaguggaacucugcaaaggaggcggucgaggacgagcgcuucugggaccuaguucaucgggagagagagcuucacaagcaggggaagugcgcaacgugcguguauaacaugaugggcaagcgggagaagaagcucggugaauucggcaaggcaaaggguagccgcgccaucugguauauguggcucggagcccgguuccuggaguucgaagcgcucgguuucaugaaugaagaccacugguucucccgugaaaauagccuuuccggggucgagggcgaggggcugcacaaacugggcuacaucuugcgcgauaucagcaagaucccgggcggaaacauguacgcagacgacacggccggcugggacacccggguuacagaggacgaccugcagaacgaggcgaagauaacggacaucauggagccggagcacgcccuauuggcgaccuccaucuucaaauugaccuaccagaauaagguggucagaguucagcggcccgcaaagaaugggaccgugauggaugucaucucgcgacgagaccaacgcgggucuggucaaguggggacuuacggauuaaacaccuucaccaauauggaggugcagcugauccggcagauggagagcgaggggauuuuucuacccuccgagcucgagacgccuaaccuggcggaacgcgcccuugacuggcucgagaagcauggcgccgagcggcugaaacgcauggcgaucagcggggacgacugcguagugaagcccaucgacgaccguuucgccacggcucuaacggcccucaaugacauggggaagguucguaaggacauuccccaaugggagccgucuaaggguuggaacgacuggcagcaggucccguuuugcagccaucacuuccaccaacugaucaugaaggacgggcgagagauagucgugcccugucgcaaucaggacgagcuggucgggcgugccagagugucccaaggggcuggcuggucucuccgggagaccgccugucugggaaaaucuuacgcacaaauguggcagcugauguacuuucaccgccgggaccuccgccuggccgcaaacgcuauuugcagcgccgugcccguagauuggguaccaaccagcaggaccacguggagcauacacgcccaccaucaguggaugaccaccgaagacaugcuaagcguguggaaccgggucuggaucgaggagaacccuuggauggagaacaagacacacgugaguuccugggaggaagugcccuaccuuggcaagcgcgaagaucaguggugcgguucccugauugguuugacugcccgggcgaccugggcgaccaacauccagguugccauuaaccaggugcgccgucuuaucggaaacgaaaacuaccuagacuacaugaccagcaugaagcgcuucaagaacgaauccgacagcgagggcgccuuaugguga

SEQ ID NO: 23986 - RNA, 9879 nt, Artificial Sequence
  derived and/or modified CDS sequence (opt11) from DENV-1__KJ189353__SS-prME
agcgugaccaugcuucucaugcuacugccgaccgcccucgccuuccacuuaaccacccgcggcggggaaccccacaugaucgugucgaagcaagagagaggcaagagccuccuauucaaaacuagcgcgggcguaaacaugugcacucugauugccauggaccuuggggagcucugcgaggauaccaugaccuacaaaugccccaggaucaccgaggccgagcccgacgacguagauugcuggugcaacgccaccgacacgugggugaccuacgguaccuguagccaaaccggagagcaccggcgugagaagcggucuguugccuuggcgccucacgugggccugggucucgaaacucgcacagagaccuggaugagcuccgagggcgccuggaagcagauccagcgggucgagaccugggcccugaggcacccaggguucacggugaucgccuucuuccuggcgcacgcuauaggcaccagcaucacccagaaggggaucaucuucaucuuacugaugcuggugacacccuccauggcaaugcgcugcgucggcaucggcaaccgcgacuucguagaggggcuuaguggagcaaccuggguggacgucguuuuagagcauggguccugcgugacgaccauggccaaaaacaagcccaccuuggacaucgaacugcugaagacggaggucaccaauccagccgugcuucgcaaguugugcauugaggccaaaaucagcaauaccaccacggacucccgcuguccgacccaaggggaggccacguugguggaggagcaggacgcuaacuucgucugccggcgcaccuucguugaucggggcugggggaacgguugcgggcuguucggcaaagggagccuccucacgugcgccaaguucaagugcgugaccaaguuggagggcaagaucguacaguaugagaaccucaaauacuccgugaucgugaccguucacaccggugaccagcaccaggucggcaacgagacgaccgagcauggcaccauugcgacaaucaccccacaagcccccaccagugagauccagcugaccgacuacggggcccugaccuuagacugcucgccacggaccgggcuggauuucaacgagaugguccuguuaacgaugaaggagaaaaguuggcuggugcacaagcagugguuccuggaccucccgcugcccuggaccuccggggccagcacgagccaggagaccuggaaccggcaagaccugcucgugacguucaagaccgcacacgcgaagaagcaggaggucguagugcuggggagccaggagggcgccaugcauaccgcccuaaccggggccacggaaauccaaaccagcggcaccaccacaaucuuugccgggcaccucaagugccgucuuaagauggacaagcucaccuugaagggaaugaguuacgucaugugcacgggaagcuuuaaacuggaaaaggagguggcggagacccagcauggcacggugcucguccaggugaaguacgagggaacugacgcccccugcaagauucccuucuccacccaggaugagaaaggggugacccaaaacggacggcugaucacggccaauccuaucguuacggacaaggaaaaaccgguuaacauugaaaccgaaccuccuuuuggggagagcuauaucgugguuggcgccggcgagaaggcgcucaagcuguccugguucaagcgcgggagcuccaucggcaaaauguucgaagcaaccgcccgcggggcucgccguauggccaucuugggcgacacagcaugggacuucgggagcauuggcggcguguuuacuuccguggggaagcuuguccaccagaucuucgguaccgccuacgggguccuguucagcggcguguccuggacuaugaagauagggauuggaauccugcugacguggcugggccuaaacagccggaguacaagccucuccaugaccuguaucgcaguaggcauggucacccuguaccugggcguaaugguacaggcugacuccgggugcgugaucaacuggaagggccgcgaguugaagugcggguccgggaucuucgugacgaacgaaguccauaccuggacagagcaguacaaauuccaggccgacagcccgaagcggcugagugccgccaucggcaaggcgugggaggagggggugugcggcauacgcuccgcgacccgguuggagaauaucauguggaagcagauuagcaaugaguugaaccacauccuucuugagaacgauaugaaguuuaccgucguagugggcgacgccaauggcauccucgcgcaggggaagaaaaugauccgaccucagccgauggaacacaaguacuccuggaagucaugggguaaagccaagaucaucggcgcggacauccaaaacacuaccuuuaucaucgacgggcccgacaccccggagugcccugacggccagcgcgccuggaacaucugggaaguugaagacuacggauucgguguguucacgaccaauaucuggcucaagcugcgcgacuccuacacccaaaugugcgaucaccgacugaugagcgcugccaucaaagacuccaaggccgugcacgccgacaugggguacuggaucgagagcgaaaagaacgagaccuggaaguuagcccgcgcgucuuucaucgaaguaaagaccuguacguggcccaagucacacacgcugugguccaacggaguccucgagagcgagaugauaauccccaagaucuacggcgguccaaucucccagcacaauuacagaccaggcuacuucacccaaaccgccgggcccuggcaccucggcaaguuagagcucgacuucgagcugugcgagggcacgaccguggugguagacgagcauugcgggaacagaggcccgagccugcggaccaccaccgugaccgggaagaucauccacgaauggugcugccggaguugcaccuugccgcccuuacgguuccggggggaggacgggugcugguacggcauggagauucgaccugugaaggagaaagaggagaaccugguccgcagcaugguguccgccggcagcggcgagguggauagcuucucccucgggauacuuugcguaagcaucaugaucgaggaggugaugcggagucgcuggagcagaaagaugcugaugaccgggacgcuggccguuuuuuuacuacucaucaugggccaguugaccuggaacgaccugauccggcucuguaucauggugggggcuaacgcaucagaccgcaugggcaugggcacaaccuaucuagcacugauggccacguucaagaugcggcccauguucgccguggggcuccuguuccgccggcugaccucccgcgaggugcuccuccugaccaucggccucucccugguagccagcguggagcugcccaauagccucgaggagcugggggacggucuggcgauggggaucaugaugcucaagcugcugaccgaguuccagccccaucagcucuggacgacccugcugagccucaccuucgucaagacaacgcugucccuggacuacgccuggaagaccacugccauggcccucagcaucguaucccuguucccccugugccugagcaccacgucccagaaaaccaccuggcugccggugcugcuaggaagcuucggcugcaagccccugaccauguuucugaucaccgagaacaagaucugggggaggaaguccuggccccucaacgagggcauuauggcaaucgggauagucucuauccuacuguccucucuacugaagaacgacgugccacuggcgggcccgcucaucgcgggcgggaugcugaucgccugcuacguuauuagcgguuccagcgccgaccugucccucgagaaggccgcagaggugagcugggagcaagaggcugagcacuccggugccagccacagcauacugguggaggugcaagacgacggcacgaugaagaucaaggacgaggagcgcgacgacacccugaccauccuccuaaaggccacgcugcucgcggucucugggguguaccccauguccaucccggcuacccuguucgucugguauuucuggcagaagaagaagcagcguuccggcguccucugggauacccccuccccacccgaggucgagcgcgccguccucgacaacggcaucuaccggauccugcagcgcgggcugcuagggcggucucaggucggggugggcguguuucaggauggggucuuccacaccauguggcacgugacccgcggugccgugcucauguaccaaggcaagcgucuggagcccuccugggccagcguaaagaaggaccugaucuccuacggggguggguggcguuuccagggcagcuggaacacgggggaagaggugcaggugauagcgguggaacccggcaagaauccgaagaacguccagacuacccccggcacguucaaaacgccagagggugaagugggcgcuauugcacucgacuucaagcccgggaccuccggcucuccgaucgucaaccgggagggcaagaucguggggcuuuacggcaacgggguugugaccaccuccggcacguacgugagcgccaucgcucaggcgaaggccagccaggaaggcccccugcccgagauugaggacgagguauucaagaagcgcaauuugacuaucauggaccugcacccagguuccggcaaaacccgccgcuaccugcccgccaucgugcgggaggcuauaaagcgcaaguugcgcacccugauccuggcgcccacgcggguuguggccagcgagauggccgaggcacucaaggggaugcccaucagguaccagaccacugccgucaagagcgaacacacuggccgggagaucguggaucugaugugccacgcgacguucacgaugcgacugcugagccccgugcgggugcccaacuacaacaugaucaucauggacgaggcccacuucacagaccccgccuccaucgccgcccgcggauacaucucgacucgggugggcaugggggaagcggcagcaaucuucaugacggccacgccacccggcuccguugaggccuucccucagagcaacgcgguuauacaggacgaggagcgagacauccccgagcgguccuggaacagcggcuacgauuggaucaccgauuuccccgggaaaaccgugugguuugugcccuccauaaagaguggcaaugacaucgcgaacugucugcgcaaaaauggcaagcggguaauacagcugagucggaaaacguucgacaccgaguaccagaagaccaagaacaacgacugggacuacgugguaacaacagacauaucugagaugggcgccaacuuuagggccgaucgcgucaucgacccccggcgcugucucaagcccgugauccugaaggacggacccgagcgggugauacuggcgggcccgaugccugucacggcggccuccgccgcccagcgccggggccggaucgggcgcaaccaaaacaaagagggagaucaauacguguauaugggacagccgcucaacaacgacgaggaccacgcgcacuggaccgaagcgaagaugcugcuggacaacauaaacaccccagagggcaucaucccggcgcuauucgagccugagcgcgaaaagucggcggccaucgacggcgaguaccgcuuaagaggcgaggcgcgcaaaacguucgucgaguuaaugcggaggggcgaccugcccgugugguuaagcuacaagguagccagcgaaggguuccaguacuccgaccggcguuggugcuucgacggcgagcggaacaaccagguccuugaggagaacauggacguggagauauggaccaaggagggggagcgcaagaagcuccgaccgcgcuggcuggacgcgcggacauacagcgacccucuggcacuccgcgaguucaaggaguucgccgcggggcggcgcaguguuuccggcgaucugauccuggagauagggaagcucccccagcaucugacccugagagcccagaaugcgcucgacaaccuagucaugcugcacaacagcgaacagggcgggaaggccuaccgccacgcgauggaggagcuucccgacaccaucgagacacuaaugcugcucgccuuaaucgccgugcugacgggcggggugacuuuguucuuccuuucaggcaaggguuuagguaaaaccagcaucggccuccugugcguuacggccuccagcgcccuucucuggauggcguccguggagccccauuggaucgccgccagcaucauccuggaguucuuccugauggugcuccugauccccgagcccgaccgucagagaaccccccaggacaaccagcuggccuauguugugaucggucuccuguucaugaucuuaaccguggccgcgaacgaaaugggguugcuggagaccacgaagaaggaccuggguauaggauacguggccgccgagaaccaccagcaugccaccauguuggauguggaccugcacccggcauccgccuggacccucuaugccguggccaccacggucaucacccccaugaugcgacauacuauagagaacacuacggcuaauauuucccucaccgcgaucgcgaaccaggccgccauacugaugggccuggacaaaggguggcccaucuccaagauggauaucggggugccccuccuggcccuggggugcuacagccaggugaacccgcucacacugacugcggccgugcugaugcucguggcucacuaugccaucaucggucccgggcugcaggccaaagcaacgcgggaagcucagaagaggacagccgccggcauuaugaagaaccccaccguugauggcaucgucgccaucgaccuggacccaguggucuacgacgcgaaguucgaaaagcagcuagggcagauaaugcugcugauccuaugcaccucccagauuuuacugaugaggacgaccugggcccucugcgagagcaucacccuggcaaccggcccucuuacgacucugugggagggauccccaggcaaguucuggaacaccaccaucgccgucaguauggccaacauuuuccgcggaucguaucucgcaggggccggucuggccuuuagccucaugaagucccucgggggaggccgacgcgguacgggugcgcagggggagacccugggcgaaaaguggaaaaggcaauuaaaccaguuaagcaagagcgaguucaacacguacaaacggagcgggauaauggaggucgaccggagcgaggcgaaggagggcuuaaagcguggcgagacgacgaaacacgccgugagucggggcaccgccaagcuccgcugguuuguagaacggaacuuagugaagccagagggaaaggugaucgaccuggguugcggcagagggggcuggagcuauuauugcgccggacugaagaaggugaccgaggugaaaggcuacaccaaaggcgggcccggucacgaagaaccgaucccaauggccacguacggcuggaaucuugugaagcugcacucuggcaaggacgucuuuuucaugccgcccgagaagugcgacacccugcucugcgacaucggggagagcagccccaacccaaccaucgaggaaggacggacccugcgcgugcugaagaugguggaaccguggcuccgcggaaaccaauucugcaucaagauccugaaccccuacaugccgagcgugguggagacccuggagcgcaugcagcgaaaacacgguggcaugcuagugcgcaacccgcugucccggaauucaacgcacgaaauguacuggguauccugcgggaccggcaacaucguuagcgcggugaauaugaccucccgcauguugcucaaccgcuucacaauggcccaccggaagccgacguacgagcgcgacgucgaccugggugccgggacccggcauguugccguggagccugaggucgccaaccuggacaucaucggccagcgcauagagaacaucaaaaacgaacacaagucaacguggcauuacgacgaggauaacccguacaagaccugggcguaccacggguccuacgaaguaaaacccagcggcuccgcuagcuccauggugaauggggucgugaggcucuuaaccaagcccugggacgucauccccauggugacucagaucgccaugaccgauacuacgcccuuuggccaacagcgcguguucaaagagaaggucgacacucggacgccaagggccaagcggggcaccacgcagaucauggaggugaccgcgaaguggcuguggggguuucucagccgcaacaagaaaccccgcaucugcacccgcgaggaguucacgcguaaggugcgcagcaacgcugccaucggcgcggucuuugucgacgagaaccaguggaacucagcuaaggaggcgguggaggacgagcgguucugggauuugguccaucgugaacgagagcugcauaagcaggggaagugugccacgugcguguacaauaugaugggcaagcgcgaaaagaaguugggggaguuugggaaggccaaagguucucgggccaucugguacauguggcugggggcccgcuuccuggaguuugaagcgcucgguuucaugaaugaggaccacugguucucccgggagaacagccugagcgggguggaaggcgaggggcugcauaagcucggauacauccugcgcgacaucucgaaaaucccgggcggcaauauguacgccgaugacaccgccggaugggacaccaggguuacagaagacgaucuucagaaugaggccaagaucacggacaucauggagcccgagcacgcccuccuggcgaccuccauauuuaaauuaacauaccaaaacaaaguggugcggguccaacgcccugccaagaaugguacggugauggacgugaucagccggagggaccagcggggcuccggccaggucgggaccuacggccuuaacaccuucaccaacauggaagugcagcugauccgccaaauggagagcgaagggaucuucuugcccuccgagcucgaaacccccaaucuggccgagcgagcccuggacugguuggagaagcacggugccgagcgacugaagcggauggcgaucagcggggacgacugcguagucaaacccaucgacgaccgcuucgccacugcccuaacagcccucaacgacaugggcaaagugcggaaagacaucccccagugggagcccucaaaaggcuggaacgacuggcagcaggucccguucugcucacaccauuuucaccaguugaucaugaaggacgggcgcgagauagucguucccugccggaaccaggacgaacuggugggccgagcgcguguuucacagggugcgggcuggagccuucgcgagacugccugccuugggaaguccuacgcccagauguggcagcugauguacuuccaccggcgcgauuuacggcuggccgcgaacgcaaucuguagcgccgugcccgucgacuggguccccaccagccgcaccacgugguccauucacgcccaccaccaguggaugaccaccgaggacaugcuguccguguggaaccggguguggaucgaagagaacccguggauggagaauaagacccaugucucuagcugggaggagguaccauaccucggcaagcgggaggaucaguggugcggaucccugaucggccugacugccagagcgaccugggccacgaacauccagguggccaucaaccaggucaggcgccucauagggaacgagaauuaccuugauuacaugacaagcaugaagcguuucaagaacgaguccgacagcgagggugcccugugguga

SEQ ID NO: 23987 - RNA, 9879 nt, Artificial Sequence
  derived and/or modified CDS sequence (opt11) from DENV-1__KJ189354__SS-prME
ucugucacuaugcugcucaugcugcugcccaccgccuuggcauuccaccugacgacccgcggcggggagccccacaugaucgugagcaaacaggagaggggcaagagcuugcuguucaagaccucggcgggggugaauaugugcacacugaucgccauggaccugggcgagcucugcgaagacaccaugaccuacaagugcccccggauaaccgaggccgaacccgacgacguggacugcugguguaacgccaccgacaccugggugaccuaugggaccugcagccagaccggugagcaccggcgugagaagagguccguggcccuggcaccccacgugggccuggggcucgagacccgcaccgaaaccuggaugucuuccgagggcgccuggaagcaaauacagcggguugagaccugggcccuucgccacccuggguucacgguaaucgccuucuucuuagcgcaugcaaucggcaccucgaucacacagaaggguaucaucuucauccucuugaugcugguaacccccuccauggccaugcgaugugucggcaucggcaaccgcgacuucgucgaggggcuuucaggggcaacgugggucgacgucgugcuggagcacgggucgugcgugaccacuauggccaaaaacaagcccacauuggacauagagcuccugaagacagaggugaccaaccccgcggugcugcggaagcucugcaucgaggccaagaucucgaacaccaccacggacucccgauguccgacccagggugaggccaccuugguggaggaacaggacgccaacuucgugugccggcgcaccuucguggaccggggcuggggcaacggcugugggcuguucgguaaggggagccuccugacaugcgccaaauucaaaugcgugaccaagcuggagggcaagaucguccaguacgagaaccucaaauacuccgugauagugaccguccacaccggcgaccaacaccagguggggaacgagacuaccgagcaugguaccaucgcgaccaucacgccccaggcccccacgagcgagauccagcugaccgauuacggggcccugacccucgauugcagcccccgcacaggucuggauuucaacgagaugguccugcucacgaugaaggagaaaagcugguuggugcacaagcagugguuucuggaccucccccugcccuggaccucgggggcauccacuucgcaagaaaccuggaaccgucaggaccuccuggugacuuucaagaccgcacacgcuaagaaacaggaagucguggugcuaggcucccaggaaggcgccaugcauaccgcccugaccggugccacggagauucagaccagcggcacaacgacgauuuucgccgggcaucucaagugccgccugaagauggauaagcucacccucaagggcauguccuacgucaugugcacggggagcuuuaagcuggagaaggaaguggcugagacccagcauggcaccguacugguccaagugaaauacgaggguaccgacgcacccuguaagauccccuucuccacccaggacgagaagggcgugacccagaacggacggcugaucacggcaaauccgaucgucacugacaaggagaaaccggugaacaucgagaccgagccgccguuuggggaaagcuacaucgucgucggcgccggcgagaaagcacucaaacuguccugguucaagcgcgggagcuccaucgguaagauguucgaagccaccgccagaggggcacgccgcauggccauccugggugacacggcgugggacuucgggagcaucggagggguguuuaccuccgucgggaagcucguccaccagaucuucggcaccgccuacggggugcuguucaguggcguguccuggaccaugaagauaggcaucggcauacugcucacguggcucggcuuaaacagccggagcaccagccucagcaugacuugcaucgccgucggaauggugacccuuuaccuuggcgugauggugcaggcugauagcggcugcguaaucaacuggaagggccgcgagcuuaagugcgggucaggcaucuucgugacgaacgagguucacaccuggaccgagcaguacaaguuccaggccgauucgccgaagcggcugagugcggccaucggcaaagccugggaggaggggguguguggcauccgcuccgccacccggcucgaaaacaucauguggaagcagaucucaaacgaacugaaucacauccugcuagagaacgacaugaaguucacagugguagugggggacgccaacggcauuuuagcgcaaggaaagaagaugauccgcccccagccgauggaacauaaguauucuuggaaguccuggggcaaggccaagaucauaggcgccgacauccagaacacgaccuucauaaucgacggccccgacaccccggaaugccccgacggccagcgggccuggaacaucugggagguggaggacuacggguucggugucuuuacaacgaacaucuggcugaagcugcgggacuccuacacccaaaugugcgaucaccggcucaugucugcggccauuaaggacuccaaggccgugcaugcugacaugggcuacuggauagagagcgaaaagaacgagacuuggaagcuggcccgcgcguccuucauagaggugaaaacuuguacguggcccaagagccacacccuauggaguaacgggguccucgaaagcgagaugaucaucccgaagauauacggcggucccaucucccagcauaacuaccggcccggcuacuucacccagaccgcugggcccuggcaucucggcaaguuggagcucgacuucgaccuaugcgaaggcaccaccgucguggucgacgagcacugcgggaaccgcgggccgagccugcggaccaccaccgugaccgggaaaaucauccacgaguggugcugucgcuccugcaccuuaccgccccugcgguuccgcggcgaggaugggugcugguacggcauggagauccgcccgguuaaggagaaggaggagaacuugguccgcucaaugguuuccgccgguuccggagaggucgauaguuucucccucggcauccugugugugagcaucaugaucgaggaggugaugcggucacgcuggagccgcaagauguuaaugaccgggacgcucgcuguguuccugcugcucaucaugggucagcugaccuggaacgaccugauccggcucugcauuaugguaggggccaacgcguccgaucgcaugggcauggggaccaccuaucuggcccuaauggccacuuucaaaaugcggccgauguucgccgugggauuacuguuucgucggcugacuagccgcgaaguguuacugcugaccaucggcuuauccuuaguugccagcguggagcuuccuaauucccucgaggagcugggggacggccuagccaugggaauaaugaugcucaaacugcuuaccgaguuucagccacaucagcucuggaccaccuuacucagccucacguucgucaagacuacgcugucccuggacuaugccuggaaaacaaccgccauggcccucuccaucgugucccuguuccccuuaugccuuucgaccacuucccagaagacuaccuggcugccgguauuacucgggagcuucggcugcaagcccuuaaccauguuccugaucaccgagaacaagaucuggggacggaaaagcuggccccucaacgagggcauuauggcgauugggauuguaagcauccugcuguccucacuacugaagaaugacgucccccuggccggcccgcucaucgccggcgggaugcugaucgccugcuacguaaucagcggcuccagcgccgaccugagccucgagaaggcggccgaggugucaugggagcaggaggccgagcacuccggcgccagccacuccauucugguggaggugcaagacgacgguaccaugaagaucaaggacgaggagcgcgacgacacccugacgauccuccugaaagccacccuucucgcggucagcgggguauaccccauguccaucccugccacgcuguuugugugguauuucuggcagaagaagaagcagcggagcgguguccuaugggacaccccaucgccgccugaaguggagcgcgccgugcuggacaacggcaucuaccggauccugcagcgcgggcugcugggacguagccaggucggaguuggcguguuucaggacggagucuuccacaccauguggcacguuacacgcggcgccguacuuauguaccagggcaagcggcuggagcccucuugggccagcgucaagaaggaccugaucucauacgggggcggguggcgcuuccaggguagcuggaacacgggggaagagguucaggugaucgcagucgaacccggcaagaacccaaagaacgugcagaccacccccggcaccuucaaaacucccgaaggggaagucggcgccaucgcucucgacuucaagcccgggacaagugggagcccuaucgucaaccgcgaaggcaagaucguggggcucuauggcaacggugugguuacuaccucagggacguauguuagugcuauagcccaggcgaaggcgagccaggaggggccccuaccggagaucgaagacgagguguucaagaagcgcaaccucaccaucauggaccuucacccgggcuccggcaagacccgacgcuaucugcccgcgaucguacgagaggccaucaagcgcaaguuaaggacccugauccuggcgcccacgcgggugguggccagcgagauggccgaggcuuuaaaggggaugcccaucagguaccagaccacggccgucaaguccgagcacacgggccgggaaaucguggaccugaugugccacgcgacguucaccaugcgccugcucagcccugugcgggucccaaacuacaauaugaucaucauggacgaggcucauuucaccgaccccgcauccaucgccgcacgcggauacaucucuacgcgggugggcaugggggaggcggccgccaucuucaugacggccacaccacccggcuccguggaggcauucccccaaagcaacgcugucauccaggacgaggagcgagauaucccggagcgguccuggaacaguggcuacgauuggauaacugauuuccccgggaagaccgugugguucgugccguccaucaaaucuggcaacgacauagcaaacugccugcgcaagaacgggaagcgggucauacagcuauccaggaaaaccuucgauaccgaguaccagaagaccaaaaacaacgacugggauuacguaguuaccaccgauaucagcgagaugggcgccaacuuccgggccgacagggucaucgacccccggaggugccugaagccaguuauccucaaggacgggcccgagcgggugauacucgcgggccccaugcccguaacugccgccuccgcggcccaacgccgaggucguaucgggcgcaaccagaacaaggagggagaccaguacguauacauggggcagccccucaacaacgacgaagaccaugcucauuggaccgaggccaagaugcugcuagacaacaucaacaccccugaagggaucaucccggcccucuucgagccagagcgggagaaguccgccgccaucgacggggaguaccgccugagaggggaagcacggaagacguucguagagcugaugcggcggggcgaucuccccguguggcuuuccuacaagguggcgagcgagggguuccaguacuccgaccggagauggugcuucgacggagagcggaacaaccaggucuuggaggagaacauggauguggagaucuggacaaaggagggggaacgcaagaagcuccgaccccgcugguuagaugcucguaccuacucagacccgcuggcccuucgugaguuuaaggaguucgccgcagggcggcgcagcgugucuggugaccugauucuggagaucgguaagcucccccaacacuuaacccugcgggcccagaacgcuuuggacaaccucgugaugcugcauaacagcgagcaggguggaaaggcguaccgccacgcgauggaagaacuccccgacacuaucgagacgcugaugcugcuggcccugauagccgugcugaccggcggggugacccuuuucuuccuuuccggcaagggcuuagggaagaccagcauaggcuugcugugcgucacggccuccagcgcgcugcuuuggauggcguccguugagccgcacuggaucgccgcgagcaucauccuggaguuuuuccugaugguguuacuuaucccagagccugaccggcagcgcacaccccaggacaaccagcuggccuacguugucauugggcuucuguucaugauucugaccguggccgcaaaugagaugggccuccuggagacgacgaagaaggaccuggggaucggguacguagccgccgagaaucaccaacacgcuaccaugcucgacgucgaccugcauccggcuuccgccuggacccuguaugcgguggccacuacggucaucacccccaugaugagacauaccaucgaaaacaccacggccaauaucagccucaccgcaaucgcgaaccaagccgccauccuuaugggccuggacaagggguggcccauauccaagauggacaucggcgugccccuccuggcccuugggugcuacagccaggugaacccucucacccugaccgcggccgucuuaaugcucgucgcccacuaugccaucaucggcccuggacuccaggccaaggcaacgagagaggcccaaaagcguaccgccgccggcaucaugaaaaauccaaccguggacggaauaguagccaucgaccuggaccccguuguguaugacgcgaaguucgagaagcagcuugggcagauuaugcugcugauacuuugcaccucccagauccugcugaugcgcacgacuugggcccucugugaaagcauaaccuuagccacgggcccucuaacgacccuaugggaggggucccccgggaaguuuuggaauaccaccauugccgucagcauggccaauauauuccgcggcuccuaccuggcgggugccggucucgccuucagucucaugaaaagccuaggagggggucggcgcggcacgggcgcccaaggggagacucugggagagaaguggaagcggcagcuuaaccagcugagcaaaagcgaguucaauacauacaaacgguccggaaucauggagguggacagaagugaggcuaaggagggccugaagcgcggugagaccacgaagcaugcggugucccgagguacggcaaaguugcgaugguucguagagcggaacuuagugaagccugagggcaaggugauugaccugggcugcggccgcgggggcuggagcuacuauugcgcgggacugaagaaggugaccgaggucaagggcuacaccaaaggcgggcccggacacgaagaaccaauccccauggcuaccuacggguggaaccucgugaaacugcacuccggcaaggauguauucuuuaugccgccagagaagugcgacacccugcucugcgacauaggagaguccuccccgaauccuaccaucgaagagggacggacccugcggguucugaagaugguggagccauggcuccguggcaaccaguuuuguauuaagauccugaaccccuacaugccuagcguuguagagacccuggaacgcaugcaaagaaagcaugggggcaugcucguucguaacccgcugucccggaacucgacgcaugagauguacuggguuuccugcgggaccggcaacaucgugagcgcgguaaacaugaccucccggauguugcucaauagauuuaccauggcccacaggaagcccacguacgagcgcgaugucgaucugggcgcuggaacccggcauguggccguggaaccugaggucgccaaccuggauauaaucggccagcguaucgagaacaucaagaacgagcacaagagcaccuggcacuacgacgaggacaacccguacaagaccugggcguaccacggauccuaugaagugaagcccuccggauccgccagcuccaugguuaauggugucgugcgucuccugacgaaacccugggacgucauccccauggugacgcaaaucgccaugaccgacacaacgccguucgggcagcagcggguguucaaagagaagguugacaccaggacgccccgcgcuaaacggggcacuacccagauuauggaggugaccgcgaaguggcuguggggguuccucucucgcaacaagaagccucggaucuguacccgcgaggaguucacccggaagguucgcucaaacgccgccauaggcgccgucuucguggacgagaaccaguggaacuccgcuaaggaggcgguggaagacgagaaguucugggaccugguccaccgggagcgggagcugcacaagcaggggaagugcgcuacguguguguacaacaugaugggcaagcgggagaagaagcucggggaguucgggaaggcgaagggcagccgagccauuugguacauguggcugggggcuagauuccuggaguucgaggcgcucggcuucaugaacgaggaccacugguucucucgcgagaauagccuguccgggguggaaggcgaggggcugcauaagcucgguuacauacugcgagacaucagcaagauuccaggagggaacauguacgccgaugacacagccggcugggacacgcgcgucaccgaggaugaucugcagaacgaagccaagaucacugacaucauggagcccgagcacgcccuccucgcgaccuccaucuucaagcugaccuaccagaacaaggugguacgcgugcaacggcccgcaaagaacgggacugugauggacgugauuucccgccgugaccaacgcggcuccggccaagucgggacguacggccucaacaccuucaccaacauggagguacagcugauucgccagauggagagcgaggggaucuuccugcccuccgagcuagaaaccccuaaucuggccgaacgcgcauuggacuggcucgaaaagcacggcgccgaacggcugaaacgcauggcgaucuccggggacgauugcguagucaaacccaucgaugaccgguucgcgacggcccugaccgcccuaaacgacaugggcaaggugagaaaggacauaccccagugggagcccuccaagggcuggaaugacuggcagcaggucccguuuuguagccaccacuuccaccagcugauuaugaaggaugggcgcgaaauuguuguccccugccgcaaccaggacgagcuggugggccgggccagggucucccaaggggcuggauggagccuccgcgagacggccugccuggguaaauccuacgcgcagauguggcagcugauguauuuccaucgccgggaccugcgccuggccgccaacgccaucugcagcgccguuccgguggacuggguccccaccagccggacgacguggaguauccaugcccaucaccaguggaugaccaccgaggacaugcugagcguguggaaccgcguguggauugaggagaacccguggauggagaauaagacacacgucuccagcugggaagagguaccguaccucggcaaaagagaggaccagugguguggcucccugaucgggcuuacggcccgcgcuaccugggccacaaacauccagguggcaaucaaccagguccgccggcucaucggcaacgaaaacuaccucgacuacaugaccagcaugaagcgcuucaaaaacgaaagcgacagugagggugcccugugguga

SEQ ID NO: 23988 - RNA, 9879 nt, Artificial Sequence
  derived and/or modified CDS sequence (opt11) from DENV-1__KJ189355__SS-prME
agcguaaccaugcugcuaaugcuacugcccaccgcccucgccuuccaccugaccacccgcggaggggaaccccauaugaucguuagcaaacaggaacggggaaaaagccuccucuuuaaaaccagcgcggggguaaacaugugcacccucauagccauggaccugggagaacuaugcgaggacaccaugacuuacaaaugcccccgcaucaccgaggccgaacccgaugacgucgacugcuggugcaacgccaccgauacguggguuaccuacgggaccugcagccaaaccggcgagcaucggcgcgagaagcgaucuguagcccuggcgccgcaugugggucugggccuagagacucgcacggagaccuggaugagcagugaaggcgccuggaagcagauucagaggguagagacgugggcccuacgccacccgggguucacggugaucgccuucuucuuggcgcacgccaucggcaccagcaucacccagaaagguaucauauucauccuccugaugcuggugaccccguccauggcuaugcggugcgucggcaucggcaaucgcgacuucguggaggggcucaguggcgcuacguggguggacgucgucuuggagcacggguccugugugacuaccauggccaaaaacaaaccuacccuggauaucgaacuauuaaagacggaggucacgaacccggccguacuacggaaguuaugcauugaggcuaagaucagcaauaccaccacggauucccguugcccgacccagggcgaggccacccugguagaggagcaggacgcuaauuucgucugccgcagaaccuuuguggaucgggguugggggaacggaugcgggcuguuuggcaaggggagccuccugacgugcgccaaguucaagugcguuacuaagcuggaaggcaagaucgugcaauacgagaaccuaaaguauuccgugaucgugaccguacacacgggcgaccagcaccaaguggggaacgagacgaccgaacacggcacaauugcgaccauaacuccccaggcccccacgagugagauccagcugacagacuauggggcacugacacucgauugcagucccaggacuggccucgacuuuaacgaaaugguccugcucacgaugaaggagaagucuuggcugguacauaagcagugguuccuggaccucccgcugcccuggacauccggggccagcacaucccaggagaccuggaaccgucaggaucugcucgugacguucaagaccgcccacgcgaagaaacaggaagucguggugcuggguagucaggagggcgccaugcacaccgccuuaacuggggccacagagauccagaccagcggaacgacuacgauauucgccgggcaccucaagugucgccugaagauggacaaacugacccucaagggcaugucauacguaaugugcaccggcagcuucaaacuggagaaggaagucgcugagacacagcacggcacgguccuaguacaggugaaguacgaggggaccgacgcccccugcaagaucccuuuuuccacgcaagacgaaaagggcguuacucaaaacgggcggcugaucacggccaaccccaucgucaucgacaaagagaagcccguaaacaucgagacugagccgcccuuuggcgagucguauaucgucgucggcgccggggagaaggcgcucaagcuguccugguucaagagggguagcuccauuggcaagauguucgaggccaccgcacgcggcgcccggcgcauggcaauccugggagacaccgccugggacuucgggagcaucggaggcguauucacguccgucgggaagcucguccaccagauauuuggcaccgccuacggggugcuuuucagcggcgucuccuggacuaugaaaauagggauaggcauucugcugaccuggcugggacuuaauucucgguccaugagccuauccaugacguguaucgccgucgggaugguaacccuuuaccugggcgugaugguccaggccgacagcgggugcgugauuaacuggaagggucgugagcucaagugcggcuccgggaucuucgugaccaacgagguccacaccuggaccgagcaguauaaguuucaggccgauagcccgaagcggcugagcgcggccauaggcaaggcgugggaggaaggggugugcggaauccgcucugccacccgguuagaaaauauuauguggaagcagaucucaaacgagcuaaaccauauucugcuggagaaugauaugaaguucaccgugguagugggggaugccaacggaauacucgcccaggggaagaagaugauccgcccccagcccauggagcacaaauacuccuggaagucuugggggaaggccaagaucaucggugccgacauccagaacacaacguucaucaucgaugggcccgacacgccggagugcccugacggccagcgggcauggaacaucugggagguugaggacuacggauucggagucuuuaccaccaacaucuggcugaaacugcgcgacuccuauacccaaaugugugaccaccggcucaugagcgcggcaauuaaggacuccaaggccgugcacgccgacaugggcuacuggaucgagagcgagaaaaacgagacguggaaacuggcgcgcgcgucauuuaucgaggugaagaccugcaccuggcccaagagccauaccuuauggucuaacgggguccuugagagugaaaugaucaucccuaagaucuacggugggccaauaucccagcauaacuaccggcccggcuauuucacgcagaccgcaggccccuggcaccuuggcaagcuggagcucgacuucgaccugugcgaagguaccacggugguggucgacgagcacugugggaaccgaggcccgucucugcggacgaccaccguaacugggaagaucauacacgaguggugcugccgcuccuguacccuaccgcccuuacguuuccguggagaggaugggugcugguacgguauggagauacgccccgugaaggagaaagaagagaaccugguccggagcaugguguccgccggcaguggggagguagacagcuucucccucggcauucuguguguaucuaucaugaucgaggaggugaugcggucccgcuggucucgcaagaugcucaugaccgggacccucgccgucuuccuacugcucaucaugggccaguuaacuuggaacgaccugauucggcucugcaucauggucggggccaacgcuuccgaccgcaugggcaugggcacgacuuaccuggcguuaauggccaccuucaagaugcgcccgauguuugccgugggucuccuguuccgccggcugaccucucgcgagguguuauugcuaacgauuggccucucacucguggccuccguggaguuacccaacucucucgaggaacugggggauggacuggcgaugggcaucaugauguuaaagcugcugaccgaguuccagccccaucaacuuuggacuacauugcuuagccugacuuucgucaagacaacccugucccuggacuacgcauggaagaccacggcgauggcgcucaguaucgugucccucuucccccuaugucucucuacuaccagucagaaaaccacguggcugccggugcuauugggcagcuucggcugcaagccccugacuauguuccuaaucaccgagaauaaaaucuggggccguaaguccuggccccuaaacgaggguauuauggcgaucgggauagucagcauucugcugucgagccucuugaaaaacgacgugccccucgccgguccgcucaucgccgggggaaugcugaucgcauguuacgugaucucgggcuccucagccgaccugucguuagagaaagcagccgaggugagcugggagcaggaggccgagcacagcggagccagccacuccauccucguagaggugcaggacgauggcaccaugaaaaucaaagacgaggaacgggaugacacccugacaauccugcuuaaagcuacccuucucgcaguuagcgggguguacccaaugaguauccccgccacccuguucguaugguauuucuggcagaaaaagaaacaacgcagcggaguacucugggacacccccucgcccccagagguggaacgugccgugcucgacaauggcaucuaccggauccugcaacgcggccugcugggucguagccaagucggagugggcguguuccaggauggggucuuccacacuauguggcacgugacccgcggcgccguacucauguaccaggggaagcgguuggagcccuccugggccagcgucaaaaaggacuugaucagcuacgggggcggcuggcgcuuccaagggagcuggaauaccggggaggagguacaggugauagcggucgagccuggcaagaacccgaagaacguccagaccacgcccggcaccuucaagacacccgagggggaggugggcgccaucgcucuagacuuuaaaccaggaacguccgggagcccgaucgucaaccgggaggggaagaucguggggcuguacggcaacgggguggucacgaccucggggacguaugucucagcuauugcacaggcgaaggccagccaggaggggccccugccugagaucgaggacgagguguucaagaagcgcaauuuaaccauaauggaucuacacccgggcuccggcaagacgcggcgcuaccugcccgccaucguucgagaggccaucaagcgcaagcuccgaacccugauccuggcgccgacgcgagugguugcaagcgagauggccgaggcccucaaggggaugccaauccgcuaccaaaccacggcgguaaagucugaacacaccggcagagaaaucguggaccuaaugugccacgcgaccuucaccaugcgccugcucagcccggugcggguccccaacuacaauaugaucaucauggaugaggcccacuucacggaucccgccucgaucgccgcgcgcggguacaucagcacaagaguagggaugggggaggcggccgcaaucuucaugaccgccacgccgccuggcuccguggaggcuuucccccagagcaacgcggucauccaggacgaggagagggacaucccggagcgguccuggaacaguggcuacgacuggauaacggacuuccccgggaagaccgugugguucgugccgucgaucaagagcgggaaugacaucgccaacugccugcgcaagaacgggaaacggguaauccagcucucccguaagacguucgacaccgaguaccaaaagacgaagaacaacgacugggacuacgucgucaccaccgacauuucggaaaugggcgcaaauuucagagccgaccgcgucaucgacccccggaggugccuuaagcccgugauacugaaggacgggccagagagagugauacuggcgggcccuaugccggucacugccgccucggccgcccagcgacggggccgcaucggccggaaucagaacaaagagggcgaccaauacguguacaugggacagccccucaacaacgacgaggaccaugcgcacuggacagaggccaagaugcugcuggauaacaucaacacacccgaagggauuaucccugcccucuucgaacccgagcgggaaaaauccgccgccaucgacggugaguaucgucuuagaggcgaggcccgcaagaccuucgucgaguugaugcggaggggcgaccuccccguguggcuguccuacaagguagccagcgagggcuuccaguacuccgaccguagauggugcuucgacggcgagcggaacaaccaggugcuggaggagaacauggacguggaaaucuggaccaaagagggggagcgcaagaagcuccggcccagguggcuggaugcccggaccuacagcgacccgcuggcuuugcgggaguucaaggaguuugccgcgggcaggcgcagcgugucgggcgacuugauucuggagaucgggaaacuaccacagcaccugacccugcgggcccagaacgccuuagacaaccuugucaugcugcacaacagcgagcagggcggcaaagccuaucgucacgcgauggaggagcucccagacacaauugaaacccugaugcugcucgcccuuaucgccgugcugaccggaggcguuacacucuucuuccuauccggcaagggacuggguaagacguccaucggccugcuaugcgucaccgccuccagcgcgcugcucuggauggccuccgucgagccccacuggaucgccgccucuaucauucuagaguucuucuugaugguucuccugaucccggagccugaccggcagcgcacgccccaggacaaucaguuggcuuacguggugaucgggcuccuguucaugauucugacgguggccgccaacgagaugggccucuuagaaacuaccaaaaaggaccuagggauugguuacgucgcagccgagaaccaccagcaugccacaaugcuggauguggaccugcacccggccucagcauggacgcuguacgccguggccaccaccgucaucacccccaugaugaggcacacgaucgagaacaccaccgcgaacauaucccucacagcgaucgccaaccaggccgccauccugaugggccuagacaagggguggccgauuuccaagauggauaucggcgucccccucuuagcccuggggugcuacagccagguaaacccgcucacguuaacggccgccguccugaugcucguggcccacuacgcuaucaucggccccgggcugcaggccaaggcgacccgggaggcacaaaagagaacggccgccggcaucaugaagaacccuacgguggaugggaucgucgccaucgacuuggacccggugguauacgacgcgaaguuugaaaagcaacuugggcagaucaugcugcugauccucugcaccucucagauauugcugaugcggacaaccugggcccucugcgagagcaucacgcuagcuacuggcccucugaccacucuaugggaggggucacccggcaaauucuggaacacaacaauagccgucagcauggccaacaucuuccgcggguccuaccuggcgggggccgggcuggccuucucacucaugaagucccuagggggcgggcggagaggaaccggggcucagggagagacccuuggcgagaaauggaagcggcaacuuaaccaguugagcaagagcgaauuuaacacauauaagcgauccggaaucauggagguggaucguucagaggcgaaggagggucugaagcgcggggagaccacuaagcacgcggugucgcggggcacagcaaagcucagaugguucgucgagcggaaucuggugaagccggaaggaaaggucaucgaucugggcugugggcgcgggggcuggagcuacuacugcgccgggcugaagaaggugaccgagguaaagggcuacacaaagggcgggcccggccaugaggagccaauccccauggcaaccuacggguggaaccucguaaagcugcauucaggcaaggacgucuuuuucaugccgccggaaaaaugcgacacccugcucugcgacaucggggagagcucccccaaccccaccauugaggaaggccggacccuccguguucugaagaugguggagcccuggcugcggggcaaccaguuuugcauuaagauccugaaccccuacaugccgagcgucguggagacccuagagcgaaugcaacggaagcacgggggaaugcucgugcgcaacccccugucccguaacagcacgcacgagauguacugggucuccugcgggacaggaaacauagugagcgcggugaacaugacgucucgaaugcuccugaaucgcuucaccauggcccaccgaaagcccaccuacgaacgcgaugucgaccucggcgcaggaacccggcacguggccguggagcccgaggucgccaaccucgacaucauuggacagcgaaucgagaacauaaagaacgagcauaagagcaccuggcacuacgacgaagacaacccguacaagaccugggcguaccacgggagcuacgaggugaaacccaguggcuccgcuagcucaaugguuaauggggucgugcggcuccugacgaaacccugggacgugaucccuaugguuacccagauugcgaugaccgacacuaccccguucggccaacagagaguguucaaagagaaggucgacaccagaacgccccgggcuaagcggggcaccacccagauaauggagguuacggccaaguggcuuuggggguuccuaagccgaaacaaaaagccccguaucugcaccagggaggaguuuacacggaaggugagaucgaaugcggcgaucggugcaguauucguggacgaaaaccaguggaacuccgccaaggaggcggucgaggacgagcgguucugggaccuggugcacagggagcgggagcugcauaagcaggggaagugcgcaaccugcgucuacaacaugaugggcaagcgggagaagaaacucggagaguucggcaaggccaagggaucucgggcaaucugguacauguggcugggcgcccgcuuucuggaguucgaagcacucggcuucaugaacgaggaccacugguuuucucgggagaauagccuauccggagucgagggcgaggggcugcauaaacuaggcuauauccuucgcgacaucagcaaaaucccagggggaaacauguacgcggaugacaccgccggcugggauacgagagucacugaggaugaccugcagaacgaggcgaaaaucaccgauaucauggagcccgaacacgcccuccuggcgacauccauauuuaagcuaacguaccagaauaaggugguacgggugcaacgccccgccaagaaugggaccgugauggacguaaucagccggcgugaccagcggggcucagggcaggucgggacguacggccugaacaccuucacgaacauggaggugcagcugauccgccagauggagagcgagggcaucuuucuccccagugagcucgagacgccgaaccuagccgagagggcccuugguuggcucgaaaagcacggggccgagagguugaagaggauggcgauuagcggcgaugauugcguugugaagccuauagacgaucgcuucgccaccgcccugacugcgcucaacgacaugggcaaggucagaaaggacauuccccagugggagcccagcaaaggauggaacgacuggcagcaagucccguucugcagccaccauuuccaucagcugaucaugaaggacggacgugagauugucgugcccugucgaaaccaagacgaacugguggggagagcccgggucagucagggcgcaggauggagccuccgcgagacggcuugucugggcaaguccuacgcccagauguggcagcugauguacuuccaccggcgggaucuccggcuggccgcgaacgccauuugcucggccgugccuguggacuggguccccaccagccguacgacuugguccauacacgcccaccaucaguggaugacuacggaggacaugcugagcguguggaaucgaguguggauagaagagaauccguggauggagaacaagacucacgucucgucuugggaagaagucccauaccuaggaaagagagaagaccaguggugcggcucccucaucggccugaccgcccgcgcuaccugggccacgaauauucaaguagcuaucaaccagguccgccgccucaucgguaacgagaacuaucuggacuacaugacuagcaugaagcgguucaagaaugaguccgauagugagggcgcacugugguag

SEQ ID NO: 23989 - RNA, 9879 nt, Artificial Sequence
  derived and/or modified CDS sequence (opt11) from DENV-1__KJ189358__SS-prME
uccguaacaaugcuguuaaugcugcugcccacugugcuagccuuccaccugaccaccagggguggggaaccccacaugauagugagcaagcaggagaggggcaagucccuccuguuuaagacuagcgccgggguuaauaugugcacccugaucgcuauggaucugggcgagcucugcgaggauaccaugaccuacaagugcccccgcaucaccgaggcugaaccagaugauguggacugcuggugcaaugccaccgacacgugggugacuuacgggaccugcagccagacgggcgagcaucgcagagaaaagcgguccgucgcuuuagcgccgcacgucggccugggucucgaaacccgcaccgagaccuggaugaguuccgagggcgccuggaagcagauccagcggguggaaacgugggcccugagacaccccggguucaccgugaucgcauucuuccuggcccacgcgaucggcacgucgaucacgcagaaggggaucaucuucauccuccugaugcuggucaccccauccauggccaugagaugcgugggaaucggaaaucgcgacuucgucgaggggcucagcggcgcaacuugggucgacguuguucuggaacacgggaguugcgucaccaccauggccaagaauaagccuacucuggauauugagcuccuaaagaccgaagucacgaaccccgccguguuacgcaagcucugcaucgaggcgaagaucagcaacaccaccacggacuccaggugcccgacccagggcgaggccacccucguggaggagcaggaugccaacuucgucugccggcgcacuuucguggaccgcggcugggggaacggcugugggcuuuucggcaaggggagccucuuaacgugcgccaaguucaaaugcgucaccaagcucgagggaaagaucgugcaauacgagaaucucaaauauuccgugaucgucaccgugcacaccggagaccagcaccaggucgggaacgagacgaccgagcauggcaccaucgccaccaucacgccacaggcgcccacgagcgagauccagcuuaccgacuacggagcccugacccucgauuguagcccccggaccggccuggauuucaaugagaugguacugcugacaaugaaagaaaagucauggcuggugcacaaacagugguuccuggaucucccgcugcccuggaccuccggcgccagcacuagccaggaaaccuggaaccggcaggacuuacucgucacguuuaagaccgcccaugcgaagaagcaggaggucguagucuugggcucccaggagggcgcgaugcacaccgcccuaaccggggccacggagauacaaaccagcggcacuaccacgaucuuugccgggcaccucaagugucgccuuaaaauggacaaacuuacccucaagggcaugucguacgugaugugcacagggagcuucaagcuggagaaggagguggccgagacccaacacggcacgguccugguccagguaaaguacgagggcaccgacgcuccgugcaaaauccccuucuccacucaagaugagaaaggggucacgcagaacggacggcugaucacggccaacccaaucgugaccgacaaggagaagcccgugaacaucgagacugaaccgccguucggggagagcuacaucguggugggcgcgggcgagaaggcccucaaguugucuugguucaaacgcgggagcuccaucggcaagauguucgaggcgacugcccgcggugcgaggcggauggcgauccugggcgacacggccugggauuucggcagcauuggcgguguguucaccuccguagggaagcucgugcaucagguguucgggaccgcguauggggugcuguuuagcggugugaguuggaccaugaagauaggaaucggcauccugcuuaccuggcugggccucaauagccggucgacuagccucuccaugacgugcaucgccguugggaugguaacccuguaccugggcgugaugguacaggccgauagcgggugcguuauuaacuggaagggccgagagcucaagugcggauccggaauuuucgugacuaaugaggugcacaccuggaccgaacaguacaaauuucaagcggacagcccaaagcggcugagcgccgcaaucggcaaggccugggaggaaggaguaugcggcauccgauccgccacccggcuggagaacaucauguggaagcaaaucuccaacgaacucaaccauauucugcuggagaaugacaugaaguucaccguggugguuggggacgccaacgguauccucgcccagggcaagaagaugaucagaccgcaaccuauggagcacaaauauuccuggaaguccuggggcaaagcgaagaucaucggcgccgacauccaaaacacgaccuuuauuauagacggaccagacaccccggagugcccagauggccagcgugccuggaauaucugggagguggaggauuacggcuucgggguguuuaccacuaacaucuggcugaaacugcgcgacuccuacacgcagaugugcgaucaccggcucauguccgccgcgaucaaggacucuaaggccguccaugcagacaugggcuacuggauugaguccgagaagaacgagaccuggaaacuagcucgcgcgagcuucaucgaagugaagaccuguacauggcccaagagccauacccugugguccaauggggugcucgagucagagaugaucaucccuaaaaucuacggcgggccgaucucccagcacaacuaccggcccggauauuucacccagaccgccgggccguggcaccuuggcaagcuggagcucgacuucgaccuaugcgagggcacgaccgucguuguggacgagcauugcgggaaccgcggcccgagccugcggaccaccacggugaccgggaagaucauccacgaguggugcugccgcucuugcacccugccgccucugcgcuuccgcggcgaagacgguugcugguacggcauggagauccggcccgugaaggagaaagaggagaaccuaguccgcuccauggucuccgccggcagcggggagguggacucauucucacucggcauccugugugugagcaucaugaucgaggaaguuaugcguucccgcuggagcaggaagaugcugaugaccgggacgcucgcaguguuccuguugcucaucaugggccaacugaccuggaacgaccugauucgguuaugcauuauggugggggccaacgccuccgacagaaugggcaugggcaccacccaccuggcgcugauggcuacguuuaagaugcggccgauguucgcagucgggcucuuguuccgccgacugaccucacgggaggugcuacugcugaccauuggucuuuccuuggucgcgucgguggagcugcccaacucccucgaggagcugggggacggccuggccaugggcauuaugaugcugaagcuguuaaccgaguuccagcccuaccagcucuggacuacccugcuuagccucacuuucguuaagaccacgcugucguuggacuacgcguggaaaacgaccgcaauggcacucucaaucguuagucuguucccccugugccucagcaccacgucacagaagaccaccuggcugccaguucuucucggguccuucggcugcaagccccugacuauguuccugaucacugagaacaagaucugggggcgaaagucauggccauugaacgaggguaucauggccaucgggaucgugagcauucuguuguccucacuccugaagaacgacgugccccuggcgggcccgcuaaucgccggcgggaugcugauagccugcuacgugauaagcggcuccuccgccgaccugucccucgagaaggccgcagaggugagcugggaacaggaggccgagcauuccggggccagccacuccauccugguugaagugcaggaugauggcacgaugaagauuaaggacgaggagcgcgacgacacccugaccauucuccugaaagccacgcugcucgcagugagcgggguguaccccauguccaucccugcgacgcuguucgugugguacuucuggcagcggaagaagcagcgcagcggcguccuuugggacacccccuccccgcccgaggucgagcgggcagugcuagacaacggcauauaccggauccugcagcgggggcugcugggccgcucgcaagucggggucggcguguuccaggacggaguguuccacaccauguggcacgucacaaggggcgcagugcucauguaccagggcaagcgccuggagccuagcugggcaagugucaaaaaggaccugaucuccuacgggggcgguuggcgguuccagggcagcuggaauacgggggaggagguacaggucaucgccguagagcccggcaagaacccgaagaacguccaaaccaccccuggaaccuuuaaaacgcccgaaggagaggugggcgcgaucgcguuggacuucaagcccgguacguccggcucgccgauugugaaccgcgaggggaagauaguaggacuguacggcaacgggguggugaccaccuccggaacguacgucagcgccaucgcacaggccaaggcuagccaagaggggccucugcccgagauagaggacgagguguucaagaagcggaacuugacuaucauggacuugcacccgggauccggcaagacccgcaaguaucugccggccauugugcgggaggccaucaagcgcaaacuucgcacccugauccuggccccuacgcggguaguggcgagcgagauggcggaggcccucaaggggaugcccauuagauaucagacaacggccgugaaguccgagcacaccggccgggagauugucgaccugaugugucacgccacguucaccaugcgccugcucagcccggugcggguccccaacuacaacaugaucauuauggacgaagcgcacuucaccgaccccgcuuccaucgccgcccgcggguauaucagcacccgggucggcaugggggaagccgcggccaucuuuaugacggccacaccucccggcagcguggaggccuucccacagagcaacgcagugauccaggacgaggagcgugacaucccugagcgguccuggaacucagguuaugacuggaucacggacuucccaggaaagaccgucugguuuguuccuucgauaaagagcggaaacgacaucgcgaacugucugcgcaagaacgguaagcggguuauccagcugagucgcaagaccuucgacaccgaguaccagaagacaaagaauaacgacugggauuaugucgugaccacagacaucucagagaugggcgccaacuuccgagcugaccggguuaucgauccccgccgcugccucaagccugucauccugaaggacgggcccgagcgggugauacuggccggcccgaugcccgucacagucgccuccgccgcccagcgccggggccgcaucgggcgcaaccagaacaaggagggcgaccaguacguauacauggggcaaccccucaacaacgaugaggaccacgcccacuggaccgaggcaaagaugcugcuggacaacaucaacaccccagagggcauuaucccggcucucuucgagcccgagcgagagaaguccgccgccauugacggggaguaccgccuacggggcgaggccaggaagacauuugucgagcuuaugcggcgcggcgaccuccccguuugguuauccuauaagguugccagcgagggguuccaguacuccgaccggcgcuggugcuucgauggcgagcgcaacaaccaggugcuggaggaaaacauggacguggagaucuggaccaaggagggggagcggaagaagcuccggccucgcugguuggacgcgcguaccuacuccgauccgcuggcccuccgcgaguucaaggaguucgccgccggccgacgcagcguguccggcgaccugauccuagagaucgggaaacuuccccagcaccugacccugcgcgcccaaaacgcgcucgacaaccuggucaugcuccacaacagcgagcaaggagggaaagccuaccgccacgccauggaggagcuucccgacaccaucgagacgcugaugcugcucgcccuuauugcggugcugaccggaggugugacccucuucuuccuguccggcaagggccuggggaagaccagcaucggccuucugugcgucacugccuccucugcccuguuguggauggcaucaguggagccccacuggaucgcugcgaguaucauccuagaguucuuccucauggugcuccugaucccggagccugacaggcagcguacgccacaagacaaccaacuggccuacgucgugauagggcuccuguucaugauccuuacgguggccgccaacgagaugggcuugcuagagaccaccaagaaggaccuggggaucggguacgucgccgcggagaaccaccaacacgccaccaugcucgacguggaccugcacccggccagcgcguggacgcuguacgccguggcaaccacgguaauuacccccaugaugcggcacacaaucgagaacaccacagccaauaucagccucaccgccaucgccaaccaagccgcaauccugaugggccuggacaagggguggcccaucaguaagauggacauuggcguaccccuacuggcgcugggcugcuauagccaggugaauccgcucacgcugaccgccgcugucuugauguuggucgcacacuacgccauuaucggcccggggcuucaagccaaggccacgcgcgaagcucagaaacgcaccgcggcuggcaucaugaaaaaccccaccguagacggcaucgucgccaucgaccuugaccccgugguguacgacgccaaauucgagaagcaguuggggcagauuaugcugcugauccucugcaccucccagauccugcugaugcggacgaccugggcccuuugcgagucaaucacacucgccaccggaccucuuacgacccuaugggaggggucacccgguaaguucuggaacaccaccaucgccgucaguauggccaacaucuuccgcggcuccuaccuggccggggccggucuggcguucucacucaugaaaucgcucgggggcgggcggcgcggcacgggcgcccaaggugagacccugggggagaaguggaagcggcaguuaaaccagcugagcaagucugaguucaacaccuauaagcgcagcgggaucauggaaguggaccgcagcgaagccaaggaggggcugaagcgcggggagaccacgaagcacgccguaucccgaggcaccgcaaagcuccgcugguucguggagcggaaccuggugaagcccgaaggcaaggugaucgaccugggcugcggcagaggcggcuggagcuauuacugcgccgggcugaagaaggucacagaggugaaaggguacaccaagggcgggccuggccaugaggagccgauacccauggccacauacggguggaaccucgugaagcuccacuccggaaaggacgucuucuucaugccgccggaaaagugcgacacccuucucugcgacaucggggagagcaguccgaaccccaccaucgaggaagggcggacccugagggugcugaagaugguugagcccuggcuccggggcaaccaauucugcaucaagaucuuaaaccccuacaugccgagcgucguugagacacucgagcgcaugcagcggaagcaugggggcaugcugguccgcaacccgcugucgcgcaacagcacgcacgagauguacugggucuccugcgggaccggcaacauugugagcgccguaaauaugacaucgcgcaugcugcucaaccgcuucaccauggcccaccggaagcccacguacgagcgcgacguagaucugggcgcggggacccggcacguggccguggagcccgaggucgcuaaccuggacaucaucggccagagaauagaaaauaucaagaacgagcacaagagcaccuggcacuacgacgaggacaauccguacaagaccugggcguaccacgggagcuacgaggugaagccaagcggcuccgccagcuccauggucaacgggguggugcgacuccugacgaagcccugggauguuauacccauggugacccagaucgcuaugacagacacgacuccguuuggccaacagcgcguauuuaaggaaaagguugacacgcgaacaccccgcgccaagcggggcacgacgcagaucauggagguaacggcuaaguggcuguggggauuccucagccgaaauaaaaagccccgcauuuguacccgcgaggaguucacccgcaagguccgcaguaacgccgccauuggcgccgucuucguagacgagaaccaguggaacucagccaaagaagccguggaagacgagcgauucugggaucuaguccaccgcgagagggagcugcacaaacaggggaaaugcgcgacgugcgucuacaacaugaugggcaagagagagaagaagcucggggaguucggcaaggcgaagggcucccgggcaaucugguauauguggcugggggcacgcuucuuggaguucgaggcucucggcuucaugaacgaagaccacugguuuagccgggagaacagccuguccgggguggaaggcgaggggcugcacaagcugggguacauccugcgcgacaucucuaagaucccgggagggaauauguacgccgaugacaccgcggggugggauacccgcauuacggaagacgaccugcaaaacgaggcaaaaaucacagauaucauggagcccgaacacgcccagcuagccaccuccauuuucaagcuaaccuaccaaaacaaaguagugagagugcagcgccccgcaaagaacgggacggucauggacgugaucucacggcgcgaccagcggggcuccggccaggucgggacguauggccugaacaccuucaccaacauggagguccagcucauccgccagauggagagcgaggggauauucuuacccuccgaguuagagaccccgaaccucgccgagcgggcccuggacuggcuggagaagaacggggcugagcgccucaagcggauggccaucagcggggacgacuguguggugaagcccauagacgacagguucgccacggcguuaaccgcacugaacgacaugggcaagguccggaaggacaucccccagugggagccaaguaagggguggaacgauuggcagcagguaccguucugcagccaccacuuccaucaacucaucaugaaggacgggcgcgagaucgugguacccugccggaaccaagacgaacucgugggccgcgcccgggugucccagggggcgggcuggucgcuacgcgaaaccgccugccucgggaaguccuacgcgcaaauguggcaguugauguauuuccacagacgcgacuuaagacucgcggccaaugccauuugcagcgcgguccccguggauugggugcccacgagccgcacuacgugguccauccaugcccaccaccaguggaugacaacggaggacaugcugagcguguggaaucgcguuuggaucgaggagaacccguggauggaggauaagacgcacgugucuuccugggaagaggugccuuaccugggcaaacgagaagaccaauggugcggcucccucauuggguuaacggcgcgcgccaccugggcaacaaacauucagguggcgaucaaccaggugcggagguuaaucggcaaugaaaacuaccucgacuacaugacaagcaugaagcgguucaagaacgagucugacagcgagggggcccugugguga

SEQ ID NO: 23990 - RNA, 9879 nt, Artificial Sequence
  derived and/or modified CDS sequence (opt11) from DENV-1__KJ189359__SS-prME
agcgugaccauguugcucaugcuccugcccaccguccucgccuuucaucugaccaccagaggaggggaaccccacaugaucguauccaagcaagagcggggcaagagcuuacuguucaaaacauccgcgggcgugaauaugugcacccugaucgccauggaccugggggaguuaugcgaggacacaaugaccuauaaaugcccccgcauaaccgaggcugagcccgacgacguggauuguuggugcaacgccaccgacaccuggguaacguaugggacuugcucucagacgggcgaacaccgacgggagaagcgguccguggcccuggcgccccacgucggcuuaggguuagagacccgcaccgagaccuggaugucguccgagggggcauggaagcagauccaacggguggagaccugggcccugcgccaccccggguucacagugaucgccuuuuuccuggcccacgcgaucggcacguccaucacgcagaaagggaucauuuucauccuauugaugcuugucaccccuagcauggccaugcggugcguaggcauugggaaccgcgauuucguggagggguugucaggcgcuacguggguugacgucgugcuggagcacgggucuugcgucaccaccauggcuaaaaacaaacccacccuggacauagaauugcuaaaaacggagguaacaaaccccgccguguuacggaagcucugcaucgaagccaagaucucuaauacgacaacggacucccguuguccgacccaaggcgaggcuacccugguugaggagcaggacgccaacuuugugugucggcggacguuuguggaccggggcugggggaacggcugcggacuguuuggaaaggggagucuccugacuugcgcuaaguuuaagugcguuaccaaacuggagggaaagaucgugcaauacgaaaaucucaaauauuccgugaucgucaccgugcacaccggcgaccagcaucaggugggaaacgaaacgaccgagcauggcaccauagccacaauuacaccccaagcgccuacuagcgagauucaacuuaccgacuacggugcucugacauuagacugcuccccacguacgggauuggacuucaacgagaugguccuccucacgaugaaagagaaaagcuggcuggugcauaaacaaugguuccuggaccuaccccugccauggaccucuggugcuucaacgagccaggaaacauggaaccgccaggaccugcuggucaccuucaagacggcccacgcaaagaaacaagagguugugguccuggggucccaggaaggcgcaaugcacaccgcucuaaccggggccacugagauccagacgagcgguacaaccacgauuuucgcggggcauuugaaaugccgcuuaaagauggacaaacugacccucaagggcaugaguuaugugaugugcaccggaaguuucaaguuggagaaggaggucgcugaaacccagcacggcacaguccugguccaagucaaguaugaaggcaccgacgcuccauguaagauccccuucucgacucaagacgagaagggugucacccagaacggccggcuuaucacggcgaacccgauuguaaccgacaaggaaaagccuguuaacauugagaccgagccacccuucggugaguccuacaucguggucggcgccggagagaaggcccuaaaguuaaguugguucaagcgcgggagcucgaucgguaagauguucgaggcaacagcucgcggugcgcgucgcauggccauacugggagacacggccugggacuucggcagcauagguggcguguucacgucgguagggaagcucguucaccaggucuucggcacggcguaugggguccuguucucuggcguguccuggacgaugaagaucgggauaggcaucuugcugacguggcucggccugaacucacguuccaccagccucaguaugaccugcaucgcagugggaauggucacccucuaccugggggugauggugcaggccgacagcgggugcgucaucaauuggaaaggccgcgagcuaaagugcggauccggcaucuucgugacgaaugaagugcauacguggaccgagcaauacaaguuucaggccgacagcccgaagcggcugagugccgcaaucgggaaggccugggaggaggggguuugcggcauucgcuccgccacccggcuggagaauauaauguggaagcagaucuccaacgagcucaaccauauucugcuggaaaacgauaugaaguucacuguaguggucggggacgccaacggcauacucgcccaaggcaagaagaugauucgcccccagcccauggagcacaaauauucauggaaaaguuggggcaaggcgaagauaaucggcgcugauauacagaacaccacuuuuaucaucgacggacccgauacgccggagugucccgauggacaacgggccuggaacauaugggagguggaggacuacggcuucgggguguuuaccacgaacauauggcugaagcugcgcgauuccuacacccagaugugugaccaccggcuuaugucagcagcaaucaaggacuccaaggccguccacgcggacaugggcuacuggaucgagagcgagaaaaaugaaacauggaagcuggcacgcgccuccuucaucgaggugaagacaugcacguggccgaagucccacacucugugguccaacggugugcucgagagcgagaugaucauccccaagauauacggcgguccgauuucccagcauaacuaccgucccggcuacuucacgcagaccgcggggcccuggcaccugggcaagcuggagcucgacuuugaucugugcgaggguacgacagucgugguggacgagcauugcgggaacagaggcccgagcuugcguaccacaacggucacggggaagaucauucaugaguggugcugccgcuccuguacccuaccuccauugcgguuucguggggaggauggaugcugguacgggauggaaauacggcccgucaaggaaaaggaggagaaccuggugcgaagcaugguaagcgccgguagcggggagguggacagcuucagucucggcaucuugugugugaguaucaugaucgaggaaguuaugcggucucgcuggagccgcaagaugcuuaugaccggcacgcucgcuguguuucugcugcucauaauggggcagcugaccuggaacgaucugauccgucucugcauaaugguaggggcuaacgccagugaccgcauggguauggggaccacauaccuggcgcuuauggccacauucaagaugcggccgauguucgccgucgggcuccuguuccgccggcugacaucacgcgaaguucucuugcugacuaucgggcucucccuugucgccagcgucgaacuucccaacucccucgaggagcugggagacggccuggcuaugggcaucaugaugcugaagcuguugacagaguuucaaccccaccagcuuuggacgacacugcugucgcucacguuugugaagaccacgcugucccuggacuaugcguggaagaccaccgccauggcucucuccaucgucucccuguucccucugugccucagcacuacaucccaaaagacgaccuggcugccggugcuucuugggagcuucggcuguaaaccccugaccauguuccuuaucacggaaaacaagauauggggccggaagucauggcccuuaaacgaggggaucauggccauaggaaucgugagcauccuucugagcagccuccuuaagaacgacgucccucuggcaggcccgcucaucgccggcgggaugcugaucgccugcuacguuaucagcgguuccagcgccgaucugagccucgagaaagcggccgaagugaguugggagcaggaggcggagcacaguggggcuucucacuccauauuggucgagguacaggacgacgguacgaugaagaucaaggacgaggaacgugaugacacccugaccauucuacugaaggccacacugcucgccgugagcggggucuacccuauguccaucccugcgacgcuguucguaugguacuucuggcagcggaagaaacagcgcucgggaguguuaugggauacccccucgccucccgagguggaacgggccguacucgauaacggcaucuaccgcauacugcagcggggccugcugggccggagccaggugggggucggaguguuccaggacgggguauuccacaccauguggcacguuacccguggcgccguucucauguaccaagggaaacgccuggagccaucaugggccucggugaaaaaggaccugaucucauacggaggaggguggcguuuccagggcagcuggaacacgggugaggagguccaggucaucgccguggagcccggcaagaacccgaagaauguccagaccacuccgggcacguucaagacgcccgaaggggaaguaggcgcgaucgcccucgacuucaagcccggaacauccgggagcccgaucgugaaccgcgaggggaagaucguagggcuguacgggaacgggguuguaaccaccuccggcacguacguaagcgccauagcccaggcgaaggcgagccaggaggggccucuaccagagauugaggaugaaguauuuaaaaagcgaaaccucaccaucauggaucugcacccgggcuccggcaagacacggcgauaccugcccgccauagugcgugaggccaucaaacgcaagcuccgcaccuuaauccuggccccgacaagggucguggcgucagagauggcugaggcgcucaaggggaugccgauccgauaccagaccacugccgugaagucggagcacaccggacgcgaaaucguggaccugaugugccacgccacuuucaccaugcggcuauuaaguccuguacgggugccuaauuacaacaugauuauaauggacgaagcccauuucacggaucccgcuuccaucgccgcccguggguacaucagcacccgagucggcaugggggaagcugcggcgaucuucaugacggccacgccgccaggcaguguggaggccuucccccaguccaacgccguaauccaggacgaggagagggacauuccugaacgcaguuggaacaguggcuacgacuggaucaccgacuucccagggaagacugucugguucgugccuucaauuaaaagcggcaaugacauugcaaacugccugcggaagaacgggaaacgcgugauccagcuaucccgcaagaccuucgacacagaguaccagaagaccaagaacaacgacugggacuaugucgugacaacugacaucagcgagaugggggcaaauuucagggccgaccggguaauagacccccgccgaugucuaaagccugucauccuuaaggauggaccugagcgcgugauucuggcuggcccgaugcccgucacuguagcuuccgccgcccaaagacggggccgcaucggccggaaccaaaacaaggaaggugaccaguacguguacaugggccagccacuaaacaacgaugaggaucaugcgcacuggaccgaggccaagaugcuguuagauaacaucaauacccccgagggcaucaucccggcacucuucgagcccgagcgcgaaaaguccgccgccaucgacggggaguacagguugcgcggcgaagcccggaaaacuuucguugaacugaugcgucguggugaccucccaguguggcuauccuacaagguggcaagcgagggguuucaguauuccgaucgccgguggugcuuugacggagaacgcaacaaucagguccucgaggagaauauggacguggagauauggaccaaagagggggaaaggaagaagcuccgcccccgguggcuggacgcccgaacuuacagugacccgcuggcccuccgggaguucaaagaguucgccgccggacggcggagcguguccggcgaccugauccucgagauuggcaaacuuccccaacaccucacucuacgagcccagaaugcccucgacaaccuggucaugcuccacaacagcgaacagggcgguaaggccuaucggcaugcgauggaggaauugcccgacacgaucgagacguuaaugcuuuuagcacugaucgcggugcugaccggcggggugacccucuucuuccucagcggcaagggccuggggaagaccuccauaggccuccuaugcgucacggccucuagcgcccuauuauggauggccuccguggagccgcacuggaucgccgcgagcauuauauuggaguuuuuccugaugguucuccugaucccggaacccgaucgacagcgcacgccccaggacaaccaacuggccuacgugguuauugggcuacuuuucaugaucuugaccguggccgcgaacgagauggguuugcuggaaaccaccaagaaggauuuaggaaucggauacguggccgcggagaaccaccagcacaccacgauguuagacguggaccugcacccggcauccgcguggacccuguaugccguugcuacgacaguaauuacucccaugaugcgccacacaaucgagaacacgaccgcgaacaucagccucacugcaauugccaaccaagccgcaauacugaugggucuggacaagggguggcccauauccaagaucgacaucggcguaccuuugcuugcgcugggauguuacagccagguuaacccguugacccuaacggccgccguccucaugcucguggcccacuaugcaaucauaggccccggacuucaggcgaaggcaacccgcgaggcucagaagcggacugcggcaggcaucaugaagaacccaacuguggacggaaucguugcgaucgaccucgaccccgugguguacgacgccaaguucgagaaacaguuggggcagaucaugcugcugauuuugugcacgagucagaucuugcucaugcgcacaaccugggcucucugcgagagcaucacccuggcgacgggcccacugacgacucucugggaggggucccccggaaaauucuggaacacaacgaucgcggucagcauggccaacaucuucaggggcaguuaucuugccggugccggucuggcauuuucccucaugaagucccuugggggcgggcgccgugggacuggagcccagggggagacucugggcgagaaauggaaacggcagcucaaccaauugucaaaaagcgaguuuaacaccuacaagcgguccgggauaauggaaguggaccgcagcgaggccaaggagggacugaaacgcggggagacgaccaagcacgcugugagccgcggaaccgccaaacugcguugguuugucgagcggaaccuggucaagccggagggaaagguaaucgaccugggguguggcagaggcggauggaguuacuacugcgcggggcugaaaaagguaaccgagguaaagggauauaccaaaggcgggcccgggcaugaagaaccuaucccgauggccacauauggguggaaccuagugaaacugcacuccggcaaagacgucuucuucaugccgcccgaaaagugcgacacccuacucugugacaucggugagagcucccccaaccccacuaucgaggaaggcagaacgcuccgggugcugaagaugguggagcccuggcuccgcgguaaucaguuuugcauuaagaucuugaaccccuacaugcccagugucguggagacccuggagcgaaugcagcgcaagcacgggggcaugcuggugcgcaacccccuuucccguaauagcacccacgagauguacugggucuccuguggaaccggcaauaucgugucugccguaaauaugacaagucgcauguuacucaaccgguucaccauggcacaccgcaagcccaccuacgaacgugacgucgaccugggcgcagggacccgccacguggcaguggagccugagguugccaacuuagacauuauuggccagcggaucgagaacaucaagaacgagcauaaaagcaccuggcacuacgaugaagacaacccguacaagacgugggcauaccacggguccuaugaagugaaaccuucgggcucagccagcuccauggugaacggggucgugaggcuccugacgaagcccugggacgucauccccauggugacucagaucgccaugacugauacgaccccguucgggcagcagcgcguauucaaagagaaaguggacacucgcacgccacgcgcgaaaaggggcacuacgcaaaucauggaggugaccgccaaguggcuguggggauuccucagccggaacaagaagcccaggaucugcacccgggaagaguucacucgcaaggugcgaagcaacgcagcaaucggcgcggucuuuguggacgagaaucaguggaacacggcaaaagaggccguggaggaugagcguuucugggaccugguccaccgugaacgcgagcuccacaagcagggaaaaugcgcgaccugcguguacaacaugaugggcaagagggagaagaagcucggggaguucggcaaagcaaagggcucccgcgcgauuugguacaugugguuaggggcucgguuccuggaguucgaggcccucggcuuuaugaacgaagaccacugguuuucccgcgaaaauucgcucagcgggguggaaggagaggggcuccauaaauugggcuauauccuucgcgacaucaguaagaucccgggcgggaacauguacgcggacgacaccgcggguugggacacgcguauuacagaggacgaccuacaaaacgaggccaagauuaccgacaucauggagccggagcaugcacuccuagccacgagcaucuucaagcucaccuaccagaauaaggucgugcgagugcagcgucccgccaaaaacgggaccgucauggacgugaucucccgccgggaccagcggggaagcggccaggugggcaccuauggcuugaacaccuucacgaacauggagguacaacugauccgucagauggaaucggagggcauuuuccugcccagcgagcucgagacgcccaaccuggcugagcgcgcgcuggauuggcucgaaaagcauggcgccgaacggcugaagcggauggccaucuccggggacgacugcguggugaaacccaucgacgaucgguucgcaaccgcccugaccgcucucaacgauauggguaagguccgaaaggacauuccccagugggagccuagcaagggcuggaacgacuggcagcagguacccuucuguucccaccauuuccaccagcugaucaugaaggacgggcgggagaucguaguccccugccgcaaccaggacgaguuagucgggcgggcgcgagucagccagggugcgggcuggucccuccgggagaccgcaugccucggcaagucauacgcccagauguggcagcugauguacuuccaccgccgggaucuccgcuuggcggccaacgccaucuguuccgccguccccguggacugggugccaacuucccgcaccaccuggaguauccacgcgcaccaucaguggaugacaacggaggacaugcuuuccguauggaaccggguguggaucgaggagaauccauggauggaggauaagacccaugugagcuccugggaggagguccccuaccucggcaagcgcgaggaccaauggugcggcagcuuaaucgggcucacagcuagagccaccugggccacgaacauccagguggccauaaaccaggugcgccggcuaauaggcaacgagaauuaccuggauuacaugaccuccaugaaacgauucaagaacgaaucugacagcgagggagcucugugguga

SEQ ID NO: 23991 - RNA, 9879 nt, Artificial Sequence
  derived and/or modified CDS sequence (opt11) from DENV-1__KJ189360__SS-prME
agcguaaccaugcugcucauguuacuacccacggccuuagcguuccaccugaccacgcgcggcggggagccccacaugaucgugaguaagcaggagcggggcaagagccuccuuuucaagaccucugcaggggugaacaugugcacccuuaucgcaauggaccugggcgagcucugcgaggacacgaugaccuacaagugcccccgcaucaccgaggcugagcccgacgacguggacugcugguguaacgccaccgacacgugggugacguacgggacuuguagccagacaggcgagcaccggcgcgagaagcgguccguggcccuggcgccccacguggguuuagggcucgagacccgcaccgaaaccuggaugucguccgagggcgccuggaaacaaauccagcggguggagaccugggcccugcgucaccccggcuucacagugaucgccuucuuccuggcacacgccaucggcaccagcaucacccagaaggggaucauauuuauccuccugaugcuggugacccccuccauggccaugcggugcguaggcaucggcaaucgcgacuucguggagggucuaagcggagccacuugggucgacguuguacuggaacacgggagcugcgucaccaccauggcaaaaaacaagccuacguuagacaucgagcucuuaaagacggaggugaccaaccccgcgguucugcggaagcuuugcaucgaggccaagaucagcaacaccaccacugacucucgcugccccacccaaggcgaggcaacccugguggaagagcaggacgccaacuuugucugccggcgaaccuucguggaccggggcugggggaacggaugcgggcuguucggaaaggggucccuccugacgugcgccaaguucaagugcgugaccaagcuggagggcaagaucguccaguacgaaaaccucaaauauuccgugaucguaaccguccauaccggcgaccagcaccagguagggaaugaaacgaccgaacauggcaccauagcgacgaucacgccccaggcgcccacgagcgagauacaauuaaccgacuacggggcccugacccucgacugcagcccacggaccggccuggauuucaacgagaugguccugcucacgaugaaggagaaguccuggcuggugcauaagcagugguuccuggacuuaccucugcccuggaccuccggggccucuacuucacaggagaccuggaaccggcaagaccugcucgugacauucaagaccgcccacgcgaaaaagcaggaggucguagugcuuggcagucaggagggagccaugcacaccgcccugacuggagccacagaaauccagacuagcggcaccacuacaauauucgccgggcaccucaagugccgccugaagauggauaagcugacccugaagggcauguccuacguaaugugcaccggaagcuuuaagcuggagaaggagguggcggagacccagcacggcacggugcuggugcaggugaaguaugaggguaccgacgcccccugcaaaaucccguucuccacccaggacgaaaagggggucacgcagaacggccgucugaucacggcgaacccgaucgucaccgacaaggagaaacccguuaacaucgaaaccgagccucccuucggggaaagcuacaucgugguaggggccggggagaaggcgcucaaguuauccugguucaagcgcgggucauccaucggcaagauguucgaggccacugcacgcggcgcccgccguauggcaauccuaggcgacacggcgugggacuucgggagcaucggggguguguuuacuuccguaggaaaguuaguacaccagaucuucggcaccgccuacggagugcuguucucuggcguguccuggacuaugaagaucgguaucggcauccugcucacguggcugggccugaacucgcguuccaccucucuguccaugaccuguaucgccgucggcauggugacccuguaucugggcgucaugguccaagccgacucggggugcgugaucaacuggaaaggcagggagcucaagugcggguccggcauauuugugacuaacgagguccacaccuggaccgagcaguacaaguuucaagcagauagccccaaacggcuaagcgccgcuauuggcaaggccugggaagagggugugugcggcauccgcuccgccacgagacuggagaauauuauguggaagcagaucagcaacgaacucaaccacaucuuacuggaaaacgacaugaaauucaccgugguagucggggacgccaacggaauccuagcgcaagggaagaaaaugauccgcccccaaccuauggagcacaaguacuccuggaaguccuggggcaaggccaagaucaucggcgccgacauccagaacacgaccuucaucaucgacgggcccgacaccccggagugccccgacggccagcgugccuggaacaucugggagguugaggacuacggauucggcgucuucaccacgaacauauggcugaagcugcgugauuccuacacccagaugugcgaccaccggcucaugagcgcggccaucaaggauuccaaggccgugcaugcggauaugggcuacuggauagagagcgagaagaacgagacauggaagcuggcucgcgcguccuucaucgaggugaagacaugcacauggccgaagagccacacucuaugguccaacgguguccucgagucagagaugaucauccccaagauauacggcgggccgaucucccaacacaacuaccgccccggcuauuucacccagaccgcgggccccuggcaccugggcaaguuagagcuugacuucgaucugugcgaggggacgaccguagugguagacgaacacugcgggaaucgcggcccgagccugcggaccacgacggugaccgggaagaucauucacgaguggugcugccgcucaugcacucucccgccacuccgguuccgcggcgaggacgggugcugguacggcauggagaucagacccgugaaggagaaagaggagaaccugguccgcagcaugguguccgccggcagcggggaggucgacagcuucucccuaggaauauugugcgucucgaucaugaucgaggagguuaugcggucccgcuggagccgcaagaugcugaugacugggaccuuggccguauuccuguuguuaaucaugggccagcuuacguggaaugacuuaauucgucucugcaucaugguaggggccaacgcguccgaccgaaugggcaugggcaccacuuaccuggccuuaauggccacguucaaaaugcggccuauguucgccgucgggcugcuguuccgcagacugaccagucgcgaggugcuucugcugaccaucggccucuccuuggucgcuagcguggagcugcccaacucuuuggaggagcugggagacggccuggcgaugggcaucaugaugcucaagcuguuaaccgaguuccagccacaucagcucuggacgaccuugcugagccucaccuucguuaaaacuacgcugucuuuagacuacgccuggaagaccaccgcaauggcacucagcaucguaucgcuguucccccugugccucucgaccacgagucagaagacuaccuggcugccagugcuguuagggagcuucggcugcaagccgcugaccauguuccugauaaccgagaacaagaucugggggcggaaguccuggccccucaacgagggaaucauggcgauaggaaucgucagcauccugcuguccagccucuugaagaacgacgucccacuggccggcccgcucaucgcuggcggcaugcugauagccuguuacgugaucagcggcuccucagccgaucugucccucgagaaggcggccgaggucagcugggagcaggaggcagagcacuccggggccagccauaguauacugguggagguacaggaugauggcacgaugaagauuaaggaugaggagcgcgacgauacccugaccauccuccugaaggccacccugcucgcggucagcgggguauaccccauguccauccccgccacgcuguucgugugguauuucuggcagaagaaaaaacagcggaguggcguccugugggacacccccucgccgcccgagguggagcgcgcagugcucgacaacggcaucuaccgaauacugcagcgcggccuccucggcaggagccaggucggggugggaguguuucaggacggggucuuucacacgauguggcacgugacccgcggcgccguccucauguaucagggcaaacggcuggagcccucuugggcuagcgugaaaaaggaccugaucuccuacggaggcggguggcgcuuccagggcagcuggaacacgggagaggagguccaggucaucgcaguggagcccggcaagaacccgaagaauguacaaaccacccccggaacuuucaagacgccggaaggcgaggugggcgcgaucgcccucgacuucaagcccgggaccuccggaagcccuaucgucaaccgggaaggcaagauuguggggcuguacggcaacgguguggucaccacuuccggcacguacgucagcgcgaucgcccaggcgaaggccagccaggaaggcccccugcccgagaucgaagacgagguguucaagaagcgcaaccuuacgaucauggaccugcacccgggcagcggcaagacccggcgcuaccugccagccaucguccgggaggccaucaagcgcaaacuccgcacccucauccuggcgcccacgcggguggucgccucagaaauggccgaggcacuaaaggggaugccuaucagguaucagacuacggccgucaagucagagcacaccggccgggagauuguagaucugaugugccacgcgacauucaccaugcgccugcucagcccugugcggguccccaacuacaacaugaucaucauggaugaggcgcacuucaccgauccugccagcaucgcagcucgcggcuacauaucaacccgggugggaaugggggaggcggcugccaucuucaugacggccacaccgcccggcuccguugaggccuucccccaaagcaacgcggucauccaagacgaggagcgugauauacccgagcggaguuggaacagcggcuacgauuggaucaccgacuuccccgggaagaccgugugguucgugcccucgaucaagagcggcaacgacauagccaacugucugcgcaaaaacgggaagcgggucauccagcugucacgcaagacuuuugacaccgaguaccaaaaaaccaagaacaacgacugggacuacguagugaccaccgacaucucggagaugggcgccaacuuccgggccgaucgcgucauagauccacggagaugccucaagccagugauucugaaagacggccccgagcgcgugauccuggcgggcccgaugcccgucacugccgcuagugcugcccagcgccgugguagaauagggcggaaccagaacaaagagggcgaucaauacguguauauggggcaaccucucaacaacgacgaggaccacgcccacuggacagaggccaagaugcuccuggauaacauuaacacccccgagggcaucaucccggcacuguucgagcccgagcgugagaagucggccgccaucgauggggaguaccggcugaggggcgaggcgcgcaagacguuugucgagcuaaugcggcgcggagaccuccccguaugguuauccuauaagguggcaagcgagggguuccaauacuccgaucggcgcuggugcuucgacggagagcgaaacaaccaggucuuggaggagaacauggacguggagaucuggaccaaggagggggagcgcaaaaagcucagaccccgguggcuggaugcacguaccuauucagacccgcuggcccuccgcgaguucaaagaguucgccgcgggcaggcguagcguguccggagaccugauccucgagauagggaagcucccccagcaccuuacucuucgggcccagaacgcccucgauaaccuggucaugcugcacaacagcgagcagggcggcaaggccuauagacacgcgauggaagagcuccccgauaccaucgagacgcugaugcugcucgcccugaucgccgugcugaccggcggggucacccucuucuuucuguccggaaagggucuggggaagacaagcaucggccuacugugcgucacggccuccagcgcccuccucuggauggcguccguagagccccacuggaucgccgccagcaucauccuggaguucuuccuaauggugcuacugaucccagagcccgaucggcagcguacgccccaggacaaccaacuggccuacguugugaucggucuacuuuucaugauccugaccguggccgcgaacgagaugggccuacuggagaccacgaagaaggaccugggcauaggcuacguagccgccgagaaccaccaacacgccaccauguuggacguggaccugcacccggcauccgcauggacgcuguacgccgucgccacgacgguuauuacccccaugaugaggcacacgaucgagaacaccacagccaacaucagccuuaccgccaucgcgaaucaggcugcuaucuugaugggucuggauaagggguggccgaucuccaagauggauaucggcgugccccuccuggcgcugggcugcuacucgcaagugaacccgcucacccugacagcugccguccugaugcucguggcgcacuacgccaucaucggccccggccugcaagccaaagcgacucgcgaggcgcaaaagcgaaccgccgccggaaucaugaagaaucccaccguggacggcaucguagcaaucgaccuggaccccguuguguacgacgcaaaguucgagaagcagcucgggcagaucaugcuucugauccucugcacuucccagauccugcugaugcgaacgaccugggcccucugcgagagcaucacccuugcuaccggcccguugacgacgcuaugggagggguccccgggcaaguucuggaacaccaccaucgccgucagcauggccaacaucuuucggggcuccuaccuggccggggcgggccuggccuucagucucaugaaaucccuggggggcgggcggcggggcacgggggcccagggggaaacccugggagaaaaauggaagcggcagcucaaccagcugagcaagagcgaauucaacacuuauaagcgcagugggaucauggagguggaccggagcgaggcgaaggaggggcugaagcgaggggagaccacaaaacacgcuguaucccgggguacugccaaauugcgcugguucgucgagcggaaccuggugaaacccgagggcaaggugaucgacuuggggugcggccgcgggggcuggagcuacuacugcgccgggcugaagaaggucaccgaagucaagggcuacacgaagggcggaccgggccacgaagagccgauccccauggcaaccuacggguggaaccucgugaagcuccacuccggcaaagacguauuuuucaugccgcccgagaaaugugacacacuacucugcgacauuggcgagagcuccccgaaccccaccaucgaagagggccgaacccuacgcguucugaagaugguagagcccuggcuccguggcaaccaauucugcaucaagauucugaacccauacaugccaagcgucguggagacccuggaacgcaugcaacgaaagcacggugggaugcucgugcgcaacccccuuucccggaauagcacgcacgagauguauugggucuccugcgggacgggcaacaucgugucagcugugaacaugacgucgcgcaugcuguugaaucgcuucaccauggcccaucggaagcccacguacgagcgcgaugucgaccugggcgcggggacgagacacguugccguggagcccgaggucgccaauuuggacaucaucgggcagcguauagaaaacaucaagaacgagcauaagagcaccuggcacuacgacgaggacaaucccuacaagaccugggcuuaccacggguccuacgaggugaaaccgucaggcuccgcaucgagcauggugaauggggucgugaggcuccugacgaagcccugggaugucauucccauggugacccagaucgccaugacagacaccaccccguucggccaacaacgagucuuuaaggagaagguggacacccggacgccccgagccaagcgggggaccacgcagaucauggaggugaccgccaaguggcuguggggguuccucagccguaacaagaagcccagaaucugcacacgcgaggaguucacucggaaagugcggagcaacgcugccaucggugccgucuuuguggaugaaaaccaguggaacagugccaaggaggccguggaggacgagcguuucugggauuugguccaccgcgagagggagcugcacaagcagggcaagugugccacgugcguguauaacaugaugggcaagcgcgagaagaaacucggggaguucggcaaggccaaaggcagccgcgccaucugguacauguggcugggggcccgcuuccuggaguucgaggcccucggguucaugaaugaggaccacugguuuucccgggaaaacagccuguccgguguggagggcgagggguuacacaaguugggcuacauccuccgggacaucucuaagaucccgggggggaacauguacgcagacgacaccgccggcugggacacgcgcguaaccgaggacgaccugcagaacgaggccaaaaucacggacauuauggaaccagaacacgcccuccuggcuacguccauuuucaagcugaccuaccagaacaagguagugcggguccagaggcccgccaagaacgguaccguuauggacgugaucucacggcgugaccagcggggcuccggccaggucgggacguauggccuuaacaccuucaccaacauggaaguacaguuaauacgccagauggagagcgagggcaucuuccugcccuccgagcucgagaccccgaaccuggcagagcgcgcucuggacuggcucgagaagcauggagccgaacgccuaaagcguauggcgaucagcggggacgacugcguggucaagcccaucgaugaccgguucgcgaccgcccuaacagcucucaacgacaugggcaaggugcggaaagacaucccccagugggagcccuccaaggguuggaacgacuggcaacaggucccguuuugcagccaucacuuccaccagcugaucaugaaggacgggcgcgagaucgucguucccugcaggaaccaggaugagcuagugggccgcgcccgggucagccagggugcuggcuggagccuccgcgagaccgccugccucggaaagucguacgcccagauguggcaacugauguacuuccaccgucgcgaccuccgucuggccgcgaacgccaucugcagcgccguuccggucgacuggguccccaccagccgcaccacguggucaauccacgcccaccaccaguggaugacuacagaggauaugcugaguguguggaaucgcguguggaucgaggaaaacccguggauggagaacaagacccacgucaguagcugggaggaggugcccuaucucggaaagcgagaggaccaauggugcggcagccugaucgggcugacggcccgcgcaaccugggccacaaacauccagguagcuauuaaccagguccgacgucucaucggaaacgagaauuaccuggacuacaugacgagcaugaagcgguucaagaaugaguccgacagcgagggggcacugugguag

SEQ ID NO: 23992 - RNA, 9879 nt, Artificial Sequence
  derived and/or modified CDS sequence (opt11) from DENV-1__KJ189361__SS-prME
agugucacgaugcugcuaaugcugcuacccacagccauggccuuccaccucacgacccgcgggggggagccacacaugaucgugagcaaacaggaacgugggaagagccuguuauucaagaccagcgcgggugugaacaugugcacccucauugcuauggacuugggggaacugugcgaggacaccaugaccuacaagugucccagaaucaccgaagccgaaccagaugacguggauuguuggugcaaugccaccgacacgugggugaccuacggcaccugcagccagaccggggagcacaggcgcgagaagcgguccguggcucuggcgccccaugugggguuggggcuggagacgcgcacggaaaccuggaugagcucagaaggcgcauggaagcagauccagcgggucgagaccugggcccuccgccacccgggguucacggugaucgccuucuuucucgcacacgccaucggaaccucuauuacccaaaaggggaucauuuucauucugcugaugcuaguuaccccauccauggcaaugcggugugugggcaucggcaaucgcgauuucguagaagggcugagcggcgcuacuuggguagacgucguucucgagcacgggaguugcguaaccaccauggcuaagaacaagcccacccuggacaucgagcugcucaagacugaggucaccaacccugcgguucugcguaaacugugcauugaggcaaaaaucagcaauacgaccacggauucccgcugcccgacccagggugaagccacccucguggaagagcaggacgccaacuucguaugccggcgcaccuucguggaccgcggcugggggaacggcugcgggcuguucggcaaggggagcuuauugacgugcgcgaaauucaagugcguuaccaagcuugaggggaagaucguccaauaugagaaccuaaaguauucagugaucgugaccguacauaccggcgaccaacaccaggugggaaacgagacaaccgagcacgguaccaucgcgaccauuacgccccaggccccaacuagcgagauccaacuuaccgacuauggggcccuaaccuuggacugcagcccucggaccggccucgacuuuaaugagaugguucugcugacgaugaaagagaaguccugguugguacacaagcagugguuucuggauuuaccacucccguggacuuccggcgccuccacgagccaagagaccuggaaccggcaggaccuguuaguaacguucaagacagcccacgccaagaaacaagagguagugguacucggcagucaggagggggcgaugcacaccgccuuaacgggcgcgaccgagauucaaaccucaggcacuaccacgaucuucgcuggacacuugaaaugucgucuuaagauggacaagcugacauuaaagggcaugucuuacgucaugugcaccgguaguuucaagcucgaaaaggagguggcggagacccagcacggcacggugcugguucaaguaaaguaugagggcaccgaugcaccuugcaagauucccuuuuccacccaggacgagaagggggugacccagaacggccggcugauuacggcgaacccgaucgucaccgacaaggagaagcccgugaacauagaaaccgagccgccguucggagaaagcuacauaguagucggagccggcgagaaggcguuaaaauuauccugguucaagcgagggagcuccauugggaaaauguucgaggcgaccgcacgaggggcccgccgaauggccaucuugggcgacacggccugggacuuugggagcaucggcgguguguucaccucagugggaaaacugguccaucagaucuuuggcaccgccuacgggguauuguucagcggcgucuccuggacuaugaagauagggaucggcauccuguugacguggcugggccuaaacagcagauccaccagccuguccaugaccugcaucgcugucgggauggugacccucuaucugggugucaugguccaggccgacagcgggugcguaaucaauuggaagggccgcgagcugaagugcgggaguggcaucuucgugacuaacgaaguacacaccuggacggaacaguacaaguuccaggcagacucacccaagcgucugagugccgccaucggcaaggccugggaggaaggagucugcggcauccguucugccacccgguuggaaaauauaauguggaaacagaucagcaacgaacugaaccauauacuguuggagaacgauaugaaauuuaccgucguagugggggaugcaaacggaauauuggcgcaagggaaaaagaugauccgcccccaacccauggaacauaaauauagcuggaagucgugggggaaggcgaagauuaucggcgcggauauccaaaacacgacuuuuaucaucgacggaccagacaccccggagugucccgacggucagcgggcguggaacaucugggagguagaagacuacggguuuggugucuucacuacgaacaucuggcucaaacugcgcgauuccuauacucaaaugugugaccacagacucaugucagcagccaucaaggacucaaaggcgguacacgccgauaugggguacuggauagagucagagaagaacgagacauggaagcuugcucgcgcguccuucaucgaagugaaaaccuguaccuggcccaagagccauacacugugguccaacgguguccuugaaagcgaaaugaucauccccaagauuuauggcgggccgaucucccagcacaacuaccggcccgguuacuucacucagaccgccggucccuggcaccucggaaagcuggagcuggacuuugaccucugcgaaggcacgacagucguggucgaugagcauugcgggaaucgcgguccaucacuacggaccacuacgguaaccgggaaaaucauccacgaguggugcugccgcucaugcacuuugccaccccugcguuucagaggcgaggacggguguugguacgggauggaaauacggcccgucaaagagaaagaggagaaccucgucagaagcauggugucugccgguagcggggagguggacagcuucucccuaggaauccucugcgucagcaucaugaucgaggaggugaugcggucgcgcuggagcaggaagaugcugaugaccggcacgcuagcaguuuuucuucugcugauaaugggucagcucaccuggaacgaccugauccggcuguguauuaugguaggggccaacgcauccgaccgcaugggcaugggcaccacauaccucgcacugauggcaacguuuaagaugcggccgauguuugccguggggcuccucuuccgccggcugacgucuagggaggugcuguugcugacuaucgggcuauccuuaguugccagcguugaauugcccaacucgcuggaagagcucggggacggacuggcgaugggcauuaugauguuaaaacucuuaaccgaauuccaaccgcaccaacuuuggacgacccuccugucacucacguucgucaaaacuacgcuaucccucgacuacgcauggaagaccaccgccauggcucugucaauaguuuccuuguucccccugugccugucgaccacgucccaaaagaccacauggcucccggugcuccuggggagcuucggcuguaaaccccuuaccauguuccucauaaccgagaacaagauaugggggcgaaaguccuggccccugaacgaaggcaucauggcgauaggcaucgucagcauccuccuguccagccugcucaagaacgacgugccgcuagcaggcccacugauugccgggggcaugcucauagccuguuacgugaucucuggcuccagcgcggaucugucccuggagaaggcugcggaggucucaugggagcaggaggccgagcacucuggggccagccacuccauccugguggaaguucaagaugacggcacgaugaagaucaaggacgaagagagagaugauacucugacgauauuguugaaggccacgcugcucgcggucuccggaguguacccuauguccaucccugccacuuuguuugugugguacuucuggcagaaaaaaaaacagcggucgggcguccugugggauaccccauccccccccgaaguggagcgagcagugcuggacaacggcauuuaccgcaucuugcagcgcgggcuguugggccggucccaggucggggugggaguguuccaagauggcgucuuccacacaauguggcauguuacacgcggcgcagugcugauguaccaagguaaaagacuggaacccuccugggccagugugaagaaagaccucaucucguacgggggaggguggagauuccagggcaguuggaacacgggggaagaaguccaggugaucgccguagaacccggcaagaacccgaaaaacguccagaccacccccggcacuuucaaaacgcccgagggcgaggugggcgcaauagcacuagacuucaagccggggacauccggcagcccuauugucaacagagaggguaagaucguugggcucuacggcaacggagugguaacuaccagcggcacauacgugagcgccaucgcgcaggcgaaggccagccaggaggggccccugcccgagaucgaagacgagguguucaaaaagcgcaaucugaccaucauggaccuccacccggguucaggcaagacccggagguaccuccccgccaucguccgggaggccaucaaacgcaagcuaaggacgcucauacuggcgccuacaagggucguggccagugagauggcugaggcacugaaggggaugcccauccgguaccaaaccaccgcggucaagucggagcacaccggacgugagaucguggaucucaugugucacgcgacguucaccaugaggcuccugagccccgugcgugugccgaacuauaauaugauuauaauggacgaggcccacuucaccgauccagccucuauugcagcccgcggcuacauuagcacucggguggguaugggcgaggccgccgccauauucaugacggccacaccacccggguccgucgaagcguucccacagaguaacgcggugauccaagacgaagagagagacauucccgaacggucuuggaacucaggcuacgacuggaucacggacuucccggggaaaacagugugguucguccccuccaucaaguccggcaacgacaucgccaacugucuaaggaagaacggcaaacggguuauccagcugucccgcaagacuuuugacacggaauaccagaagacuaaaaauaaugacugggacuaugucgugacgacggacaucucggagaugggcgccaacuuccgggcggaccgcguuaucgacccccggcgcugccuuaagcccgugauccucaaggaugggccagaacgggucauccuagcggggccuaugccagucaccgccgcuucagccgcucagagacggggacgcauuggccggaaccagaacaaggagggcgaccaguacguauauauggggcaaccgcuuaauaacgacgaggaccacgcgcauuggaccgaggcgaagauguugcuagauaauauuaauacccccgagggaaucauccccgcccuguucgaacccgagcgggaaaaguccgcugccaucgauggggaguaccguuuacggggcgaggcgcgcaagacguucguugagcugaugcggcgcggcgaccugcccguguggcucaguuacaaggucgccagcgaaggauuccaguacuccgacaggcgguggugcuucgacggcgagcggaacaaccagguuuuggaggagaacauggacguugaaauuuggacaaaggagggagagaggaaaaaacuuagaccucguugguuagaugcucggaccuacucagacccauuagcccugcgagaauucaaggaauucgcggccggacggcgcucugucuccggcgaccucauccuggagauagggaagcugccgcagcaccucaccuuacgggcccagaacgcucucgacaaccugguuaugcuacauaauucggagcaaggcgggaaggccuaucgucacgcgauggaggaauugcccgacaccaucgaaacucucaugcuuuuagcccucaucgccguguuaacuggaggcguuaccuuauucuuccugagcgggaagggccugggcaaaaccuccaucggccugcucugcguuacugcuuccagcgcccuacuauggauggcuuccguagaaccgcauuggaucgcugccagcaucauucuugaauucuuccugaugguguugcucauuccggagcccgaccgucagaggaccccccaggauaaucagcuagccuacguggugaucgggcuccucuuuaugauccugacaguggcagcgaacgagaugggccugcucgagaccacaaagaaggaccuaggcauaggguacgucgccgccgagaaccaccagcaugccaccaugcuugacguagaucuccacccugcgagcgcguggacguuauacgccguugcuaccacagucaucacacccaugaugcggcacaccaucgagaacaccacugccaacaucagcuugaccgccauagcaaaucaagccgccauccucaugggccuggacaaaggguggcccauaagcaaaauggauaucggcgugccccugcuagcccuugggugcuacagccaggugaacccgcugacgcuaacggccgcgguccuuaugcugguugcccacuaugccauuaucggacccgggcuccaggcaaaggcgacgcgcgaggcgcaaaagcggaccgcggcgggaaucaugaagaauccuacaguagacgguauuguagccaucgaucuugacccugucguguaugaugcgaaauucgagaagcagcucgggcagaucauguugcucauacuaugcaccagccaaauccuccugaugcgaacaacaugggcccugugcgagagcauaacccucgccaccggcccguuaaccacucugugggaagggucccccggcaaguucuggaacaccaccauugccgucaguauggccaauaucuuucgcggcucauauuuggcgggggcuggauuggccuucucguugaugaaaucccuagggggaggucggcgcggcacgggggcgcaaggggagacgcuuggcgagaaguggaagaggcaguuaaaccagcucagcaagagcgaguucaacacguacaaacgcagcggcaucauggaaguagaccggagcgaagcgaaggagggucuuaagcguggcgagaccaccaagcacgcagugucacgggggaccgcaaagcuacguugguucguggagcgcaaccuagugaagcccgaggguaaagugaucgaccugggcugcgggcgcggggguuggaguuauuacugcgccgggcuaaaaaagguuacggaggucaaaggcuacaccaaggggggcccuggucacgaagagcccauucccauggcuaccuacggguggaaucuggugaagcuccacuccgggaaggacguuuucuucaugccucccgagaagugcgauacccugcuaugcgacaucggggaauccucgccgaauccaaccaucgaggagggccgcacccuccgaguccuaaagaugguggagcccugguugcggggcaaucaauucugcauuaaaauccuaaacccauauaugcccucagucguugagacccuugagaggaugcagcgaaagcacggagggaugcuugugcggaacccccuguccaggaauagcacucacgaaauguacugggucagcugcgggaccggcaauauugugucugcuguuaauaugaccagccggaugcuacugaaccgcuuuaccauggcccacagaaagcccacguacgaacgggauguugaccuuggcgccgggacgcggcacguggccguggagcccgagguagccaaccuggacaucauuggccagcgcauugagaacaucaagaacgagcacaagucuaccuggcacuaugaugaagauaacccguauaagacuugggcuuaccacggcuccuaugaagugaagccgucaggcuccgcgucaaguauggugaacggggucguacggcugcucaccaaacccugggacgucauccccauggugacccaaauagccaugaccgauacuacgccguuuggucaacaacgaguguucaaggaaaaaguugacacccggacgccccgagccaagcggggaaccacacaaaucauggaggugacugcgaaguggcuauggggguucuuaagccgcaauaagaaaccccgcauaugcacccgcgaggaguucacccggaaaguucgcucaaacgcggccauuggugccgucuuuguggaugagaaccaauggaacucagccaaagaagcgguggaggacgagcgauuuugggaccucguccauagggagcgcgagcugcacaagcaaggaaagugugcaacgugcguguacaauaugaugggcaagcgagaaaagaaguugggagaguuugggaaggcgaagggaagccgugccaucugguacauguggcuuggggccagauuccuggaguucgaagcgcugggcuucaugaaugaggaccacugguucucccgcgagaacagccuuagcggaguggaaggugaagggcugcacaagcugggcuauauccuccgugacaucagcaagauaccgggcgggaacauguacgccgaugauaccgccgggugggauacacgcgucacggaagacgaccuucagaaugaagccaaaaucacggacauaauggagccagagcaugcccugcucgcgaccaguauauucaaguuaaccuaccaaaacaaaguugugcggguacagcggcccgccaagaaugggacaguuauggacgugaucucgcggagagaccaaagaggcuccggucaggucgggacguacggccugaauacauuuaccaacauggagguucagcucauacgacagauggagagcgaaggaaucuuccugccgucagagcuggagacgccgaaucucgccgagagggcgcucgacugguuggagaagcauggcgcagaacgccuuaagcggauggcgauaagcggggaugauugcguggucaagccuauagaugacagauucgcgacggcccugaccgcccugaacgauaugggcaagguacggaaggacaucccgcaaugggagccauccaaggguuggaacgauuggcagcagguaccguucugcucacaccacuuucaccagcucaucaugaaagaugggcgcgagauagugguuccguguaggaaccaggacgagcuagucgguagggccagggucucccagggcgcgggcuggagccugcgcgaaaccgccuguuuggguaagucuuaugcgcaaauguggcaacugauguauuuccauagacgcgaucuuaggcucgccgcgaacgccauaugcuccgcugugccaguagauuggguucccacaagccgcaccacgugguccauccacgcccaccaccaguggaugaccacagaggacaugcugaguguguggaaccgcguguggaucgaagaaaauccguggauggaagacaagacccacgucagcucgugggaagaagugccuuaucuggggaagcgggaggaccaaugguguggaucucucaucgggcuaacggcaagggcgaccugggcuacgaacauacaggucgccaucaaccagguacggagacugaucggaaaugagaacuaucucgacuacaugaccagcaugaagcgcuucaagaacgaauccgacucggaaggggcucucugguaa

SEQ ID NO: 23993 - RNA, 9879 nt, Artificial Sequence
  derived and/or modified CDS sequence (opt11) from DENV-1__KJ189362__SS-prME
ucggucacaaugcuccucaugcugcuucccaccgcguuggcguuucaccugacgacccggggcggggaaccccacaugaucguaagcaaacaggaacgggguaaaagccuucuguucaagaccagcgcgggggugaauaugugcacgcugaucgcaauggaccugggcgaacugugcgaggacaccaugaccuacaaaugccccagaaucacagaggccgagcccgacgacguggacugcugguguaacgccaccgacacuuggguuaccuaugguaccugcagucagaccggcgagcaccggcgggaaaagagauccgucgcccuggcgccccacgugggucugggucucgagacccgcaccgagaccuggaugagcagugagggggccuggaagcaaauccagcggguugaaaccugggcgcugcgccauccaggguucacgguaaucgcguucuuccuggcgcacgccaucggcacgagcaucacucagaaagggaucauuuucauacuguugaugcuggugacccccuccauggccaugcgcugcgucggcaucggcaaucgugacuucguagagggccucagcggcgccacguggguggacgucguacuggagcacgggaguugcgugaccacaauggcgaagaacaagccaacgcuugacauugaauugcugaaaacggaggucaccaaccccgcgguauugcgaaagcucugcaucgaagccaagaucagcaauaccaccacggacucccgaugcccgacucagggggaggccacuuuggucgaggagcaagacgccaacuucgucugccgacgcacccugguagaccgcggcugggggaaugggugcggucuguuuggcaaggggucuuugcuaacuugugcuaaguuuaagugcgugacgaaauuggaggguaagaucguccaguaugaaaaccugaaguacuccgugauagugaccguccacaccggggaccagcaccaaguggguaacgagacuaccgagcacggcaccauagcgacgaucacgccccaggcacccacuagcgagauccagcugaccgacuauggggcacucacccuggacugcagcccucgcaccggcuuagacuucaacgagaugguccucuugacgaugaaggagaagaguuggcugguacacaagcagugguuccucgaucugccuuuacccuggaccucuggggcaagcacgagccaagagaccuggaaccggcaggaccuccuggucaccuucaagaccgcccacgcaaagaagcaggaggucgugguguugggcagucaggagggggccaugcauacagcccucaccggggcgacugagauccagacuucaggcaccaccacgauauuugccgggcaccugaagugucgccuuaagauggauaagcucacccuaaagggcauguccuacgucauguguacagggagcuucaagcuggagaaggagguggcggagacccagcacgggaccgugcuugugcagguuaaguaugagggcaccgacgcccccugcaaaauccccuucucuacccaggaugagaagggcaugacccagaauggcaggcuuaucacggccaaccccaucgugaccgacaaggaaaagcccgucaacaucgagaccgagccgcccuucggcgaaagcuacaucgugguaggcgccggcgagaaggcgcugaagcuguccugguucaagcgcgggucuucgaucggcaagauguucgaggcaaccgcacgaggugcacgcaggauggccauacucggagacacugcgugggauuucgggagcauuggcggaguauucaccuccguugggaagcuggugcaucagaucuuugguaccgcuuacggggugcuguucagcggcguguccuggaccaugaagaucgguaucgguauccuccucacguggcuuggcuuaaacagcaggagcaccucucuauccaugacaugcaucgccguggggauggucaccuuauaccucgggguuauggugcaggcugauagcgggugugucaucaacuggaaaggccgagaacuuaagugcggcuccggcaucuuugugacgaacgaggugcacaccuggaccgaacaguacaaguuccaggcugacagcccuaagcggcugagcgccgccauaggcaaggcaugggaggaggggguaugcggcauccgcucggccaccagacucgaaaacaucauguggaagcaaaucagcaacgagcugaaccacauccuacucgagaacgacaugaaguucaccguuguggucggggacgccaacggcauauuggcccaggggaaaaagaugauccgcccccagcccauggagcacaaguacagcuggaaguccuggggcaaggccaaaaucaucggagccgacauucaaaacacgaccuucauaaucgacggacccgacacgccagagugucccgauggccaacgggccuggaacaucugggagguggaggacuacggauucgguguguucaccacgaauaucuggcugaagcuccgugacuccuauacucagaugugcgaccaccgguugaugucagcggccaucaaggacuccaaagccguccacgccgacaugggauauuggaucgagagcgagaaaaacgagaccuggaagcuggcuagggcgucauucaucgaagugaagaccuguacauggcccaagagccacacccucugguccaacggggugcuggagagcgagaugaucaucccaaagaucuacggcgggccgaucucccagcauaacuaccgucccggguacuucacccagacugccgggcccuggcacuuaggcaaacucgagcuugacuucgaucugugcgaaggcacaaccgucgugguggacgaacauugcgggaaccgcgguccgagccuccguaccaccacggugacgggaaaaaucauacacgaguggugcugcagauccuguacucugccgcccuugcguuuccgcggcgaggacgggugcugguauggcauggagauuagacccgugaaggagaaggaggagaaccucguacgcagcauggucuccgcaggcagcggggagguggacucguucucccuggggauauuauguguaagcauuaugaucgaggaggucaugcggucccgcuggagccgcaaaaugcucaugacugggacgcuggccguguuccugcugcugaucaugggacagcugaccuggaacgaccugauccggcucuguaucauggugggugcaaaugcauccgaccguaugggcaugggcacaacuuaccuggcauugauggcgacguucaagaugcgcccgauguucgcgguagggcuauuguuccgacgguuaaccagccgcgagguucuguuacuaacaaucggccugucccuaguggccucggucgagcugcccaacuccuuagaggaacugggcgacgguuuggcgaugggcaucaugaugcugaagcugcucacggaguuccaaccccaccagcucuggacgacacugcucagccugacuuucguacggacgacucugucccuugacuacgccuggaagaccaccgccauggcguugagcaucgucucacuguucccccugugccuaucuaccacgucgcagaagaccaccugguuaccggugcuccugggcagcuucggcugcaagccccugaccauguuccucaucacugagaacaagaucuggggacgcaaguccuggccccugaacgagggcaucauggcgaucgggaucgugagcauucuucucaguagccuccucaagaacgacgucccccucgccggcccguugaucgccggcgggaugcugauagccugcuaugucaucucgggguccagcgcagaccuuucccuggagaaggcugcugaagucuccugggaacaagaggccgagcacuccggcgcuucucacuccauccugguggaggugcaggaugacggcacuaugaagauaaaagacgaagaacgggacgacacccucaccauccuucuaaaagccacccuccuggccguguccggcguguacccaauguccauacccgcuacgcuuuucgugugguacuuuuggcagaagaagaagcaacgcucaggcgugcucugggacacccccuccccgcccgagguugagcgggccgugcuagacaaugguauauaccggauccugcagcggggguuguugggccgcucccaaguugggguaggcguguuccaggacgguguguuccauacaauguggcacgucacccggggcgccguguuaauguaccaggguaaacgcuuagagccguccugggccagugugaagaaggaccucaucuccuaugggggaggcuggagguuucaaggguccuggaauacgggggaggagguccaagugaucgcgguggagcccggaaagaacccgaaaaacguccaaacgacucccggcaccuucaaaacgcccgagggggaagugggcgccaucgcguuagacuucaagcccggcaccuccgguagcccgaucguaaaccgugaaggcaagaucgucggucuguacggcaauggggucgugacuacguccgggaccuacgucucugccaucgcccaggccaaggccagccaagaggggccgcucccugaaaucgaggacgagguguucaagaagcggaaccugacuaucauggaucugcacccgggcuccgggaagacccggagauaccucccggccauuguccgugaggccaucaagcgcaaacuacggacccugauucucgcgcccacgcgcgucguggccucggagauggccgaagcccuaaaagggaugcccauccgguaccaaaccaccgccgucaagucggaacauacuggccgugagauagucgaccugaugugucacgcgaccuucacuaugaggcugcugucaccggugagagugcccaacuacaacaugaucauaauggaugaggcucacuucaccgauccagccucuaucgccgcacgggguuacauaagcacacgcguaggcaugggagaagcggccgccaucuucaugacugcuacgccgcccggauccguggaggccuucccccagagcaaugcggugauccaggacgaggagcgggacaucccagaacgcuccuggaauagcggcuacgacuggaucacugacuuuccuggcaaaaccgucugguucgugccuuccaucaaaagcggcaacgacauugccaacugccuucggaaaaacgggaagagagugauacagcucucccgaaagacguucgacaccgaguaccaaaagaccaagaacaaugauugggauuaugucgugacaacggacauuucggagaugggagccaacuuccgcgccgaucgggucaucgacccccgccggugcuuaaagcccguuauacugaaggacgggccggagagagugauccucgcggggccgaugcccgugaccgcugcaucugcggcccagcggcgcggccgcaucggacguaaccaaaauaaagaaggagaccaguacgucuacauggggcagccccuaaacaaugaugaagaccacgcgcacuggaccgaggccaagaugcuguuagacaacaucaacacccccgaaggaaucaucccagcccuguucgagcccgagcgcgaaaaguccgccgccauugauggggaguaccggcugcgcggcgaggcgcggaagaccuuuguggaacucaugcgacggggagaccugcccgucuggcuauccuacaaaguagccagcgaaggcuuucaguauucggaccgccgguggugcuucgacggcgagcgcaacaaccaggugcucgaggaaaacauggacguugagaucuggaccaaggagggugagcggaagaaauuacguccucgguggcuggacgccagaacuuauagcgacccgcucgcgcugagagaguucaaggaguucgcagcuggacgccggucgguguccggggaccugauccucgaaaucgguaaguugccgcagcaccuaacucuacgcgcacagaaugcccucgauaaccuggugaugcuacacaacuccgagcagggcgggaaggcauaccggcacgcgauggaggagcugcccgacaccaucgagacacugaugcuccuggccuuaaucgccgugcucacgggcggggugacccuguucuuucuguccggcaagggccuggggaagacgucaauuggcuuacugugcgugacugccuccucuguacuccuguggauggccagcguugagccgcacuggauugcggccagcaucauccuggaguucuucuugauggugcuacugauaccggagccggacaggcagcggacgccccaagacaaccaguuggccuacgucgucaucgguuuauuauuuaugauccuuaccguagccgcaaacgagaugggccugcuggaaacaacuaagaaagacuuagggaucggcuacguagcagccgaaaaucaccaacacgccacuaugcuggacgucgaucuacacccugccucagccuggacccucuaugcgguggcuacgacggucaucacucccaugaugcgccacaccaucgaaaauaccacggccaacaucagccugaccgccauugccaaccaggccgccauucugaugggcuuagacaaaggguggccuaucuccaagauggauaucggcgugccccugcuagcccuggggugcuauagccaagugaauccgcuuacccucacagccgccguucucaugcugguggcgcacuacgcaaucaucggccccggcuugcaggccaaggccacgcgcgaggcgcagaagcggaccgccgcgggcaucaugaagaaccccaccguggacgguaucgucgccaucgaccucgaccccgugguauacgacgcaaaguucgagaagcaguuggggcagauuaugcuguugaucuugugcaccucccaaauacugcucaugcgcacgacuugggcguuaugcgagucuauuacccucgccaccggcccgcucacgacccuaugggaaggguccccagguaaguucuggaacaccaccaucgccguuagcauggcuaacauauuccgaggcagcuaccuggcaggggcgggucucgcuuucucacucaugaaaagccuggguggagggcgccgggggacgggcgcucagggggagacgcucggcgagaaauggaagcgccaacugaaucagcugagcaagucagaguuuaauaccuacaaacgguccgggauaauggaggucgaccggucggaggccaaggaaggacucaaacguggggagacaacuaagcaugcuguuagccguggcacagccaaguugcggugguucgucgagcgcaaccuggugaaaccagaggggaaggugaucgaucucggguguggccgcggcggguggucuuacuacugugcugggcucaagaaagucacggaggucaagggcuacacgaaaggcgggccgggucaugaggagccgaucccuauggccaccuauggguggaaccucgugaagcuacauuccggaaaagacgucuucuucaugccgccggagaagugcgacacgcuccugugugauaucggggagagcuccccaaaccccaccaucgaggagggacgcacgcuacggguccugaagaugguggaacccuggcuucgagguaaccaguucugcauuaagauccugaaccccuauaugccgagcguaguugagacacuugaacguaugcaacgcaagcaugggggcaugcuugugcguaaucccuugaguagaaauagcacgcacgagauguacugggucuccugcggaacgggcaacauaguaucagccguaaacaugaccucccguauguugcugaaccgguucaccauggcgcaucgcaagccuacguacgagcgagacgucgaccucggcgccggaacccgccacgucgccguggaacccgaggucgccaacuuggacaucaucggccagcggaucgagaauauuaaaaacgagcacaagagcaccuggcacuacgacgaggacaacccguacaaaaccugggcguaccacgggagcuacgaaguuaagcccucuggcuccgccagcuccauggugaacggugucgugcgccugcuaacgaaacccugggacgucauuccaauggugacccaaaucgccaugaccgacacuacgccguuuggccaacagcggguguucaaggagaaggucgauacacgcacgccccgggccaagcgcggcaccacgcaaaucauggaagugaccgccaaguggcuuuggggguuccugagccggaauaagaaaccucgcauaugcacgagggaagaguucacccgcaaggugcgcucaaacgccgcgaucggggccgucuucguggacgagaaccaguggaacuccgcgaaagaagccguggaagacgagcgcuucugggaccugguccaccgggagagggagcuacacaagcaagggaagugcgcaacgugcguguacaacaugauggguaaacgggagaaaaagcugggggaguucggcaaggcaaaggggagucgugccaucugguacaugugguugggagccagguuccucgaguucgaggccuugggcuucaugaacgaggaccacugguucucccgcgaaaacagccuguccgggguggagggcgaaggguuacauaaacugggcuacauucugcgcgacaucagcaagaucccgggcgggaacauguacgccgacgacaccgcgggcugggacacccgggucacggaagacgaucuccaaaacgaggccaaaauuacugauaucauggagccggagcacgcucugcuggccacguccaucuucaagcugacguaccagaauaagguugugcgcguccaacggccagcgaagaacggcaccgugauggacgugauaagccgcagagaccagcgugguuccggccaggucgggaccuacggccugaacacuuucacaaacauggaggugcagcugauucgacagauggagagcgaggggauauuccucccauccgagcuagaaaccccgaaccuggccgagcgagcccucgacuggcucgagaaacacggcgccgagcgauuaaagcgcauggccaucuccggggacgauugcguggucaagccgaucgacgaucgguucgcgacggcucuaaccgcccugaacgacauggguaagguccgcaaggacaucccgcagugggagcccuccaagggcuggaaugacuggcaacaagucccguucugcagccaccauuuccaccagcuaaucaugaaggacggccgggagaucgucgugcccugccgaaaccaagaugagcucgugggccgggcccgcgucucccagggggccggcuggucguuacgcgagacggcuugccugggaaaguccuaugcacaaauguggcaacucauguacuuccaucgccgggaccuacgccuggcugccaacgccauaugcucggccgugcccguggauuggguccccacaagucggaccacgugguccauccacgcccaccaccaguggaugaccacggaagauaugcucagcguguggaaccggguauggauugaggagaacccguggauggaaaacaagacccacgucuccagcugggaggaggugcccuaccuuggcaagcgcgaggaccagugguguggcucccugaucgggcucaccgcccgggccaccugggcgaccaacauccagguggccauuaaccagguccgcagacugaucggcaacgagaacuaccuggacuacaugaccagcaugaaacgcuuuaaaaacgaauccgacucugagggggcucucugguag

SEQ ID NO: 23994 - RNA, 9879 nt, Artificial Sequence
  derived and/or modified CDS sequence (opt11) from DENV-1__KJ189363__SS-prME
uccgugacuaugcugcuaaugcuauuaccgacugcgcuugcguuccaccuaaccacgcggggaggcgaaccccauaugauaguauccaagcaggaacgcggcaaaagucucuuguucaaaaccucagcaggcgugaacaugugcacccuaauugcaauggaccuaggugaacucugcgaagauaccaugacguacaaauguccgcgcauaacggaagccgaaccugaugacguugauuguuggugcaacgccaccgauaccugggugacguacgguacgugcagucagacgggagaacaccgacgcgaaaagaggaguguagcccuggcaccccacguuggccugggccucgaaacacgaacagagacguggaugagcagcgaaggcgcauggaaacaaauacagcggguagagacgugggcguuacgacacccaggcuucaugguuauugcauuuuuccuagcgcacgcgauugggaccucaauaacgcaaaaagguauuaucuuuauccuguugaugcuaguaacuccaaguauggccaugcguugugucgguaucggaaaucgcgacuuugucgaaggacuaagcggggccacauggguagacgugguacucgaacauggaagcugcgugacgacaauggcaaagaacaaacccacacuagacaucgagcugcuuaaaaccgaggucacgaacccagccguccuacgcaagcucugcaucgaagcaaaaauaaguaauaccaccaccgacagccgcuguccaacccaaggggaagcaacauuaguagaagaacaggacgcaaacuucguaugccguaggaccuucgucgacagaggaugggggaauggcugcggacuuuuugggaaaggaucacugcucacaugcgcaaaauucaagugugugacaaaacuagaggggaaaaucguucaauacgaaaaucugaaauacuccgugauugugacuguucauacaggcgaucagcaccaaguaggcaacgagacgacagagcacgggacuauagcuaccaucacaccucaagcccccacgucagaaauacagcuaacugauuacggagcgcugacauuagacugcagcccgcggacaggauuggauuuuaacgaaauggugcuccuaacaaugaaggagaaaagcuggcuaguccacaaacaaugguuucuggaccugcccuugcccuggacgucaggcgccagcacgucacaagaaacauggaaccgccaagaccuccuagucaccuucaaaaccgcacacgcaaagaaacaggagguaguaguacucggaagucaggaaggggcaaugcacaccgcauugacgggcgccacggaaauccaaaccaguggaaccaccaccauuuucgcaggacaccugaaaugccgcuugaagauggacaagcucacccuaaagggaaugucauauguaauguguacugggucauucaaauuagaaaaagaaguagcggaaacgcaacacgguaccguacucguacagguaaaauaugaagguacugacgcgccuuguaagauuccuuuuaguacccaagaugagaagggagugacccaaaauggucgucuaaucaccgcgaacccaauagucacagacaaggagaaaccgguaaacaucgaaaccgaaccacccuucggcgagagcuacaucguagucggagcaggcgagaaagcccucaaacuaagcugguuuaagagggggagcucuauuggcaagauguucgaagcgacggcucggggcgcgcgccgaauggccauucucggugacacagcgugggacuucggcagcauaggcggaguauuuacaagcguagggaagcuaguccaucaaauauuuggaacagcguacgggguacuauuuaguggagugagcuggacaaugaaaauaggcauuggaauccucuugacguggcucggccugaacucgagaaguacaagucuaagcaugacuugcauugccgucggcaugguaaccuuguauuuaggcgucaugguacaggcagauuccggaugcgugaucaauuggaaggggagagaacuaaaguguggauccgguauuuuugugacaaaugaggugcacacauggacagaacaguacaaauuccaagcggacucaccaaaaagguuaucagcagcaauaggaaaggccugggaggaaggaguaugcggcauccgaagcgccacacgacuggaaaauauaauguggaagcagauaucuaacgaacugaaucacauacuacuggaaaaugauaugaaauuuaccguuguaguaggcgacgcuaacgguauccuagcccagggcaagaaaaugauaaggccgcaaccgauggagcacaaauauagcuggaaauccuggggaaaagcuaagaucaucggcgcagacauacagaacacuacauucaucauagacggaccggacacgcccgaaugcccagacggucaacgagccuggaacauaugggaaguagaagacuacggcuucggcguauuuacaacaaauaucuggcucaaacuacgcgacucguacacccaaaugugcgaccauagacuuaugagugcagcaauaaaagacucaaaagcugugcacgcagauaugggguacuggauagagucugagaaaaacgaaacauggaagcuagcacgagcuucauucauagagguaaagacgugcacguggccgaaaucacacacucuguggagcaacgggguacuggaauccgaaaugaucauuccaaaaauauaugggggccccauaucgcagcauaacuacagaccgggcuacuuuacacaaacugcaggaccguggcaccugggcaaauuggaauuagacuuugaccuaugcgagggaacaacgguggucguagacgaacauugcggaaaccggggaccaagccugcggacaacaacaguuacaggaaaaauaauacacgaauggugcugcaggagcugcacacuaccgccuuuacgauucagaggggaagacgggugcugguacggaauggaaauccgcccagugaaggagaaagaggagaaccuagugcgcucuaugguaagcgcaggaagcggugaaguagacagcuucagccucggcaucuuaugcguuuccaucaugauagaagaggugaugaggagccgcuggucucgcaagaugcucaugacagggacacuagccguauuucuacuucucaucauggggcaacuuacguggaacgaucucauccggcucugcaucaugguuggggccaacgcgucagaccgcauggguaugggcacaacguaccuggcccuaauggccacguucaaaaugcgaccaauguuugccgucggucuucucuucagacgucucaccuccagagagguguugcuacugacaaucggccugucucugguagcaagcguagagcuacccaauagucucgaagaauuaggagauggccucgcgaugggcaucaugaugcugaaauuacucacggaauuucagccucaccaacuuuggacaacccuccuaucccugacauucguaaaaaccacacucucccuagauuacgccuggaaaacgacagcaauggcacuuuccaucguauccuuguucccucuguguuuaucaaccacaucucaaaagacaaccugguuacccgucuuacucggcucguucggaugcaaaccccucacgauguuccuaauuacggagaacaagaucuggggccgaaagagcuggccucuuaacgaggguauaauggcuauuggcauaguauccauccugcugaguagccuacugaaaaaugaugucccacucgcaggcccuuuaaucgcuggagggaugcugauagcgugcuaugugauuuccggaaguucagcagaccuuagccuagaaaaagcagcggaaguaagcugggagcaagaagccgaacauucaggggcaucccacagcauucucguagaggugcaagaugacggaacaaugaaaaucaaagacgaggaacgugacgauacgcugacaauacuacuaaaggcgacacuauuggcuguaagcggcguguauccaaugagcauucccgcaacucucuuugugugguauuucuggcaaaagaaaaagcagcggagcgggguucugugggacacccccucgccacccgaaguagagagggcgguacuagacaacggcauuuacaggauucuacaacguggcuugcucggacggucucaggugggaguaggcguauuccaagacgguguauuccacaccauguggcacguuacccgcggcgccguccugauguaccagggcaagcgccuagaaccaagcugggcgucugugaagaaggaccuaaucagcuacggcgggggauggagguuccaaggaucguggaauacgggagaagagguccagguaauagcuguagaaccagggaaaaacccaaagaacguccagacaacccccggcacauuuaaaacacccgagggagaaguaggggcgauagcccucgacuucaaaccagggaccucaggcucaccuauugugaacagagagggaaaaauagugggacucuauggaaacggcguagugaccacuuccgguacguacguaucggcaauugcacaggcgaaagcgagucaagaagguccacugccagaaauagaggacgaaguguucaagaaaagaaacuuaacgauaauggacuuacacccgggaucagggaaaacaagaagauaccucccagccaucgucagagaagcgauaaaacggaagcuccggacccugauacuagcucccacacggguuguagccucugaaauggccgaggcauuaaaggggaugccaauucgcuaccagacuacggcggugaaaagcgaacacacaggacgugagaucgucgaucucaugugccacgcuacguucacuaugcgccuccuaucgccgguccgcguacccaacuacaauaugaucaucauggaugaagcacauuucacggacccugcauccauagcagcacgcggauacauaagcacuagaguaggcaugggagaggcagcagcaaucuuuaugacggcaaccccgccggggucgguggaagccuucccgcaaagcaacgcagugauacaggaugaggagagagacaucccggagagaagcuggaacagcggguacgacuggaucaccgacuuccccgggaagaccgugugguucgucccuagcaucaaauccggcaacgacaucgccaacugccuuaggaaaaacggaaagcgagugauacaacuaucccgcaagacguucgacaccgaauaccaaaagaccaaaaacaaugacugggacuauguagugacuacugacauaagcgaaaugggugccaacuuccgggcggauagagucauugauccucgccgaugccuaaaaccgguaauccuaaaagacgggccagaaaggguuauccuagcaggaccaaugcccguuacagcugcaagcgcugcacagagacggggccggauuggucgaaaccaaaacaaagagggcgaucaguauguguauauggggcaacccuuaaacaaugacgaagaucacgcacacuggacggaggcgaagauguugcuggauaacaucaacacgccggagggaauaauaccagcacucuuugaacccgaacgcgagaaaagcgccgcuauagacggggaauaucgacuacggggagaagcgagaaagacauucguagaacuaaugagacguggcgaccugcccguauggcuguccuacaaagucgcaagcgaaggauuucaguacuccgacagaagauggugcuucgauggagaacgaaauaaccaagugcuagaggaaaacauggacgucgaaauauggacgaaagagggcgaaaggaaaaagcucaggccaagauggcuugacgcccgaacguauucggacccgcuagcacugcgagaguuuaaggaguucgcggcgggacgccgcagcguaagcggcgacuugauacucgaaauaggcaaauugccucaacaucugacacugagggcccaaaacgcguuagauaaccuugucaugcugcacaacuccgaacaagguggaaaggccuacagacacgcaauggaagaacuaccagacacaaucgaaacccuaaugcuccuagcacuaauugccguccuaacaggcggaguaacucuguucuuccugaguggcaagggacuugguaaaacaagcaucggauuauugugcguaaccgccucaagugcccuauuauggauggccagugucgagccgcacuggauugcggcgaguaucaucuuggaguucuucuuaaugguguugcuaauaccagagccagaccgccagagaacaccgcaagauaaccagcuggcauacgugguuaucggguuacucuuuaugauucucacaguggcagcaaacgaaaugggccugcuugaaacgacaaagaaagaccucgggauaggauaugucgcggcagagaaucaccaacaugcgacaaugcucgacgucgaccuccacccagcuagcgccuggacccuauacgcuguggccacuacaguaauaacaccaaugaugaggcacacgaucgaaaacacuacagccaacauaucguuaacagcaaucgccaaucaggcagcaauucucaugggccuagauaaaggauggccaauaucgaaaauggacaucgggguuccacuuuuggcgcuugguugcuacagucaagucaauccccucacacuaaccgccgccguauugaugcuaguggcccacuacgcaaucauaggcccagggcugcaagcaaaggccacgcgcgaagcccaaaagcgaacggcugcgggcaucaugaagaacccgacaguagacggaauaguggcaauagaccucgacccaguagucuacgacgcaaaauucgagaaacaacucgggcaaauaaugcugcugauccucugcacgucgcaaauauugcuaaugagaacaacaugggcacuaugugaaucaaucacccucgccacaggaccgcucacgacguuaugggagggaucacccggcaaauucuggaacacuaccauagcaguaucgauggcaaacaucuucagggggucauaccucgccggugcagggcuagcuuucagccucaugaaaucucucggagguggccguagggggacaggcgcacaaggggaaacauuaggcgagaaauggaagcgacaacugaaccaacuaucaaaauccgaguucaacacguauaaacggagugguaucauggagguugacagaagugaggcaaaagaaggccuuaagcggggcgagacaaccaaacacgccguaagccggggaaccgcgaagcugcggugguuuguugagcguaaccucgugaaaccggaagguaaagugaucgacuugggaugcggaaggggcggauggucguacuacugcgcaggcuugaagaaagucaccgagguuaaggguuacacgaaagggggaccaggccacgaagaaccaaucccaauggcgaccuauggcuggaaccuaguaaaacuccacagcggcaaagacguauucuucaugcccccugaaaagugcgacacccuacuaugcgauauuggggagucaucaccgaaccccacgaucgaggagggccgaacacuaagggucuugaagaugguugaaccuuggcuucgaggcaaccaguucugcauaaagauacuaaacccguacaugccgucgguugucgaaacuuuagagaggaugcaacgaaaacauggaggcaugcugguccgaaauccacuuucucggaacucgacacaugagauguacuggguuagcugugguaccggaaauauaguaucugccguaaacaugacaagcagaauguugcuuaaccgcuucaccauggcccaccgaaagccaacguacgagagagacgucgauuuaggcgcaggaacucggcacguggcaguagaacccgaagucgcgaaucuggacauuaucggucagcgaauugagaacaucaaaaacgagcacaaguccacguggcacuacgacgaagacaaccccuacaaaaccugggcuuaccauggaaguuacgagguaaaaccuucaggcucggccagcagcauggucaacgggguggugaggcuacuaaccaaaccgugggaugucaucccaauggugacccaaaucgcgaugacggauacaacuccguucgggcagcaacgcguauucaaagagaaagucgacacacgaacgccgcgcgcaaagcgcggaacaacacaaauaauggagguaaccgccaaaugguuguggggguuccucagucgaaacaagaaaccgcgcauauguacacgagaggaguucacgaggaagguaagaagcaacgccgcaauaggcgcgguguucguagaugaaaaccaauggaauagcgcaaaggaagccguggaagacgagagauucugggaucuugugcaccgggagagagaacugcacaagcagggaaaaugugcgaccugcguguacaacaugauggggaagcgcgaaaagaagcucggagaguucggaaaagccaaaggaucgagggcaauaugguacauguggcuaggcgccagauuucucgaguucgaggcguugggcuucaugaacgaagaccacugguuuucccgagagaacucucucucgggcguggaaggagagggccuccacaaacuuggauacaucuugagggacauaagcaaaaucccaggaggaaacauguacgcggacgauacggccggaugggauaccagagucacagaggaugaccugcagaacgaggcgaaaauaacggacaucauggagcccgagcaugcccuacuugcaaccuccaucuucaaacugacauaccaaaauaagguaguccgcguucaacgccccgccaaaaacgggacgguaauggacgucaucagccgcagagaucagcgaggaagcgggcaagucgguaccuacggauugaacacguuuacuaacauggagguacaguugaucagacaaauggaaucagaggggauauuccucccgagcgaacucgagacacccaaccucgccgaacgggcacuggacuggcuagagaaacauggggcggagcgccugaaacgaauggcgauuucgggcgaugacuguguggucaaaccaaucgacgaccgguucgccacagcacugacagcacugaacgacaugggaaaagugagaaaagacaucccacagugggagcccagcaagggauggaacgacuggcagcagguaccauuuugcucucaucacuuccaccagcucaucaugaaggauggccgggaaauaguaguucccugccgaaaccaagacgagcucgucggccgcgcaagaguaucacagggugcaggauggagccugcgagagacugcgugucuagggaaaucuuaugcacaaauguggcaacuaauguacuuccaucgacgagaccuccgccuagcagccaacgcaauuugcagcgcaguacccguagacugggugcccacaagccgaacgacaugguccauacacgcucaucaccaauggaugacgaccgaagauaugcucagcguuuggaacaggguguggauagaagagaacccauggauggaaaacaaaacucacgucucgagcugggaagaagucccguaucuagguaagcgagaggaccaguggugcggcuccuuaaucggacugacggcgagagcgacuugggcuaccaacauccaaguagcuauaaaccaagugcggagacugaucggcaacgaaaauuaccuagacuacaugacgucaaugaaacguuucaaaaacgagagcgacagcgaaggcgcccuaugguag

SEQ ID NO: 23995 - RNA, 9879 nt, Artificial Sequence
  derived and/or modified CDS sequence (opt11) from DENV-1__KJ189364__SS-prME
agcguuacuaugcucuuaaugcugcugcccaccgcacucgccuuccaccugacuacccggggcggggagccacacaugaucgugagcaagcaggagcgggguaagucccucuuauucaagaccagcgcaggggugaacaugugcacccugaucgccauggaccugggcgagcucugcgaggacaccaugacauacaagugcccccgcaucacggaggccgagcccgacgacguggacugcuggugcaacgcaaccgauacuugggugaccuacgggaccugcucgcagaccggggagcaccggcgggagaaacgguccguggcccuugcgccccacgugggccuggggcucgagacacgcacagagacauggaugucuuccgagggcgcauggaagcagauccagcggguggagaccugggcccugcgccaccccggguucacuguuaucgccuucuuccuggcacacgccaucggcaccaguauuacccagaaggggaucauuuucauccuccugaugcugguaacccccaguauggccaugcggugcgucgggaucggcaaucgugacuucguagagggacuuagcggggccacguggguggacgucguucuugagcauggguccugcguaaccaccauggccaagaacaagcccacccucgacaucgagcuccugaagaccgaagucaccaacccagccgugcugcggaagcucugcaucgaggccaagauaagcaacacgaccacggacagccgcugcccgacccagggcgaggccacccugguggaggagcaggaugccaacuucgucugcaggcgcaccuucgucgaccgggggugggggaacggcugcgggcuguuuggcaaggggucgcucuuaacgugcgccaaguuuaaaugugugacgaaacuugagggcaagaucguccaguacgagaaccucaaguacuccgucaucgugaccguccacaccggagaccagcaccagguggggaacgaaacgacugagcauggcaccaucgcgacgaucacgccgcaggcccccacgucggagauccaguugaccgacuacggggccuugacccucgacuguuccccgcgcacuggccuagacuucaaugaaaugguccuucucacgaugaaagaaaagagcuggcuagugcacaaacagugguuccucgaucucccucugccguggaccuccggugccagcaccagccaggagaccuggaaccggcaggaccugcucgugacguuuaagaccgcccaugcgaagaagcaggaggucguggugcugggcucccaggagggcgccaugcacacggcgcugacuggcgccacagagauccagacgagcgguaccaccacgauauucgcagggcaucucaagugccguuuaaagauggacaagcugacccucaaagggaugagcuacguuaugugcaccgggagcuucaaguuagagaaggagguugcggaaacccagcacggcacaguguugguccaaguuaaauacgagggcaccgacgcuccgugcaaaauccccuucuccacccaggacgaaaaggguaugacccagaacggccggcugaucaccgcuaacccgauagucaccgauaaggagaagcccgucaacaucgagaccgagccgccauucggggaaagcuacauagucgugggcgcuggcgagaaggcgcucaaguuauccugguucaagagggggagcuccaucggcaaaauguucgaggccaccgcccgcggagcccgccgcauggccauucugggcgacacggcgugggacuucgggagcaucggcggggucuucaccuccguugguaagcucgugcaccagaucuucgggaccgcguacgggguacuauucagcggcguauccuggaccaugaagaucggaaucggcauccugcucacguggcugggccugaacagccgguccaccagccucuccaugacauguaucgccgucgggauggucacgcuauaccugggagugauggugcaggccgacagcgguugcguuauaaacuggaagggcagggagcucaaaugcgggagcgguaucuucguaacgaacgagguacauaccuggaccgagcaguacaaguuccaagccgacucgccaaagcggcugucggcggcgauaggcaaggccugggaggaaggagucuguggcauccgauccgcuacccggcucgaaaauauuauguggaaacagaucagcaaugaacucaaucacauccugcuagagaaugacaugaaguucaccguuguggucggggacgccaauggcauucucgcucaggggaagaaaaugauccgcccccaaccuauggagcacaaguacuccuggaagucuugggguaaagccaagaucauuggagcggacauacagaacacaaccuucauuaucgacgggcccgacaccccagagugcccggacggccagagagcauggaauaucugggaaguggaggacuacggguucggcguguuuacaacgaacaucuggcugaagcugcgggacuccuacacccagaugugcgaccaccgccucaugucggcagccaucaaagacuccaaggccguccacgccgacaugggcuacuggaucgagagcgagaagaacgagaccuggaagcuggcacgcgcgucuuucaucgaggugaagaccugcacguggccuaagagccacacccugugguccaacggggugcucgagagcgagaugauaaucccaaagaucuacggcgggccgaucucucagcacaacuaucgacccggcuauuucacccagaccgcugggccguggcaucucggcaagcuggagcucgacuucgaccugugcgagggcacgaccgucgugguggacgagcacugcgggaaccgcggcccaucucugcggaccaccacggucacgggcaagaucauccacgaauggugcugccgauccugcacuuuaccaccgcugcgguuccguggcgaggacgggugcugguacgggauggagauccggccagucaaggagaaggaggagaaccugguacgcaguauggugagugccgggagcggggagguggacagcuucuccuuggggauccucugcgugagcaucaugaucgaggaggucaugcgaucccgauggagccgcaagaugcugaugaccgggacguuggccguguuccuguugcucaucaugggccagcuuaccuggaacgaccugauccgacucugcaucauggugggggccaacgccuccgacagaaugggcaugggcacaacauaucuggcccuaauggcuacguuuaagaugcggccgauguucgccgucgggcuccucuucagacgacuaaccagccgcgaggugcuccugcugaccauaggucucucccugguggcuagcgucgagcuacccaacucccucgaggaacugggagauggacuggcgaugggcaucaugaugcugaagcugcugacggaguuccagccccaccaacucuggacgacccugcugagucucaccuucgugcggacgacauuaucccuggacuacgccuggaagaccaccgccauggcccucagcaucguaucccuguucccccugugucuaagcaccacuucucaaaagacuaccuggcugccggugcuguuagggagcuucgggugcaagccccugaccauguucuuaaucaccgagaacaagaucuggggacgcaagagcuggccucucaacgagggcaucauggccaucggaaucgugagcauucugcuuagcucgcugcugaagaacgacguccccuuagccggcccccucaucgccggcgggaugcugaucgcaugcuacgucaucucgggcuccagcgccgaccuaucacucgaaaaggcggccgaaguaagcugggagcaggaggccgagcauucuggggccagccacucgauccuggucgaggugcaggacgauggcaccaugaagaucaaggacgaggaacgugaugacacccugaccaucuuacugaaggccaccuuacucgcggugagcggggucuaucccauguccaucccugccacucuguucgugugguacuucuggcagaagaagaaacagaggagcggggugcugugggacaccccuuccccacccgaagucgaacgugcaguucucgacaacggcaucuaucgcauccugcagcgggguuugcucggccgcucgcaaguaggagucggcgucuuccaggacggagucuuccacaccauguggcacgucacucggggagccgugcucauguaccaaggcaagcgccuggaacccagcugggccagcgugaagaaagaccugaucuccuaugggggagguuggcguuuccagggcagcuggaacacgggggaggaaguacaggugaucgcgguugaaccgggcaagaacccgaagaacguccagacgacccccggcaccuucaaaacgcccgagggggaagucggcgcgauugcucucgauuucaagcccgguaccagcggcagcccgauagugaaccgcgaaggaaaaaucgucgggcuguauggcaacggggugguuaccaccuccggcacuuacgucagcgccaucgcccaggcgaaagccucucaggaggguccccugccggaaauugaggacgagguguuuaaaaagcgaaaccucaccaucauggaccugcacccgggguccggcaaaacccgccgguaccugccggccaucgugcgcgaggcuaucaagcgaaagcuccggacccugauucuggcgcccacgcgcgucguggccagcgagauggccgaggcccuaaaggguaugcccauccgcuaccaaaccacugccgugaaauccgagcacaccgggcgagaaaucgucgaccuaaugugucaugcgacguucaccaugcggcuucuaaguccggugcgcgugcccaacuacaacaugaucaucauggacgaggcccacuucaccgaccccgcauccaucgccgccagaggcuacaucagcacucgcgucggcaugggggaagcggccgccaucuucaugacggcaacgccgcccggcuccguggaggcguucccccagagcaacgcggugauccaggacgaggagcgggacaucccagagcgcuccuggaacucuggcuacgacuggaucaccgacuuucccgggaagacagucugguuugugccgaguauuaagagcggcaaugacaucgcaaacugcuuacggaagaacgggaagcgcgugauccaacuguccaggaagacguucgacaccgaguaccagaagaccaaaaacaacgacugggacuacgucgugaccacggacaucuccgagaugggugccaauuuccgcgccgaccggguaaucgacccccgccgcugccucaagcccgucaucuugaaagacgggcccgagcgcgucauccuagcaggcccgaugcccgugaccgccgccuccgccgcccagcggcggggacgcaucgggcggaaucagaacaaggagggcgaucaguaugucuacauggggcagccccucaacaacgacgaagaccacgcgcacuggaccgaagccaagaugcugcuggacaacauaaauacccccgaaggcaucaucccggcccuuuucgagcccgagcgcgagaaaucggccgcaauugauggagaguaccggcuacguggcgaggcgcggaagacguuugucgagcuuaugcgccggggcgacuuaccagucugguuauccuacaaggucgcaagcgagggguuccaguauuccgaccgccgguggugcuucgacggcgagcgaaacaaccagguucuggaggagaacauggacgucgagaucuggaccaaagagggcgagcgaaagaagcuccgcccccgguggcuggacgcccggacuuauagcgacccgcuggcccuccgggaguucaaggaguucgcagcgggucgccggagcguguccggcgaccugauccuggagaucgggaaguugccacagcaccucacccugcgggcccaaaaugcccucgacaaccuugugauguugcacaauuccgagcagggagggaaggccuaccgucacgcgauggaggagcugcccgacaccaucgagacgcugaugcugcucgcccugaucgcggugcugaccggcggggugacacucuucuuucuguccggcaagggacuggggaagacgagcauagguuuacugugugucacggccuccucagcccuucucuggauggcguccgucgagccacacuggaucgcggccagcaucauccuugaguucuuccugauggugcuuuuaaucccggagcccgaccgccaacggacgccccaggacaaccaguuggccuaugugguaaucgggcuccuguucaugauucugacgguugcggcgaaugagaugggacuacuggagaccacgaagaaggaccuggggaucggauauguggccgccgagaaccaccaacacgccacgaugcucgacgucgaccugcacccggccagcgcguggaccuuguacgcaguggccacuaccgugaucacccccaugaugcgccacaccaucgagaacaccacggcgaacaucagccugaccgccaucgccaaccaggccgccauccugaugggcuuagacaagggcuggcccaucuccaagauggacaucggcgucccccuccuggccuuggggugcuacagccaggugaacccgcucacccugaccgcggcggugcugaugcucguugcccacuacgccaucaucggaccggggcugcaggccaaggcgacgcgcgaggcccagaagcggaccgcggccggcaucaugaagaaccccacuguggauggcaucguagcaaucgacuuagaccccgucguguacgacgcaaaauucgagaaacagcucgggcagaucauguugcugauauugugcaccagucagauucugcugaugcgcacgaccugggcucuaugcgagaguaucacccuagccaccggcccgcugacuacccucugggaggggucccccggcaaguucuggaacacaaccaucgcaguauccauggccaauaucuuccggggauccuaccuggcgggggccgggcuggccuucagccuuaugaagucccucgggggagggcgccggggcacgggcgcccagggggagacccugggcgaaaaauggaagcgccagcuuaaccagcugagcaaaagcgaguucaacaccuacaaacggagcgggaucauggaggucgaccgcagcgaagcgaaagagggacuaaagcgaggggagaccacgaaacacgccgugucccgcggcaccgccaagcuccggugguucgucgagcgcaaccuggucaagcccgagggcaaggugauugaccucggguguggccggggagguuggagcuacuacugcgccgggcucaagaaggugacggaggugaaaggcuacaccaagggcgggcccggccacgaggagccgauccccauggccaccuacggguggaacuugguuaaacugcauuccggaaaggacguguucuucaugccacccgagaagugcgacacgcuguuaugcgauaucggggagagcuccccuaaucccacgaucgaggaggggaggacgcugcgggugcugaagaugguggagcccuggcuccgcggcaaccaguucugcaucaaaauacuuaacccauacaugccgagcguaguagagacccuggagcgcaugcagcgcaaacacgggggcaugcuggugcguaauccucuguccaggaacucgacgcacgagauguacuggguguccugcgggaccgguaacauugugagcgcgguaaacaugaccucucgaaugcuacuaaaccgguucaccauggcccaccgaaagcccacguacgagcgggacguggaucuuggcgccgggacccgccacgucgccguagaacccgagguggcgaaccuggacaucaucggucagcggauugagaacaucaaaaacgagcacaagagcaccuggcacuacgacgaagacaacccguacaaaacaugggcguaccauggguccuacgaggucaagcccucgggcuccgcuagcagcauggugaacggugugguccgccuccugacgaagcccugggaugugauccccauggucacccagaucgccaugaccgauaccacgccauuuggccagcagcggguguucaaggagaagguggauacccgcacgccccgggccaaacgagguacuacgcagaucauggaggucaccgccaaguggcuguggagcuuccucucacgaaauaagaagccccgcaucugcacccgagaggaguucacccguaagguccgguccaacgcggcgauaggggccguuuuugucgacgaaaaucaauggaacuccgcgaaggaggcuguggaagacgagcgcuuuugggaccuggugcacagggagcgcgagcugcacaaacagggaaaaugcgcaaccugcguauauaacaugaugggcaagcgggagaaaaagcucggggaguucggaaaggccaagggcucccgcgccaucugguacauguggcugggcgcccgguuccuggaguucgaggcgcucggguucaugaacgaagaccacugguucucaagagaaaauucacuaucaggcguggagggggagggccugcacaagcugggcuacauucugcgcgacaucuccaagauuccggguggcaacauguacgccgacgacaccgccgggugggacacccgggugacggaggacgaccugcaaaacgaggccaagauaacggacaucauggagcccgagcacgcauugcuggccaccagcaucuucaagcugaccuaccagaacaaggucgugcgcguccagcguccugccaaaaauggaaccgucauggacgugaucucccgccgggaccagcgcgggagcggacaggugggaaccuacgggcucaacacuuucaccaauauggaaguccagcugauccggcagauggaauccgagggaauauuccugcccucugagcucgaaaccccgaaccuggccgagcgcgcucucgacuggcucgagaagcauggugccgagcggcugaagcguauggcgaucaguggcgacgauugcgugguuaagcccaucgacgaccgguucgccacugcauugacggcgcucaacgacauggggaaaguccgaaaggacaucccccagugggagcccagcaagggcuggaacgacuggcagcagguaccauucugcucccaccacuuccaccaacugaucaugaaggacggccgggagaucguugucccgugccgcaaccaggacgaauuaguuggacgggcgcgcgugucgcaaggagcuggguggucccucagagaaaccgcgugccugggcaagagcuacgcccagauguggcagcucauguacuuccaucgccgggacuugagacuggccgcgaacgcaaucugcagcgcuguccccguagacugggugcccacgucccgcaccacguggagcauccacgcucaccaccaguggaugacaaccgaggacaugcucuccgucuggaaccgagucuggauugaagagaacccuuggauggagaauaagacccacgugucauccugggaggaaguuccuuaccucgggaaacgcgaggaccaguggugcggcagccugaucggccugaccgcccgggcgaccugggccaccaacauccaaguagccaucaaccaggugcgccgguugaucgggaaugagaacuacuuagauuacaugaccuccaugaagcgauucaaaaacgaauccgauucggagggcgcccugugguaa

SEQ ID NO: 23996 - RNA, 9879 nt, Artificial Sequence
  derived and/or modified CDS sequence (opt11) from DENV-1__KJ189365__SS-prME
agcgugacuaugcugcucaugcugcugcccaccgcccucgccuuccacuugaccacucguggcggugaaccccacaugauuguaagcaagcaggaacgcggcaagagccucuuauucaagacgagcgcgggggugaacaugugcacccucaucgcaauggaccugggugaacucugcgaggacaccaugaccuauaaguguccccgcauaaccgaagcggagcccgaugacguggacuguuggugcaacgcuaccgacaccugggucaccuacgggaccugcagccagaccggcgagcaucgccgcgaaaaacgguccguggcgcuggcgccccacgugggccuggggcucgaaacccgcaccgaaaccuggaugagcuccgagggagccuggaagcagauccagagagucgagaccugggcccugcgccaccccggguucaccgugaucgcguucuuccuggcucacgcuaucgguaccagcaucacccagaagggaaucauuuucauucuccucaugcuggucacccccucaauggccaugcggugcgucggcaucggcaaccgcgacuuuguggagggguugagcggcgccacguggguggacgucguguuagagcacgggucgugcgugaccaccauggccaagaauaaacccacccuggacauagaguuacugaagacggagguaaccaaccccgcggucuuacgcaagcucugcauagaggcuaagaucagcaacaccacuacggacucccgcugcccgacccaaggcgaagcuacccuaguggaggagcaggacgccaacuucgucugccggcgcacguuuguggacagagggugggggaacgggugcgggcuguucggcaagggcagccuccugacgugcgcaaaguuuaagugcgugaccaagcuggaaggcaagaucguccaguacgagaacuugaaguacuccgugauuguuaccguccacacuggcgaccagcaucagguggggaacgagacgaccgagcauggcacuaucgcgaccaucacgccccaggcacccacguccgagauacagcugaccgacuacggggccuugacccucgacugcagcccccggacuggccuugacuuuaacgagaugguacuacucacgaugaaggagaaguccuggcuggugcacaagcagugguuccuggaccucccguugcccuggaccuccggggccagcaccagccaggaaaccuggaaccggcaggaccuguuagugaccuucaagaccgcccacgcgaaaaagcaggagguugucgugcugggcucccaggagggcgccaugcacaccgccuugaccggggccacggagauccagacuagcggcaccaccaccaucuucgccgggcaccucaagugccgccugaagauggacaagcugacccuuaaaggcauguccuacgucauguguaccgggagcuucaaguuggagaaggagguggcggagacccaacacggaacggugcugguucaagugaaguacgagggcaccgacgcccccugcaagauccccuuuuccacccaggacgagaagggugucacccaaaauggccguuugauaacggccaacccgauagucacggacaaagaaaagcccgugaacauagagaccgagccgcccuucggggagagcuacauuguggucggcgccggcgagaaggcgcucaagcugagcugguuuaagcgggguagcuccauaggcaagauguucgaggccaccgcccgaggggcccgccguauggccauacugggagacacggcgugggacuucgggagcaucggcggcguguucaccuccguggggaaacucguacaccagaucuucggcacugcuuacggggugcuguuuagcggcguguccuggaccaugaagaucgggaucggcaucuuacucacguggcugggccuuaacagccgguccaccucacuuuccaugaccugcaucgucguggggauggugacucuauaucugggcgucaugguccaggcggauagcgggugcgugaucaacuggaagggccgcgagcucaaaugcgguuccggcauuuuugucacgaacgagguacacacuuggacggaacaguacaaguuccaagccgacagcccgaagcggcugagcgccgcgaucggcaaagcaugggaggaggggguguguggcauccgcuccgccacccggcucgaaaauauaauguggaaacagaucagcaacgagcugaaccauauccuccuggagaacgauaugaaguucaccgucguggugggggacgcaaacgguauccuggcgcaggggaagaagaugauccgcccccagcccauggaacauaaguacuccuggaaguccuggggcaaggcgaaaauaauaggcgccgacauccagaacacuaccuuuauaaucgacgggcccgauacaccggagugucccgacggacagcgcgccuggaacaucugggaggucgaggauuacggguucgguguguucacaacuaacauauggcugaagcugcgcgacuccuacacacagaugugugaccaccgguuaaugagcgccgccaucaaggacucuaaggccguucacgccgauaugggcuacuggauagagagcgagaagaacgagacauggaaacuggcccgcgcauccuucauugaggucaaaaccuguacguggcccaagagccacacccuguggucaaacggugucuuagagagugaaaugaucauccccaagaucuacggggggcccaucagucaacacaacuaucggcccggcuauuuuacccagaccgccgggccuuggcacuugggcaaacuggagcuagacuuugaccugugcgagggcacgacgguggucgucgacgagcauugcgggaaccgcggcccgucgcugcggaccaccacugugaccgggaagaucauacaugaguggugcugccgcuccugcacccuaccgccucugcguuuccgcggcgaggacgggugcugguacggcauggagauccggccgguuaaggagaaggaagaaaaccuaguacgcagcaugguguccgccgguagcggggaggucgacucauucucccuaggcauccugugcgugucuauuaugaucgaggaagugaugcggucccgcuggagccgcaagaugcugaugaccgggacacucgcagucuuucuacugcugauaaugggccagcugaccuggaacgacuuaauacgguugugcauuauggugggggccaacgccagugaccgcaugggcaugggcacgaccuaccuggcgcugauggccacguuuaagaugcggcccauguucgcagucgggcuccuguuccgccggcuuacaaguagggagguccuccugcugaccaucggccucagucugguggccaguguugaguuacccaacucccuugaagagcuuggggacggccuggcgaugggcauaaugaugcucaaacugcugacggaauuccagccccaccagcucuggacaacgcugcucagccugaccuucgugaagaccacgcugucguuagacuaugcuuggaaaaccaccgccauggcccucucaaucguuucacuguucccccugugccucagcaccacuucccagaagaccaccuggcugccggucuuguuggggucuuuuggcugcaagccauugaccauguuccugaucaccgagaacaagaucugggggcggaagaguuggccacucaacgagggcaucauggcuaucgggaucgugagcauccuccucuccagccuccugaagaacgacgugccccuggcgggcccccucaucgcuggagggaugcuaaucgccugcuacgugaucagcggcuccuccgcggaccugagccucgagaaggccgcugaggugagcugggagcaggaggcagagcauaguggggccagccacuccauccugguggagguccaggacgacggaacgaugaaaaucaaggacgaagagcgcgacgauacccugacuauccuccugaaggccacacugcucgccguguccgggguguauccaauguccauccccgcuacacuguuugucugguacuucuggcagaaaaagaagcagcggagcggcgugcugugggauacccccucaccgcccgagguggaaagagccguccucgacaacgggauuuaccggauucugcagcgcgggcugcugggacgcagccaggugggggugggcguguuccaggacgggguguuccacaccauguggcauguaacccgcggcgcuguccucauguaccagggcaaacggcuggaacccuccugggcgagcguuaagaaggacuuaaucaguuacgggggcggauggcgcuuccagggcucauggaacacuggggaagagguacaggucauagccguggagcccggaaagaauccgaagaacgugcagaccacccccggcaccuucaagacgcccgagggggaggucggagcgaucgcccuggacuucaagccagguacuuccggcagcccaaucgugaaccgggagggcaaaaucguggggcuguacggcaauggagucgugaccaccuccggcacguacgugagcgcaaucgcccaggccaaggcgagccaagaggggccuuugcccgagaucgaagacgaggucuucaagaaacgcaaucucaccauaauggaccugcaccccggguccggcaagacacggcgcuaccuaccagccauaguaagagaagcuaucaagcgcaagcuccgaacacugauacuggcccccacgcggguugucgcgagcgagauggccgaggcccuuaaggguaugcccauucgguaccaaaccaccgcagugaaguccgaacauaccgggcgugagaucguggaccuuaugugucacgccacguucaccaugcgcuuacucagcccgguccgugugcccaacuacaacaugaucaucauggacgaggcgcauuucaccgaccccgcuuccaucgcagcccgcggcuauauuagcacaagggugggcaugggggaggccgcggccaucuucaugacagccacgccgcccggauccgucgaggccuucccccagagcaacgccgugauccaggacgaggagagagacauccccgaacgguccuggaacagcggcuacgacuggaucaccgacuuccccgggaaaacggugugguucgugcccaguaucaaaucaggcaaugauaucgcgaauugccuacgcaagaacgggaagcgggugauccaacugucccggaagacguucgacaccgaguaccagaaaaccaagaacaaugacugggacuacguugucaccacggacaucucugaaaugggcgccaauuuccgggccgaucgcgugaucgacccccggcguugucucaagccagugauccugaaagacgggcccgaacgggucauuuuagccgggccuaugccugugaccgcggccuccgcggcccagcgucgcggccgcaucgggcgaaaccagaacaaggaaggcgaccaguacgucuauauggggcagccccucaacaacgacgaagaccaugcccacuggaccgaggcuaaaaugcugcuggacaacaucaacacccccgagggcaucaucccggcgcucuucgagcccgagcgagaaaaguccgccgccaucgacggggaguaccgccugagaggcgaggcucgcaagacguucguggagcugaugcggcgcggggaccucccaguguggcuguccuacaaggucgcgagcgagggguuccaguacuccgaccgaagaugguguuucgacggcgaacggaacaaccaggugcuggaggagaacauggauguggagaucuggaccaaggagggggagagaaagaagcucagaccccggugguuagacgcccggaccuacagcgacccgcuggcccuccgcgaguucaaggaguucgcugccggccggcgcagcgugucgggcgaccugauccuggagaucgggaagcugccacagcaucugacccuuagagcgcagaacgcccucgacaaccuggugaugcuucacaacuccgagcaaggagggaaggcuuaucggcacgccauggaggaacucccggacaccaucgaaacgcucaugcugcucgcgcugauagccgugcugaccggcggcguuacccucuucuucuuguccggcaagggccuggggaagaccucaaucggcuugcuaugcguuacagccagcucugcccugcucuggauggccuccguugaaccacacuggaucgcagccagcaucauucuggaguucuucuuaaugguccuccuaaucccggagcccgaccgccagcgcaccccccaggacaaccagcuggcuuacgucgugaucgggcuccuguucaugauacugaccgucgccgccaacgaaaugggccucuuagagaccacgaagaaggacuuggguaucggcuauguggcggcagagaaccaccaacaugccaccaugcucgacguugaccugcacccggccucggccuggacccuguacgcgguugcaacuacggugaucacccccaugaugcggcacaccaucgaaaacaccacugccaacauuucccuaaccgccaucgccaaccaggcggccauccucaugggccuggacaagggguggcccauauccaagauggacaucggagugccgcuccuggcccucggaugcuacagccaggugaacccccucacauugaccgcagcggugcugauguuggucgcgcacuacgccaucauaggacccggguuacaggcgaaggccacgcgagaggcgcagaagaggacggcugcuggcaucaugaagaaccccaccgucgacggcaucguggccaucgaccuggaccccguggucuacgacgccaaauucgagaagcagcucgggcagaucaugcugcugauccuaugcaccucccagauccuauugaugcgaaccaccugggcgcucugugagagcauaacccuugcgaccggcccccucacaacucucugggaggggaguccgggcaaguucuggaacaccaccaucgccguaagcauggcuaacaucuuucgcggcuccuaccuggcaggggcaggucuggccuucagccucaugaagucccucggggggggccggcgcggcacgggcgcccagggggagacgcugggcgagaaguggaagcgucagcucaaccaguugagcaagagcgaauucaacaccuacaagcgcucagggaucauggaagucgaccggagcgaggcaaaggagggucugaagaggggggagacuacaaagcaugcugugucccggggcaccgccaagcuccgcugguucguggaacgaaaccuagucaagcccgagggcaaggugaucgaucuggggugcggucgcgggggcuggucuuauuacugcgccggucugaagaaggugaccgagguaaagggcuacaccaagggcggccccgggcacgaggagccgauccccauggcaaccuacggguggaaccucgucaaacugcacucaggcaaggacguguucuucaugccgcccgagaagugcgacacguuauugugcgauaucggggagagcuccccgaacccaacaaucgaggaaggcaggacacugcgcgugcugaagaugguggagcccuggcuacggggcaaccaauuuugcaucaaaauccugaacccauacaugccgagcgugguggagacacuggagcgcaugcagcggaagcacgggggcaugcuuguccggaacccccugucccggaacagcacacacgagauguacuggguguccugcgggaccggcaacaucguuagugccgucaacaugacuagccguaugcugcucaaccgcuucaccauggcgcaccggaagccaacauaugagcgcgacguggacuugggcgccgggacccggcacguggcagucgagccggaggucgccaaccuggacaucaucggccagcgaaucgagaacaucaaaaacgagcacaaaagcaccuggcacuacgaugaggacaacccguacaagaccugggccuaccacgggucguacgaggugaagcccagcggcuccgcuagcuccauggucaauggggugguccggcuccugacaaagccgugggacgugauccccauggugacgcagaucgccaugaccgacaccacgccguucggacagcagcgcgucuucaaggagaagguggacacccggacgccccgggccaagcgcggcaccacgcagaucauggaggugacggcuaaguggcuguggggguucuugagccgcaacaagaaaccccgcaucugcacccgagaggaguucacccggaagguacgcucaaacgcagcgauuggggccguguucgucgacgagaaccaguggaauuccgccaaggaggccguagaggacgagcgguucugggaccuggugcaccgcgagagggagcuccauaagcaggggaagugcgcgacguguguguacaauaugaugggcaagagagagaagaaacucggggaauucgguaaggccaaaggcagccgggcuaucugguacauguggcugggggcccgcuuucuggaauucgaagcccucggcuucaugaacgaggaccacugguucagccgggagaacucccuuuccggugucgagggcgaggggcugcacaagcucggcuacauccuucgggauaucaguaagaucccgggggggaacauguacgcugacgacacagcgggcugggacaccagagugacugaggacgaucugcagaacgaggccaagaucacggacauaauggagccugagcacgcccuccuugccaccuccauauucaagcugacuuaccagaacaagguaguccgggugcagcgccccgcgaagaacgggaccgugauggacgugaucagccggcgcgaucagcgcggguccggacagguggguacguacggccucaacaccuucacaaacauggaggugcaacugauacggcaaauggagucugaagggaucuuucugcccuccgaguuggagaccccgaaucuggccgagcgggcccuggacuggcucgagaagcacggcgccgagcgucugaagcggauggcaaucucuggggacgacugcgucgugaagcccaucgacgaccgcuucgcgacggcccugacugcccucaacgacaugggcaaggugcgaaaggauaucccccagugggagcccuccaagggauggaaugauuggcaacaggucccauuuugcagccaccacuuccaccagcugaucaugaaggauggacgggagaucguggugccgugccgaaaccaggacgagcuggucggccgagcgcggguuucccagggugccggcuggagccugcgggagaccgcgugccucgggaaguccuacgcccagauguggcagcugauguacuuucaccggcgcgacuuacggcucgcggccaacgcgaucugcagcgccguuccgguggacugggugcccaccagcaggaccacguggaguauucaugcucaccaucaguggaugaccacugaggacaugcugucuguguggaaccgagucuggaucgacgaaaacccguggauggagaacaagacccacguauccagcugggaggagguuccguaccucggcaagcgggaggaccaguggugcggcucccugaucgggcucacggccagagccaccugggcgaccaauauucaggucgccaucaaccaggugcggcgccugauuggcaacgagaauuaccuugauuauaugaccagcaugaagagauucaagaaugaguccgacucagagggggcgcugugguga

SEQ ID NO: 23997 - RNA, 9879 nt, Artificial Sequence
  derived and/or modified CDS sequence (opt11) from DENV-1__KJ189366__SS-prME
ucagugacaaugcugcucaugcugcuacccacggcgcucgccuuccaucuuaccacucgcggcggggagccccauaugaucgucaguaagcaagaaaggggcaaaucucuauuauucaagaccucagcaggagugaacaugugcacguugaucgccauggaccugggugaguuaugcgaggacacgaugacauauaagugcccccguaucgcugaggccgagccugacgauguggacugcuggugcaacgccaccgacaccuggguaacguacgggacauguucucagaccggcgaacaccggcgcgagaaacgguccgucgcgcuggcgccacacgugggccugggccucgaaaccaggacggaaacuuggaugucguccgagggagcauggaagcagauccaacgugucgaaaccugggcauuacgacacccgggguucacggugaucgcguucuuccuggcccacgccaucggaaccuccauaacacagaaagggaucaucuucaucuugcugaugcuggugacacccuccauggcuaugcggugcgucggcaucgguaaccgcgauuucguugagggccucagcggcgccacuuggguggacgucguccuggagcacgggucaugcgucacaaccauggcgaagaauaagccaacccuggacaucgaacuccugaagacugaggucacgaacccggccguacugcgaaaacuaugcaucgaggcuaaaauuagcaacaccaccacagacucacgaugccccacgcaaggagaggcaacucucguggaggaacaagaugcgaauuucgucugccgccgcaccuuugucgacaggggcugggggaacgguuguggccuguucggcaaggggagccuccugaccugcgcuaaguuuaagugcgugacgaaacuugagggcaagaucguacaguaugaaaacuugaaguacuccgugauagugaccguccauacuggcgaccagcaccagguggggaacgagaccacagaacacggcacgaucgccacaaucacgccccaagccccuacgagcgaaauccagcugacggauuauggcgcucugacacucgacugcagcccacggaccggcuuagacuucaacgagaugguccugcucacgaugaaggagaagaguuggcuggugcacaaacagugguuuuuagaucuccccuugccauggaccucuggggcaagcaccucgcaggagaccuggaaccggcaggaccuccucgugaccuucaagacggcgcacgcuaagaagcaggaggucguuguacuggggagucaggagggggccaugcacaccgccuugaccggggcgacugagauccagacgucaggcaccacaaccaucuuugcagggcaccuaaaaugccgccugaagauggacaagcugacacucaagggcauguccuacguaaugugcaccgguaguuuuaaacuagagaaggagguggccgaaacacagcacgggacgguccugguccaggugaaguacgagggcaccgacgcucccuguaagaucccguuuucaacucaggaugagaagggggugacccagaacggccggcugaucacggcuaauccgauugucacggauaaggagaagcccgucaacauugaaacugaaccgccauucggggaaagcuacaucguggucggcgcgggcgaaaaagccuuaaagcugucgugguucaagcgagggagcuccaucgguaagauguucgaggccacugcuaggggugcccgacgcauggccauacucggagauacggcgugggacuuuggguccaucggcggcguguucacuuccguggguaagcuaguccaucagauuuuuggcacugccuacgggguuuuguuuagcggcgugagcuggaccaugaagauagggauaggaauacuccucaccugguuaggccugaacagccgguccacgagccucucgaugacuugcauugccgucgggaugguuacccuauaucugggcgugauggugcaggccgacucagggugcguuaucaacuggaagggccgcgaacucaaaugcgggucggggaucuuugucacgaacgagguucauacguggaccgagcaguacaaguuccaggcggacagccccaagcgucuaucggcagcaauaggcaaggccugggaggaaggaguuuguggcaucagauccgccacacggcuggagaacauuauguggaagcaaaucucgaacgaacucaaccauauccugcuggagaacgauaugaaguucacuguggucgugggggacgcgaacgggauccucgcucagggcaagaaaaugauccgcccccagcccauggaacacaaguauuccuggaaguccuggggcaaggccaagauaaucggcgccgacauacagaacaccacuuucauuaucgacgggcccgacacgccggagugcccagauggccagcgggcguggaacaucugggaggucgaggacuacggguucggcgucuuuaccacuaacaucugguugaaacuacgcgauuccuauacccagaugugcgaccaccgccucaugagugccgccaucaaggauagcaaagccguucacgccgacaugggcuacuggaucgagagcgagaagaacgaaacauggaagcuugcgcgcgccuccuuuaucgaagucaagaccuguaccuggccuaagagccacacacugugguccaacggcguacuggaaagcgaaaugaucauccccaaaauauauggcggaccgauuucgcagcacaauuacaggcccggcuacuucacccagacugccgggcccuggcaccugggcaaacuggagcuggacuucgaucugugugagggcacuacgguggucgucgaugaacacugcggaaaucgcggcccaucacugcggacaacuaccgugaccgggaaaaucauccacgaguggugcuguagaucuugcaccuuaccgccgcuccgguuccgcggcgaagaugggugcugguauggcauggagauccggccagugaaagagaaagaagagaaccugguccgcagcauggugucagccggcucuggagaaguggacagcuucucccucgggaucuuaugcguaagcaucaugauagaggaggugaugcgaagucgcuggagucgcaagaugcuaaugacuggcacccuagcuguguuccuucugcucauaaugggccaacucacauggaaugaccugauccggcucugcauaauggucggugcgaacgccuccgaccgcaugggaaugggcaccacauaucuugcacuaauggcaaccuucaagaugcggcccauguuugccguugggcuacuguuccgccggcugacgagccgagagguguuguugcuaaccaucgggcugucccuggucgcgucaguagagcugccuaacagucuggaggaacuuggugacggacucgcgauggguaucaugauguuaaagcuauugaccgaguuucaaccccaccaacuguggaccacauuacugagcuuaaccuuugucaaaaccacucugucccuggacuaugccuggaagacuacugccauggcgcugagcaucgugucccuuuucccgcugugccucagcaccacuucacagaagacaaccuggcugccgguucugcucgggaguuuuggaugcaagccacugacuauguuccugaucaccgagaacaaaaucuggggucggaaguccuggccucucaacgagggcaucauggcaaucggaauagucaguaucuugcuauccagccuccugaagaaugacguuccccuagccgggccgcucauugccggcgggauguugaucgccugcuacgugaucagcggcuccucugcggaccugucccuagaaaaggcggcugaggucucgugggagcaagaggcggaacacucgggggcgagccacuccauauuaguagaggugcaggacgaugggacaaugaaaaucaaagaugaggagcgcgaugauacgcuaaccauccucuugaaggcgacccugcucgccgucucugggguuuaucccauguccaucccugccaccuuguucguaugguacuucuggcaaaagaagaagcagaggagcggcguucugugggacacgcccucaccgcccgagguagagcgcgcgguguuggacaacggcaucuacagaauccugcaacgcggccuuuugggcagaucucaggugggugugggcguauuccaggacggggucuuccauaccauguggcacgugacgcgcggcgccguacucauguaccaaggcaaaaggcuggagccgucgugggcgagcgucaaaaaggaucugaucucauacggggguggguggcgcuuccaagguagcuggaacaccggggaagagguccaggugauagccgucgagcccggcaaaaacccgaagaaugugcagacgacccccggcaccuuuaaaaccccggagggggaggugggggccaucgcccucgacuucaagcccgggacuuccgggagcccgauagucaaccgggaaggcaagauagugggccuuuauggcaacgggguagucaccacuuccggcacguaugucuccgccauagcucaagcuaaggcuagccaggaggggccccugcccgaaauagaagacgaggucuucaaaaagcggaaccucaccaucauggaccuccauccaggcagcggcaagaccaggagguaccugcccgccauuguccgggaggcgaucaagcgaaaacuccgcaccuuaauccuggcgcccacccgcgugguggcgagcgagauggccgaagcccucaagggaaugcccauccgcuaccagacaaccgcagucaaaucagaacacaccgguagagagauuguugaccuuaugugccacgccacguuuacgaugcgccuguuguccccggugcggguccccaacuacaauaugaucauaauggacgaggcccauuucaccgaucccgcaucaauugccgcgcgcggguacaucagcacucgggugggcaugggcgaggcugccgcgauuuuuaugacugcaacuccgccggggucgguggaggcguuuccccaaagcaacgcugucauccaggacgaggaacgcgacauucccgaacgguccuggaacagcggcuaugacuggauuaccgacuuccccgggaagaccgugugguucguacccuccaucaagagcggcaacgacaucgccaacugccuucgcaaaaacggcaagagagucauacagcugucgcgaaagaccuuugacacggaguaccagaagacgaaaaacagcgacugggacuacguggucaccaccgauaucuccgagaugggcgcgaacuuccgggccgaucgcgucaucgauccccggagaugccucaaacccguaauccuuaaggacggucccgagcguguaauuuuggccggcccgaugcccgucacggcugccagcgccgcgcagcgccgggggcggaucggccgcaaucaaaauaaggagggcgaucaauacgucuacaugggucagccccugaacaacgacgaggaucaugcacacuggaccgaggcgaagaugcuccucgacaauauuaacaccccugaaggaaucaucccggcccucuuugagcccgaaagagaaaaguccgcagcgaucgauggggaguaccgccugcggggcgaggcccgcaagaccuucguugagcugaugcggcgcggcgaucucccagugugguuaaguuauaagguggcgucggaagguuuccaguauagcgaccggcgcuggugcuuugauggcgagcggaacaaccaggucuuagaggagaacauggacguggaaauuuggacgaaggagggggagcgcaagaagcugaggccacgguggcuggacgcgcggaccuacucggacccgcuggcccucagggaauuuaaagaauucgcugccggccgacgcuccguaagcggcgaucugauucuggagaucgggaaacucccccagcaccugacgcugagggcgcagaacgcccucgacaaccuggucaugcugcauaacuccgagcagggcgggaaggcauaccgccacgccauggaagaacucccagauacgauugaaacccugaugcucuuggcccucaucgcuguucuaaccggcgggguuacgcuguucuuccugagcggcaagggucuagggaagaccagcaucggguuacugugcgucacugccucgucggcacugcuauggauggccucagucgagccccacuggaucgcagccucaauaauccuggaguucuuccugaugguccuccucaucccggagccggacagacaacgcacgccccaagauaaccaacuagccuacguggugaucggacuccuguucaugauauuaacgguugcugcuaacgagaugggacugcuggagaccacaaagaaagaccuggggauuggcuacguugccgccgagaaccaccaacacgugacgaugcuggacguggaccugcacccugcaucggcguggaccuuguacgccguggcaaccaccguaaucacgcccaugaugcggcauaccauugaaaaugcgaccgcuaacaucucccucacagccaucgcuaaccaggcggccauccugaugggacuggacaagggguggccgauaagcaagauggacaucggcgucccccuacuggcacugggguguuacagccaggucaacccgcucacguuaaccgccgccguacugaugcucguagcacauuaugccaucauuggccccgggcugcaggcgaaggcgacacgcgaggcacaaaagagaacggccgccggcaucaugaaaaaucccacugucgacgguaucguggcgauugaccuggaccccguggucuacgaugcuaaguucgagaagcaguuaggccaaauuaugcuucuaauccucugcaccagccagauccugcugaugcggacuaccugggcccucugcgagucgaucacucuggccaccgguccgcugaccacguugugggaggggagccccggcaaguucuggaauacgaccauagcuguguccauggcgaacaucuucagaggguccuacuuggccggggccggccuggccuucucccucaugaagucguuggggggcgggcggcgcgguaccggcgcccaaggcgaaacccuuggcgagaaguggaagagacagcucaaccagcugucuaaguccgaauucaacacguacaagcgcucaggcaucauggaaguggaccgguccgaggccaaggagggccuuaagagaggcgagaccaccaagcacgccgugagucguggcacggcuaagcuccggugguucguggagcggaaucuugugaagcccgagggcaaggugaucgaccuagguuguggccgcgggggauggucguacuacugcgcggggcugaaaaaggugaccgaggugaagggcuacaccaagggcgggcccggccacgaagagccgauacccauggcgacauacggguggaaucucguuaaacugcauagcggcaaagacguguuuuucaugccgcccgagaagugcgacacccuucucugcgauaucggugagaguagcccgaaccccaccgucgaggagggccgaacccugaggguccugaagauggucgaaccguggcuccgggggaaucaauucuguaucaaaauccugaacccuuacaugccguccgugguggaaacccuggagagaaugcagcggaaacacggggggaugcucgugcgcaacccucugagccggaauuccacccaugagauguacugggugagcugugggacuggaaauauaguaucugccgugaacaugacgagccgcaugcuucuuaaccgcuucaccauggcccaccggaagcccacuuaugagcgggacguggaucugggcgccgggacccggcacguggccguggaacccgagguggccaaccuggauaucauaggccagcgaaucgagaacauaaagaaugaacauaagucaacguggcauuaugacgaagacaauccguacaagacuugggccuaccacgggucguacgagguaaagcccagcgggagcgcauccagcauggugaacgggguagugaggcuccugacuaaacccugggaugugaucccgauggucacccagaucgcuaugacggacacgaccccauucggccagcagcgcguauuuaaggagaaggucgacacucggaccccccgcgccaagcggggcaccacccagaucauggaaguuacugcgaaguggcuguggggcuuccuaagccgcaacaagaagccccgcauuugcaccagggaagaguucacacggaaggugcgguccaacgcugcggugggcgccguauucguggaugagaaccaguggaacagcgcgaaggaggccguggaggaugagcgauuuugggaccuaguccaccgcgaacgcgagcugcacaaacagggcaagugcgcaaccuguguuuauaacaugaugggcaaacgcgaaaagaagcucggggaguucggcaaggccaaaggcucccgggccauaugguacauguggcuaggggcuagguucuuggaguucgaagcccucggcuucaugaacgaggaccacugguucagccgagaaaacuccuuaucgggcguugagggcgagggucugcacaaacugggauacauccucagagauaucaguaaaauuccgggcggcaauauguacgccgacgacaccgccggcugggacacgcgcguaaccgaggacgaccugcagaacgaggccaaaauuacggacaucauggagcccgagcaugcgcuccuggcaaccagcaucuucaaauuaaccuaccagaacaaagugguccggguccagcgccccgccaagaaugggacggucauggaugugaucucccggcgcgaccaacggggcagcggacagguggguaccuacggccugaacaccuuuaccaacauggagguccagcuaauacgccaaauggaauccgagggcaucuuucugccaagcgagcucgagacacccaaccuggcagagcgcgcccuggauuggcucgagaagcauggcgcggaacgccugaagcggauggccaucagcggggacgacugcgucgucaagcccaucgacgaucgcuucgccacggcacugaccgcccuuaaugacauggguaagguaagaaaggacaucccgcagugggagcccagcaagggguggaaugacuggcagcaggucccguuuugcucccaccacuuucaccagcuaaucaugaaggaugggagagagaucgucgugccgugucggaaccaagacgagcuggucggccgcgcacgcgugagccagggcgcagguuggucccugagggagacggccugucuggguaagagcuacgcccagauguggcaacuaauguacuuucacagacgcgaccuccggcuggcggccaaugccaucugcagcgcugugcccguggauuggguucccacgucccguaccaccuggagcauccacgcacaccaccaguggaugacaacagaggauaugcuguccguguggaaccgcguguggaucgaggaaaacccguggauggagaauaagacucacguuaguagcugggaagagguuccuuaucucggcaagcgggaggaccaauggugcgggucacugaucggucugaccgcacgugccaccugggccacgaacauccagguugccaucaaccagguccggcgccugauaggcaacgagaacuaccuggacuacaugaccagcaugaaacgguucaagaaugaaucagacuccgagggggcgcuuugguga

SEQ ID NO: 23998 - RNA, 9879 nt, Artificial Sequence
  derived and/or modified CDS sequence (opt11) from DENV-1__JN819417__SS-prME
agcgugaccauguuauugaugcuacugcccacggcccucgccuuccaccucaccacccggggcggggagccccacauggucguuagcaagcaggagcggggcaaaagccugcucuucaagaccagcgccggggugaacaugugcacccugauagccauggaucugggagagcucugcgaggacacuaugaccuauaagugcccuaggaucacugaggccgagcccgaugaugucgauuguuggugcaacgccaccgacaccugggugaccuaugggaccugcagccaaacuggcgagcaucgacgggacaagagauccguugcccuggcgccccacgucggccuggggcucgaaacacggaccgaaacauggaugucauccgagggugcuuggaagcagauccaaaagguagagacaugggcacuucggcauccuggauucacggugauugcacuguuccucgcgcacgccauaggcaccucgaucacgcagaaggggauuauuuucauacuucugaugcucguuaccccuagcauggcgaugcgcugcgugggcauaggcaaccgcgacuucguggagggguugucuggcgcgacaugggucgacgugguucucgagcacggguccugcguuaccacaauggcgaagaacaagcccacgcuggacaucgagcugcugaagacggaagugaccaaccccgcgauucucaggaagcugugcauagaggccaaaaucagcaacaccacaacugauucccggugcccgacccaaggcgaggccacgcugguggaggaacaggacgccaauuucgucugccgaagaacauucguggaccgcgggugggggaauggcugcggccuauucggaaaggggagcuuguuaacgugcgcuaaguuuaagugcgugaccaagcucgaggggaaaaucguccagcacgagaaucucaaguacuccgugauagugaccguccacacaggcgaccagcaccagguggggaaugaaacgacggaacacggaaccaucgcgaccauaacgccucaagccccaacguccgaaauccaacugaccgacuacggugcccucacucuggacugcucaccccggaccgggcuggacuucaaugagaugguccuccuaacaaugaaggaaaaguccuggcuugugcacaagcagugguuucucgaccugccccugcccuggaccuccggcgcaagcaccagccacgagaccuggaaucgucaggaccuacuggugacuuucaagaccgcccacgcgaagaaacaggagguugugguccugggcucgcaggaaggcgccaugcacaccgcacucaccggugcgaccgagauccaaaccagcggcaccaccacaauuuucgccggccaucugaaaugccgguuaaagauggacaagcucacccuaaagggaauguccuaugucaugugcacagggagcuucaaacuggagaaggagguggcggaaacccaacacggcacggugcugguccaggugaaguacgaggguaccgacgccccgugcaaaauucccuuuucaacacaggacgagaagggggugacccagaacggccgccucaucacugccaauccgaucgucaccgacaaagagaaacccgugaauaucgagaccgagccgcccuucggcgagagcuacaucgugguuggugccggcgaaaaagcgcugaagcugucaugguucaaaaaggggagcuccauagguaagauguuugaggccaccgcccgcggggcccgccggauggccauccucggcgauacggcuugggacuucgggucuauaggcggcguauuuaccuccguggguaagcugguucaccagguguucggcaccgccuauggggugcuguucagcggcguauccuggaccaugaagaucgguaucggaauccuacugacauggcugggucucaacagcagauccacgagccugucgaugacgugcaucgccguggguauggugacacuguaccugggugucauggugcaggccgacagcgggugcgugaucaacuggaagggccgcgagcugaagugcggguccggcauuuucgucaccaacgaggugcauaccuggaccgagcaguauaaguuucaggccgacagcccgaagcgauuaagcgcugccauuggcaaagcaugggaggaagggguuuguggcauccgcuccgccacccggcuggagaacaucauguggaagcaaaucagcaacgagcugaaccacauccugcuggagaacgauaugaaauucaccguaguagugggggacgcgaguggcauccuggcgcagggaaagaagaugauacgcccucagcccauggagcacaaguauaguuggaaguccuggggcaaggccaagaucauuggcgccgacacgcaaaacacaacauucaucaucgacgggcccgacaccccggaaugccccgacgaccagcgggccuggaauaucugggaggucgaggauuacggcuucgggauuuucacgacaaacaucuggcugaagcuacgggacagcuacacccagaugugcgaccaccggcuuauguccgcggccauaaaagacaguaaggccgugcaugcugauaugggcuacuggaucgaauccgagaagaaugaaacguggaagcuagcccgcgcgagcuucaucgaaguuaaaacgugcaucuggccaaagucccauacccucuggagcaauggcguccuggaguccgagaugaucaucccaaagaucuacgggggcccgauuagccagcacaacuaccggccugguuacuucacucagacugccggcccguggcaucuggggaagcucgaguuagauuuugaccugugcgagggcacgaccgucgucguagaugaacacugcgguaaucgagggccgucccuccggaccaccacgguuaccgguaagaucauccacgagugguguugcaggagcugcacccuaccgccccuacgguuccgcggugaagacggcugcugguacggaauggaaauccggcccgugaaagagaaggaagagaacuuagucagguccauggugagcgccggaagcggcgaaguggacuccuuuagccuagggauccugugcguuuccaucaugaucgaggaggugaugaggagccgcuggucccggaaaauguugaugaccggaacgcuugccguguuccugcuccugaucauggggcagcugaccuggaaugaccucaucaggcugugcauaauggucggcgccaaugcgagcgaucgcauggggaugggcaccaccuaccuggcccucaugggcacguucaaaaugcggccuauguucgccguggggcuccuguuccgccgguuaaccucacgggagguucucuuacucacgaucggccugagccuggucgccuccgucgagcuccccaacagccuagaggaacugggggauggcuuggccaugggaaucaugaugcuaaagcugcucacggaguuccaaccucaccagcuguggacgacccuacucuccuuaaccuucaucaagaccacgcuaagccucgacuacgcguggaagaccauggccaugguacuguccaucgugagccuguucccccuaugccuguccaccacuucgcagaaaacgaccuggcuaccaguacuccuggguuccuucgguugcaagcccuugaccauguuccuaauaaccgagaacaagaucugggggcgcaagagcuggccucuuaacgagggaaucauggccaucgggauugucucgauacugcucagcagcuuacugaaaaacgacguuccccucgcgggaccguuaauugcuggcgggaugcuaaucgccugcuaugugaucuccgggaguuccgccgauuuaagccuugaaaaagccgccgagauauccugggaggaggaggcggaacacucuggaaccagucacaacauccuggucgaggugcaggacgacggcacgaugaaaaucaaggaugaggagcgcgaugacacccucacuauccugcugaaggccacacucuuggcuguaagcggcgucuacccuaugucgauaccggcuacacuuuucgucugguacuucuggcaaaagaagaagcagcggagcggcgugcucugggacacccccucaccccccgaagucgagcgagccguccuugaugacggcaucuaccgcauccugcagaggggguuacuggggcggagccagguggggguugggguguuccaggacggcguguuccacaccauguggcacgucacccgcggggccgugcugauguaccagggcaagcgucuugagccguccugggccagcgugaagaaggaccucaucaguuacggcggcggguggcgcuuccagggaucguggaacacaggcgaggaaguccagguaaucgcuguggaaccaggaaagaauccgaagaacguucagaccaccccuggcaccuucaagacgccagagggcgaagugggcgccaucgcccuggacuucaagcccgggacauccggcagcccgaucgugaaccgggaggguaagaucgucggacuguacgggaacgggguggugacgaccuccggcacauacgugagcgcaaucgcucaggcuaaggcgucgcaggaggggccccucccagaaauugaagacgagguuuucaagaagagaaaccuaaccaucauggauuuacacccgggguccggcaaaacccggcgcuaucucccggcuaucgucagggaagccaucaagcgcaagcugcggacccuuauccuugcacccacacgcguaguggcgagcgagauggccgaagcgcucaaggguaugcccauccgguaccagaccaccgcugugaaguccgagcacacuggccgagagauagucgacuuaaugugccacgccaccuucacuaugcgccuccugucgccgguccgggucccaaauuacaacaugaucaucauggacgaagcccacuucaccgacccugccuccaucgcggcacgcggguacaucagcacccgugucgggaugggggaggccgccgccauauucaugacggcuacgccgcccggcagcguggaggcauucccccagagcaacgccgugauccaggacgaggaacgcgacauacccgagcgcuccuggaacucgggguaugauuggaucacggacuuccccgguaaaaccaucugguuuguucccuccauuaagagcggcaacgacaucgcuaacugccugcgcaagaacgguaagcgugugauucaauuaagccgcaagacguucgacacggaguaucagaaaaccaagaacaaugacugggacuauguggucaccacggacaucagcgaaaugggagcuaacuuucgggccgacagagucauugaccccaggaggugccugaaaccggugauccugaaggacggacccgagcgggucauccuagccggaccgaugccggugaccguggccagugcugcccagcgccggggccggauaggucggaaccagaacaaggagggcgaccaguacgucuacauggggcagcccuuaaauaacgacgaggaccaugcgcacuggacugaagccaagaugcuacuggacaacauaaauacacccgagggaaucaucccggcccuguuugaaccugagcgugagaaguccgcagcaaucgacggugaauaucgucuucgaggcgaagcccgcaagacauuuguggagcucaugagacgaggcgaccugccuguuuggcucagcuacaagguggccucugagggguuccaguacuccgaccggcgcuggugcuucgacggcgagcguaauaaccagguccucgaggagaacauggacgucgagauuuggacaaaagagggugagcgcaaaaaacugcguccccgcuggcuggacgcccggaccuacucugacccgcucgcccuacgggaguucaaagaguucgcggcgggucggcgcagcaucuccggcgaccugauauuggagauagggaaauugccacaacaccugacccucagggcccagaacgcgcuagacaaccuugugaugcuccacaacuccgagcagggcggaaaagcauaccgccaugcgauggaggagcugccagacaccauagagacacugaugcuccuggcccugaucgccgugcucaccgggggggucacccuauucuuccuguccggaaagggccucgggaaaacaucuauuggccugcucugcguuauggccuccagcgcacuucuguggauggcaaauguggaaccccauuggaucgcugccuccaucauccuugaauuuuuccucaugguccugcugaucccggagccugaccggcagcgcacuccgcaggacaaucagcucgccuacgugguuauagggcuacuguuuaugauccuaacuguugcggccaacgagaugggacugcucgagaccacgaagaaggaccucgggauaggccacguggcagcggagaaccaccaccacgccacaaugcuugacguggaucugcggccggcgucggcauggacacucuacgccgucgcaacuaccgugaucacacccaugaugcgucauacaauagaaaacaccaccgcgaauaucucccugacggcgauugccaaccaggccgccauacugaugggccuggauaagggguggcccaucagcaaaauggacaucggcgugcccuugcuggcucucgggugcuacucccaagucaacccacucacacuaaccgcggccgugcucaugcuaguggcccauuacgcgaucaucggccccgggcugcaggcgaaggccacccgugaggcccaaaagcgcacagcugccgggauaaugaaaaaucccaccgucgacgggaucguggcgaucgaucucgacccugucguuuacgacgccaaguucgagaagcaguugggccagauuaugcugcucauacuaugcacaagccagaucuuguugaugcgcaccacgugggcccugugcgaguccaucacccuggccaccggcccgcucaccacccugugggaggggagcccagggaaauuuuggaacaccaccaucgccguguccauggcuaacaucuuucggggcaguuaucucgcuggggccggccucgccuucucgcugaugaagucgcuagggggcggucgucgcggcaccggugcccagggugagacgcucggcgaaaaauggaaacgacaguuaaaccagcugucuaagagcgaguuuaacacauauaagcgaagcgggaucauggaaguagaccgcuccgaagcuaaggaagguuugaagaggggggagaccaccaagcacgccgugagucgcggcacggccaaguuacggugguucguggaacguaacuuaguuaagcccgagggcaaagucaucgaccuggggugcggccgcggcggguggucguacuauugcgccgggcucaagaaagugaccgaaguuaaaggguacaccaagggcggaccgggccacgaggaacccauccccauggccacauauggguggaaccuggucaagcuucacagugggaaggacguguucuucacuccgccugagaagugcgacacgcuacugugcgacaucggggaguccucacccaaccccacgaucgaggagggccguacacuccggguuuuaaagaugguggagcccuggcuccgcggcaaucaauucugcauuaagauccuaaaccccuacaugccaaguguggucgaaacccuugaacagaugcaacggaagcacggaggcaugcugguccgcaacccccugagccggaacaguacgcacgagauguacuggguaucaugcgggaccggaaacaucguaucagcagucaacaugacuagcaggauguugcugaaccgcuuuacgauggcccaccgcaagcccacuuacgagaaggacguggaccugggggccgggaccagacaugucgccgucgaacccgaaguugcgaaucuagacaucaucggccagcggauugagaacauuaagaacgagcauaaguccaccuggcacuaugacgaagauaacccguacaagacaugggccuaucacgggucauacgaggugaagccguccggcagcgccuccagcauggugaacggggugguucgccugcugaccaagcccugggacgugaucccgauggugacccagauagcuaugaccgacaccacgccguucggacagcagcgggucuucaaagagaagguggacacuaggacuccccgggccaaacguggcaccgcccagaucauggaggugaccgccaaguggcucuggggguucuuaucccggaacaagaagccccgaaucugcacucgggaggaauucacgaagaagguccgcucaaacgcggcgaucggcgccguguucguggaugagaaccaguggaauagcgcgaaggaagcagucgaggacgaacgguucugggaccuggugcaccgcgaacgggagcuccauaagcaggggaagugcgcgaccugcguguacaacaugauggguaagcgcgagaagaagcugggggaauucggaaaggccaaggggagucgggcuaucugguacauguggcugggagcccgcuuccucgaguucgaggcacuaggcuuuaugaacgaagaccacugguucucgcgggagaacucucuuagcgggguggaaggcgaggggcuccauaagcugggcuauauacuaagggauaucaguaagaucccgggcggaaauauguacgcagaugacacggccggaugggacacacggauuacagaggacgacuugcagaaugaggcgaagaucacggacauaauggagccggagcacgcucuguuagccaccagcaucuuuaagcuaaccuaccagaauaagguugugcgaguccagcggccugccaagaacggcaacgugauggacgucaucucucgccgugaucagcggggauccggccaaguugggaccuacgggcucaacaccuuuaccaacauggagguucagcugauccgacagauggaguccgaaggcaucuuuuugcccagcgagcuagagaccccgaaccuggccgaacgggugcucgacuggcucgagaaacauggcgccgagcgccugaagcguauggccaucucuggggacgauugcgucgugaagcccauagacgaccgguucgccacggcccucauagcccuaaacgacaugggcaaaguccggaaggacauaccccagugggaacccaguaagggauggaaugacuggcaacaggucccguucugcucgcaccauuuccaccagcuaaucaugaaggacggucgcgagaucgugguacccugucggaaccaagacgagcucgucgggcgcgcgcgcgugucucagggggccggauggucccugcgugagaccgccugucugggcaagagcuacgcgcagauguggcaacucauguacuuccaccggcgcgaucugcggcuagcggcgaacgcaaucuguuccgcagugcccgucgacuggguccccacgagccguacuacuugguccauccacgcucaccaccaguggaugaccaccgaggauaugcuuagcguauggaaccggguauggaucgaggagaacccauggauggaagauaaaacgcacgucagcucuugggaggaagugcccuaccuggggaaacgcgaggaucaguggugcggcagccugaucggguugaccgcccgcgcaaccugggccaccaacauccaagucgccaucaaccaggugcgccgccugauaggcaacgagaacuaucuggacuacaugacgagcaugaagcgguucaagaacgagagcgaccccgaaggggcucugugguga

SEQ ID NO: 23999 - RNA, 9879 nt, Artificial Sequence
  derived and/or modified CDS sequence (opt11) from DENV-1__FJ687426__SS-prME
agcgugaccaugcugcucaugcugaugcccaccgcccuagccuuccacuuaaccacgagaggcggggaaccacacaugaucgucaguaagcaggagcgcggaaagucgcuacuguucaagaccagcgcgggggugaacaugugcacccugaucgcaauggaccuaggcgaacugugcgaggauacuaugacguauaagugcccccgcaucaccgaggccgagcccgacgacgucgacugcuggugcaacgccaccgauaccuggguaacuuacgggaccugcagccagaccggcgagcaccggcgcgauaagaggucgguggcacucgcgccucacgugggccuggggcuggagacucgcacugagaccuggaugucauccgagggugccuggaagcagauccagagggucgagaccugggcacuccgacaccccggguuuacggugaucgcguuauuccuggcgcacgccauuggcaccucuaucacccagaaggggaucaucuucauacuccugaugcuagugacccccuccauggccaugcggugcgucgguaucgggucccgcgacuuuguggaggggcucuccggcgccaccuggguggaugucguccuggagcacgggagcugcgugaccacaauggccaaggacaagccuacccuggacaucgagcuacugaagacggaggucaccaaccccgcggugcuccggaagcugugcauugaggccaagauauccaacacaaccacggacucccgcugcccgacacagggcgaagccacccugguggaggagcaggacgccaacuuuguaugccggcgcacuuucguggaccggggcugggggaauggcugcggccuguuugggaaggggucgcucuugacgugcgcgaaguucaaaugugugaccaaacuggagggcaagaucguccaguacgagaaccuaaaguacucugugaucgugaccguccacaccggcgaccagcaccagguggguaacgaguccaccgagcacggcacgaccgcgaccaucacgccccaggccccaacgacagaaauccaguugaccgacuacggggcccugacucucgacugcagcccccgcacgggccuggacuuuaacgagaugguccugcucaccaugaaagagaagucaugguuaguccacaagcaaugguuccuggaccucccccugcccuggacgucuggggccagcaccucccaggagacauggaaucggcaggaccuguuggugacauucaagaccgcccacgcaaagaagcaagagguuguggugcuggggagccaggagggcgccaugcacaccgcccugacgggggccacggagauccaaacuuccggcaccacgaccaucuuugccgggcaccucaagugucgccugaaaauggacaaacugacccucaagggcaugucguacguuaugugcaccggguccuuuaagcuggagaaagagguggcggagacgcagcauggaacagugcuggugcaaaucaaguaugagggcaccgacgcccccugcaagauccccuucagcacccaggaugagaagggggugacacagaauggccggcugaucaccgccaauccgaucgugaccgacaaggagaagccugucaacaucgaggccgagccgcccuucggcgagucuuacaucgugaucggcgccggcgagaaggcccucaaacuaagcugguucaaaaagggaucauccauuggcaagauguuugaggccaccgcccgaggagcccggagaauggcgauccugggugacacggcaugggacuuugggagcauugguggcguguucaccagcgucgggaagcucgugcaccagaucuuuggcaccgccuacggggugcuuuucuccggcgucuccuggaccaugaagaucggcaucggggugcugcucacguggcugggccugaauucucguagcacuagucucagcaugaccuguaucgccguggggcuggucacacucuaucucggcguaaugguacaggccgacuccgggugugugauaaacuggaagggccgagagcugaaaugugggagcggcauuuucgugacaaaugaggugcacaccuggaccgagcaguacaaguuccaggcggacagcccgaagcgccuguccgccgccauaggcaaggccugggaggagggggucugcggcauccgcuccgccacccgccuagagaauauuauguggaaacagauaagcaaugagcuaaaccauauccugcucgagaacgacaugaaguucaccgucguagucggggacguggcaggaauccuggcccaggggaagaagaugauccggccccagcccauggaguacaaguauagcuggaaguccugggggaaggccaagauuaucggcgccgacgugcagaacagcaccuucaucaucgacggucccaacaccccggagugcccugaugaccagagagcguggaacauaugggaagucgaggacuacggguucggaaucuuuaccaccaacaucuggcugaagcuccgggauuccuauacccaggugugcgaccaccgucugaugagcgccgccaucaaggacuccaaagcaguucaugccgacaugggcuacuggauagagagugagaaaaacgagaccuggaagcuggcgggcgcguccuucaucgaagucaagaccugcaucuggccuaagagccacaccuuauggagcaauggggugcuggagagcgagaugauaauacccaagaucuacggugggccgauaucccagcacaauuaccggcccggcuacuucacgcagacugcugggcccuggcaccuggguaaguuggagcuggacuucgaccugugcgagggcaccacaguggucgucgacgagcauugcgggaaccgcggcccgucucuacggacgaccaccgugaccgggaagaucauccacgaauggugcugcagauccugcacgcugccgccccugcgauuccgcggcgaggacggcugcugguacggcauggagauccggcccgucaaagagaaagaagagaaccucguuaaguccauggugagcgccggcuccggggaggucgacagcuucucacugggacugcucugcaucuccaucaugaucgaggaggugaugcgcucccguuggucgcgcaagaugcugaugaccgggacccucgccguguuuuuucuccugauaaugggccaacugaccuggaacgaccuaauccggcugugcaucauggucggggcaaacgccuccgaccgaaugggcaugggaacgaccuacuuggcccugauggcgaccuuuaagaugcgcccgauguucgccguggggcugcuguuccggagauuaaccagccgggaaguucugcugcucacgauaggccugucccugguagcgagcguggaacugcccaacucccuggaggagcugggggacggucuagccaugggcaucaugauccugaagcugcucaccgauuuccagagccaccaguugugggccacacugcuaucccugaccuuuaucaagacgacacugucacuccauuaugccuggaaaaccauggcgaugguccucucgaucgucagccuguucccccucugccuguccacgacgagccagaagacgaccuggcugccugugcuccuggggucccugggcugcaaaccgcucaccauguucuuaauugcagagaacaaaaucuggggacguaagucuuggccccugaacgaggguaucauggcagucgggaucguaagcauccuccuguccagccugcuaaaaaacgacgugccccuggcagguccccugaucgcaggcgggaugcucaucgcgugcuacgucaucuccggcucauccgcagaccuaagccuggagaaggccgccgaggucucgugggaggaagaggccgagcacagcggggcgagucacaacauccucguggaggugcaggacgauggcacaaugaagaucaaggacgaggagagggacgacacccugacaauuuuauugaaagcaacccugcuggccgugucagggguguacccgcucucaauucccgccacccuguuugugugguauuucuggcagaagaagaagcagcgcagcggcguacugugggauacgccuagcccgccagaaguggaacgggccguacuugaugacggcauauacaggaucaugcagcgggggcuccugggccgcagccaggugggggucggugucuuccaggaaaacgucuuccauaccauguggcacgucacucgcggcgccguccugauguaccagggcaagcgccucgagcccuccugggccagcgugaagaaggaccugauauccuacggagggggcuggcggcugcaggggucauggaacaccggcgaagaggugcaaguaaucgccguggaacccgggaagaauccgaagaacgugcagacggccccgggcaccuucaagacgcccgaaggggaggucggugccauagcgcucgacuuuaaacccgguacauccgggagccccaucgugaaccgcgagggaaagauugugggucuguacgggaacggagucgugacuaccucugggaccuacguguccgcuaucgcccaggccaaggccagucaggagggaccgcuucccgagaucgaggacgagguuuuccggaaacgcaaucucaccauuauggaccugcaccccggguccggcaagacgcggcguuaccugccggccaucguacgcgaggccaucaaacggaagcuccgaacccugauacuggccccaacacgcguggucgccagcgagauggccgaggcucuuaagggcaugcccauccgcuaucagaccacggccgugaaguccgagcacaccgggaaggagaucguggaccuuaugugccacgcuaccuucaccaugcgucuacucagcccgguccgcgugccgaacuacaacaugaucauaauggacgaggcccacuucacagaccccuccagcaucgcggcccggggcuacauaucaacccgcguugguaugggcgaggcagccgcaauuuucaugacugcgacuccgcccgggagcgucgaggcguuuccucaguccaaugccgucauccaggacgaggaacgggacauacccgagcgcagcuggaacucuggcuacgaguggaucacggacuuccccggcaagacugugugguucguccccagcaucaaggccgggaacgacaucgccaacugccugcggaagaacggcaagcgcgugauccagcugucacggaagaccuucgacaccgaauaccagaagacgaagaauaacgacugggacuacgugguaaccaccgacaucagcgagaugggggcaaauuuucgggccgaccgggugaucgacccgcgccgaugccucaagccugugauacugaaagacggucccgagagggucauacuggccggacccaugccagugacugucgccuccgcggcucagcgacggggccggaucggccgcaaucacaacaaagagggcgaccaguacauauacaugggucagccuuugaacaacgacgaggaucacgcccacuggacggaggcgaagaugcuccuagauaacaucaacacgccugaggguaucauccccgcccucuucgagcccgagcgggagaaguccgcggcuaucgacggagaauaccgccugcgaggagaggcccguaagaccuuuguggagcugaugcgcaggggcgaccucccgguguggcuguccuacaaagucgccuccgagggauuucaauacagcgaccggcgcuggugcuucgacggggagcgcaacaaccaggugcucgaggagaacauggacguggagaucuggaccaaggagggggagcgcaagaaguuacgcccacguuggcuggaugcccgcacguacucagacccccuggcgcuucgggaguucaaggaguucgccgccggucgucggagcgucucgggcgacuuaauccuggagauuggcaagcucccgcagcaccuuacccagcgcgcccagaacgcgcuggacaaccucgugaugcugcacaacagcgagcagggcgggcgagccuaucgccaugcuauggaggaguuaccagacaccaucgagacucucaugcuguuagcccucaucgccgugcugaccggggggguaacccuguucuuuuuauccggcaagggccugggcaagaccagcaucgggcuccucugcguuauggcguccuccgugcugcuguggauggcaucuguagaaccccacuggaucgcagccagcaucauccucgaguuuuuccucauggugcugcucauacccgaaccagaccggcagcgcaccccccaagacaaccagcuggcguacguggucaucggucugcucuucaugauccucacuguggcugccaaugagauggggcugcucgagacgacaaaaaaagaccugggaauagggcacguggcugucgagaaccaccaccacgcggcaaugcuggauguagaucuccaccccgcguccgccuggaccuuauaugcaguggccaccacgaucauuaccccgaugaugcggcacaccaucgagaacacuacugccaacaucagccuaaccgccauagccaaccaggcugccauccucaugggccuggacaaaggcuggcccaucuccaagauggacaucggggucccgcucuuggcgcugggguguuacagccaggugaacccccugacccucacggccgcugugcuaaugcuuguagcccacuaugccaucaucgggccgggccuccaggcgaaagcuacacgcgaggcucagaaacggacagccgccgggaucaugaagaacccgacuaucgacggcauaguugcgaucgaccuagacccugugguuuacgacgcuaaauucgaaaaacaacugggccaaauaaugcuccugauccugugcaccucacagauccuccuaaugcggacgaccugggcgcugugcgagagcauuacguuagccaccgggccgcugacgacccuaugggaaggcucuccggguaaauucuggaauaccaccaucgccguuagcauggcgaauaucuuccgcggcuccuacuuggccggcgccgggcuggccuucucccugaugaagucccuuggcgggggccggaggggcacgggcgcgcagggcgagacccugggggagaaguggaagaggcaacucaaccagcucucgaagagcgaguucaacaccuacaagcgcaguggaaucauggagguagaccggagcgaggcuaaggagggguuaaagagaggugagacaacgaaacacgcaguaucccgggggaccgccaagcugcgcugguuuguggagcggaauuuagugaagccggagggcaaggucaucgaccucggaugcggccgcggcggguggagcuacuacugcgccggacugaagaaagugacggaagugaagggguauacaaagggcggucccggccacgaagagcccaucccgauggcgacauacggcuggaaccuggucaagcuccauucagggaaagacguguucuucaucccacccgagaaaugcgacacccuuuugugcgacaucggcgaauccuccccgaacccgacgaucgaggaggggcggacgcuccggguacuuaagauggucgagcccuggcugcggggcaaccaguuuugcauuaagauacucaacccauauaugccuagcguggucgagacgcuggagcagaugcagcgcaagcauggcgggaugcucguccggaauccguugucccgcaacagcacccacgaaauguacuggguuuccugcggaaccgggaacaucgugagcgccgucaauaugaccucccggaugcugcugaaccgcuucaccauggcccaccggaagcccacguacgagagagauguagaucucggcgccgguacccgccacguggcugucgagcccgagguggcuaaucuggacauaaucgggcagcggauugagaacauaaaacaugaacacaaaucaacguggcauuacgacgaagacaaccccuacaagaccugggccuaccacggcuccuacgagguaaagccgagcgggucagcuagcagcauggucaacggcguggugaaacuguuaacgaagcccugggaugugaucccuaugguaacccagaucgccaugaccgacacgacgcccuuugggcagcagcgggucuucaaagagaagguggauacacggaccccuaaggccaagcgggguaccgcgcagaucauggaggugaccgcaaaguggcucuggggcuuccugucccggaacaagaagccgcgcauaugcacccgggaggaguucacgcgcaagguccggagcaacgccgccaucggcgcgguguuuguggacgagaaucaguggaacucugcaaaagaggccgucgaggaugaucgcuucugggaccucgugcaccgagagagggagcugcacaagcagggcaagugcgcgaccuguguguacaacaugauggguaagcgggagaaaaaguuaggcgaguucgguaaggccaaggggagucgcgcgaucugguacauguggcucggggcccgguuucuggaguucgaggcccugggguucaugaaugaggaccauugguucucccgcgagaacagccucuccggcgucgaaggggagggccugcauaaauugggguauauccuuagagacaucaguaaaauccccggugggaacauguacgccgaugacacggccgggugggacaccaggauaacggaggacgaccugcagaacgaggcgaagaucacugacauuauggaaccggagcacgcccuacucgccaaguccauauucaagcugacguaccagaauaagguugugcgggugcagcgccccgccaagaauggcaccgugauggacgugauaagccggcgcgaucagcgcgguuccggccaggugggcacguacggccugaacaccuucacgaacauggaggcccagcucauccggcagauggagagcgagggaaucuucucccccaacgaguuagagacgccaaaucuggccgagcgagugcucgacuggcuggagaaguacgggguggaacgucuuaagcgcauggccaucagcggcgaugacugcgucgugaagccgauugacgacagauucgccaccgcccucacagcucugaacgacauggggaaggugcgcaaagauauuccccagugggagcccuccaagggcuggaacgacuggcagcaggucccuuucuguagccaccacuuccaccagcugaucaugaaggacggccgggagaucgugguaccgugcagaaaccaggacgagcuggucggucgggcgagagucucccagggugcaggguggucucugcgggagacggccugccuuggcaagagcuacgcccagauguggcaacuuauguacuuucacagacgugaccugcgcuuggcggccaacgccaucugcuccgccgugcccgucgacugggugccuaccagccguaccaccugguccauccaugcccaccaccaguggaugacgaccgaggacaugcucagcgucuggaaccgcguuuggaucgaggagaaccccuggauggaggacaagacccggaucuccagcugggaggaugugccguaucuuggcaagcgcgaggaccaguggugcggaucccugaucggucucaccgcgagggccacgugggccacaaacauccagguugcgaucaaccagguccgcagauuaaucggaaaugagaacuacagugacuacaugacuucaaugaagcgcuucaaaaaugaguccgagcccgagggcgcccuaugguga

SEQ ID NO: 24000 - RNA, 9879 nt, Artificial Sequence
  derived and/or modified CDS sequence (opt11) from DENV-1__FJ687428__SS-prME
ucugugacaaugcuccucauguuaaugcccaccgcgcuggcauuccaccucacaacgcggggcggggagccgcauaugaucgucaguaagcaggaacggggcaagagccuguuguucaagaccagcgcgggggugaauauguguacuuugaucgccauggaccuaggggaacugugcgaggacacuaugaccuacaagugcccccgaauaacggaggccgaaccugacgacguggacuguuggugcaacgcgaccgacacguggguaacauacgggaccugcagccagaccggcgagcaccggcgggacaagcgaagcguagcacucgcgccucauguaggccugggguuagagacgcgcaccgagaccuggaugagcuccgagggcgccuggaagcagauccagcggguggagaccugggcccuccgccacccgggguuuacggugaucgcccucuuccuggcgcacgcgaucggcaccagcaucacccagaaagggaucaucuucauccucuugauguuggugacccccuccauggcgaugcggugcgucggcaucggcagccgagauuuuguagaagguuuguccggugccacuuggguugacguggugcuugagcacggcucgugcgugaccaccauggcaaaagacaaacccacccucgacaucgagcuccugaaaacggaggugaccaaccccgcgguucucaggaagcucugcaucgaggccaagaucaguaacacuacaacggacagucgcugcccgacccagggcgaggcuacccucgucgaagaacaagacgccaacuucgucugccggcggaccuucguggaucggggcugggggaacggcugugggcuguucggcaaggggucccuccugacgugugccaaauuuaaaugcgugaccaagcuggaaggaaaaaucguccaguacgaaaaccuuaaguacagcgugaucgugaccguacacaccggcgaucagcaccagguagggaacgagucgacggagcacggcaccacugcuaccaucacgccgcaggcccccacaaccgaaauucagcuuaccgacuacggggcccuaacccucgacugcucaccccggaccggccuggacuucaacgagaugguccugcucaccaugaaggagaaauccugguuggugcacaaacagugguuccuggaccucccgcugcccuggaccagcggggccagcaccagucaggagacguggaaccggcaggaccugcuagugaccuucaagaccgcucacgcgaagaaacaggaggucgugguguugggcucucaggagggcgccaugcauacugcucugacgggcgcgaccgaaauccagaccuccgguaccacgaccaucuucgcugggcaccucaagugucggcugaagauggacaagcugacucucaagggcaugagcuacgucaugugcaccggauccuucaaguuagagaaggagguggcggagacgcaacauggcaccguacugguucagauuaaguaugaagggaccgaugcaccgugcaagauccccuucucgacccaggacgagaagggggugacucagaacggucggcugaucacagcgaacccgaucgugaccgauaaggagaaacccgucaacaucgaggcagagccgcccuucggggaguccuacaucgugaucggcgcgggcgagaaggcacucaagcugagcugguucaagaagggaucaagcaucgggaagauguucgaggccaccgcccgcggugcccgucgcauggccauccugggcgacacggccugggacuuuggguccaucggcggcguauucaccucaguuggaaagcucguacaccaaaucuucggcaccgccuauggggugcuguucuccggcguaagcuggacgaugaagauuggaaucgguguauugcuuacgugguugggccugaacagucguagcaccucccuuaguaugacuuguaucgcugucgggcuggugacucuauaccuaggcgugauggugcaggccgacuccgggugcgucaucaauuggaagggccgggagcuuaagugcgggagcggcaucuucguuacgaaugaggugcacaccuggaccgagcaguacaaauuccaagcugacagcccgaagcgccugucagcugccaucggcaaggccugggaggaggggguuugcggcauccggagcgcuacccgccucgagaacauaauguggaagcagauaucuaacgagcugaaccacaucuuacucgagaacgacaugaaauuuacagucguggucggagacguggcggggauccuggcccaggggaagaagaugaucaggccccagcccauggaguacaaguauucauggaaaagcuggggcaaggcaaagaucaucggcgcugacguccagaacagcacguuuaucauagacggcccuaacaccccggaaugccccgaugaccagcgugcguggaauauaugggaggucgaggacuacggguuugguaucuuuaccaccaacauauggcucaagcugcgggacuccuauacccagguaugcgaucaccgccugaugucugccgccauaaaggauuccaaggcgguccacgcagauaugggcuacuggauugagagcgagaaaaacgagacguggaaacuggcgggcgccucuuucaucgaggugaaaaccuguaucuggcccaagucacauacccucugguccaacggcgugcuggaauccgagaugauaauccccaagaucuauggaggcccuaucucccagcacaacuaccggcccggcuacuucacgcagaccgccgggccauggcacuuaggaaagcucgagcuugacuucgaccugugcgaggggaccaccguggucguggacgagcauugcgggaaccgugggccgucgcuucggacgaccacugugaccgguaagaucauccacgagugguguugucgcucaugcacguugccaccccugagauuccgcggcgaggaugggugcugguacggcauggagauccggcccgucaaggaaaaggaggagaaccuugugaagucuauggugagcgccggcuccggggaaguagacagcuucucccuuggcuuauuguguauuagcaucaugaucgaagaggucaugcggucucgguggagccgcaagaugcugaugaccgggacgcucgccguguucuuccucuuaaucaugggccagcugacauggaaugacuuaauccgucucuguaucauggucggagccaacgccuccgacagaaugggcauggguacgacauaucuggcccuaauggccacauucaagaugcgccccauguucgcgguggggcuguuauuucgccggcucacgagccgggaggugcugcuccugacaauuggccugucccugguagcgagcguagagcuccccaacucccuggaggagcucggagacggccucgccaugggaaucaugauccugaaguuacucacagacuuccagagccaucagcugugggccacacugcucucacugacguuuaucaagacgacgcuuucgcuccacuacgcguggaaaaccauggcgaugguccuguccaucgugagccuguuuccucucugccuguccacgacaagccagaagaccacuuggcuucccgugcugcugggguccuuaggcuguaagccgcucaccauguuccugaucgcagagaauaagaucugggggcgcaagagcuggccccuaaacgaggguaucauggccgucgggaucgugagcauauugcucaguucucugcugaagaaugacgugcccuuggcgggaccccucauagcuggcggcaugcuaauugcgugcuaugucaucuccggcagcagugccgaucugagccuugagaaggccgccgagguuuccugggaagaggaggcagagcacagcggggccucccacaacauccucguggagguccaggacgacggcacgaugaagaucaaggacgaggagcgggaugacacccugaccauucugcucaaggcuacacugcuggccgucagcggaguauacccacucuccauucccgccacccuguucgucugguacuucuggcagaagaagaaacagcgcagcggcguucuaugggacacgcccagcccuccagagguggagcgagccgugcuggacgauggcaucuaccgcaucaugcagcgggggcuccugggaaggucacaggugggcguuggggucuuucaggaaaacguuuuucauaccauguggcacgugacccgcggggccguucugauguaccagggcaaacguuuagagcccucgugggcaagcguuaagaaagaccugauuuccuacggcggaggguggcggcugcaggggagcuggaauaccggcgaagaggugcagguuaucgccguugagccggggaagaaccccaagaacgugcagacugcccccggcaccuucaagacucccgaaggcgaaguaggugcuaucgcgcucgacuuuaagccgggcacuuccggaagccccaucgugaaccgcgagggcaagauagugggccuguacgggaauggcgucgugacgacaagcgggaccuacguuuccgccauagcccaggcaaaggcuucccaagagggcccgcugcccgagaucgaagacgaggucuuucggaagcggaaucuaaccaucauggaccugcacccuggcuccggcaagacgcggcgcuaccugccggccauugugcgggaggccaucaaacgcaagcuccgcacccugauccuggcccccaccagaguggucgccagcgagauggcggaagcgcucaagggaaugcccauccgcuaccaaaccacugccguuaagucggagcacaccgggaaggagaucguggaccucaugugccacgccaccuucacaaugagacugcucagccccguacgagugccuaacuauaacaugaucaucauggacgaagcgcacuucacggacccguccagcaucgcggccagaggauauauauccacccgcguugggaugggcgaagcggccgcgaucuucaugaccgccaccccucccgggagcgucgaggccuucccccaguccaacgcggugauccaggacgaagaacgggacaucccggagcgcagcuggaacuccggcuacgaauggauaacggacuuccccgguaagacagugugguuugucccuucgaucaaggccgggaacgauauagcgaacugccugcggaagaacgguaagcgaguuauucagcugucccggaaaaccuucgacaccgaauaccagaaaacgaagaauaacgauugggacuacgugguuacaacggacaucagcgagaugggggcaaacuuccgcgccgaccgggugaucgacccgcggaggugucucaagccugugauccuuaaggacggccccgaacgcgucauccuugccgggcccaugcccguuaccgucgcuuccgcggcccagcggagaggccggauuggaaggaaccacaacaaggaaggggaccaguacaucuacaugggccagccccucaacaacgacgaggaccacgcccauuggaccgaggccaagaugcugcuggacaacaucaacaccccugaagggauaaucccagcccuauuugaaccugagcgggagaaguccgcggcaaucgacggcgaguaccgccugagaggggaggccaggaaaaccuuuguagagcugaugcgcagaggggaccugccagucuggcuguccuauaaggucgccagcgaggguuuucaguacagcgaccgccgguggugcuuugacggcgagcgcaauaaucaaguguuagaggagaauauggacguggagauuuggaccaaggagggcgagaggaaaaagcuccgccccagauggcuggaugcccgaacguacuccgacccucuggcguuacgggaguucaaggaguucgcagccgggcgccgguccgucucuggcgaccuuauccuggagauuggcaaacuaccgcaacaucugacucagcgcgcgcagaacgcgcuggacaaccucguaaugcugcacaauagcgaacaaggcgggcgggccuaccgucacgcuauggaggagcugcccgacaccauugaaacccuuaugcugcuggcccucaucgcggugcucaccgggggagucacccuuuucuuccuguccgggaaaggccuggggaagaccuccaucgggcugcucugcgucauggcguccuccguucugcuguggauggcauccguagagccccacuggaucgccgccagcaucauacuugaguuuuuccugauggugcugcucauccccgagccggaccggcaacgcacgccgcaggauaaucaauuggccuacguugucauuggucuccuguucaugauccugacaguggcagccaaugagauggggcugcucgagacgaccaagaaggaccuggggauagggcauguggccguugagaaccaccaccacgccgcaaugcuggacguggaucuccauccggcgagcgccuggacccuguacgcaguggccacaacgaucaucacaccgaugaugcggcacacaaucgaaaacaccacggcgaacaucagccuaacggcgaucgccaaccaagccgccauacucaugggccuugacaagggguggcccauauccaagauggacaucggggucccacugcucgcguuggggugcuacagccagguaaacccccuaacgcucacggcggcugugcugaugcuagucgcccauuacgccaucaucgggccuggcuuacaggcaaaggccacccgcgaggcccagaagcggacugcggcugggaucaugaaaaaccccaccauugacggcaucguagcgaucgaccuggacccuguugucuacgacgccaaguucgagaagcagcucggccagaucaugcugcugauccugugcaccucccaaauccugcuaaugcgcacgacaugggcucucugcgaaagcaucacccucgccaccggcccccuaacgacccugugggagggcucgccggggaaauuuuggaacaccacaaucgccguuaguauggcgaauaucuuccgaggcuccuauuuggccggcgcugggcucgccuuuucgcuuaugaaaagccucggcgggggccgacgcgggacgggggcacagggagagacgcugggggagaaauggaagcggcaguuaaaccagcucucaaaaagcgaguucaacaccuauaaacgcuccggaauuauggaggucgaccgguccgaggcgaaggagggguugaagcgcggcgagaccacgaaacaugcugucagucgggggacagccaagcugcgcugguucguggagcgcaaucuggugaaacccgaggguaagguaaucgaccucggcugcggacggggcggcuggagcuacuacugugccggacugaagaaggugaccgaagugaagggguacacaaaagggggacccgggcacgaggagccaauuccgauggccacguauggcuggaaccuugucaagcuccacucagggaaggacguguucuuuauaccacccgagaagugcgacacccuccugugcgacauaggcgaaucaagcccuaacccgaccaucgaggaagggcggacacucagaguccuaaagauggucgagcccuggcugcggggcaaucaguucugcauuaagauacucaauccuuauaugcccagcguaguggagacgcucgaacagaugcaacgcaagcacggcggaaugcugguccggaacccgcucuccaggaacucuacccaugagauguacugggucucuugcggcaccgggaacaucgucagcgccguaaauaugaccucccggaugcugcugaaccgcuucaccauggcccaccggaagcccacguacgagcgcgacgucgaccucggcgcgggaaccaggcauguggccguagagccagaaguggcgaaccuggacauaaucggacaacgcaucgaaagcaucaagcacgagcacaaguccacauggcauuacgacgaagacaaccccuacaagaccugggccuaccacggaagcuacgaagugaagcccuccgggagcgccucauccauggucaacggcguggucaagcuacucacgaagcccugggacgugauccccauggugacgcagauagccaugacagacaccacccccuucgggcagcaacgcguuuucaaagaaaagguggacacacggacaccgaaggccaagcgcggcaccgcucaaaucauggaggugacugccaagugguuguggggcuuccugagcagaaacaagaagccacgcaucugcacccgggaggaguuuacacggaagguacggucuaaugccgcuaucggagcgguguucguugaugaaaaccaguggaauagugcuaaggaggcugucgaggacgaccgcuuuugggaccucgugcaccgggagagagaacuccacaagcaggguaagugcgcgaccugcguguacaauaugauggguaagagggaaaagaagcuaggcgaguucgguaaggccaaaggcagccgcgcgauuugguacauguggcugggagcccgcuuccuugaguuugaggcacugggguuuaugaacgaggaccacugguucagccgcgaaaacuccuuauccggcgucgagggggagggccugcacaagcugggguacaucuugcgggacaucaguaagauccccgguggcaauauguacgccgacgauacggcgggcugggacacccgcauaaccgaggacgaccugcagaacgaggccaaaauaacagacaucauggagccggagcacgcacucuuggcuaagagcaucuucaagcugaccuaucaaaacaaaguuguccggguccagcgaccggcuaaaaacggcacggucauggacgugaucucccgcagggaccagcgaggcuccgggcaggucggcaccuauggucuaaacaccuucacuaacauggaggcccagcugauaaggcagauggaaagugaaggcaucuucucccccaaugagcuggagacccccaaccucgcggaacgcguucuugacugguuggagaaauacggaguugagcggcuaaagcgcauggcgaucuccggagacgacugcgucgucaagccaaucgaugaccgguuugccacugcccugaccgccuuaaaugacauggggaaagugcgcaaggauaucccgcagugggaacccagcaaaggcuggaacgacuggcagcaaguccccuucugcucccaucauuuucaccaacucauuaugaaagacggucgggagaucguggugccgugccgcaaccaggaugaacucgugggcagggcgcgcguuagccagggggccgguuggagccuacgcgagacggccugccugggcaaguccuacgcccagauguggcagcucauguacuuccaucguagggauuuacgccuugcugccaacgcgaucugcucagcagugcccgucgacugggugcccacuucucggacuaccuggagcauacacgcccaccaccaguggaugacuacagaggauaugcucuccguauggaaccgcguguggauugaggagaaccccuggauggaggacaaaacccggauuagcuccugggaagacguaccuuaccuggguaagcgagaggaccaguggugugggagcuugaucggucucaccgcccgggccacgugggcgacaaacauacagguggccaucaaccagguccgccgccugaucgggaacgagaacuacuccgacuauaugaccagcaugaaacgguucaagaacgaauccgagcccgagggcgcccugugguga

SEQ ID NO: 24001 - RNA, 9879 nt, Artificial Sequence
  derived and/or modified CDS sequence (opt11) from DENV-1__FJ687429__SS-prME
ucugugaccaugcugcugauguuaaugcccaccgccuuagccuuucaccucaccacuagaggcggggaaccccacaugaucgugagcaagcaggaacgaggcaaaagccugcuauucaagacuagcgccggggugaauaugugcacccucaucgccauggacuuaggcgagcugugcgaggacaccaugaccuacaaauguccccggauaaccgaggccgagccagacgacguugacugcuggugcaaugcaacggauacgugggucaccuauggcacgugcucucagaccggcgagcaccggcgggauaagcgguccguggcccuugcgccccacgugggccugggucuggaaacacggaccgagacauggaugagcuccgagggcgccuggaagcagauucaacgggucgagacgugggcgcugcgccacccuggguuuacggugauugcgcuguuccuggcgcaugcuaucggcaccagcaucacacagaaagggaucaucuucauccuccugaugcuggugaccccaucuauggccaugcggugugucgguaucggcagccgcgacuucguggaggggcucuccggagccacguggauugacguaguguuagagcacgggagcugcaucacgaccauggccaaggacaagcccacgcucgauaucgaacuccugaagacggagguaacaaauccggcggugcuacgcaagcucugcaucgaggccaaaaucucaaacaccaccacugacagccgcuguccgacccagggcgaggccacccuggucgaggagcaggacgccaacuucgugugccggcgcaccuuuguagaccggggcugggggaacggaugcgggcuguucggcaaaggcucccucuugacgugcgccaaguucaagugcgucaccaagcuggagggcaaaaucgugcaguaugagaacuuaaaguacuccguaauugugacaguucacaccggagaucagcaccagguggggaacgagagcacagagcauggcaccacggcuaccaucacgccccaagcacccacgaccgagauccaacugaccgacuauggggcccugacccucgacuguucgccgcggacgggccuggacuucaacgagaugguccugcucaccaugaaggagaagucauggcuggugcacaagcagugguuucuggaccuuccccugcccuggacgucuggcgccucaaccucacaagaaaccuggaaccgacaggaccuacucgucaccuucaagaccgcccacgcgaagaagcaggaagugguaguccuuggcagccaggagggcgccaugcacaccgcccugacgggggccacagagauccagacuuccggcaccacgacaaucuucgcggggcaccucaagugccgccuaaaaauggacaaauuaacccuuaagggcaugagcuacgugaugugcaccggguccuucaaguuagagaaggagguugcagaaacgcagcacgguaccgugcugguccagauaaaauacgaagguaccgacgcccccugcaagauacccuucagcacccaggacgagaagggggugacccagaacggucggcugaucacggccaacccuaucguaacggacaaggagaagccggugaacauagaggccgagccgcccuucggggaguccuauaucguaauaggcgcgggugagaaggcucucaagcugagcugguucaagaaggggagcaguaucgggaagauguucgaggcgacugcgcgcggggcgcggcgcauggcgauccugggcgacaccgcaugggacuucgggagcauuggcggcgucuuuaccagcguggggaagcucgugcaccagauuuucggcaccgccuacgggguccuuuucuccggggugucguggacuaugaagaucgggaucggggugcugcucaccuggcugggguuaaacucccguagcaccuccuuguccaugacguguaucgccguugggcuggugacccuguaucucggcgugaugguacaggcggacuccgguugcgugaucaacuggaagggucgcgagcugaagugcgggagcgguaucuucgugacuaacgagguccacaccuggaccgagcaguacaaguuccaggcugacagcccgaagcgccuguccgccgccaucggcaaggccugggaggagggcguguguggcauucggagcgcgacgcgucucgaaaacaucauguggaaacagaucucgaacgagcugaaccacauccuucucgagaacgacaugaaauucaccgugguagugggggauguggcuggcauccuagcccagggaaagaagaugauccggccccagcccauggaauacaaguauagcuggaagagcuggggcaaagcgaagaucaucggcgcagacguccagaacagcaccuucauaaucgacgggcccaacacaccggagugcccggacgaccagagagcuuggaauaucugggagguggaggauuacggguucggcaucuucacuaccaauaucuggcuaaaacuucgggauuccuacacccaggugugcgaucaccgguuaauguccgccgccaucaaggacuccaaagccguccacgccgacaugggcuacuggauagagagcgagaagaacgagacauggaaauuggcgagagccuccuucaucgaggugaagaccuguaucuggccaaagucgcacacccuaugguccaacggagugcuggaaagcgagaugaucauccccaaaaucuacgggggcccgaucucccagcauaacuaccgcccaggguacuucacacaaaccgccggucccuggcaccuggggaaacucgagcucgacuucgaccugugcgaggggaccaccgucgugguggaugaacauugcggcaaucguggaccgucucuuaggacaaccacugucaccggaaaaauuauucacgaguggugcugccggagcugcacgcugccgccccugcgcuuccgcggggaggacggcugcugguacgggauggaaauccgcccaguuaaggagaaggaggaaaaccuaguaaaguccaugguuagugccggcucaggcgagguggauagcuucagcuuggggcugcuuuguaucaguaucaugaucgaggagguuaugcggucccgcuggucccggaagaugcugaugaccggcaccuuagccgucuucuuccuccucauuauggggcaacugaccuggaacgaccucauucgccucugcauuauggugggcgcuaacgccucagaucgcauggggaugggcacgacuuaccuagcccucauggcuacauucaaaaugagaccaauguucgcagugggucuucuguuucgccggcucacuagcagagagguccugcugcuaacaaucggcuuaucccugguggcgagcguggagcuccccaacucccuggaagagcugggcgacggucucgccaugggcaucaugauccugaagcugcucacggacuuccaaagccaccaacuaugggccacccugcucucacugaccuuuaucaaaacuaccuuuagucugcauuaugcauggaagaccauggcaaugguccucagcauagucagccuguucccccugugccucuccacgacgagccaaaagacgaccuggcuccccguccuguugggaagccugggguguaaaccgcugacgauguuccucaucgccgagaacaagaucuggggccggaagagcuggccccuuaacgagggaauuauggccguaggcaucguaaguauccuguuauccagccugcugaagaaugacgucccccuagccggaccccugaucgcuggcggaaugcugaucgcaugcuacgugaucuccggcagcuccgccgaccucagccuggaaaaggccgccgaggugaguugggaagaggaggccgagcacucaggugcuucacacaacauccuugucgaggugcaagacgauggaacaaugaagaucaaggacgaagagcgcgacgacacccucacaauacugcugaaggccacauuacuggccgugagcggcguauacccgcugaguauccccgccacccucuucgugugguacuucuggcagaagaagaagcagcggagcggugugcugugggacacucccaguccucccgagguugagcgugccguacuagacgacggcaucuaccggaucaugcagcgcggccuguuagggagaucccaggugggcgucgggguguuccaggagaacguguuccacacgauguggcacguuacgcgcggugcggugcugauguaccaagggaaacggcucgagcccuccugggccagcgugaagaaggaccucaucuccuacggcggcggguggaggcugcagggcagcuggaacaccggggaggagguccaggugaucgccguggagcccggcaagaauccgaagaauguucagacggcacccgggaccuucaagacccccgaaggcgaggugggcgccaucgcgcuggacuuuaagcccgggaccucaggcagccccaucgugaaccgggaggggaaaauugucggccucuacggcaacgggguagugacgaccagcggaaccuacgucagcgccaucgcccaggccaaggcgagccaggaggggccgcuccccgaaauugaggacgagguguuucgcaagcggaaccugacgaucauggaccuccaccccggguccgggaagacacgccgguaccugcccgccauugugcgagaggccaucaagcggaagcugcgcacccugauccuggcccccacgcgagucguggccucggagauggcggaggcccucaaagggaugcccauuagguaccagacuacggccgugaaauccgagcacaccggcaaggagaucguugaccucaugugucacgccaccuucaccaugaggcugcugucgcccgugcgugugccgaacuacaacaugaucaucauggaugaggcccacuuuacggaccccuccagcaucgccgcccgaggguacaucuccacccgggucggcaugggggaggccgccgccaucuucaugaccgcuaccccgcccggcagcguagaagccuucccucaguccaacgccgugauccaggacgaggagcgcgacauuccggagcgguccuggaacuccggguacgaguggauaacggacuuccccggcaagaccgucugguucgugcccagcaucaaggcuggcaaugacaucgcuaacugccuccgcaagaacggcaagcgugugauccagcugagucgcaaaaccuucgacaccgaguaccagaagacgaagaacaaugacugggacuacguagugaccacugacaucucggagaugggagccaacuuccgggccgaccgcguaaucgacccgcggcgcugccugaaacccguuaucuuaaaggacggacccgagcgagucauccuggccggccccaugccagugacggucgccuccgcggcccagagacgggggcgcaucggccgcaaccacaacaaagagggcgaucaguacaucuauauggggcagccucugaacaacgaugaggaucacgcccauuggaccgaagccaagaugcuccuggacaacaucaacacccccgagggcaucauaccagccuuguuugagccggagcgcgagaaguccgcggccauugacggagaguacaggcuccggggcgaggcccgcaagaccuucgucgagcuuaugcggcgcggcgaccugcccgucuggcuuuccuacaagguggccagugaaggcuuccaauacucugaccgacgcuggugcuucgacggcgagcgcaauaaccaggugcuggaggagaacauggacgucgagaucuggaccaaggagggggagaggaaaaaguugcgacccagguggcucgaugcccggacguacucagacccccuggcgcugagggaguucaaggaauucgccgccggacggcgcagcguauccggggaccucauacuggagaucggaaaguuaccgcagcaccucacucagcgggcgcagaacgcgcuggacaaccuggugaugcuccauaacagcgaacagggcgggcgcgcguaccggcacgcaauggaggagcuacccgacaccaucgaaacacucaugcucuuagcccugauagccgugcucacgggaggggugacccuguucuuccuguccggaaaggggcucgggaagaccagcaucggccugcuguguguaauggcguccagcguccuucuguggauggccuccgucgagccccacuggaucgccgccucuauuauccuggaguucuuucucauggugcugcugauccccgagccagaucgccaacggacgccccaggacaaccagcucgccuacgucgugaucggguuacuguucaugauccucaccguggccgccaacgagaugggucuccuggaaacgaccaagaaggaucuagggauaggccacgucgccguggagaaccaccaccacgccgccaugcuggacguagaccugcaccccgcguccgcauggacccucuacgccgucgccaccacgauaaucacaccgaugaugaggcauaccauugagaacaccacggccaacaucucgcugaccgcaaucgccaaccaagccgcuauccuuauggggcuggacaaaggguggcccauauccaaaauggacaucggcgugccccugcuugcgcucgggugcuacucucaggugaauccccuuacccugaccgcagccguccucauguuaguggcccacuacgccauuaucgggccgggacugcaggccaaagcuacgcgggaggcccaaaagcgcacggccgccgguaucaugaagaaucccaccauugaugggauaguggcgauagacuuggaccccguuguguaugacgcaaaguucgagaagcagcugggccagaucaugcuacucauucugugcaccucccagauccugcucaugcgaacgacgugggcccugugcgagagcaucacucuggccaccgguccccucacgacccugugggagggguccccgggcaaguucuggaacaccaccaucgcagugagcauggcuaacaucuuccguggguccuaccuggccggcgcuggccucgccuucagccugaugaagucucucggcggugggcgccgcggaaccggggcgcagggcgagacgcucggagagaaguggaagcgccagcugaaccagcuuaguaagucugaguucaauacuuacaagcgguccgggauaauggaggucgaccgcagcgaggcgaaggagggccucaagcggggggagacaacgaaacaugccgugucccgcggaaccgccaagcugcggugguucguagagcgaaauuuggugaaacccgaagggaaggugaucgaccugggcugcggacgcggcggguggagcuacuacugcgcugggcucaagaagguuacggaggucaaggguuacacaaaggggggcccugggcacgaggagcccaucccgauggccacguacggguggaaucuggugaaacugcacuccgggaaagauguguucuuuaucccacccgagaagugcgacacccuccuaugcgacauuggggagucauccccuaacccgaccaucgaagagggccgcacacuccggguccucaagaugguggagcccuggcuucgagguaaccaguucugcaucaagauccugaaucccuauaugcccagcgucguagaaaccuuggagcagaugcaacggaagcauggcggcaugcucgugagaaacccacugagccggaacagcacacacgagauguacugggugucuugcgggaccggcaauaucgugagugccgugaacaugaccuccagaaugcuccugaaccgguuuaccauggcccacaggaagcccacguacgaacgcgacguggaccugggggcagguacccggcacgucgccguggagcccgagguggcgaaccucgacaucauaggccagcgaaucgagaacaucaagcacgagcacaaaagcaccuggcacuacgacgaggacaacccguacaagaccugggcuuaccacgggagcuaugaggucaaaccgagcggcuccgcaagcucuauggugaacgggguggucaagcugcugaccaagcccugggaugugauccccauggugacccaaauagccaugaccgacaccacgcccuucggccagcagcggguguucaaggaaaaaguggacacccgcaccccgaaggccaagcgggggaccgcgcagaucauggaggucacugcccgcuggcucuggggcuucuugucgcggaauaagaagccucgcaucugcacccgggaggaguucaccagaaaaguaaggagcaacgccgccaucggcgcgguguuugucgacgagaaccaguggaacuccgccaaggaggccguggaagacgaccgcuucugggaccugguucaccgcgagagggagcuccacaaacaagggaaaugcgcgaccuguguuuauaacaugauggguaagcgggagaagaagcugggggaguucggcaaggcaaaggggucaagagccauuugguauauguggcuaggcgcacgguuccucgaguucgaagcccucggcuucaugaacgaggaccacugguucucccgcgagaacagccuguccgggguggagggugaaggguuacacaagcuggguuacauccugcgugacaucagcaagauccccgguggcaauauguacgcugacgauacggcuggaugggacacccgcaucaccgaagacgaccuccagaaugaggcgaagaucaccgacaucauggagccggaacacgcccuguuagccaaguccaucuucaagcucacuuaccagaacaagguuguccgugugcagcgccccgcgaaaaacggaacugucauggacgucaucagccgccgggaccaaaggggcuccggccaaguggggaccuacggucuuaacaccuucacgaacauggaggcccagcucauccgucagauggaguccgagggcaucuucucccccaacgagcucgagaccccaaaccuugcggagcgcgugcuggacuggcucgagaaguacggcgucgagcggcugaaacgcauggccauuucuggggacgacugcguggugaagccuaucgacgaccgguucgccacggcacugaccgcccucaacgacaugggcaagguccggaaggauaucccgcagugggagcccuccaaaggguggaacgacuggcagcaggucccuuucugcagccaccauuuccaccaauuaaucaugaaggacggucgggagaucguggucccgugccggaaccaggacgagcuaguggguagagcgcgcguuagccagggugccggguggagccuccgugaaacggccugccugggcaagagcuacgcccagauguggcagcugauguacuuccaucgccgggaccuucgccuggcggccaacgcaaucugcuccgccgugcccguggauugggugcccacaagccggaccaccuggucgauacaugcccaccaccaguggaugacgaccgaggacaugcugagcguuuggaaccgcguguggauugaggagaaccccuggauggaggacaagacccgcauaucauccugggaggacguaccauauuuaggcaagcgcgaggaccaguggugcgggucccugauuggccugaccgcgcgcgccacgugggccaccaacauucaggucgcaaucaaccaggugcgccgucucaucggcaacgagaacuacucagacuacaugacauccaugaagcgguucaagaacgagucggagcccgagggcgcccugugguga

SEQ ID NO: 24002 - RNA, 9879 nt, Artificial Sequence
  derived and/or modified CDS sequence (opt11) from DENV-1__FJ850068__SS-prME
ucagugacgaugcugcucaugcugaugccgaccgcccucgccuuccaccucaccacccguggcggggagccccacaugaucgucucuaaacaggaaagaggaaagagucuacuguucaagaccucggcgggggugaacauguguacccugaucgcgauggaccucggcgaacugugcgaggacacgaugaccuacaagugcccacgcaucaccgaggccgaacccgacgauguugacugcuggugcaacgccaccgacacuugggugaccuacgggaccugcagccagaccggcgagcaccgacgcgacaagcgcuccguggcccucgcgccgcacgugggccuggggcuggagacgcgcacugagacuuggaugagcagugaaggcgccuggaagcagauucagcggguugagaccugggcccucaggcaccccgguuucacggugaucgccuuauuccuggcgcaugcuaucgguacgagcauaacucagaagggaaucauuuucauccuccugaugcuggugacccccuccauggcgaugcggugcgucggcauuggcagcagagacuucguggaaggccucucgggcgcuacguggguggaugucgucuuagaacacgguaguugugugacaaccauggcuaaggacaagcccacccuugacaucgagcugcugaagacggaggucaccaaccccgcagugcuuaggaaacucugcaucgaggccaagaucuccaacaccaccacagacucacgcuguccgacucagggcgaggccaccuugguggaggagcaggacgccaauuucgucugccggcgcaccuucguagaccguggcugggggaaugggugcggucucuuuggcaaggggucccuucugacgugugccaaguuuaagugcguaaccaagcuggaggguaagaucguccaguacgaaaacuugaaguacagcgucaucgucacaguccacaccggcgaccagcaucaaguggggaacgaaagcacggagcacggcaccaccgcgaccaucacgccccaggcccccacgaccgagauccagcugaccgacuacggggcccucacccucgacugcagcccccgcacuggcuuggacuucaacgaaaugguccugcugaccaugaaggagaaguccuggcugguucacaagcagugguuccuugaucugccccuucccuggaccagcggcgccagcacuucccaggagacauggaaccggcaggaccuacucguuacuuucaagacugcccacgcgaagaagcaggaggugguggugcugggcagccaagagggcgccaugcacaccgcccugacgggggccacagagauacagaccagcgguaccacgacaaucuucgccggacaccugaagugccgccugaagauggacaagcugacccucaagggcaugucauacgucaugugcaccggguccuuuaaacuggagaaggaaguugcggaaacgcaacacggcaccgugcugguucagaucaaguacgaagggaccgacgccccuuguaagauccccuucuccacucaggacgagaagggggugacgcagaacggccggcugauuacggcgaaccccaucgugaccgauaaggagaagcccguuaacaucgaggccgaaccccccuuuggggaguccuacaucgugaucggugcgggggagaaggcccucaagcugagcugguucaagaagggcuccagcaucggcaagauguucgaggccaccgcccgcggggcccggcgcauggcgauucugggcgacacagccugggacuucgggagcaucggcggcguguucacuagcgucgggaagcucguucaccagauauucggcacagccuauggggugcuuuucucuggcgucaguuggaccaugaagauugggaucggcgugcuccucacauggcugggccugaauucacgcagcaccucacucucuaugacgugcaucgcugucggucuggucacccuguaucuuggcgugauggugcaggccgacucggggugugucaucaacuggaagggccgagaguuaaagugcgggagcggcaucuucgugacgaacgagguucacaccuggacggagcaguacaaguuccaggcggacagcccgaaacguuuaucggccgccauuggcaaggccugggaggagggggucugcggcauccgaagcgccacccgucuugagaacaucauguggaaacagauuuccaacgaguugaaccacauccuacucgagaacgacaugaaguucaccguuguggucggggacguggcgggaaucuuagcccagggaaagaagaugauucggccccagcccauggaguacaaauacagcuggaaguccuggggcaaggccaagaucaucggcgccgaugugcagaauagcacguucaucaucgacgggcccaauacccccgagugucccgaugaccagcgcgcauggaacaucugggaggucgaggacuacggcuuugggaucuucacgaccaauaucuggcugaagcuccgggacuccuacacccaggugugcgaccaccgacugaugucggccgcaauaaaggacuccaaagccgugcaugcagauaugggcuacuggaucgaguccgagaaaaacgagacuuggaagcuggcgggcgccuccuucauagaggucaagaccugcaucuggcccaagagccacaccuuauggucaaacggggugcuugaaucagagaugaucauccccaagaucuacggagggccgaucucccagcauaacuaccggcccggcuacuucacgcagaccgccgggccuuggcaccugggcaaacucgaacuggacuucgaccugugcgagggcaccacgguggucguggacgagcauugugggaaccgcggcccgucucuccggacgaccacagucaccggcaaaauuauccacgaguggugcugccgcuccugcacgcugccgccccuacgguuccgcggcgaggacgguugcugguacggcauggagauccggcccgucaaggagaaggaggagaacuuggugaaaucgauggugagcgccggcuccggggaggucgauagcuucucccugggccugcucuguaucagcaucaugaucgaagaggugaugcgcucccgguggagccggaaaaugcuuaugaccggcacccuggccguguucuuccuccugaucaugggccaacugaccuggaacgacuugauccgauuaugcaucauggucggggcgaacgcuuccgauaggaugggcaugggcacgacuuaccuggcccucauggcgaccuucaagaugaggccgauguuugccgucggccugcuguuucggcgccucaccagccgggagguauugcugcuaacgauaggacugagcuuggucgcaaguguggagcuccccaacagccuggaggagcugggggacgggcucgccaugggcaucaugauucugaaacuucucacagauuuccagagccaccagcugugggccacccugcucucacugacauucaucaagacgaccuuuagccugcacuacgccuggaagaccauggcgaugguccucuccaucguuaguuuguucccccugugucucuccaccacgagccagaagaccaccuggcugcccgugcugcuugggucccugggcugcaagccgcugaccauguucuuaaucgccgagaauaagaucuggggucgcaaaagcuggccguugaacgagggcauaauggcagucgguauagugagcaucuugcuauccagccugcuaaaaaacgacgugccccucgcgggcccccucauagccggcgggaugcugaucgcgugcuacgucaucuccggcucguccgccgaccucagccuggagaaagccgccgaaguguccugggaggaagaggcagagcacagcggugcgucccacaacauccugguggagguccaggacgauggcacgaugaagauaaaggacgaagagcgggaugacaccuugaccauccuguuaaaggcgacccugcuggcggugagcgggguuuacccgcuguccauccccgccacccucuuugucugguauuucuggcagaagaagaagcagcgcagcggcguccuaugggacacgccaagcccgcccgaggucgaacgggccguuuuagaugacggcaucuacagaaucaugcagcggggacugcucggccgcagccagguuggggugggcgucuuucaagagaacguguuucacaccauguggcacgugacccgcggggccguccucauguaucagggcaagcgccuagagcccuccugggcgagcgugaagaaagaccucauuuccuacggcgggggcuggcggcugcaggggagcuggaacacgggcgaggagguacaggucaucgccguugagcccgggaagaacccgaagaacguccagacagcccccggcaccuucaagacucccgaaggcgaggucggggcuauagcccuggacuucaagcccggcaccuccgggagccccaucgugaaccgcgagggcaagaucgugggccucuacgguaacggcgucgucacgaccagcgggaccuacguguccgcaauugcccaggccaaggcgagccaggagggcccgcugcccgagaucgaggacgaggucuuccgaaagcgcaaccugacuauaauggaccuccaccccggguccggcaagacacguagauaucugccggcgauagugcgggaggccaucaagcgcaagcugcggacccucauccuggccccgacccguguugucgccagcgaaauggcggaagcacugaagggcaugcccauccgcuaccaaacaacagccgugaaguccgagcacaccggcaaggagaucguggaccucaugugccacgcuaccuucaccaugcgucugcugucccccguccgugugccgaauuacaauaugaucauuauggacgaagcccauuucaccgaccccuccagcaucgccgcccggggcuacaucaguacccgcguggggaugggcgaggccgccgccaucuucaugaccgcgacgccgcccggcagcgucgaggccuucccgcaguccaacgccguuauccaggacgaggagagggacauccccgaacgcagcuggaacuccggcuacgaguggaucacggacuuccccggcaagaccgugugguucguucccagcaucaaagccgggaaugauaucgcaaauugcuugcggaagaacggcaagcgcgugauacagcugucccggaagaccuucgacacggaguaccaaaagacgaagaauaaugauugggacuacguggucaccaccgacaucagcgagaugggggccaacuuccgcgccgaccgggugauagacccgcgacggugccucaagccagugauccucaaagacggccccgagcgcgucauccuugccggcccaaugccggugaccgucgccuccgcggcccagcggcgaggucggauaggcaggaaccauaacaaggaaggggaccaguacaucuacauggggcagccccucaauaacgacgaggaccacgcccacuggacggaggccaagaugcuccuggacaacaucaacaccccugaggggaucauacccgcccuguucgaaccggagcgggagaagucagcggccaucgacggcgaguaucggcuccgcggcgaggcccggaagacuuucguggagcugaugcggcggggcgacuuaccaguguggcucuccuacaaggucgccagcgagggcuuucaguauagcgaucggcgguggugcuucgacggagagcgcaacaaccaggugcuagaagagaacauggacguggaaaucuggaccaaggagggcgagcggaagaaacugcgucccagguggcucgacgcccguacguacuccgacccccuggcgcuucgagaauucaaggaguucgccgcagggcgccggagcgucuccggcgaccucauccuggagaucggaaagcugccccagcaccucacccagcgugcccaaaaugcucuggacaaucuggugaugcuccacaacagcgagcagggcgggcgggccuaccgccaugccauggaagagcugccggauaccaucgagacucugaugcuacuggcccugaucgccguguugaccggaggcgucacccuguucuucuuauccgggaagggccucggcaagacuagcaucggcuuacugugcgucauggcguccucagugcuccuguggauggcauccgucgaaccccacuggaucgcugccagcaucaucuuggaguucuuccucauggugcugcugauccccgagccggaccggcagcgcacgccgcaggacaaucaacucgccuacgugguaaucggccugcucuuuaugauccucaccguggcugccaacgagaugggacugcuggagacgaccaagaaggaucucgguaucgggcacguggccgucgagaaccaccaccacgccgccaugcuggauguggacuuacaccccgcguccgcauggacccucuaugccguggccaccacgaucaucaccccuaugaugagacacaccaucgagaacacuacggccaacaucaguuuaaccgcgaucgccaaccaggccgccaucuugaugggccucgacaagggcuggccaaucuccaagauggacaucggaguucccuugcuggcgcucgguugcuacucccaagucaacccccugacccugaccgccgccgugcucauguuagucgcccacuacgccaucaucgggccgggccugcaggcuaaggccacgcgcgaggcccaaaagcggaccgcggccgggaucaugaagaaucccaccaucgacggcaucguugcgaucgaccucgaccccguggucuacgacgccaaauucgaaaagcagcugggacaaaucaugcuacucauccugugcaccucccagauccuucucaugcgcacgaccugggcgcugugcgaguccaucacacuggccaccgggccccucacgacccugugggagggauccccggguaaguucuggaacaccaccauagccgucagcauggcgaauaucuuccgcggcuccuaccuggccggcgccgggcucgccuuuucccugaugaagagccugggcgggggccggcgcgggacuggggcgcagggcgagacccucggggagaaguggaaacggcaguuaaaccagcugucaaagagugaauucaacaccuacaagcgcuccggcaucauggagguggaccgguccgaggcuaaggaggggcucaagcgcggcgagacgacgaagcacgcugucucgcgggggaccgccaagcugcgcugguucguggagcggaaccuggugaagcccgagggcaaggucaucgaccugggcugcgggcgcggcggauggagcuacuacugcgccggccucaagaagguaaccgaggugaaaggguauaccaagggcggucccggccacgaggagccuaucccgauggcgacguacggcuggaaccuggucaagcugcacuccgggaaggacguguucuuuaucccccccgaaaagugcgacacccuccugugcgacaucggggaaagcucccccaauccaaccauagaagaggggcggaccuugcgcguucucaagauggucgagcccuggcugcggggcaaccaguucugcaucaaaauccugaacccguacaugcccuccgucguggagacgcucgagcagaugcaacggaagcacggggguaugcugguccggaacccgcugucccgaaacagcacccaugagauguacuggguauccuguggcaccgggaacaucgugucggccgucaacaugaccucccggaugcuccugaaccgcuucaccauggcccaccggaagcccacguacgagcgcgacgucgaccucggcgccggcacccgucacguagccguggagcccgagguggcgaaccucgauaucaucgggcagcggauugaaaacauuaaacacgagcacaagagcaccuggcacuacgacgaggauaaccccuacaagaccugggcauaccacggcuccuacgaggugaagccgagcgggagcgccagcuccauggucaacggcguggucaagcugcugacgaagccaugggacguuaucccaauggugacccagaucgccaugacggauacuacgccuuucgggcagcagagagucuucaaggagaaggucgacacccggacuccgaaggccaagcgcggcacugcgcagaucauggaggugacggcccgguggcuauggggcuucuugucccgaaauaaaaagccgcguaucuguacccgcgaggaauucacccggaagguucgcuccaacgcagccaucggggccguguucguagacgagaaccaguggaacuccgccaaggaggccgucgaggacgaccgguucugggaccuggugcaccgugagcgggagcuccacaagcaaggcaagugcgcgaccugcguguacaacaugauggggaagcgcgagaaaaagcugggcgaguuugggaaggccaagggcucuagagccaucugguacauguggcugggcgcacgcuuccucgaguucgaggcccuaggauucaugaaugaggaccacugguucucccgggagaauagccuguccggcgucgaaggggaggggcuccauaagcugggauauaucuuacgcgacaucagcaagauaccuggcggcaauauguaugcugaugacacggccggaugggacacccggaucacggaggacgacuuacaaaacgaagcgaaaauuacggacaucauggagccggaacacgcccugcuggccaaguccauauucaagcucacuuaccagaacaaggugguucgcguccagcgccccgccaaaaacggcaccgugauggacgugaucagccgccgagaucagcgaggguccggccaagucggcaccuaugggcugaacaccuuuacgaacauggaggcccagcugauccgccagauggagagcgaagguaucuucuccccaaacgagcucgaaacccccaaccucgcggagcgggugcuggacuggcucgagaaguacgggguggagagacuuaagcggauggccauuagcggcgacgauugcguagugaagccgauugacgaccgcuucgccaccgcccugacagccuugaacgacauggguaaggugcggaaagacauaccccagugggagccuagcaagggguggaacgacuggcagcaaguccccuucugcagccaccacuuccaccagcugaucaugaaggacggccgcgagaucguggugccgugccggaaccaggacgagcuggucgggcgcgcgcgggugucccaaggggcgggguggagccuccgcgagacugccugccugggcaagagcuacgcccagauguggcagcugauguacuuccaccgucgcgaccuccggcuggcggccaacgccaucugcuccgccgugcccgucgacugggugcccaccagcagaaccaccugguccauccacgcccaccaccaguggaugacgaccgaggacaugcugagcguguggaaccgggucuggauagaggagaaucccuggauggaggauaagacacgcaucagcuccugggaggacgugccguaucuugggaaacgggaagaccaguggugcgguucccucaucggucugaccgcgcgggcaacaugggccaccaacauccagguggcaauaaaucagguccgccggcucaucgggaacgagaauuacucugacuacaugaccuccaugaagagguucaagaacgagagcgagcccgagggcgcgcugugguga

SEQ ID NO: 24003 - RNA, 9879 nt, Artificial Sequence
  derived and/or modified CDS sequence (opt11) from DENV-1__FJ687430__SS-prME
agcguaaccaugcuacuaaugcugaugccuacggcccuggccuuccaccuuaccacccggggcggggagccccacaugaucgucagcaaacaggaacgcggcaagucccugcuguucaaaaccuccacggguguuaacaugugcacacucaucgccauggaccucggugagcuuugcgaggauaccaugaccuacaaguguccuaggaucaccgaggccgagcccgaugacguggacugcuggugcaacgccacggacaccugggucaccuaugggacaugcagccaaacgggagagcaccggcgcgauaaacgguccguggcgcucgcuccccacguuggccuggggcuggagacuaggaccgagacauggaugagcagugaaggcgcuuggaaacaaauucagaaaguugagacuugggcacucagacaucccggcuucacggugaucgcgcuauuccuggcccacgccaucggaacuaguauuacacagaaggggauaaucuuuauacuccuuaugcuggucacgcccuccauggccaugcgcugcguaggcaucggcagccgggacuucguggagggguuauccggcgccaccuggguggaugucguuuuggagcacggcagcugcguaaccacuauggccaaggacaagccgacguuagauaucgaacucuugaaaaccgagguuacgaauccugccguguuacgaaaguugugcauugaagcgaaaaucuccaauacaacgaccgauucgcgcuguccgacccagggcgaagccaccuugguggaggagcaagacgccaacuucgucugccggcggacguucguagaccgcggcugggggaacggcugcgggcuauucgguaaaggcagcuuaauuaccugugccaaguucaagugcgugaccaagcuggagggcaagauaguccaauacgagaacuugaaguacagcgugaucgugaccguccacacgggugaccaacaccagguggggaaugaguccaccgaacacggcacuaccgccacaaucacgccccaggccccaaccacugagauccagcucacggacuacggggccuuaacgcuugacugcagcccucggacagggcucgacuucaaugagaugguucuacugaccaugaaagagaaguccuggcucgugcacaagcaaugguucuuagaccugccccuccccuggacgagcggcgccucaacgucccaggagaccuggaaccgccaagaccuccuggugaccuucaagacagcccacgccaagaagcaggaggucgugguauugggaagccaggaaggcgcgaugcacacggcgcuaacaggugcaacggagauccagaccagcggcaccaccacaaucuucgccggucaccugaaaugccgacuuaaaauggacaaacugaccuuaaagggcaugagcuaugucaugugcacgggauccuucaaacucgagaaagagguggccgagacccagcacggcaccaucuugguacagaucaaauaugaaggaacagaugcgcccugcaagaucccauucagcacgcaagaugaaaagggggucacccagaacggccggcugaucaccgcgaacccuaucguaaccgacaaagagaagccagugaauaucgaagccgagccaccuuuuggcgagucauacauaguaaucggcgcgggugagaaggcgcugaaacuaagcugguucaagaagggguccagcaucggcaagauguuugaggccacggcacggggugcuagacggauggccauccugggggacaccgcuugggacuucgguaguauugggggcgucuucaccucugucgggaagcuaguccaccagauauucggcaccgccuauggggugcuguucuccggcguaagcuggacgaugaagaucgguaucgguguucugcugacauggcucggccugaacucccgcagcaccucccugagcaugacuuguaucgcuguggggcucguuacgcuuuaccugggcgucauggugcaggccgacagugggugugugaucaacuggaaggggagagaguugaagugugggagcggcaucuucgucaccaacgagguacacaccuggacugagcaguacaaguuucaggccgacagcccgaaacggcuuuccgcugccauuggcaaagccugggaagaaggugugugcggaaucagguccgccaccaggcucgagaauauaauguggaaacagaucuccaaugagcucaaccacauccugcuggagaacgacaugaaauucacggucguggugggggacguugccggaauacuugcgcaagggaagaagaugauuagaccccagccgauggaguauaaguauucuuggaaguccuggggcaaggcaaagaucaucggugcagacguccagaaugccaccuucaucaucgacggccccaauacucccgagugccccgaugaucagcgagcguggaauaucugggaaguugaggacuacggcuucgggaucuuuaccacaaacaucuggcugaagcuccgcgacucauacacgcagguuugcgaccaccggcucaugagcgccgccaucaaggacucuaaagccgugcacgcugacaugggcuacuggaucgagagcgaaaagaacgaaaccuggaagcucgcgcgagccagcuucaucgaggucaagacuugcauauggccgaagucacauacgcuguggagcaacggcguacucgaguccgagaugaucauccccaagaucuacgggggaccgauuagccagcauaacuaccgcccgggguacuucacccagaccgccggccccuggcaccuggggaagcuagagcucgauuucgaccugugcgagggcacuacggucgucgucgacgagcacugcggcaaucgcgguccuucucuacguaccacaacagucacgggaaaaauuauccacgaguggugcugucggucguguacgcucccaccccuccgauucagaggggaggauggcugcugguacgggauggaaauccgccccgugaaggagaaagaggaaaaccugguaaagucuauggugucugccggcagcggggaaguggacucuuucagccucgggcugcugugcaucucaaucaugaucgaggaggugaugcgcucacgguggucucguaagauguuaaugaccggcacccucgccguguuuuuuuuauuaauaauggggcaauugacuuggaacgacuugauacgguugugcaucauggugggcgcgaacgccuccgacaagaugggcaugggcaccaccuacuuggcucugauggccacuuucaaaaugcgccccauguucgcagucggucuccuuuuccggcggcugacgucccgcgagguccuccugcugacaaucggccugucacuaguggcguccguagagcugcccaacagccucgaagagcugggcgacggacuugccauggggauuaugauccucaagcugcugacugacuuccagucccaucaguuaugggccaccuuacugagccucacguuuaucaagaccacuuucucgcuccacuacgccuggaagaccauggcgauggugcugucaaucguuucguuauucccgcugugccugagcacuacaucccagaagacaacauggcuccccgugcuacugggcucgcucggauguaaaccgcuaacgauguuccugaucgcggaaaacaagaucuggggccgaaaguccuggccccucaacgagggaaucauggccguagggaucguuucgauccugcugucaucccuccugaagaaugaugugccacuggccggacccuugaucgcgggcggcauguugaucgcgugcuacguaauauccgggaguagcgccgaccuguccuuggagaaggcugccgaagugagcugggaggaagaggccgagcauaguggggcgagccacaacauccugguggagguacaggacgacgggaccaugaagaucaaggacgaggagcgggacgauacccugaccauucuuuuaaaggcaacgcugcucgcaguauccgguguguacccgcucagcauacccgccacgcuguucgugugguacuuuuggcagaagaagaagcaacgcuccgggguacugugggacaccccgagcccgccagagguagagcgcgcuguguuagacgacgggaucuaucguauuaugcagcgaggccugcuggggcggucccaaguaggaguagggguguuccaggaaaacguuuuccauacgauguggcacgugacccgcggcgcgguccucauguaccaggggaagaggcuggagcccucgugggccuccgucaaaaaggaccugaucagcuacggcggcggcuggcgucuccagggguccuggaauacgggcgaggaggugcagguaauagcggucgagccuggcaagaacccaaaaaacgugcagacagcccccgggaccuucaaaacccccgaaggagaagugggagccaucgcgcuggacuucaagcccgggacgagcggcagccccaucgucaaucgggaggggaaaaucguggggcuguacggaaaugguguugucaccacgagcggcaccuacguaagcgccaucgcucaggcuaaggcgucccaagagggcccgcuuccggagaucgaagacgaggucuuuagaaagcgcaaccuaacuaucauggaucugcaccccggcagcgggaaaacccgacgguaucuccccgccauaguccgcgaagccaucaaaagaaagcugcgcacccugauccucgccccgacccgggugguggccuccgagauggcggaggcccugaaaggaaugcccauccgcuaccagacgacggccguaaagagcgagcacacugggaaggaaaucguggaccuuaugugccaugccacguucacgaugcgcuuacuguccccuguucgagucccgaacuacaacaugaucaucauggacgaggcccacuucaccgaucccucaucuauagcggcucgcggauauaucucgacccgggugggaaugggugaggccgccgccauuuucaugaccgcgacgccccccggcuccguggaggccuucccacagucaaacgccguaauucaggacgaggaacgcgacauucccgagcggucauggaacagcggguacgaguggaucacggauuuccccggcaagaccgugugguucgugccuagcauuaagagcggcaacgacaucgccaacugccugcguaagaacgggaagcgggucauccaguuaucccgcaaaacuuuugauacggaguaccagaaaaccaagaacaacgacugggacuacgugguaacuaccgacaucagcgaaaugggcgccaacuuccgggccgaucgcgucaucgauccgcgucggugccugaagccgguaauuuugaaagacgggcccgagcgggugauccuagcgggcccuaugccgguaacgguggccuccgccgcucagcgccgggggcguaucggccggaaccacaacaaggagggugaccaauacaucuacaugggacagccacugaacaacgacgaggaccaugcccacuggacggaagccaagaugcuccucgacaacaucaauaccccugaaggcaucauuccugcgcuguucgagccggagcgggagaagucggccgcgaucgacggggaguaucgacuccgcggggaggcccgcaagaccuucgucgaguuaaugcggcguggagaccugccgguguggcugagcuauaagguugcgucggaaggcuuccaguacuccgaccggcgcuggugcuucgacggcgaacggaacaaccaaguccuagaggagaacauggacguugaaaucuggacaaaagagggugagaggaagaagcugcgcccuagguggcuggacgcccguaccuacuccgaccccuuagcccugcgggaguucaaagaguucgcagccggccggaggucgguguccggggacuuaauccuugagauuggcaagcugccgcagcaccuaacacagcgggcucaaaaugcacucgauaaccugguaaugcugcacaacagcgagcaaggcgggcgcgcguaccggcaugcucucgaggaacuccccgacaccaucgagacgcucaugcuccuugcucugaucgccguacucaccggagggguuacgcuguuuuucuuguccggccgcggguugggcaaaaccucuauuggccuccuaugcgucauggcguccagcguguuacuguggauggcgucaguggagccacauuggaucgcugccagcaucauacuggaguucuuucucauggugcugcucauucccgaaccggaucggcagcgaacuccgcaagauaaccagcuagccuauguggugaucggcuugcuguuuaugauccucacagucgccgcgaaugagauggggcugcuggagaccaccaagaaggaccuugggaucggacacguagccguggagaaucaccaccaugccuccaugcuggacguagacuugcaucccgccagcgccuggacucucuacgcaguggcgacgacgaucauuaccccgaugaugcgacacacuaucgagaacacgaccgccaacaucucccucaccgccaucgcaaaccaggcagccauccuaaugggguuggacaaaggguggcccaucucuaagauggauauaggggugccccugcuggcccucgggugcuacucgcaggucaacccccugacacugacggccgcgguacucaugcugguggcucacuacgcuaucaucgggccggggcugcaggcgaaggcuaccagagaagcgcagaaacguacggcggccggaauaaugaagaaccccaccgucgaugggaucgucgccauagaucuagaccccguuguuuacgacgccaaguucgagaagcaacucggccagauuaugcugcucaucuuauguacgagccagaucuuacucaugcguacgacuugggcgcugugcgaauccauaacccuggccacggguccucuaacuacacugugggagggaagcccgggcaaauucuggaacaccacgaucgccguauccauggccaacauuuuccgcgggagcuaucuagcuggcgcgggucucgcuuucagcuuaaugaagucccucggcggugggaggagggggaccggggcacagggugaaaccuugggcgagaaauggaagcgacagcugaaccagcuuagcaagucagaguucaacacuuacaagcgcagcgggaucauggaggucgaccgauccgaggccaaggagggacucaagaggggcgagacgacaaagcaugcggugucccggggcaccgccaagcugcgcugguucguugaaagaaaucuggugaagccagaggggaaggucaucgaucugggaugcggccgcgggggcugguccuauuauugcgccgggcucaagaaggucaccgaggugaagggcuacacuaaaggcgggccuggccacgaggagcccauccccauggccaccuacgguuggaacuuggucaagcuucacuccggcaaagacguguuuuucaucccgccagaaaagugcgauacccuacucugcgacaucggggagucgagccccaauccgacgauugaggaggggcggacgcugcgcgugcucaagauggucgagccuuggcuccgaggaaaccaguuuuguaucaaaauccugaacccguacaugcccagcguggucgagacgcucgagcagaugcaacgcaagcacgggggcaugcugguacguaacccgcugucccgcaacuccacacacgagauguacugggugagcugcggaacgggcaauaucguuucugcggugaacaugaccucgaggaugcuacugaaccgauuuacgauggcgcaucggaaaccaacuuaugagagggacguggaccugggggcggguacccgucacguggcagucgagcccgagguggccaaccucgacaucauuggccagaggauugaaaacauaaagcacgaacacaaguccaccuggcauuacgacgaggacaacccauacaaaacgugggccuaccacgggucauacgagguaaagccguccggcagcgcguccagcauggucaacgggguggucaaacugcucacgaagcccugggacgucaucccaauggugacccagaccgccaugaccgauaccacucccuucggccagcaaagagucuucaaggagaagguggacacccggaccccgaaagccaagcgcggaaccgcccagauaauggaagucacugcccgguggcucuggggcuucuugagccgcaacaagaagccccggaucugcacccgcgaggaauucacacggaagguccgcaguaacgcggcgauuggugccguauucguggacgagaaucaguggaauuccgccaaggaggcgguagaggaugagagguucugggacuuggugcaucgcgaacgugaauugcacaaacagggaaagugugccaccugcguguacaacaugauggguaagagagagaagaaguuaggggaguucggcaaagcgaaggggucccgcgccaucugguacauguggcuuggagcucgcuuucuagaguucgaagcucuaggcuuuaugaacgaggaccacugguucagcagagagaauucgcugucaggugucgagggcgaggggcuccauaaacuaggcuacauccugcgugacauauccaaaauccccgggggcaauauguaugcugacgacaccgccggcugggacaccagaaucacggaggacgacuuacagaaugaagccaaaaucaccgacauaauggagccggaacaugcccuccuggccaagagcaucuuuaaguuaaccuaccagaauaaggugguucgcguucaacggccggccaagaacgggacugugauggacgugaucucgaggcgugaccaacggggcucuggccaaguuggcacguacggccugaacaccuuuaccaacauggaggcccagcugauacgccaaauggaguccgaggggauuuuuuccccuuccgagcucgaaacccccaauuuggccgaacgcgugcucgacuggcucgagaaguacggcguugagcgccugaaacguauggccaucagcggggacgacuguguaguaaagcccauagacgaccgcuuugccaccgcccucaccgcccucaacgacaugggaaaggugcggaaggacaucccccagugggagcccucuaagggauggaacgacuggcagcaggugcccuucugcagccaccauuuucaucaguugaucaugaaggaugguagagagauugucgugccgugcagaaaucaagaugagcugguaggccgagcccgugugagccagggugcugguuggucgcugcgcgagacggcgugucucggcaaguccuacgcacagauguggcagcugauguacuuccaccggcgcgaucucagguuagcagccaacgcaaucugcuccgccgugccagucgacugggugccgacuagccgcacuaccugguccauucaugcccaccaccaguggaugaccaccgaagacaugcuuagcguuuggaaccgggucuggaucgaggagaaccccuggauggaggacaagacgcacaucuccagcugggaagacgugccguaucuugguaagcgcgaggaccaauggugugggucccugaucggauuaaccgcccgagcgaccugggcgaccaacauccagguagccaucaaccagguaagacgccucaucggcaaugagaacuaccuggacuacaugacuucaaugaagcgguucaagaacgaguccgacccugagggcgccuugugguaa

SEQ ID NO: 24004 - RNA, 9879 nt, Artificial Sequence
  derived and/or modified CDS sequence (opt11) from DENV-1__FJ687432__SS-prME
agcgugaccaugcugcucauguuaaugcccaccgcccuggccuuccaccuuacaacccggggcggggaaccccacaugaucgugagcaagcaggaacgggguaagagcuuacuguucaagaccuccaccggggugaacaugugcaccuuaauugccauggaccugggcgagcugugcgaagauaccaugaccuauaagugcccccggauaaccgaggcugagcccgacgacguggacuguugguguaacgccacugacacaugggucaccuacgggacguguucacagacgggcgagcacaggcgagacaaaaggagcguggcucucgcgccccacgugggcuuagggcuggagacccgcaccgaaaccuggaugagcucggagggcgcguggaagcagauccagaaggucgagacgugggcccuccggcaccccggguucaccgucaucgcccuguuucuggcccaugcgaucggcacaagcaucacccagaaggggaucauuuucauccuccugaugcuggucacacccuccauggccaugcgauguguugggaucggcagccgggacuuuguggaggggcucuccggcgcuaccuggguggacgucgugcuggagcacgggagcugcgugaccaccauggcuaaggacaaacccacgcuugacauagagcuacugaagaccgaggucaccaacccggccgugcugcguaaacucugcaucgaggccaagaucuccaauaccacgaccgauagccguugcccgacccagggcgaggccacccugguugaggagcaggaugcuaacuuugucugucgccguacguuuguggaccgagggugggggaacggaugcggacucuucggcaaagggucccucaucacgugcgccaaguucaagugcgugaccaagcuagaaggcaaaauuguccaguacgagaaccugaaauacagcgugaucgugaccguccauacgggcgaucagcaccagguggggaacgaguccaccgagcacggcaccacagccacuaucacgccccaggcgcccaccaccgaaauccagcucacagacuacggggcccugacgcuggacugcucaccccggaccggccuggacuucaacgagaugguccugcugaccaugaaggagaaguccuggcucgugcauaagcagugguuccuggaccugccgcucccauggacuagcggagccucuacgucccaggaaacguggaaccgccaggaccugcuggugaccuucaagaccgcucaugccaagaagcaagaggucguggugcucgggagccaggagggcgcgaugcacacagccuuaaccggggccaccgagauccagacauccggcacgaccaccaucuucgccgggcacuugaagugucggcucaagauggacaagcuaacccuuaaaggcaugagcuacgucaugugcacagguuccuucaaacucgagaaggagguggccgagacccagcacggcaccauccucgugcagaucaaguacgagggcaccgaugcgcccugcaagauccccuuuuccacgcaggaugagaagggagucacccagaacggccgccugauaaccgccaacccgaucgugaccgacaaggagaagccagugaacaucgaagccgagccgcccuucggggaguccuacaucgugaucggugccggcgagaaggcgcugaagcugagcugguucaagaaggggucgagcaucggcaagauguuugaggccacggcccguggggcccgccgaauggccauccugggcgacaccgcgugggauuuuggguccaucggcggcguguucaccagcgugggaaagcugguccaccagaucuucgggaccgccuacgggguucuguucuccggcgugagcuggacgaugaagaucgggaucgggguccuguuaaccugguugggccucaacagccgguccacuuccuuauccaugaccugcaucgccgugggucucgugacucuguaccugggcguaauggugcaggccgacagugguugcgugaucaacuggaagggccgcgaauuaaagugcggguccggcauauuuguaaccaacgaggugcacaccuggaccgagcaguacaaguuccaggccgacagcccgaaacggcuuuccgcggccauaggcaaggccugggaggagggugugugcggcauacgcucugccaccagguuagagaacaucauguggaagcagaucaguaacgagcucaaccacaucuugcuggagaacgacaugaaguucacggucguggugggcgacgucgcuggcauccuugcgcaggggaagaagaugauccgcccccagcccauggaguacaaguacagcuggaaguccuggggcaaggccaagaucaucggugccgaugugcagaacgccaccuucaucaucgacgggccuaacaccccggagugccccgacgaccaacgggccuggaacauuugggagguggaggacuacggcuucgggaucuuuaccacgaacauauggcugaagcugcgcgacagcuacacccaggucugcgaccaccggcucauguccgcagccaucaaagacagcaaggccgugcacgccgacaugggcuacuggauagaguccgagaagaaugaaaccuggaaacuugcgcgcgccagcuucaucgaggugaagaccugcaucuggcccaagucccacacccuguggucaaacggcguccucgaguccgagaugaucaucccaaaaaucuacgggggaccaaucagccagcacaacuaccggcccggguacuuuacccagaccgccggccccuggcaccuugggaagcucgagcucgauuucgaccugugcgagggcaccacggucgucgucgacgagcauugugggaaccgcgggccgucccugcggaccaccaccguuacggggaaaaucauccacgaguggugcugccgaucauguacccugccgccccuccgguuccgcggggaggacggcugcugguacgggauggagauccggccggugaaggagaaggaggagaacuuaguaaaguccauggugagcgccggcagcggcgagguagacaguuucagccucgggcugcuuugcaucucuaucaugauagaggaggucaugcgcagccgguggucccgaaagaugcucaugaccggcacccuagcaguauucuuccuacucaucaugggacagcuuacguggaacgaucugauucgguuaugcauaauggugggagcgaacgcgagcgaccggauggguaugggcaccaccuaucuggcgcugauggccacguucaagaugcguccgauguucgccgucggccuccuguuccggcgccugacgucccgggagguucuccuguugacgauuggauugagccuaguggcaucugucgagcuucccaacagccuggaggagcugggggacggacuggccauggggauuaugauccucaagcugcugaccgacuuccaaucacaccagcucugggccacccugcugucacuaacauucaucaagaccaccuucucccugcauuacgcauggaagaccauggcaauggugcugagcaucgucuccuuguucccccugugucugagcacuaccagccagaagacaaccuggcuucccgugcuucugggcagccucgggugcaagccgcugaccauguuccugauugccgagaauaagaucuggggacgaaaguccuggccccuaaaugaggggaucauggcggugggcaucguaagcauccugcugagcucccuccugaagaacgacgugccccuggccgggccccucauagccgguggcauguuaaucgcuugcuacgugauuucuggguccucggccgaccugucccucgagaaagcggccgaggucagcugggaggaggaggccgagcacucuggcgcgagucacaacauccugguggaggugcaggacgacgggaccaugaagauuaaagacgaggagcgcgacgacacccugacuauccuccugaaagccacgcuacucgccgucuccggcguguacccgcugucuauccccgccacgcuguucgugugguacuucuggcagaagaagaagcagcgcucagggguccucugggacacucccagcccgcccgagguggagcgggccguucuggacgauggcaucuaccgcaucaugcagcggggccugcugggacgcucccaggucggaguggggguguuccaggagaacgucuuccacaccauguggcacgugacgcggggcgcggugcucauguaccaagggaaacgccuugagcccagcugggccuccguuaagaaagaccugaucagcuacgggggcggguggaggcuccagggcuccuggaacacgggggaggaaguucaggugaucgccgucgaacccggcaaaaaccccaaaaacguucagaccgcacccgggacauucaagacccccgagggcgagguuggcgccaucgcgcuggacuucaagccagggacgagcggcucgcccaucgucaaccgcgaggggaaaaucgugggccuauacggcaacggggugguuaccaccagcggcacuuacguguccgccauugcccaggccaaggcgucccaagaggggccgcugcccgagaucgaggacgagguguuccggaagcgcaaccugacaauaauggaucugcaucccgggagcgggaagacccggcgcuacuuaccggccaucgugcgggaggcgaucaagcgcaagcugcggacccugauccucgcccccacacgcgugguggccucagaaauggccgaggccuuaaaaggcaugccgauccgcuaccagacuaccgccguaaagagcgagcacaccggcaaggaaaucgucgaccugaugugccacgccaccuucacgaugcgcuuacugucccccgugcggguuccaaacuacaacaugaucauuauggaugaggcccacuuuaccgaccccagcaguaucgccgcccggggguacaucucuacccgcgugggcaugggggaggccgcagccaucuucaugacggcaacuccacccggcuccguggaggccuucccccaaagcaacgccgucauccaagacgaagaacgggacauccccgagcgcagcuggaacaguggguacgaguggaucacagauuuccccggcaagaccgugugguuugugcccuccaucaaaucgggcaacgacauugccaacugccugcggaagaacgguaagcgcgucauccagcugucucggaagaccuuugacacggaguaccagaagaccaagaacaacgacugggauuacguggugacaaccgacaucagcgagaugggcgcuaacuucagagccgaccgggucaucgacccuagaaggugucugaaacccgugauucucaaggacgguccugagcgcgugauccucgccggccccaugccggucacuguggccuccgccgcgcagcggagagggagaaucggccgcaaccacaacaaagaaggcgaccaauacaucuacauggggcagccccugaacaaugacgaggaucacgcccacuggacagaggccaagaugcugcucgacaauauaaacaccccagagggcaucauucccgcccuguucgagccggagcgggaaaagagcgccgcaauugacggggaguaccgccugcgcggcgaggcgcggaaaaccuuugucgaguuaaugagaagaggggaccugcccguguggcuguccuacaagguggccagcgagggcuuccaguacucugaccgccgguggugcuucgauggcgagcggaauaaccaaguccucgaggagaauauggacguggagaucuggacgaaggagggggagcggaagaagcugcgcccucgguggcuggacgcccgcaccuacuccgacccacucgcccugcgggaguucaaggaguucgcggccggcaggagaagcguuuccggggaccugauacucgagauugguaagcucccccagcaccuuacccagcgagcccaaaaugccuuagacaaccuggucaugcugcacaacagcgagcaaggagggcgggcguaccgccaugccuuagaggaacugcccgacacaaucgagacguugaugcuccuggcccugauagccgugcucaccggcggggugacccucuucuuccuguccggccgggggcucggcaagaccuccaucggccugcugugcgucauggccuccucgguacucuuguggauggccuccguggaaccccacuggaucgccgccagcaucauacuggaguucuuccucaugguccuccugauccccgagccggaccgccagcggacaccacaagacaaccagcucgcauacguggugaucgggcugcuguucaugauccucacgguugccgcgaacgagaugggcuuguuggagaccaccaagaaggaccucgggaucggccacguggccguggaaaaccaccaccaugccaguaugcuggacgucgaccugcaccccgccagcgccuggacccucuacgcgguggccacgacgaucaucacccccaugaugcgccacaccaucgaaaacacgaccgccaacaucucccugaccgccauugccaaccaggcggcuauccugauggggcucgacaagggcuggcccaucagcaagauggacauugggguuccgcugcuggcccucgggugcuacucccaagucaacccccugacgcugacagcugcggugcucaugcugguggcccacuaugccaucaucggcccggggcugcaggccaaggccacccgggaggcgcaaaagcgcacugccgccggcauuaugaaaaaccccaccguugacgggaucguagccaucgaccucgacccuguggucuaugacgccaaguucgagaagcagcugggccagauuaugcugcucauccuauguacgagccagauauugcuaaugcgcaccaccugggcgcugugcgaaagcaucacgcuggcuacgggcccccuaaccacucugugggaggguagcccgggaaaguucuggaacacgacaaucgcuguaucuauggccaacauauuccggggaagcuaccucgcuggcgcgggccucgccuucagccugaugaagucccucgggggcgggcggcggggcacaggcgcccagggcgagacccuuggcgagaaguggaagcggcagcucaaccagcucagcaagagugaguuuaacacuuacaaaagaagcgguaucauggagguggaccgcucagaggcgaaggaggggcuaaagcgcggggagacgaccaagcaugcagucagccggggcacagccaagcugcggugguuuguggagcgcaaccuagucaagcccgaggggaagguaaucgaccugggcugcggucgcggcgggugguccuacuacugugccgggcuaaagaaggugaccgaggucaaggguuacaccaagggcggccccggccacgaggagcccaucccgauggcaaccuacggguggaaccuggucaagcuccacuccggcaaggauguguucuucauaccgccagagaaaugcgacacccucuugugcgacauaggagaauccaguccgaacccgaccaucgaagagggcaggacgcuccgggugcuuaagaugguugagcccuggcugcgcgguaaccaguucugcaucaaaauucugaaccccuacaugcccuccgugguggagacccucgagcagaugcagagaaagcacggcggcauguugguccgcaacccgcuaagccggaacuccacccaugagauguacuggguuagcugcggaacgggcaacaucguguccgccgucaauaugaccagccgcaugcucuuaaaccgguucacgauggcccaccgcaagccuaccuacgagcgcgacguggaucugggggccggcacccggcacguggccgucgagcccgagguggccaaccucgacaucaucggccagagaaucgagaauaucaagcacgagcacaaguccaccuggcacuacgacgaggacaaccccuacaagacgugggccuaucacgggagcuaugaggugaaacccuccggcagcgcgaguuccauggucaacgggguggucaagcugcuaaccaagcccugggacgugaucccaauggugacccagacggccaugacagacaccaccccguucggccagcagcgggucuucaaagaaaaaguggacacgcguaccccgaaggccaagagagggaccgcucagaucauggagguaacggcccgcuggcuuugggguuuucucagccggaacaagaagccccgcauuugcacccgggaggaguucacgcgcaaagucagguccaacgcggccauuggcgccguguucguggacgagaaccaguggaacagcgccaaagaggcggucgaggacgagcgcuucugggaccuggugcaccgagagcgugaacuucacaaacaggggaagugcgcaaccugcgucuacaacaugaugggcaagcgggagaagaagcugggggaguucggcaaggccaaggggucccgcgccaucugguacauguggcugggugcccguuuucucgaguuugaagcgcucggguucaugaacgaggaccacugguucagccgcgagaacucccugagcggggucgagggagaggggcuccauaagcugggauacauccugagagacaucagcaagaucccaggagggaacauguacgccgacgacacagccggcugggacacccgcauaacggaagacgaucuccagaacgaggccaagaucaccgauauuauggagccggagcacgcccugcuggccaaaagcaucuucaaacucacuuaccagaacaaggucgugcggguccagcgccccgccaagaaugggacugugauggacgugaucucccgccgggaccagcgcggcagugggcaggucggcacguacggccugaacaccuuuacuaacauggaggcccagcugauccgucagauggaaucagaaggaauauuuagcccguccgagcucgagacacccaaucuggccgagcgcguguuggacuggcucgaaaaguacggcguggaacgccugaagcgcauggccaucagcggugacgacugcgucgugaagccgaucgacgaccgauucgcgacggcccugaccgcccucaacgacaugggcaaggugcgcaaggacaucccccaaugggagcccuccaaggguuggaacgacuggcagcagguccccuuuugcagccaccauuuccaccagcugaucaugaaggacggccgggaaauuguggugccgugccgcaaccaggacgagcugguaggccgagcgcgcgugucgcagggggccggguggucacuccgggagaccgcgugccugggcaagucuuacgcccagauguggcagcuaauguauuuccaccgccgggaucuccgccuggccgccaacgcgauuugcuccgccgugcccgucgauugggugcccaccagccggacgaccugguccauccacgcacaccaucaguggaugaccaccgaggacaugcugagcguauggaacagagucuggaucgaggaaaaccccuggauggaggacaagacgcacauauccagcugggaggacgugccguaccuggguaagcgggaggaccaguggugcgggucccugaucggccugacugcccgcgccacuugggcgacgaacauccaggucgccaucaaccagguccggcggcucauuggcaacgagaacuaccuggacuacaugaccagcaugaagcgcuucaagaaugaguccgacccagagggugcccugugguga

SEQ ID NO: 24005 - RNA, 9879 nt, Artificial Sequence
  derived and/or modified CDS sequence (opt11) from DENV-1__JQ922547__SS-prME
ucggugacgaugcuucugaugcugcugccgaccgcgcucgcuuuccaccucaccacccggggcggggaaccgcacaugauuguguccaaacaggaacgggguaagagccuccuuuucaagaccagcgccggggugaacauguguaccuuaaucgccauggaccuaggggaacucugcgaagacacaaugaccuauaaaugcccacgcaucaccgaggcggagccugaugauguggacuguugguguaacgccacggacacuugggugaccuacgggaccugcagccagaccggggagcaucgacgagacaagcggucaguagcgcuggcuccgcacguggggcuagggcuagaaacaagggccgagaccuggaugagcagcgagggcgccuggaagcagauccagaaggucgagaccugggcuuugcgccauccgggguucaccgugaucgcucuguuccuugcccacgccaucggcacgagcaucacccagaagggcauaauuuucauccugcugaugcucguaacccccucgauggcuaugcguugcgugggcaucggcaacagagacuucguggaaggguugucgggcgcccccuggguggacgucguuuuagaacacgggaguugcgugaccacgauggcgaagaacaaacccacccucgauauugaacugcugaaaaccgaggucaccaacccggcugugcuccgcaagcugugcaucgaggccaagaucucaaacaccaccaccgacagccggugccccacucagggcgaggcuacacucgucgaggagcaggacgccaacugugucugccgacggaccuucguggaucgcgggugggggaacggcuguggcuuguucggcaaggggagcuugaucacgugcgcuaaguuuaagugcgugaccaagcuggaaggcaagaucguacaguacgaaaaccuaaaguacuccgugaucguuacgguacacaccggcgaucagcaccagguggggaacgagaccaccacccaugggacaaccgccaccaucaccccgcaggccccgacgagcgagauccagcucaccgacuauggugccuuaacccuggacugcuccccgcguaccggucuggacuucaacgagaugguguugcucacgaugaaggagaaguccuggcuggugcacaagcagugguuccuggacuugccccucccuuggaccucaggggccagcaccagccaggagacauggaaccggcaggaucugcucgugacguucaagaccgcgcacgcaaagaagcaggaggucguggugcuugguucccaagaaggcgccaugcacaccgcccugacaggggcgacggagauccagacaucagggaccacuacgaucuucgcagggcaccucaaaugccggcugaagauggacaaauugaccuugaaggguaugagcuacguuauguguacggggagcuucaagcucgagaaggagguggccgagacucagcacggcacggugcugguucaggugaaauacgaggguaccgacgccccgugcaagauaccguucucaacccaagaugaaaagggggcuacccagaacggccgcuuaaucacggcuaacccgaucgugaccgacaaggagaaacccgucaacaucgaggccgagcccccguucggggagucguacaucguggugggggcuggcgagaaggcccucaaacugucgugguucaagaagggcaguuccaucgggaagaugcuggaggcaacagcgcgcggggcccgccggauggcuauuuuaggcgacaccgcgugggacuucggguccauaggaggcgucuucacgucuaugggaaagcuggugcaccaggucuuuggcaccgccuacggcguccuuuucucgggcgucaguuggacgaugaagaucgggaucgguauccuccugaccuggcugggccucaacagccgcaacacgucgcuuagcaugaugugcaucgcgguggggauggugacccuguacuugggcguuauggugcaggccgacucagggugcguaaucaacuggaagggccgcgagcugcugugcgguaccggcauuuucgugaccaacgaggugcacacguggacagaccccuacaaguuucaggccgacccuagcaacagacucucccccaucaucggcaaggccugcgucauccgggugugcggcauccggagcgccacccgccuggagaacaucauguggaagcaaaucagcaacgagcuuaaccauauccuccuugagaacgacaugaaguucacuguggugguaggcgacguguccgggauccuggcgcaaggcgagaaaaugauccggccgcagccuauggagcacaaguacaguuggaaaagcuggggcaaagccaagaucaucggcgcagacguacagaacacuacuuucaucaucgacggccccaacaccccagagugcccggacaaucagcgcgcguggaauaucugggaaguugaggauuaugguuucggcauuuucaccaccaacauauggcucaaacuucgagacagcuacacccaggugugugaucaccgccugaugucugccgccauaaaagacagcaaggccguccaugccgacauggguuauuggaucgagucugagaagaacgagacguggaagcucgcccgggcgucauucaucgagguaaaaaccugcaccuggccaaaaucucacacgcucuggagcaauggcgugcucgaguccgagaugaucaucccuaagaucuacggcggaccaaucagccagcacaacuacagacccggauacuucacccagaccgccgggcccuggcaccugggcaaauuggaguuggacuucgacuucugcgaggguaccacgguagugguggacgagcacugcggcaaucgggguccuucccuccgaacaacuaccguaacagguaagauaauacacgaguggugcugucggucgugcacccugccaccccugcgcuucaagggcgaagacgguugcugguauggaauggagauccggccagugaaagacaaagaggagaaucucguaaagagcauggucagcgcugguuccggggagguggacagcuucaguuuaggccugcucugcaucuccaucaugaucgaggaggucaugagaagccguugguccaagaagaugcuuaugguugggacacuggccguuuuccuccuguugaucaugggccagcucaccuggagcgaccugauccgccuguguauuauggugggugcgaaugccagugacaggauggguauggggacgaccuaccucgcccuuauggccaccuuuaagaugcgucccauguucgccguaggccuacucuucccgaaacuuaccagccgcgagguccuccuccucacaaucggccugucccucguugccagcgucgagcugccuuccagccuggaagaacucggggacggucuggccaaggggauuaugaugcugaagcuccuuaccgacuuccagucccaccagcugugggccacccuccuguccuuaacuuucauaaagacgaccuuuucccuccacuacgcguggaaaaccauggcuauggugcugagcaucgucucacuauuccccuuaugccuguccaccacgucccagaagaccacauggcugcccgugcuccugggcagccucggcugcaaaccgcucccuauguuucuuauaacugagaauaagaucuggggacguaagaguuggccccugaacgaggguauaauggcuguugggaucgucagcauucuccugagcucgcuacucaagaacgacgugccgcuggccggaccgcuaauugccgggggcaugcucguggccugcuacguaauaagcggauccagcgccgacuugucccuggagaaggccgccgaagugagcugggaggaggaggcggaacacuccggcgcgagccacaacaucuugguagaaguccaggacgacgguacgcguaagauuaaagacgaggagcgggacgacacgcuuaccauccugcuuaaggccacccugcuggcggugucugggguuuaccccaugagcauccccgccacacuguucguuugguauuuuuggcagaagaagaaucagcguuccggcgugggguugaucacgccuucgccgccugagguggaacgggccguucucgacgacggcauauaccgaauccugcagcgcggccuacuggggcgcucccagguuggcguggguguauuucaggagggcguauuccacacgauguggcacgugacacgcggggccguacucauguaccaaggaaagcgccucgagcccagcugggcauccgugaagaaggaccugaucaguuacggaggcggguggcgguuccaggggucguggaacacaggggaggaggugcaaguuaucgcuguggagccuggucgaaacccuaagaacgugcagacggccccaggcaccuuuaagaccccugaaggagaggucggggccaucccgcuggauuucaaaccaggcaccucugggucccccaucgugaaccgggagggcaagaucguaggccucuacgggaacggagucgugacgaccagcgggacuuauguguccgccauagcccgagccaaggcuucacaagaggguccauugccagaaaucgaagaugaagucuuccggaagcggaaucugaccauaauggaccuccaucccgggaguggcaagacgcggcguuaccugcccgccaucgugagagaggcgaucaagcggaagcugcgaacccucauacuggcgcccaccagagugguugccagugagauggcagaagcccugaagggggugccgauucgcuaucaaaccaccgccgucaagucagagcauaccgggaaggaaaucgucgacuuaaugugccacgcgaccuucaccaugcggcuguugucccccgugcgcgugcccaauuacaauaugaucaucauggaugaggcccauuucacggaccccgccucgaucgcagcacggggauacaucuccacacgcgucgggaugggagaggcggccgccaucuucaugaccgcaacaccgacggggagcguggaagcauucccccaguccaacgcgauaauccaggaugaggaacgggacaucccagagagaagcuggaacuccggcuacgacuggaucaccgauuuucccggcaaaacuguaugguuugucccgaguaucaaguccgggaacgacauugccaacugccucaagaagaauggcaagcgugugauccaguugagucgcaagaccuuugacacugaguaccagaagaccaagaauaaugauugggacuacguggucaccaccgacauauccgagaugggggccaacuuucgcgcugaccgcgugaucgacccucggcgcugccugaagccagucauccucaaggacggcccugaacgggugauccuggcggggccgaugccagugacggucgccagcgcugcccagaggcgggggcguauaggccgcaaucaaaauaaggagggggaccaauacaucuacaugggccagcccuccaacaaugacgaggaccaugcccacuggaccgaggcaaaaaugcugcuagacaacaucaacacccccgaggggauaaucccggcccuguuugagcccgagcgcgagaagucagccgccaucgauggcgaguaccggcugcgcggggaggcaaggaagaccuucguggaguuaaugcggcgcggagaccugcccguuuggcuauccuacaaaguagcgagcgagggauuccaauacagcgaucggcgcuggugcuucgacggggaacggaacaaccaggugcucgaggagaacaaggacguggagaucuggacuaaggagggcgagcgcaagaaguuacguaccuguuggcuugacgcccggacguacuccgacccuuuagcccugcgagaguucaaggaguucgccgcagggcgccggagcgucuccggugaccugauucucgagaucggcaagcugccacaacaccucacccagaaagcgcaaaaggcccucgacaaccuggugaugcugcacaauagcgaacaaggagggaaggcuuaucgccacgcaauggaggagcuccccgacacgauugaaaccuuaaugcuguuagcgcuuaucgccguucugaccgggggcgucacccucuuuuuccuuuccggacggggccugggcaagacaagcaucgggcuucugugcgugauggccuccucaguguuacuuuggauggcuagcgucgagccccacuggaucgcggcgagcaucauuuuagaguucuuccugauggucuuacucaucccggagccggaccggcaacggacgccccaggacaaccagcuggccuacgucgucaucggccugcuauuuaugauccugaccguggccgcuaacgagaugggcuugcuggagacuaccaagaaggacuuaggcaucgggcacguggccgcugagaaucaccaccacgcgaccaugcucgauguugaccucagacccgcuagcgcauggacccuuuacgcuguggcgaccacgaucaucacgccgaugaugcgccacaccaucgagaacacgaccgccaacaucagccuaaccgcgauugccaaccaggcugcgauccuuaugggccuagauaagggcuggcccaucuccaagauggacaucggggucccccugcuggcccugggcugcuacagccaggucaacccuuuaaccuuaacugccgccgugcucaugcucgucgcacacuaugccauaaucgguccgggacuucaggcaaaggccacucgcgaggcccaaaagaggacugcggccgggauuaugaagaacccaaccgucgauggcaucguggcaaucgaucuagacccaguggucuacgacgccaaguucgagaagcagcucggucaaaucaugcugcugauccucuguacgucccagauccugcuaaugaggaccacaugggcgcucugcgagucgaucaccuuggcgaccgggccauugaccacgcucugggagggauccccggggcgguucuggaauaccaccauagcggugagcauggccaauaucuuuaggggcucuuaccuggccggcgccgggcuggcguucucuuuaaugaaaucccugggcggugguaggcgggggacgggugcccagggcgagacgcugggggagaaguggaaacgccagcucaaccagcuauccaagucugaguuuaacacguacaagcgguccggcaucauggagguagaccgcagcgaagccaaggaggggcuuaaacggggcgagaccaccaagcacgccgucucccgggggacggcgaagcuccggugguuuguggagaggaaccucgugaaaccggaggggaaggucauagaucugggcugcgggagaggcgguuggagcuacuacugcgccggccugaagaaggugaccgagguaaaaggguacaccaaagguggucccgggcacgaggagccuaucccgauggccaccuacggcuggaaucucguuaagcugcacuccggaaaggacguguucuucauuccgcccgagaagugcgacacgcugcucugcgacaucggcgagagcucaccgaauccgaccauagaggagggccgcaccuuacgggugcugaagaugguggagccguggcucagggguaaccaguucugcauaaagauccugaaccccuacaugcccagcgugguggagacacuggaacagaugcagcggaagcacggcgguaugcucgugcggaauccgcucucccggaacaguacccacgaaauguauugggucaguugcggcacggggaacaucgugagcgcggucaauaugaccucccgcaugcuguuaaaucgcuucaccauggcacaccgcaagccgaccuacgaacgggacguggaccugggcgcgggcacucgccacguggccgucgagcccgagguggccaacuuagacauuauagggcagcguauugagaacauuaagaacgaacacaaguccacauggcacuaugaugaggacaaccccuacaaaacaugggccuaccacggcaguuacgaagucaagccaagcggcuccgcuagcagcaugguaaauggcgugguccggcuccugaccaagcccugggacgugaucccuaugguaacgcagaucgcuaugaccgacaccacuccguucgggcagcagcgcgucuuuaaggagaagguggacacgagaacccccaaagccaaacgcggcacagcccaaaucauggaaguuacggcgcgguggcuguggggcuuucucucaaggaauaagaaaccccggauuugcacgcgggaggaguucacacggaagguucgcaguaacgccgcgaucggggcuguguucguggaugagaaccaauggaacucugccaaagaagccgucgaggacgagcgguucugggaccuggugcaucgcgaacgggaguugcacaagcaaggcaagugcgcgaccugugucuacaacaagauggggaagcgugagaagaaacucggcgaguucgggaaggcgaaaggcaguagagcuauaugguacauguggcucggcgcccgcuuccuggaguucgaggcccucggguuuaugaaugaggaccacugguuuucccgugagaacucccuguccggagucgaaggggagggcuuacacaagcucgguuacauccugcgcgacaucagcaggauccccggcggcaacauguacgcggaugacacggccggaugggacacgcgcauuacggaagacgaccugcaaaaugaggccaagauuaccgacaucauggaacccgaacacgcccuuuuagcuaccuccaucuuuaaguuaaccuaucaaaacaagguggugcgcgugcagaggccggcgaagaacggcacggugauggacgcuaucagucgccgggaucagcgcggauccggacaggugggcacuuaugggcucaacaccuuccugcacaaggaggcccagcuuauuaggcagauggaguucgaagggaucuuucucccgucagagcuagagacgcccaaccuagccgggcgcguccucgacuggcuggagcaguacgguguggaacggcuuaagcgcauggcuaucuccggggacgacugcguggucaagccaaucgacgaccgguucgcgacugcucuaaccgcccugaacgacaugggcaagguucgcaaagauauuccccagugggagcccuccaaaggcuggggagacuggcaacaggugcccuuuugcucccaccacuuccaccagcuaaucaugaaggacgucagggagauuguggugcccugccgaaaccaggacgagcucgucggacgggcccgugugagccagggggccggauggucccugcgugagaccgccugccugggcaagagcuacgcgcaaauguggcagcucauguacuuccaccgcagagaucuacgacuggcggccaacgcaaucugcagcgccguuccagucgacugggugcccacgucacgaacuaccuggucuauucacgcacaccaucaguggaugacgaccgaagacaugcucaguguuuggaaccgcgucuggaucgaggagaauccuuggauggaggacaaaacucacgugagcuccugggaggacgucccguacuugggcaaaagggaagaccaguggugugggagccugauugggcucaccgcucgcgcaaccugggcgaccaauauccaagucgccaucaaccaggugcgccgacugaucggcaacgaaaacuacuuggauuacaugaccuccaugaaacgcuucaaaaaugagucggaucccgagggggcccugugguaa

SEQ ID NO: 24006 - RNA, 9879 nt, Artificial Sequence
  derived and/or modified CDS sequence (opt11) from DENV-1__EU482567__SS-prME
agcgucaccaugcugcugaugcugcucccaacugcccucgcauuccaccugaccacccggggcggggagccgcauaugauugugagcaagcaggagcgggguaagucacuccuguucaagaccagugcggggaucaauaugugcacccugaucgccauggaccugggagagcuuugcgaggauacuaugaccuauaagugcccccggaucacggaggcagagcccgacgacguggauugcuggugcaacgcaaccgacaccuggguuacuuauggaaccugcucucagaccggcgaacaucggcgugacaagagguccgucgcgcuggcaccccacgugggcuuagggcucgagacacggaccgagacuuggaugagcuccgagggggccuggaagcaaauacagaagguugagaccugggcccuaagacaccccggguucacgguaaccgcccucuucuuagcgcaugcuauuggcacgucuauuacgcaaaagggcaucaucuuuauccugcucauccucgugacgccuuccauggccaugcgaugcgugggcaucgguaaccgagacuucgucgaaggacugagcggcgcuacuuggguggacgugguccuggagcacgggucaugcgugaccacaauggccaaggacaagccaacgcucgauauugagcugcugaagaccgaggugacuaaccccgcggugcuccgcaagcuuugcauagaagccaaaauuuccaacacaacgaccgauuccagaugccccacacagggcgaagccacgcugguggaggaacaagauucuaauuuugugugucgccggacauucgucgaccgcggcuggggaaacggcugcggccucuucgguaaagggucccugcugacgugugcuaaguuuaagugcgugaccaaacucgagggcaagaucguccaguaugagaauuugaaauacagcgugaucgucaccgugcacaccggagaccagcaccaggucggcaaugagacuaccgagcacggcacgauagccaccaucacuccccaggcgcccaccagcgagauccagcugacagacuacggggcacucacccuggauugcucuccccggacgggccuggacuucaacgagauggucuuacugaccaugaaagagaaguccuggcucguccauaagcagugguuuuuagaucugccgcugcccuggacuagcggggccagcaccagccaggagacguggaaccgccaagaucuguuggugaccuucaagaccgcucacgcuaagaagcaggaaguggucgugcucggcagccaggaaggcgcgaugcacaccgcccuaacaggggccacggaaauccagaccuccggcaccacgaccaucuuugccggccacuuaaaaugccgacugaagauggacaaguugacccuuaaggguaugagcuacgugaugugcacaggcuccuucaagcuugagaaggagguggcggagacgcagcaugguaccguccuggugcaggucaaguacgaaggcacagacgcgcccugcaagauaccauuuagcgcccaggacgagaaggguguaacccaaaacggccgcuuaaucacugccaacccgauugugaccgacaaagaaaagcccguuaauaucgagaccgagccgccauucggggaguccuacauaguggugggcgccggcgagaaggcacugaaguuaucaugguucaaaaagggaaguuccaucgguaaaauguuugaggcuaccgcacgcggggcccgcaggauggccauccugggcgacacugcgugggauuucggauccauuggcggugucuucaccuccgccgggaaacuagugcaccagguguuuggcgccgccuacggggucuuauucuccgguguuagcuggaccaugaaaaucgggaucggcauccuccuaaccuggcugggguuaaacucccgcucgacaucccuuagcaugacuugcaucgccgugggcaugguuacccuguaccuugguguggugguucaggccgacuccgggugcgugauuaauuggaagggccgcgaauugaagugcggaaguggcaucuucguaacaaacgagguccacacguggaccgagcaguauaaauuccaggcagauagcccgaaacggcucagcgccgccaucggcaaggccugggaagaagggguuugcgguauccgcagcgcgacacgccucgagaauaucauguggaagcagauauccaacgagcucaaccacauccugcuggagaacgacaugaaguuuacaguggucgugggggacgccaacgggauacuggcccagggaaagaagaugauccgaccccagcccauggagcaccgguacaguuggaaauccuggggcaaagcuaagaucauaggggccgacauccagaacgccaccuucaucaucgacgggcccgacacgccggagugucccgaugaccagcgcgccuggaauaucugggagguggaggacuauggcuucgggauuuucacaacaaacaucuggcugaaacuucgggacucauacacccagaugugcgaccaccgccuuauguccgcagcaaucaaggacagcaaagcaguacacgccgauaugggcuauuggauugagagcgagaagaacgagaccuggaagcuggcacgcgccaguuuuauagaggugaaaacaugcaucuggcccaagagccacacccuauggagcaacgguguauuggaguccgagaugaucaucccaaagauuuacgggggcccgaucagccagcacaacuaccgccccggcuacuucacccaaacggccggccccuggcacuuagggaagcucgaguuggauuucgaucugugcgagggaacgaccgucgucguggacgagcacugcggaaaucgcgguccgagccugagaaccacuaccgucacuggcaaaauuauacacgaguggugcugucggagcugcacccugccgccgcugagauucaggggggaggaugguuguugguacgggauggagauccgcccgguaaaagagaaggaggagaaccucgugcgguccauggucagcgcgggcucaggagaaguggacuccuucagccuggggauauuauguguuuccaucaugaucgaggaagucaugcggagcagaugguccagaaaaaugcucaugacagguacucuggcaguauuucuguuacugaucaugggacagcuuaccuggaaggaccucaucaggcuuugcaucauggugggcgcgaaugccagcgaccggauggggaugggcaccacguaccuggcccucauggcgacuuucaagaugcgcccgauguucgccgucggacuacucuuucggcgccuuacgucucgagaggucuugcuucucaccaucggguugagccuggucgccagugucgaguugccuaacagucuggaggagcugggcgauggacuggcaaugggcaucaugaugcugaagcugcuuacggaguuccagccccaccaguuauggaccacccuccugagcuuaaccuucaucaacacgacgcugucucuggacuacgccuggcggacaauggcuaugguacugucuauuaucucuuuguucccacucugccucucuaccacgagccagaagacgaccuggcugccgguucuccugggcuccuucgggugcaagccccuuaccauguucuuaauuacggagaacaaaaucuggggccgcaaaagcuggccccugaacgagggcaucauggccaucggcaucguaaguauccugcucagcagccugcucaagaacgacgugccccucgccggcccguuaaucgcaggugguaugcugauugcuugcuacguuaucuccggaagcagugccgaccuuucguuggagaaagccgcggaaguaucaugggaggaggaggccgagcacagcgguacgucccacaacauccucguggaaguccaggacgacggcaccaugaagaucaaggacgaggagcgcgacgacaccuugaccauucuucugaaggcgacucuccuggccgugagcgggguauacccgauguccauccccgcgacccuguuugugugguacuuuuggcagaaaaaaaagcaacggagcggggugcucugggacacucccuccccgcccgagguggagcgagccguccuggacgacggcaucuauaggauacugcagcggggccugcuggggaggagccaggugggcgugggggucuuccaggacggcgucuuucauaccauguggcacgugacucgaggggccgugcugauguaccaaggcaagcgacuagagcccaguugggcgagcguaaaaaaggaccuuaucuccuacggagggggcuggcgcuuccagggaucguggaauaccggcgaagaggugcaggucauugcaguggagcccgguaagaacccgaagaacgugcaaacaacccccggcacguuuaaaacucccgagggggaaguuggugccaucgcccuugacuucaagcccggcacuuccggaagcccgauugugaaccgggagggcaagaucgugggcuuauacgguaauggugucgugacgacguccgggacauaugucagcgccaucgcgcaggcaaagaccagucaggagggcccccuacccgagaucgaggacgaagucuucaagaagcgcaacuugaccauaauggaccugcacccgggcuccggcaagacucggcgcuacuugccagcaauagugcgggaagccaucaagaggaagcuucgcacacugauacuggcgcccacccguguggucgccagcgaaauggcagaggcccugaagggcaugcccauccgcuaccagaccacggccgugaagagcgaacacaccggacgagaaaucguagacuuaaugugucaugcaaccuucacaaugcggcucuuaagcccuguacgggugcccaauuacaacaugaucauaauggacgaagcccacuucacggacccggcaaguaucgcggcuagaggcuacaucagcacucggguggggaugggagaagcggccgccauuuucaugacagccacgccucccggguccgucgaggccuucccccagagcaaugcggugauucaagacgaggagcgcgacaucccggagcggucuuggaacaguggcuacgacuggaucacggauuucccgggcaagacugucugguucguuccgucuaucaaaagcgggaaugauaucgcuaacugcuugcggaagaacggcaagcgggucauucagcuaucccgcaagacuuuugacacugaguaucagaaaacuaagaacaaugacugggauuacguggugaccacagacaucucggagaugggagcaaacuuccgggccgaccgcgugaucgaccccagacgcugucugaaacccguaauccugaaagacggcccugagcgcgugauccucgcgggaccuaugcccgugacagucgcuagcgcggcccagcgccggggccgaaucggccgcaaccaaaacaaagagggggaccaguaugucuauaugggucagccccuuaacaacgaugaggaccacgcccacuggacggaggcgaaaaugcuguuagacaacauuaacaccccagaggggaucaucccggccuuauuugagcccgagcgggagaaguccgcggccaucgacggcgaguaccgccugaggggagaggcccgcaagacuuuugucgagcucaugaggcguggagaucugcccgucuggcuauccuacaaaguggcguccgaggguuuccaauacuccgaccggcgcuggugcuucgacggggagagaaacaaucaagugcucgaggagaauauggacgucgagaucuggaccaaagagggugaacgcaaaaagcugaggccgcgauggcucgaugcucggacuuacucggacccgcucgcccugagggaauucaaggaguucgccgccgggcggaggagcguauccggcgacuuaauucuagagaucggcaagcugccucagcaccugaccuugcgggcacagaaugcacuggauaaccuggugaugcuccacaauagcgagcagggugggaaagccuacaggcaugccauggaggaacugccagacaccaucgagacucugauguuacucgcucugaucgcgguucucaccgggggcgugacgcuguucuuucugagcgguaaaggccugggaaagaccucuaucgggcuguugugcgugauggcauccagcgcccuccuguggauggccaacgucgagccccacuggaucgcggccuccauuauacuagaauucuucuuaaugguguugcugaucccggagccggaccggcagcgaacgccccaggacaaccagcucgccuaugugguaaucggccugcucuucaugaucuugaccgucgccgccaacgagaugggguugcuagaaacgaccaagaaggacuuaggcauagggcacguagccgccgagaaccaucaccacgccacaaugcucgacgucgaccugcguccggcaagcgcguggacgcucuaugcagucgcaacgacagugauaacgcccaugaugcgccauaccaucgagaauacgaccgccaacaucucccugacggccauugccaaccaggcagccauccugaugggcuuagacaagggauggcccaucaguaagauggacaucggggucccccuucuggcucucggaugcuacucccaagucaacccucugacacugacggccgcagugcucaugcuuguggcccacuacgccauaauagggccaggcuuacaagccaaggcuacacgggaggcacagaagaggaccgccgccgggauaaugaaaaacccgaccguugacggcaucguagccaucgacuuggaccccgucguguacgaugccaaguucgaaaaacaacugggccagaucaugcuguuaauacugugcacgagccagauacugcugaugcggacuacaugggcgcugugcgaguccaucacccuggccacggggccgcucaccacccugugggagggcagcccggggaaguucuggaauaccacgauugccguuuccauggccaacauauuucggggcucuuaccucgcuggcgcggggcucgcuuucucccugaugaagucccugggcggaggccgcagagggacgggcgcccagggcgagacccucggggaaaaguggaagcgccaguuaaaucaacuauccaaaagcgaauucaacaccuauaagcggagcggcauaauggaggucgaccguuccgaggcccgggaagggcucaagcgcggcgagacgaccaagcaugcggugagccgugggacggcuaaacugaggugguucguggagagaaaucuggucaagccagagggcaaggugauagaccuggggugugggcgcgguggcugguccuacuacugcgccggccucaagaaggugaccgaagugaagggcuacacgaagggcgggcccgggcacgaggagcccauacccauggccaccuacgguuggaaccugguuaaacuuuacucugggaaagauguguucuucaucccccccgagaagugcgacaccuugcuuugcgacaucggcgaauccagcccgaacccaaccauagaagaggggcguaccuuacgcguccuuaagaugguggaaccuuggcuucggggcaaucaguucugcauuaagauucuaaacccguacaugccguccguaguagaaacccuagagcagaugcagcgcaagcacggaggaaugcugguucggaacccacugagccgcaacuccacccacgaaauguacuggguaagcugcggcaccgggaauaucgucagcgccgugaauaugaccucccgaaugcuauuaaaccguuucacgauggcucaucggaagcccacguacgaacgagacguggaucuaggcgccgggacccgccacguggcgguggagccugaggucgccaaccucgacaucaucggccagcggauugagaacaucaagaacgagcauaaaagcaccuggcacuacgacgaggacaacccuuacaagacgugggccuaucacggaagcuacgagguaaaaccguccgggagcgcguccagcauggugaacggcguaguccgcuuauuaaccaagccuugggaugugauccccauggucacgcaaauagccaugaccgacacgacccccuucggccagcagaggguauucaaagagaagguggauacccgcacuccgagagcgaaacgcggcacggcacagaucauggaggucaccgccaaguggcucuggggcuuccugucccggaacaagaagccccgcauauguacccgggaggaguucacccgcaagguucgcaguaacgcagccaucggcgccguguucgucgacgagaaccaguggaauucagccaaagaagcggucgaagacgaacgcuuuuggaaccuggugcaccgagagcgcgaguuacacaaacaagguaagugcgccacguguguguacaauaugaugggaaagcgggaaaagaagcugggcgaauucgggaaggccaagggcucccgagccaucugguacauguggcugggcgcccgguucuuggaguuugaggcgcugggguucaugaacgaggaucacugguucagucgcgagaacaguuucagcggcguggagggggagggccugcacaaacuuggauacauacuuagagacaucaguaagaucccgggcggcaauauguaugcugaugacaccgcagggugggacacccggauuacagaggacgaccugcagaacgaggccaagauaacagauaucauggagcccgagcacgcacugcucgcuaccagcauauuuaagcugaccuaccaaaacaaggugguccgcgugcagaggccagcaaagaacggcaccgucauggacgucaucagucgacgggaccaacgcgggagcggccaggugggcacuuacgggcucaauacauucaccaacauggaggugcagcugauccggcagauggaguccgaggggaucuuccuccccagcgagcuggagacgccgaaccuggcugagcgcguccuugacugguuagagaagcacgggaccgagcggcucaaacgcauggccaucucuggggaugacugcguggugaaacccgucgacgaacguuucgcuaccgcacugaucgcccucaacgauaugggcaagguacgcaaagauaucccccagugggagccaucuaaaggguggaacgacuggcagcaggucccguucugcucccaucacuuucaccaguugaucaugaaggacggucgggagaucgucgugcccugccgcaaccaggacgagcuugucgggcgggcccgcgucucucaaggugccgguuggucccuucgggagacugccugucugggcaagagcuacgcgcaaauguggcaacuuauguacuuucaccgccgggaucugagacuggcugcgaacgccaucugcuccgcggugccaguggacugggucccgacaagccgcacaacuuggagcauacacgcucaucaccaguggaugaccacagaggacaugcugaguguguggaaccggguuuggaucgaggagaacccguggauggaagacaagacccaugucucuaguugggaggaggugcccuaccucggcaagagagaggaccagugguguggcagccugaucggccugacggcccgggccaccugggcaaccaacauacaaguugccaucaaccagguacgucgguugauuggaaacgagaacuaccucgacuacaugaccaguaugaaacgauucaagaacgagagugaccccgagggcgcacuuugguga

SEQ ID NO: 24007 - RNA, 9879 nt, Artificial Sequence
  derived and/or modified CDS sequence (opt11) from DENV-1__FJ390378__SS-prME
agcgucaccaugcuguuaauguugcugccuaccgcccucgcguuccaccugaccacccggggcggggagccccacaugaucguuuccaagcaggagcggggcaagucccuuuuguucaagaccuccgcggggaucaauaugugcacccugaucgccauggaccugggagaacucugcgaggacaccaugaccuauaagugcccccggaucaccgaagccgaacccgacgacguggacugcuggugcaaugcgaccgacacuugggugaccuacgguaccuguucccagacuggcgagcacagacgcgauaagcguuccgucgcacuggcgccccacgugggccuggggcuggagaccagaaccgagaccuggaugagcuccgagggggccuggaagcagauucagaaggucgagacuugggcgcugagacaccccggguucacgguuaccgcccuguucuuggcgcacgcuaucgggaccagcaucacccagaaggggaucaucuucauccuucuaaugcucgugacgcccuccauggcaaugcgcuguguuggcaucgggaaccgggacuucguggaggggcugagcggcgccacuuggguggacgugguccuggaacacgggucaugcguuaccaccauggccaaggacaagcccacgcuugauauugaacugcugaagaccgaggugaccaaccccgcgguccuccgcaaacugugcaucgaggccaagauuagcaacaccacgacggacucccggugcccgacccagggcgaggcaacucuugucgaggagcaggacagcaacuucgucugccgacggacguucguggaccgcgguuggggaaacggcugcggucucuucggcaagggcucccugcuuacuugcgcgaaauucaagugcgugaccaaguuagagggcaagaucguccaauacgagaaccugaaguauagcguaauugugaccgugcacacgggcgaccaacaccaggucgggaaugagacgaccgagcacggcaccaucgcaaccaucacaccccaggcgcccaccucugagauccagcugacggacuacggugcacuaacccuggacugcagcccccggacgggccuggacuuuaacgagauggugcuccugacgaugaaggaaaaguccugguuaguccacaagcagugguucuuggaucuaccgcugcccuggacaagcggagcaagcaccucucaggagacguggaaccgccaggaucuccuggugacauuuaagaccgcgcacgccaagaagcaggagguaguggugcugggcagccaggagggugcgaugcacaccgcacuaacgggugccacugagauccagaccucgggcacuacgaccaucuucgccgggcacuuaaaaugccggcugaagauggauaaacuuacuuugaaaggcaugaguuacgugauguguaccgguagcuucaaguuggagaaggagguugcagagacgcagcacggcacaguguugguucaggucaaguacgagggaacggacgccccuugcaagaucccauucagugcccaggacgagaaggggguuacccagaacggccgccucaucacggccaacccgauugugaccgacaaagaaaagcccgucaacaucgagaccgagccaccguucggggaguccuauaucgugguaggcgccggugaaaaggcacugaagcugagcugguucaagaagggguccaguauuggcaagauguucgaggccaccgcucgaggagccaggaggauggcaauccucggcgauacggcgugggacuucggguccauaggaggaguuuucaccucagugggcaagcucgugcaccaggucuucggcgcggccuacggggugcuguucuccggcgucagcuggaccaugaagaucggaaucggcauacuccugaccugguugggccucaauucccgcagcacgucacugagcaugacauguaucgccgucgggauggugacucuguaccucggggucaugguucaggcugacuccggcugcguaaucaacuggaagggucgcgagcugaagugugggagcgggaucuucgugaccaacgagguacacacguggaccgagcaguacaaguuucaggcggacagcccgaagcgguuauccgccgccaucggcaaggccugggaggaggggguauguggcauccgcagcgccacacggcucgagaacaucauguggaaacagaucucuaaugagcugaaccacauccuguuggagaacgacaugaaguucaccguggucguaggggacgcuaacggcauccuggcucaggggaagaaaaugauccgcccucagcccauggagcacagguauagcuggaagucaugggggaaggccaagaucaucggcgcagacauccagaacucaaccuuuaucaucgacgggcccgacacgccagagugccccgaugaucagcgcgcguggaauaucugggagguagaggacuacgguuucggcaucuucacuaccaacauauggcugaagcuccgggacuccuacacccagaugugcgaccaccggcugauguccgcagccauuaaggauuccaaggccguccacgcagacauggguuacuggaucgagucugaaaagaacgagacguggaagcuggcgcgggcguccuuuauugaagugaagaccugcaucuggcccaaaagccacacccucugguccaacggcgugcuggagagcgagaugaucauccccaagaucuacgggggcccuauuucccagcacaauuaccggcccggguacuucacccagacagcaggcccguggcaccugggcaaguuggaacuggauuucgacuuaugcgagggcaccacugucgugguggacgagcacugcggcaaccgcggcccgagccuuaggaccacgaccgucaccggcaaaauaauccacgaguggugcuguagguccugcacccugccgccccugcgcuuccgcggggaggauggcugcugguacgggauggagauuaggccagucaaggagaaggaagagaaccuaguccggucgaugguuucagccggcucaggggagguugacagcuuuuccuuagggauccugugcgugagcaucaugaucgaagaagucaugcgcucccgguggucgaggaagaugcucaugacggggaccuuggcgguguuccuccuccugaucauggggcaguuaaccuggaaugaccugauccgccuguguaucauggugggugcgaacgccuccgaccggauggggauggguaccacuuaccuggcccucauggccaccuucaagaugcgaccgauguucgcugucgggcugcuguucagacgacugacgucacgggaggugcugcugcucaccaucgggcugucccuggucgccuccguagagcuccccaacucccucgaggagcugggcgacgggcucgccaugggcauuaugaugcugaaacuguugacggaguuccagccccaccaacuguggaccacccuccucagccugacauucaucaaaacgacccugucccucgauuaugccuggcgcaccauggcuaugguuuuaagcaucgucucacuguucccccuaugccugagcaccacuucccaaaagacgacauggcugccugugcugcugggcaguuucggguguaagccgcuuaccauguuucucaucacggaaaacaagaucuggggccgaaaaucuuggccucugaacgaggggauuauggcgauuggcaucgugucaauccugcucucgagucugcugaagaacgacguaccccuggcgggaccacugaucgccggcggaaugcugaucgcauguuaugugaucuccggguccagcgccgaccucucccuagagaaagcggccgaaguuagcugggaggaagaggcggaacacuccggcaccagccauaacaucuuagucgagguucaggacgacgggacgaugaaaaucaaggacgaggagagggaugacacgcucaccauccuccugaaagcaacgcuccuggccgucuccggagucuacccuaugagcaucccugcgacgcucuuugugugguauuucuggcagaagaagaagcagcgaucggggguucucugggacacccccaguccacccgagguagagcgcgccguccuggacgacggcauuuaccggauccugcagcgcggccuccucggccggagccaggugggcgucggcguguuucaggauggcguguuccacaccauguggcacgucacgcgcggggccgugcuaauguaccagggcaagcgacuggaacccucgugggccucggugaagaaggaccucaucagcuauggagggggauggagguuccaggggagcuggaacacgggagaggagguccaggugaucgcaguggagcccggcaagaauccgaagaacguccagaccacccccgguacguuuaagacccccgagggcgaaguaggagcgaucgccuuggacuuuaagcccggcacuagcggguccccgaucgugaacagggagggcaagauaguuggccuguaugggaacggcgugguaaccacaagcgggacguacgucagcgccauagcccaggcgaagaccucgcaggagggcccgcuccccgagauagaggaggagguguucaagaagcgcaaccugaccauuauggaccugcacccggggucagguaagacgcggcgcuaucuccccgcaauuguucgggaagccaucaagagaaagcugcgcacgcugauccucgcccccacacgggucguggccagugaaauggcagaggcgcuuaaaggaaugcccauccgcuaccagacgacggccguaaagagcgagcacacagggagggaaaucguagaccugaugugccaugccaccuucacaaugaggcuccuguccccggugcgcgugccuaauuauaacaugaucaucauggacgaagcccacuucacugauccggcgagcaucgccgcccgcggguacaucucgaccagggucgggaugggugaggccgccgcaaucuucaugaccgccacgccucccgggagcguugaggccuucccccaguccaacgcagugauccaggaugaagaacgcgacauccccgagcggagcuggaacuccggcuacgacuggaucacggacuuccccggcaagaccgucugguucgugcccucuaucaaguccggaaacgacaucgccaacugucuacguaagaacggcaagcgggugauccagcuaucucgcaagaccuucgacaccgaguaccagaagacgcggaacaacgacugggacuaugucgugacaaccgacaucuccgagaugggggcgaauuuccgagccgaccgagucauugacccccgccggugccugaagccugucaucuugaaagacggucccgagcgcgugauccucgccgggccgaugcccgugaccgucgccuccgcggcccaacggcgcggccgcaucggcaggaaccagaacaaggagggcgaccaguacguguacaugggccagccccugaauaacgacgaggaccacgcccacuggacggaggccaagaugcugcucgacaacaucaacacacccgaggggaucaucccggcccuauucgagcccgagcgcgagaaguccgcagccauugacggcgaauaccgccugcgcggggaggccaggaagaccuuugucgagcucaugcgacggggagaucugcccguguggcugagcuacaaaguggccuccgagggcuuucaguacucagaccgucgguggugcuucgacggggagaggaacaaccagguccuugaggagaauauggauguggaaaucuggaccaaagagggcgagcggaaaaagcugcgcccacgguggcuggacgccagaacguauagcgacccgcuggcgcugagagaauuuaaggaauuugccgccggccgccgguccgugagcggcgaccugauucucgagaucgggaagcucccccaacaccugacccuacgcgcucagaacgcccuagacaacuuggucaugcuccacaauuccgaacagggcgggaaggcguaccggcacgccauggaggaguuacccgacaccaucgagacccugaugcuccuagcccugaucgccgugcuaaccgggggcgugacgcuguucuuccugagcgggaaggggcucggcaagaccucuaucgggcugcugugcgucauggccagcuccgccuuacuguggauggcgaacguggagccgcacuggaucgccgccagcauaauucuggaguucuuccucaugguguuacugaucccggagcccgaccgccaacggacgccacaggacaaucaacucgcuuacgucgucaucggcuugcuguucaugauccucaccguggcggccaacgagauggggcugcuggagacgaccaaaaaggaucucgguaucgguuacguggccgccgagaaccagcaccacgcgaccauguuggacguagaccugcgcccggccuccgccuggacacucuacgccguugccacgaccgugaucacccccaugaugcgccacaccauugagaacacgacggcgaacaucagccucaccgccaucgcgaaccaagcggccauccuaaugggccucgauaagggcuggcccaucuccaagauggacaucggggugccccugcuggcgcucggaugcuacucccagguuaacccgcugacccucacggccgccguccucaugcugguggcccacuacgcgaucauagggcccggccugcaggccaaggcgaccagagaggcccaaaaacguacagccgcagggaucaugaagaaccccacgguggacggcauugucgccaucgaccucgaccccgugguuuacgacgccaaguucgagaagcagcugggccagaucaugcugcuaauccuuugcacgucccagauccugcugaugcggaccaccugggccuugugcgagucuauaacccuggcuaccgguccucuaacaacccugugggagggcagccccgggaaguuuuggaacacgacuaucgcaguuucgauggccaacaucuuccgcggcuccuauuuggccggagccgggcucgccuuuagccugaugaagucccugggcgggggccggcgcgggaccggcgcgcagggcgagacccucggggagaaguggaagcggcagcugaaucagcugagcaagucugaguucaauaccuacaagcgcuccggcaucauggaaguggaccggagcgaagcuaaagaagggcucaagcggggcgagacgacaaagcacgccgucucccgggguaccgccaaguuacgcugguucgucgagagaaaccuaguaaagcccgagggcaaggugaucgaucugggcugcgggcgcggcggguggucauacuacugcgcggggcucaagaagguuaccgaagucaagggguauacgaagggcggccccgggcacgaggaaccuauacccauggccacuuacggcuggaaccuggugaaacuuuacuccgggaaggacgucuucuucacuccgcccgagaaaugcgacacacuccugugcgauaucggcgagucauccccaaaccccacuauugaggaagggcguacgcugcgcgugcucaaaaugguggaacccuggcugcggggcaaccaguucugcaucaagaucuuaaaucccuacaugccuagcguuguggaaacacucgagcagaugcagcgcaaacacggcgggauguuggugcggaacccuuugucccgaaacagcacccacgagauguauuggguauccugugguaccgggaacaucgugucggccgugaacaugacgucccgcaugcuauuaaaccgguucaccaugacccaccgcaaacccaccuacgagcgggacgucgaccugggcgccggcacgaggcacguggccguggagcccgaggucgcgaaucucgacaucaucgggcagcggauugagaacauaaagaacgagcacaagagcaccuggcacuacgacgaggauaacccguacaaaaccugggccuaccacggcaguuaugaggucaagcccagcggguccgcaagcucuauggugaacggcgucgugagacugcugacgaagcccugggaugucauccccaugguuacgcagaucgccaugaccgauaccaccccguucggccagcagagaguguucaaagaaaaggucgauacgcggacaccccgggccaagcgcggcaccgcgcagaucauggagguuaccgccaaauggcuauggggcuuccugagccggaacaagaagccccgcaucugcacgcgagaggaguuuacccgcaaagugcggagcaaugccgccaucggggccgucuucguggacgagaaccaguggaacuccgcgaaggaggccguggaagacgaacgcuucugggaucugguucaucgggagcgcgagcuccacaaacagggcaagugugcgaccugcgucuacaacaugauggggaagcgggagaagaagcugggcgaguucgguaaggccaagggcagccgcgccaucugguauauguggcugggcgcccgguuccucgaguucgaggcgcuuggguucaugaacgaagaccacugguucucucgcgagaacuccuucuccgggguggagggggaaggccuucacaagcucggguacauccugcgcgacaucagcaaaaucccgggcggcaacauguacgcagacgacaccgccgggugggauacgcgcauuaccgaggacgaccugcagaacgaggcgaagaucaccgacauuauggagcccgagcacgccuuacuggcaacguccaucuucaaacugacuuaccagaauaaggucgugcgcguacaacggcccgccaaaaacggaaccguuauggacgugaucagccgccgagaccagcgcggguccggucaggugggcaccuacgggcucaacaccuucacgaacauggagguccaguuaauccgucagauggagagcgaggguaucuuucugcccuccgaacuagagaccccgaaccuggccgagcgcgugcugaacuggcucgagaagcaugggaccgaacgucugaagcgcauggcgaucagcggcgacgacuguguggugaagcccguggaugaccgguucgcuaccgcacugaucgcauugaacgacaugggcaaaguccgcaaagacaucccacagugggaacccucgaagggcuggaacgacuggcagcagguaccguucugcagccaccauuuucaucagcugaucaugaaggacggccgggagauuguagugcccugccgcaaccaggaugagcuggucggacgugcucgcgugucccagggcgcaggguggagccuacgcgagacggccugucuaggcaagucuuacgcccagauguggcaacugauguauuuccaccgucgggaccugcgccuggccgccaaugcgaucuguagcgccgugccggucgacuggguaccgaccagccgcacuacaugguccauucacgcgcaccaccaguggaugacuacggaggauaugcugagcguguggaaccgggucuggaucgaggaaaacccguggauggaggacaagacccauguguccagcugggaggagguucccuaccucgggaagcgcgaggaucaauggugcgguucccugaucggccugaccgcccgggcgaccugggccacgaacauccagguggcuaucaaucaggugcggcgguuaaucggcaacgaaaauuaccuggacuacaugaccagcaugaagcgguucaagaacgagagugacccagagggcgcccugugguga

SEQ ID NO: 24008 - RNA, 9879 nt, Artificial Sequence
  derived and/or modified CDS sequence (opt11) from DENV-1__FJ205872__SS-prME
uccgugaccaugcugcucaugcugcugcccacugcccucgcauuccaccuaaccacccgaggcggagagccccacaugaucguuuccaagcaggagcggggaaaaucccuccucuuuaagaccuccgcugggauaaauaugugcacguuaaucgcaauggaccucggcgagcucugcgaggacacaaugaccuacaagugcccccggaucaccgaggccgagccagacgacguggacuguuggugcaaugccacugacaccuggguuacguacgggaccugcagccagaccggcgagcaccgucgcgacaagcgauccgucgcccuugcgccccacgugggccuggggcucgagacucgcacugagacuuggaugagcuccgagggcgccuggaagcagauacaaaagguggagaccugggcccugcggcaccccggguucacggugacugccuucuuucucgcgcacgccaucggcaccagcaucacccagaaagggauaaucuuuaucuugcugaugcuggucacccccagcauggccaugcguugcguaggcaucggcaaccgggacuucgucgaggggcucagcggcgccaccuggguggacgucguauuggagcacggguccugcguuaccacgauggccaaggacaagcccacgcuggacaucgagcuccuuaagaccgaggugaccaaccccgcggucuuacgcaagcucugcaucgaggccaagaucagcaacaccacgaccgacucccggugcccgacccagggcgaagccacccugguagaggagcaggacucuaacuucgucugccgccggacauuugucgaucgcggcugggguaacggcugcgggcuauucggcaaggggucccucuuaacuugcgccaaguucaagugcgugacaaagcuggagggcaagaucguucaguacgaaaaccucaaguacagcgucaucguuaccguacacacgggcgaccagcaccaggucgggaacgaaaccaccgagcacggcaccaucgccaccaucaccccccaggcgcccacuuccgagauccagcuuaccgacuacggggcccugacccucgauugcuccccccggacgggucuggacuucaacgagauggugcugcucacaaugaaggagaaguccuggcucguucacaagcagugguucuuagaccucccccugcccuggaccagcggcgcaagcaccucccaggagacguggaaccgucaggaccugcucgugaccuucaagacugcccacgccaagaagcaggagguggucgugcugggcagccaagagggcgcaaugcacaccgcccugaccggggccacugagauucagaccucugggaccacgaccauauucgcugggcaccucaagugccgccugaagauggacaagcugacccucaagggaaugagcuacgugaugugcaccggguccuucaaacuggagaaggaggucgccgagacucagcacggaaccguccuggugcaggugaaguacgagggcacagacgcaccuugcaaaauccccuucagugcccaggacgagaagggggugacacaaaacggcagacuaaucacggccaacccgaucgugaccgacaaggagaagcccgucaauauagaaaccgagccgcccuucggcgagagcuacaucguggugggugccggcgaaaaggcgcugaagcugagcugguucaagaagggauccucgaucggcaagauguucgaggcuacggccagaggggcccgcagaauggcgauccugggcgauacggcuugggacuucggguccauuggcggcgucuucaccagcguagggaagcucgugcaccaagucuucggcgccgccuacggggugcuguucuccggcguuucauggaccaugaagaucgggaucggcauccugcuaaccuggcugggccugaauucccgcagcacgucccucagcaugaccugcaucgccgucgggauggugacccuguaccugggcgugaugguccaagccgacuccgggugcgugaucaauuggaagggccgcgagcucaagugcgggagcggcaucuucgugacgaacgagguccacacguggaccgagcaguacaaguuccaggcggacagcccgaagcgguuguccgccgcuaucggcaaggccugggaggagggagugugcggcauccggagcgcaacccggcuggaaaacauaauguggaagcagauuucaaacgagcucaaucauauccuguuggaaaaugacaugaaguuuaccgucguggucggggacgccaauggcauccucgcccagggcaagaaaaugaucaggccacagccaauggaacaccgguacagcuggaaguccuggggcaaggccaagaucaucggggccgacauccaaaacagcaccuucaucaucgacgggcccgauacgccggagugccccgaugaccaacgcgcguggaacaucugggagguggaggacuacggcuucgggaucuucacaacgaacaucuggcugaagcugcgggacuccuacacccaaaugugcgaucaccgccuaaugucagcagcaaucaaggacuccaaggcgguccacgccgacaugggcuacuggaucgaaagcgagaaaaacgagacguggaagcuggcgcgggcguccuucaucgaagucaagaccugcaucuggcccaagagccauacccuguggaguaacggcgugcucgagagcgagaugaucauccccaagaucuacgggggcccgauuagccagcacaauuaccgcccuggguacuucacccagacggccggcccguggcaccuggggaaacuggagcucgacuucgacuuaugcgagggcaccaccguggugguggacgagcacugcggaaaccgggggccgucgcuacgcaccacgaccgucaccgguaagaucauccacgaguggugcugcagguccugcacccuaccgccucugcgauuccgcggagaggacggaugcugguacggcauggagauccgccccgugaaagagaaggaggagaacuuagugcgaagcaugguuagcgccggcuccggugagguggacagcuuuucccucgggauccugugcgugagcauuaugaucgaagaggugaugcgcucccgguggucgcgcaagaugcugaugacgggcacccuagccgucuuuuugcugcucaucauggggcagcugaccuggaacgaccugauccgccucugcaucauggugggcgcgaacgcauccgaccggauggggaugggcaccacguaccuggcccugauggccaccuucaagaugcgcccgauguucgcugucggccuccuguuucggagacugaccagccgggagguccuccugcugaccaucggccucucccugguggcgagcguggagcugccaaacucccucgaggagcugggcgacggacuggccaugggcaucaugaugcucaaacugcugacggaauuccagccucaccagcuuuggacuacucugcugagccuuaccuucaucaagacgacgcuauccuuagacuacgcuuggcgcaccauggccauggugcucagcaucgucucccuguuuccccuaugccuaagcaccacgucccagaagaccaccuggcugccggugcuacucggcucuuuuggcuguaagcccuuaaccauguuccugaucacggagaacaagaucuggggacggaaauccuggccccucaaugaagggaucauggcgaucggcaucgugagcauacugcugagcucucuccugaagaacgacgucccccucgcugggccacucauagccggcgguauguugaucgccugcuacgugaucagcgggucgagcgccgacuuaucgcucgagaaggcggccgaggugagcugggaagaggaggcagagcacucaggcacgucucacaacauccuggucgaggugcaggaugacgguacuaugaagaucaaggaugaggagcgcgacgacacucugaccauucuccugaaagcuacucugcucgcuguguccggcgucuaccccaugagcaucccggcgacccuguucgugugguacuucuggcagaagaagaaacagcgguccgggguccugugggacacccccagcccgccugaagucgagagagccgugcucgacgacggcaucuaccggauccugcagcgcggacugcuggggcggucccaggugggcgucgggguguuucaagacggcguguuccacaccauguggcacgucacgcgcggggccgugcuuauguaccaggguaaacgguuggagcccagcugggcauccgugaagaaggaccugaucagcuacggcgggggcuggcgcuuccagggguccuggaacacaggcgaagagguccaggugauagcuguggagccggggaagaacccgaagaacguccaaaccacacccggaacguucaagacucccgagggcgaggugggggcuauagcccucgacuuuaagcccggcaccaguggguccccgaucgugaaccgugagggcaaaaucgucggucuguaugggaacggcgucgugaccacgagcgggaccuacguaagugccaucgcccaggccaagacaucccaggaggguccccugcccgagaucgaggaggagguguucaagaagcgcaaccucaccauuauggauuugcacccgggaagcgguaagacgcggcgcuaccugcccgcgaucguccgggaggccaucaaacgcaaacucagaacgcuaauccuggccccuacucgggucguggccagcgagauggcggaggccuugaaggggaugcccauaagauaccagacgacggccgucaagagcgagcacacuggucgggagaucgucgaccugaugugccacgccaccuucaccaugcgucugcucuccccgguucggguccccaacuacaacaugaucaucauggacgaggcccacuucaccgaccccgcgucaaucgccgccaggggguacauuuccacacgcgucgggaugggggaggccgccgcgaucuucaugacggccacgccgccggggagcgucgaagccuucccucagucaaaugccgugauccaggacgaggagcgcgacauccccgaaagaagcuggaacuccgguuacgacuggaucacggacuuccccggaaagacggucugguucgugcccagcaucaaguccgggaacgacaucgccaacugucugcgcaagaacggaaagcgggucauccaauuaagccggaagacuuucgacaccgaguaccaaaagacgcggaacaacgacugggacuacgucguuaccaccgacaucagcgagaugggggccaacuuccgcgcugaccgggugauugacccccgccggugccugaaacccgucauccugaaggacgggcccgagcgcgugauccuugccgggcccaugcccgugaccgucgccagcgcggcccagcggcgcggccgcauuggccggaaccagaacaaggagggggaccaguacguguacaugggccagccccucaacaacgacgaggaccaugcccacuggacggaggccaagaugcugcuggacaacaucaacacccccgagggaaucaucccggccuuauucgagcccgagcgcgagaagagugccgccaucgacggcgaguaccgguugcgcggggaggcacggaagaccuucgucgagcugaugcgccggggcgaccuccccguguggcugagcuacaaaguggcaucggaggguuuccaguacucggaccgccgguggugcuucgacggggagcgcaacaaccaaguuuuagaggagaacauggacguggagauauggacaaaggagggcgagcggaagaagcuacggccccguuggcuggacgcaaggacguacagcgacccgcuggcgcugcgugaguucaaggaguucgcggccgggcgccgguccgugagcggcgacuugauccuggagaucggcaagcuaccccagcaccugaccuuacgcgcccagaacgcccucgacaaccuaguaaugcugcauaacuccgagcagggcgggaaagcguaccggcacgccauggaagaacuccccgacaccaucgaaaccuuaaugcugcucgcucugaucgccgcgcugaccggaggcgugacccucuucuuccugagcgggaagggccugggcaagaccuccaucggguugcugugcguaauggccaguuccgcccugcucuggauggccaaugucgaaccccacuggaucgccgccagcaucauccuggaauuuuuccucaugguacucuugaucccggagcccgaccgccaacgaacgccccaggacaaccagcucgccuacguggucaucggccuccuguucaugauucugaccguggcggccaacgagauggggcuccuggaaacgacaaaaaaggaccugggcaucggguacguagcugcagagaaucagcaccacgccacgaugcucgacgucgaccugcgcccggccuccgccuggacccuguacgccguggcuacgaccguaaucacccccaugaugcgccacaccauugaaaacaccaccgccaacaucagccucaccgccaucgcaaaucaggcugcgauucugaugggucuggacaagggcuggccaaucuccaagauggacauuggggucccacucuuagcccugggcugcuacagccaggugaacccgcucacccugacggccgccgugcugaugcucgucgcgcauuacgccaucauugggccgggccugcaggccaaagccacacgggaggcccagaagcgcacagcggccgggauuaugaaaaaccccaccguggacggcaucguggccauagaccuggaccccgucguguacgacgccaaguuugaaaagcagcucggccagauaaugcugcugauccucugcacgucccagauccuucugaugcggaccaccugggcccucugcgagagcaucaccuuagcgacgggcccgcugaccacccucugggagggguccccggggaaauucuggaacacgaccaucgccgugagcauggccaacaucuuucgcggcuccuaccuggcgggugccggccuggcauucagccucaugaagucccugggcggaggucggcgcggcacuggcgcccaaggcgagacccucggcgaaaaguggaagcggcagcuuaaccaauugucuaagagcgaguucaacacuuauaagcgcuccggcaucauggaggucgaccggagcgaggcaaaggaggggcuaaagcgcggagagacgaccaaacacgccgugucaagggggaccgccaagcuccgcugguucguggagcggaaccuggucaagcccgagggcaagguuaucgaucugggcugcggacgcgggggguggagcuacuacugcgccggucugaagaaggugaccgagguuaagggguacacaaagggcggcccgggccacgaagagccgauaccuauggccaccuaugguuggaaccucguuaagcuguacuccgggaaggacguguucuucacaccccccgagaagugcgacacccugcucugcgacaucggagaaagcaguccgaaccccaccauugaggagggcaggacgcugagaguccugaaaaugguggaacccuggcuccggggcaaccaauuuuguauuaagauucugaaccccuacaugccgucgguggucgagacgcuggaacaaaugcagaggaagcauggcgggaugcucgugcggaacccccugucccgcaacagcacccacgagauguacuggguguccugcggcaccggcaacauugucagcgcagugaauaugacgucccguaugcuucucaaccgguucaccaugacccaccgcaagcccaccuacgagcgggacguggacuugggcgccggcacucggcacgucgcgguggagcccgagguggccaaccuggacauuaucgggcagcggaucgagaacauuaagaacgagcacaagagcaccuggcacuacgacgaggacaacccguacaagaccugggccuaccacggcuccuacgagguaaagcccuccggcucggcuucauccaugguaaacggagugguccgucuccucaccaaacccugggacgugauccccauggucacgcagaucgccaugaccgacaccacgccguuugggcagcaacggguguucaaggagaagguggacacucguacgcccagagcuaagcgcggaacugcccaaaucauggaggucaccgccaaguggcuguggggcuuccucucacggaacaagaagccccgcauaugcacgcgggaggaguucacacgcaaggugcggagcaacgcagccaucggggcgguguuugucgacgaaaaccaguggaacagcgccaaggaggccguggaggacgagcgcuucugggaucuggugcacagagagcgcgagcugcacaagcagggcaagugcgcgacgugcguauacaacaugauggggaagagagagaaaaagcucggcgaguucgggaaggcgaagggaucacgcgcaauuugguacauguggcugggcgcucgcuuccuggaauucgaggcccucggguuuaugaacgaagaccacugguucucucgcgagaacagcuucuccggcguggagggggagggucugcacaagcugggguacauccuccgugacaucagcaagaucccuggcggcaacauguaugccgaugacacggcggggugggacacgcggaucacugaggaugaccugcagaacgaggccaaaauaaccgacauaauggagcccgagcacgcccugcuagccacauccaucuuuaagcugacguaccagaacaaagugguccgggugcagcggccggcgaagaacggcaccgugauggacguuaucucccgccgggaccagcgcgggucaggccagguuggcaccuacgggcugaacaccuucacgaacauggaggugcaguuaauccgacagauggagagcgaggggauauuucugcccucugaguuggagacuccgaaccucgcggagcgcguucugaauuggcuggagaagcacgggaccgagcgccucaagcguauggccaucucgggugacgacugcguugugaagccugucgacgaccgguucgcgaccgcccugaucgcccugaacgacauggggaaagugaggaaggacaucccccagugggagcccuccaagggcuggaacgacuggcagcaagugccguucugcagccaccacuuccaccagcugaucaugaaggacggacgggagauagucgugcccugccgcaaccaggacgagcugguggggcgggcgcgcguuucccagggcgccggguggagcuugcgggagaccgccugcuuaggcaaguccuacgcgcaaauguggcagcugauguacuuccaccgccgggaucugcgucucgcagcgaacgcgaucuguagcgccgugcccguggacuggguccccaccagccgcacaaccugguccauccacgcccaccaccaauggaugaccacggaggauaugcucagcguauggaaccgcguguggauagaggagaaccccuggauggaggacaaaacccacgucuccuccugggaggagguccccuaccugggcaagcgcgaggaccaauggugcggcucccucauaggcuuaacggcgcgggccacuugggcgacgaacauucaggucgccaucaaccaaguccgccggcugaucgggaacgagaacuaccuugacuacaugacaagcaugaagagauucaagaacgagagcgaccccgagggcgccuuaugguga

SEQ ID NO: 24009 - RNA, 9879 nt, Artificial Sequence
  derived and/or modified CDS sequence (opt11) from DENV-1__FJ205873__SS-prME
agcgugaccaugcugcucaugcugcuuccgaccgcacucgccuuccaccuaaccacccggggaggggaaccccacaugaucgugagcaagcaggaacggggcaaaagcuuguuguucaaaaccucggccgggauuaacauguguacacugaucgcaauggaccuaggcgagcucugcgaggacacuaugaccuacaagugcccccggaucaccgaggccgagcccgacgacguggacugcuggugcaacgccaccgauaccugggugaccuacggcacuuguagucaaaccggagagcaccggcgggacaagcgguccgucgcacuagcgccccaugugggccugggccucgagacccgcaccgaaacuuggaugagcucagagggcgcguggaaacagauccagaaaguugagaccugggcccugcggcauccuggguucacgguaaccgcccuguuccucgcucaugccaucggcaccagcauaacccagaaggggaucaucuuuauucugcugaugcuagugacgcccagcauggccaugcgcugugugggcauaggcaaccgggacuucgucgaggggcuguccggcgcuaccuggguggacguuguccuggagcacggguccugcguaacaacuauggccaaggacaaacccacgcuggauaucgagcugcugaagaccgaggugaccaaccccgccguccuccgcaagcuuugcaucgaggccaagaucucgaacaccacgaccgacucccggugcccgacccagggcgaagccacccuuguggaggagcaggacagcaacuucguaugucgccggacguuugucgaccgcggcugggggaacggcugcggccuuuucggcaaggggucccugcugacuugcgcaaaguucaaaugugucaccaagcucgagggaaagaucgugcaguacgaaaaccuaaaguacagcgugaucgugaccgugcauacgggcgaccagcaccaggucgggaacgaaaccaccgagcacggcaccaucgccaccaucacaccucaggcgcccaccuccgagauccaguugacugacuauggggccuugacccuggacugcagcccacggacgggccuggacuucaacgagauggugcuacugaccaugaaggaaaaguccuggcugguccacaaacagugguuccuggaccucccgcugccuuggaccucuggggccagcaccucccaggagacauggaaccgccaggaucuccuugugaccuucaagaccgcccacgcgaagaaacaagaaguagucgugcugggcagucaggagggcgcgaugcauacggcccucaccggggcaacagaaauccagaccucgggcaccacgaccaucuucgcggggcaccugaagugccggcugaagauggacaagcucacacugaagggcaugucuuacgugaugugcaccggguccuucaaacuugagaaggaagucgccgagacacagcacggcacaguacuggugcaggucaaguacgagggaaccgacgcgcccugcaagauacccuucagcgcccaggaugagaagggggugacccagaacggccgccucauaacggccaauccgaucgugaccgacaaagagaagcccgugaauauagagaccgagccgccuuucggggagagcuacauuguugugggcgcuggcgaaaaggcucugaagcugagcugguuuaagaagggguccagcauaggcaagauguuugaggccacggcccgcggggcccgccggauggccauccucggggauacggcgugggauuucggguccaucggcggcgucuucaccagcgugggcaagcuggugcaccaagucuuuggcgccgcauacggaguuuuguucagcggggugagcuggaccaugaagaucgggaucggcauacuccugaccuggcuaggccuuaacucccguagcacgucccuaucgaugaccugcaucgccguggggauggugacccuuuaccucggggugaugguccaggccgacuccgggugcgugaucaacuggaagggccgcgagcugaagugcggaagcggcauuuucguaacaaacgaggugcacacguggacagagcaguacaaguuccaagcggacagcccgaagcggcuguccgccgccaucggcaaggccugggaggaggggguaugcggcauccguucugcgacccgacucgaaaacaucauguggaagcagauuuccaacgaacugaaucacauucugcucgagaacgacaugaaguucaccgucgucgugggggacgcgaauggcaucuuggcccaggggaagaagaugauacgcccgcaacccauggaacaccgguacagcuggaaguccuggggcaaagccaagauaauaggagccgacauccagaacagcaccuucaucaucgacggacccgacacgccggagugccccgacgaucagcgcgcguggaacaucugggagguugaggacuacggcuucgguauuuucaccacaaacaucugguugaagcuucgggacuccuacacccaaaugugcgaccaccgccugaugucugccgcaauaaaggauuccaaggccguccacgcagacaugggguacuggauugagagcgagaagaacgagaccuggaaguuggcgcgggccuccuucaucgagguuaagacuugcauuuggcccaaaagucacacccucuggagcaacggcguguuagaaagcgagaugaucauaccgaagaucuacgggggcccgaucagucagcacaacuaccgcccuggguacuucacccagacggccggucccuggcaucuggggaagcuugaacuugacuucgaucugugcgagggcaccaccgucguuguggacgagcacugcggcaaccggggcccgagccuccgcaccacgaccguuacggguaagaucauccacgaguggugcugccgguccuguacccugcccccauugcgcuucagaggggaggauggcugcugguacgggauggaaauccgccccgugaaggagaaggaggagaaccucgugcggaguaugguuagugccgggucgggcgagguggauagcuucucucuggggauccucugcgucagcaucaugaucgaggagguaaugcgcuccagguggucuagaaagaugcucaugacgggcacccucgccguguuccugcuccugaucauggggcagcugacauggaacgaccucauccgccuauguauaaugguuggggccaacgcauccgauagaaugggaaugggaaccacguaccucgcccuaauggccaccuuuaaaaugcgacccauguucgcugucggguugcuauuccguaaacuuaccagccgggaggugcugcugcucaccaucggacuuucgcucguggcgagcgucgagcuccccaauucccucgaggagcugggcgacgggcuugccauggguauaaugaugcugaaacuacucacggaguuccagccccaccaguuguggaccacccuguuaagccugaccuucaucaagacaaccuuauccuuagacuaugccuggcggaccauggccaugguguuaucgaucguaucccuguucccccuuugccugucuacaacgucucagaagaccacauggcuuccgguucuccugggcagcuuugggugcaaaccccuuaccauguucuugaucacggagaacaagauauggggacgcaaauccuggccccuaaacgaggggaucauggcgaucgggauagugagcauccugcuaagcagccugcugaagaaugacgucccccuagccggcccgcugaucgcaggcgggaugcucaucgccugcuacgugaucucggggucgagcgccgacuugucccuggaaaaagcggcggaggugaguugggaggaggaagccgagcacuccggcaccagccacaauauccuagucgaggugcaggaugacgguaccaugaagaucaaggaugaggagcgggacgauacguuaacaauauugcugaaggcaacgcuguuggccgugucuggcgucuaccccaugagcauccccgcgaccuuguuugugugguauuucuggcagaaaaagaagcagcgguccgggguacuuugggacacccccaguccucccgaggucgagagagcugugcuggacgacgguaucuaccgaauccugcagcggggcuugcuggggcgcucccagguaggagucgggguauuucaggacgguguguuccacaccauguggcacgugacgagaggggccguacugauguaccaaggcaagcgacucgagccaaguugggccagugugaagaaagaccucauuagcuauggcgggggcuggcguuuccaggggagcuggaacaccggugaggaaguacaggugaucgcuguagagccgggaaagaacccgaagaauguccagaccacccccggcacguucaagacccccgagggcgaggugggggcaaucgcucuagacuucaagcccggcaccuccggauccccgaucgugaaccgcgagggcaagguggugggccuguacgggaacggcguggucaccacgagcgggaccuacguuagcgccaucgcccaggccaaaaccucccaggagggcccccuccccgagaucgaggaggagguuuucaagaagcggaaucugacgauuauggacuuacacccggguagcggcaagacgcgacgguaccucccugcgaucguccgggaggccaucaagcgcaagcuucgcacacugauccucgcucccacccgcgugguagcaucugaaauggcggaagcccugaaggguaugcccaucagguaccagacuaccgccgucaagagcgagcauaccgggcgcgagaucguggaccugaugugucacgccaccuuuaccaugcggcuccucucccccguacguguccccaacuauaauaugaucaucauggaugaggcccauuucaccgaucccgcgagcaucgccgcccggggcuauaucucaacucgcgucgggaugggcgaagcggccgcgaucuucaugacagccacgccgccagggagcguugaggcuuucccacagaguaacgccguaauccaggacgaggaacgggacauuccugagcgcagcuggaacucuggcuacgacuggaucacugacuuucccggcaagacugugugguuugugccaagcaucaaauccggcaacgacauugccaacuguuugcggaaaaacggcaagagggucauucagcucucgcggaagaccuucgacaccgaguaccaaaagacucgcaacaacgacugggacuacguggucaccacagacaucuccgaaaugggggcuaacuucagagccgaccgagucaucgacccccggcgcugccugaaacccgugauccugaaggacggccccgaacgggugauucucgcggguccgaugccuguaaccguggccuccgcggcccagcgccggggccguauuggccgcaaccagaacaaggagggcgaccaguacgucuacaugggccaaccacuaaacaacgacgaggaucacgcacacuggacggaggcgaaaaugcugcucgauaacaucaauaccccggaggguauuaucccggcucuguucgagccugaacgggagaaguccgcggccaucgacggugaguaccgccuccgcggagaggcucggaagaccuuuguggaacucaugcggcgcggcgaccugcccguguggcuuagcuauaaggucgccuccgagggcuuucaguacagcgaccggcgcuggugcuuugacggugagcgcaacaaccagguccucgaggagaacauggacguggagaucuggaccaaggagggcgaacguaagaagcugcggccaagauggcuggacgcccggacauacagcgacccgcucgcccugcgcgaguuuaaggaguucgccgccgggcggcgguccgucucuggcgaucugauccuugaaaucggcaagcugccccagcaucugacucugcgggcccagaacgcccuggacaaucugguuaugcuccacaauuccgaacagggcgggaaggccuaccgccacgccauggaagagcuacccgauaccaucgaaacccuuauguuacuggcccugaucgcugugcucacaggcggggucacgcuguucuuucuauccgggaagggccucgggaagacauccaucggacugcugugcguaauggcgucauccgcccuccuguggauggccaacguggagccccacuggaucgcagccagcauaauccuggaguucuucuuaaugguccugcugaucccggagccagaccggcagcgaacgccccaggacaaccagcucgcguauguggucaucggccugcuguucaugauacucaccgucgccgccaacgagaugggucuguuagagacgaccaagaaggaccugggcauugggcauguggccgccgagaaccagcaccacgcgaccaugcuggacguggaccugaggccggccuccgccuggacucucuacgccgucgcuacgaccgugaucacgcccaugaugcggcacaccaucgaaaacacgaccgcgaauaucagcuugaccgccaucgccaaucaggccgccauccugaugggccucgacaagggauggccuaucuccaagauggacaucgggguaccccugcuggcgcucggcugcuauagccaggucaauccgcugacccugacggcggccguacucaugcugguagcgcacuacgcgaucaucgggcccggccugcaggccaaagccacgcgcgaggcccaaaagcggaccgccgcugguaucaugaagaaucccaccgucgacggcaucguggcaauugaccucgaucccgugguguacgacgccaaauuugagaagcagcucgggcaaauuaugcugcucauacuguguacgucccagauuuuguugaugcgcaccacuugggcccuaugcgaaagcaucacccucgccacugggccacucaccacacugugggagggcucccccgggaaauucuggaacacgaccaucgcggugagcauggccaauaucuuccggggcuccuaccuggccggcgcggggcucgccuuuagcuugaugaagucgcucggcgggggccgcagagggaccggagcucagggggagaccuuaggggagaaguggaagcgccaacugaaccaacugucuaaaagcgaguucaauaccuacaagcggucaggaaucauggagguggaccgcagcgaagccaaggaagggcucaagcggggcgagacgacuaagcacgccgucucccgcgggaccgcaaaauugcggugguucguggagcgcaaccuggugaagccugagggcaaggucaucgaucugggaugcgggcguggcggcuggagcuauuacugcgcgggacucaagaaggugaccgaggugaagggguauacgaaaggaggccccgggcaugaagagccgauccccauggccacuuacggcuggaaccugguuaaguuguacucugggaaggacguguucuucacgccgccugaaaagugcgacacccuccugugcgacauaggcgaaagcaguccgaacccuaccauugaggaggguagaacgcugcggguguugaagauggucgagcccuggcugcgagggaaccaguuuugcaucaagauccugaaccccuacaugccgagcguggucgaaacccuagagcagaugcagaggaagcacggcggaaugcuggucagaaacccccuuucccgaaacagcacccacgaaauguacuggguguccugcggcaccgggaacaucgugagcgccguaaacaugacgucccgcaugcuccugaaccgauucaccaugacccaccggaagcccaccuacgagcgcgacguggaccugggggcuggcacgagacacguggccguagagcccgagguagcgaaucucgacaucauagggcaacgcaucgagaacaucaaaaacgagcacaaaagcacauggcacuacgacgaggauaaccccuauaagaccugggccuaccacggcagcuacgagguaaagccaagcgggagcgccagcuccaugguaaacggaguggucaggcugcuaaccaagcccugggacgugauccccauggucacacaaauagccaugacggacaccacgccguucggacagcaacgcgucuucaaagagaaaguggacacgaggacgccccgagccaagcggggcacagcucaaauaauggaggugacggccaaguggcucuggggcuuccugagcaggaacaagaaaccacggauuugcacgcgugaagaguucacccggaagguacgcagcaacgccgccaucggggccguguuuguggaugagaaccaguggaacuccgcgaaggaggccguugaggacgagcgguuuugggaucuggugcacagagaacgggagcuccacaagcagggcaagugcgcaaccugcguguacaacaugauggggaagagggagaagaaguugggcgaauucgggaaggcgaagggcucccgggcgaucugguacauguggcuuggcgccagguuucucgaguucgaggcccugggguucaugaacgaggaccacugguuuucccgggagaacagcuucuccggcgucgagggggagggccugcacaaauuagguuacauccugcgcgacaucagcaagauuccggguggcaauauguacgccgacgauaccgcugggugggacacgcgcaucaccgaggacgaccugcagaaugaggccaagauuaccgacaucauggaacccgaacacgccuuacuggcaacauccaucuucaagcucacguaucaaaacaagguagugcggguccaacgccccgcgaaaaacggcacaguaauggacgugaucagccggcgggaccagcgcggcuccggccaggucgguaccuacgggcucaauacguuuacuaacauggaggugcagcugauccgccagauggagagcgagggcaucuuucugcccuccgaauuagagaccccgaaccuggcggagcgggugcugaacuggcucgagaagcaugguaccgagcgccugaagcggauggcgaucagcggcgacgacugcgucgucaagcccguggacgaccgcuuugccaccgcgcugaucgcccucaacgacauggggaagguccggaaggacaucccacagugggagccuucuaaaggcuggaacgacuggcagcaggucccguucuguagccaccacuuccaccagcugaucaugaaggacggccgcgaaaucgucguccccugccggaaccaagaugagcugguggggcgcgcccgggugucccagggugcggguuggagcuugagagagacagccugucuuggcaagagcuacgcccagauguggcaguuaauguacuuccaucggcgcgaccuccggcuggccgccaacgcgaucugcagcgccgugcccguggauugggugcccaccagcagaaccacgugguccauccaugcccaccaccaguggaugaccacggaggacaugcuuagcgucuggaaccgcguguggaucgaagagaauccguggauggaggacaagacccacguguccaguugggaagagguccccuaccucgggaaacgggaggaccagugguguggcucccugaucggccugacugcccgcgcuacuugggcgaccaacauccagguugccauaaaccaggugcggcgccugaucgggaacgagaacuacuuggauuacaugaccucuaugaagcgguucaagaacgaguccgacccugagggugcccugugguag

SEQ ID NO: 24010 - RNA, 9879 nt, Artificial Sequence
  derived and/or modified CDS sequence (opt11) from DENV-1__FJ390379__SS-prME
uccgucaccaugcugcucaugcuguugcccaccgcccuugcguuccaucugacuacccggggcggcgagccgcauaugauaguguccaagcaggagcggggaaagagccuccuguucaagacgucugccggcauuaauauguguacccugauugccauggaccucggcgagcucugugaggacacgaugaccuacaagugcccccggauuaccgaggccgagcccgacgacguggacugcuggugcaacgccaccgacaccugggugaccuacgggaccugcagccaaacaggcgagcaccggagggacaaaagauccguggcccuggcgccccacguaggacugggguuagagacacgcacugagacuuggaugagcuccgaaggcgcguggaaacagauccagaaggucgagaccugggcccugcggcaucccggguucacgguaacggccuuauuccucgcucacgccaucggcaccagcauuacccagaagggaaucaucuucauccuccucaugcucgugacucccuccauggcgaugcgcugcgugggcaucgguaaccgggauuuugucgaggggcugucaggcgccaccuggguggacgugguccuggagcaugggagcugcguuaccaccauggccaaggauaagcccacgcucgacauugagcuucucaaaaccgagguuacaaaccccgcaguccuacgaaagcugugcaucgaggccaaaaucagcaacacaacuaccgauagccggugccccacccagggcgaggccacccuuguagaggagcaagacagcaauuuugugugccgccggaccuuuguggaccgcggcugggggaacggcugcggccucuucggcaagggcucccugcugaccugcgccaaauucaagugcgugaccaaauuggagggcaaaaucgugcaauacgaaaauuuaaaauacucugucaucgucaccgugcacacuggugaucagcaucaggucggcaacgagacgacggagcacggcaccaucgccacgauuacgccccaggcccccaccucagagauccaacugaccgacuacggggcucucaccuuggacugcagcccccggacgggccuggacuucaacgaaaugguccuccugaccaugaaggagaaaucguggcugguccauaagcagugguuccuggacuugccacugcccuggaccaguggagcaagcaccucccaggaaacuuggaaccgccaggaccuacuggugacauucaagaccgcucaugcgaagaagcaggaggugguggugcuuggcagccaggagggcgcgaugcacacugcccucacgggggccaccgagauacagaccuccggcaccacgacgaucuucgccgggcaucugaaaugccggcugaagauggacaagcucacccugaaaggcaugagcuacgugauguguaccggguccuucaagcuggagaaggaggucgcggagacgcagcacggcacggugcuggugcaggucaaguaugaaggcaccgacgcgcccugcaaaauccccuucagugcccaggacgagaagggagugacccagaacggccgccucaucacggccaacccuaucgugaccgauaaggaaaagcccguaaacaucgagaccgagccacccuucggggaguccuacauaguggugggcgcaggcgaaaaagcccugaagcugucaugguucaagaaggggagcagcaucggcaagauguucgaggcuacagccagaggggcccgccggauggccauuuugggcgacacggccugggacuucgguuccaucggaggcguuuucaccucugugggaaagcugguacaccagguguucggcgccgccuacggggugcuguucuccggcgugagcuggacaaugaaaauagggaucggcauccuccuaaccuggcugggccucaauucccgcagcacgucccugagcaugaccugcaucgcaguagggaugguuaccuuguaccuaggcgucaugguccaggccgacuccgguugcgugaucaauuggaagggccgcgagcugaaaugcgggagcgggaucuucgugacuaaugagguucacacuuggaccgagcaguauaaguuccaagcggacagccccaagagacugucggcggccaucggcaaagccugggaggaggggguguguggcauccgcagcgccacccggcucgagaacaucauguggaaacagaucucgaacgagcucaaccacauuuugcuagaaaaugacaugaaguuuacaguggucguaggggacgcgaacggcauccuggcccaagggcgcaagaugauccggccccagcccauggagcaccgcuacucuuggaaauccuggggcaaggccaaaaucauaggcgccgacauucagaauagcaccuucauaaucgacgggccugauacuccggagugccccgacgaccagcgggcguggaacaucugggagguggaggacuaugguuuugggaucuucaccacuaacaucuggcucaaacuucgcgacuccuacacccagaugugcgaccaucgguuaaugagugccgcgaucaaggauuccaaggcuguccacgcugauaugggcuacuggaucgagucggagaagaaugagacguggaagcuagcgcgcgccuccuucaucgagguuaagacaugcaucuggcccaaaucccacacgcugugguccaauggcguacuggagucugagaugaucauaccuaaaaucuauggugguccgaucagucagcacaauuaucggcccggguacuucacccagaccgccggcccauggcaucuggggaagcuagaguuagacuucgaccucugcgagggcaccaccgucguuguggaugagcacuguggcaaccgcgggccgagccugaggacaacgaccguaaccggcaagauaauucacgaauggugcugccgcuccuguacccugccaccccuacgauuucgcggggaggauggcuguugguacgggauggagauccggcccgugaaagagaaagaggagaaccuaguucgcagcauggucagcgccggcuccggcgagguggacagcuucucccuggggauccugugugugucgaucaugaucgaagaagugaugcggaguagguggagcagaaaaauguuaaugacaggcacacucgccguauuucugcuccugaucauggggcagcucacuuggaacgaccucauucggcugugcaucauggucggagcgaacgccuccgacaggauggggauggggaccacguaucuagcccucauggccacuuuuaagaugcggccgauguucgccguuggccugcuuuuuagacgucucaccucgagagaaguguuacugcucacgauaggacugucccucguggcgagcguagagcuccccaacucgcuggaggaacugggcgacggucucgccaugggaaucaugaugcuaaaacuccuuacggaguuccagccucaccagcuguggaccacccuguugagccuaaccuucauaaagacgacgcucucccuugacuacgcguggcggacaauggccauggucuugucgauugucucccuguuccccuuaugucugucuaccacgucccagaagaccacauggcugccuguccugcugggcuccuucgggugcaagccccugaccauguuccucaucacagaaaacaaaauauggggcaggaaauccuggccccugaacgaggguaucauggcgauuggcauagugucuauccuucucuccagccugcugaaaaaugacgucccccucgccgggccgcucaucgcuggcggaaugcucauugcauguuacguaauaagcggcaguagcgccgaccuuucccuggaaaaggcggccgaggugucaugggaggaggaggccgaacauagugguaccagccacaacauccucgucgaggugcaggacgauggcaccaugaagaucaaggacgaagaacgggaugacacccucaccauccuacugaaggcuacccuccuggcgaucuccggcguguaucccaugagcaucccagcgacccuguucguaugguauuucuggcaaaagaagaaacagcgcuccggggugcuaugggacacuccgaguccacccgaaguagagcgggccgugcuggacgacggcaucuaucgcauacugcagcguggccugcucgggcggucccaagugggagugggggucuuccaagacggcguguuccacaccauguggcauguaacgcgcggggccguacugauguaccaagggaagcgccuggagcccucuugggccuccgugaagaaggaccucauaucuuacggcgguggcuggcgguuccaagggagcuggaacaccggcgaagaggugcaggucaucgccguggagccggggaagaacccgaaaaacgugcagaccaccccggguacguucaaaacacccgagggcgaggucggugcaaucgcccuggacuucaaaccggguaccuccggcucacccaucgugaaccgcgagggaaagaucguggggcuguacgggaacggcgucgucaccacgagcgggacguacgugagcgcaaucgcccaggcgaagacgucccaggaaggaccacuccccgagaucgaggaagagguguucaaaaagcggaaccugaccaucauggaccuccaucccgggagcggcaagacgcgccgguaccucccagcgaucgugcgcgaggccaucaagaggaaacuacggacacucauccuggcacccacacgcgugguugccuccgagauggcugaggcacuaaaggguaugcccauccgguaccagaccacugcggucaagagcgagcauaccgggagggaaauuguggaucuuaugugucacgccacauucaccaugagacuacuguccccuguccgcguccccaacuauaauaugaucaucauggacgaggcucacuucacugauccggcguccauagcagcccggggguacauaucaacacgugucgggaugggcgaagccgcagcgauuuuuaugaccgccacgccacccgggagcguagaagccuucccacaguccaacgccguaauccaggaugaggaacgugacaucccagagcgcagcuggaacucuggcuaugacuggaucacggacuuccccgggaagaccgugugguuuguccccagcaucaaguccgggaacgacaucgcaaacugucugcgaaagaacggcaagcgagugauccagcuaagccggaagaccuucgacaccgaguaccagaagacacgcaacaacgacugggacuacgugguuaccacggauauauccgagaugggggcuaacuucagggcggaccgcguuaucgaucccaggcgcugucugaaaccgguaauccucaaggauggaccggagcgcgugauccuggccgggcccaugcccgugacaguggccuccgcggcgcagagacgcggacggaucggccguaaccagaacaaggagggggaccaguacgucuacaugggccaaccccugaauaaugacgaggaccacgcccacuggacggaggccaagaugcuguuagacaacauuaacacccccgaggggaucaucccggcucuuuuugaacccgaacgggagaaguccgcagccauugacggcgaguaucgucuacgaggggaggcucgcaaaacguucguggagcucaugcgacggggcgaucugcccgucuggcucagcuacaagguggccuccgagggcuuccaguacagcgaccggcgcuggugcuucgauggugagcgcaacaaccaggugcucgaagagaacauggacgucgagaucuggaccaaggagggcgagcgcaagaagcuccgaccccguuggcuggacgcccggacguacucugauccucuggcgcugcgcgaguuuaaagaguucgccgccgggcgccguuccgucucuggugaccugauccucgagauaggcaagcugccccagcauuuaacauuaagggcccagaacgcccuggauaaccuugugaugcuacacaacucugaacagggcgguaaagcguaccgccacgccauggaggaguugccagauaccaucgagacccuuaugcuccuagcccugaucgcagucuuaaccgggggcgugacgcuauucuuccuguccgggaagggccucggcaagacguccaucggguuacugugcgucauggcgagcuccgcccucuuauggauggcgaaugucgaaccgcauuggaucgcagccagcaucauacuggaauuuuucuugauggugcuguuaaucccugagcccgaccggcagcgcacgccucaggauaaccaacuugcguacgugguuauaggccuguuauuuaugauccucaccguggcagcaaacgagaugggucugcuggagacgacgaagaaggaccuuggaaucgggcaugucgccgcagagaaccagcaucacgccaccaugcuggacgucgaccugcgcccggcauccgcguggacacucuaugccgucgccacgaccgucauaaccccgaugaugaggcacaccaucgagaacacuaccgcgaauaucagccuuaccgccaucgcgaaccaagccgccauccugauggggcucgauaagggcuggcccaucuccaagauggacaucggggucccccucuuggccuugggcuguuacagccaggugaacccacucacccuaaccgcugcagugcucauguuagucgcccacuacgcgaucaucgguccuggccugcaggccaaggccacccgcgaagcgcagaagcggacggccgcggggaucaugaagaaucccacugucgacggcaucgucgccauugaccuggaucccgucguguacgacgcuaaguucgagaagcagcugggccagaucaugcugcugauccugugcacaagucagaucuuacucaugcgcacgaccugggcccugugcgagucuaucacccuggccaccgggccguuaaccaccuuaugggaaggauccccugggaaguucuggaacaccacgauugcggugucaauggccaacaucuuccggggcucauaccuugccggugcggguuuggccuuuagucugaugaaauccuuaggaggaggccgucggggcaccggugcgcaaggcgagacccucggggagaaauggaaacgccagcuuaaccagcugagcaagagcgaguucaauaccuacaaaagguccggcaucauggaggucgaccgcagcgaggcuaaggaagggcucaagcgaggcgagaccacuaagcacgccgugucgcgcggcaccgccaagcugaggugguucguugaacgcaaccuggucaagccagagggcaaagugaucgaccucggguguggucggggcgggugguccuacuacugugcuggccucaagaagguuaccgaggucaaaggguacacgaagggaggccccggucacgaggagccggugcccauggccaccuauggcuggaaccuagugaagcuguacucggggaaagaugucuucuucacaccgccagaaaagugcgacacgcuccugugcgacauuggagagagcuccccgaacccgacaauagaagagggacgcacgcugcgcguucucaagaugguggagccguggcuacgcggcaaccaguuuugcauaaagauccugaacccuuacaugccgagcgucguggagacccuggagcagaugcaacggaagcacggcgggaugcugguucguaacccucugucccgcaauucgacccacgaaauguacugggucucguguggcacagggaacaucguaagcgccgugaacaugacaagccggaugcugcuuaaccgcuucaccaugacccaccggaagcccaccuaugagcgcgacgucgaccuaggcgccggcacgcgucacguagccguggagccagaagucgcgaaccucgacaucauuggacaacgcaucgagaauauuaagaacgaacacaaguccaccuggcauuacgacgaagacaacccauacaagaccugggcguaccacgggagcuaugaagugaagcccagugggucagcaagcuccauggugaacggcgucgugcgguuacugaccaagcccugggacgucaucccuauggucacccagaucgccaugacagauaccacaccguucggucagcagaggguguucaaagaaaaaguagauacacggacaccccgcgcaaagcggggaaccgcccagauaauggaagugacagcuaaguggcucuggggcuuccugagccgaaacaagaagccccgaaucugcaccagggaggaguucacgcggaaggugcgcucuaaugccgccaucggcgcggucuuuguagacgagaaccaguggaacuccgcuaaggaagccguggaagaugagcgguuuugggacuugguacaccgggaacgugagcuccacaagcagggcaagugcgcgaccugcguauauaacaugauggggaagcgcgagaagaagcugggggaguucgggaaggcaaagggcucgcgcgcgauuugguacauguggcugggggcgcgcuuccucgaguucgaggcucugggguuuaugaacgaagaccauugguucuccagggagaacagcuuuuccgguguggagggggagggccugcacaaauugggguacauccuuagggauauaaguaaaaucccgggcggcaauauguaugccgacgacacggccggcugggacacgcgcauaaccgaggacgaucuacagaacgaggcgaagaucaccgacaucauggaaccugagcacgcccucuuagcgaccuccauuuucaagcugacguaccaaaauaagguagugcggguucagcgccccgccaagaacggcaccguuauggaugugauuagccggcgggaccagcguggauccggccagguuggcaccuaugggcucaauaccuuuacaaacauggagguccaguugauccgccagauggagucagaaggcaucuuccuuccaucagaacucgagaccccgaauuuagccgagaggguacuugacuggcuugagaagcacgggaccgagagacugaagcgaauggcaaucagcggcgacgacuguguggucaaacccguagacgaucguuucgccaccgcgcugauagcacuuaacgauauggggaaggugcgaaaagacaucccucagugggaaccaucgaagggcuggaacgacuggcagcagguaccguucuguagccaccacuuccaucagcugaucaugaaagacggccgcgaaauaguggugcccugccggaaccaggacgagcugguugggcgcgccagggugucccagggggcgggauggagucuucgagaaacggcgugucuugguaaauccuaugcccaaauguggcagcuuauguacuuucaucgucgcgaccuccgcuuggccgccaacgcgaucugcagugccguaccaguggauugggugcccaccagccgaaccacuugguccauccaugcccaccaccaguggaugacgacugaggauauguugucggucuggaacaggguguggaucgaagagaacccguggauggaggacaagacucacguuuccagcugggaggaggugccguauuuaggaaaacgggaggaccaauggugcggcucccugaucggcuuaacggccagagcgaccugggccacgaauauccagguggcgauuaaccaaguccgacguuuaaucgggaacgaaaacuaucucgauuauaugaccagcaugaagcguuucaagaacgaaagugaucccgaaggcgccuuaugguaa

SEQ ID NO: 24011 - RNA, 9879 nt, Artificial Sequence
  derived and/or modified CDS sequence (opt11) from DENV-1__FJ390380__SS-prME
agcgugacuaugcugcucaugcuacuacccaccgcccucgccuuucaccugaccacccggggcggggaaccccacaugaucguguccaagcaggaacggggcaagagcuuacuguuuaaaacuuccgccgggaucaacauguguacacugaucgccauggaccugggcgagcucugcgaagacaccaugaccuacaaaugcccccggaucaccgaggccgagcccgacgacguggacugcuggugcaacgccaccgacacaugggugacuuacgggaccugcucacaaaccggcgagcaccggcgcgacaaaagauccgucgcacuugcuccccacgugggccuaggccuggagacacgcaccgagaccuggaugucauccgaaggcgccuggaaacagauucaaaagguggagaccugggccuuacggcaccccggcuuuacggugaccgcacuguuccuggcgcaugccaucggcacuagcauuacccagaaggggauaauauucauucuauugaugcucgugacgcccucuauggccaugcgcugcgucgggauagggaaccgagacuucgucgagggacuaagcggugccaccuggguggaugugguucuggagcacgguuccugugugacuacaauggccaaggacaagcccacucucgacaucgaguuacuaaagaccgaggugacaaaccccgcggugcugcggaagcugugcauagaggccaagauuucgaacacuacgaccgacucccggugcccgacccagggcgaggccacccugguugaggagcaggauagcaacuucgugugccgccggacguucgucgacagagggugggggaacggcugcggccuguuuggcaagggcucacugcugaccugcgccaaguucaagugcguuacgaagcucgagggcaagauugugcaauaugagaaccuuaaguauagcgucaucgucacagugcacacaggcgaccagcaccaggucgggaaugagaccaccgagcacgggacuaucgccacaaucacgccccaggcgccaaccuccgagauucagcugaccgacuacggggcccucaccuuggacugcucaccccggacgggacuggacuucaaugagaugguuuugcugacgaugaaggagaaguccuggcugguccacaaacagugguuccucgauuuaccguugcccuggaccagcggggccucuaccucccaggagacguggaaccgccaggaccuccuggucacauucaagaccgcccacgccaagaagcaagaggugguagugcuggggucgcaggaaggcgcgaugcacaccgcccucaccggggccacagaaauccagaccucgggcaccacgaccaucuucgccgggcaccugaagugccggcugaagauggacaagcucaccuuaaaagggaugaguuaugugaugugcaccggguccuuuaaguuggagaaggaagucgcugagacgcagcacggaaccgugcugguacaggugaaguacgagggcaccgacgcucccugcaaaauacccuucagcgcccaggacgagaagggcgugacccaaaacggccgccucaucacggcaaacccaauaguuaccgacaaagagaagccggucaacaucgagacagaaccgcccuuuggggaauccuacaucguggugggcgcgggcgagaaagcacugaagcugagcugguucaaaaagggauccagcauagguaagauguucgaggccaccgcccgcggggcucggcggauggccauccucggcgacacggcgugggauuucggguccaucggaggcgucuucaccagcguggggaagcuggugcaccaggucuucggcgccgcuuacggcguuuuguucaguggagugagcuggaccaugaagauuggcaucggcauccuccugaccuggcucgguuuaaacagcagaagcacuucccuuagcaugaccugcaucgccgucgggauggugacccuguaccugggagugaugguccaggcggacuccgggugcgugauuaacuggaagggucgcgagcugaaaugcgggucuggcaucuucgugaccaacgagguccacacguggaccgagcaguacaaguuucaggcggauagcccgaaacggcugagugccgccaucggcaaggccugggaggagggggugugcggcauccgcagcgcuacccggcuagagaacauuauguggaagcaaaucucuaaugagcugaaccacauucugcucgagaacgacaugaaguucaccguggucgugggugaugcgaacgguauccuggcccaggggaagaagaugauccgcccccagcccauggagcaccgguauagcuggaaaagcuggggcaaggccaagaucaucggcgccgacauacagaauagcacguucauuaucgacgggcccgacacgccggagugcccugacgaccagcgcgcguggaacaucugggaggucgaggacuacgguuucggaauuuucaccacuaacaucuggcugaagcugcgagacuccuacacccagaugugcgaccaccgccugaugagcgcggccaucaaagacaguaaggcaguccacgccgacaugggcuacuggaucgagagcgagaaaaacgagaccuggaaguuagcgcgcgcauccuucaucgagguuaaaaccugcaucuggcccaaaucacacacacuauggaguaauggcgugcuggagagcgagaugaucaucccaaagaucuacggagggccaaucucccaacacaacuaccggcccggauacuuuacccagacggccggcccguggcacuuaggcaagcucgagcuggacuucgagcuuugcgaaggcaccaccgucgugguggacgagcauugcggcaaccgggggcccagccucagaaccacgaccgucaccggcaagauuauccaugaguggugcugucggaguugcacccugccuccacugcgauuccgcggggaagacggcugcugguacgguauggagaucaggcccguuaaggagaaggaggaaaaccucgugcggagcaugguuagcgccggcucuggcgagguugacagcuucucacuggggauccugugcgugucuaucaugaucgaggagguaaugcgcucccgguggagccgcaagaugcuaaugacuggcacccuggugguuuucuuccugcucaucauggggcagcugacauggaacgaccugauccgccuaugcaucauggucggcgccaaugcguccgaccggaugggaaugggcacgacguaccuggcccugauggccaccuucaagaugcgcccgauguuugcgguugggcuucuuuuccggcgccuaacgucccgggaggugcuccugcugaccauugggcucagccuugucgcaucuguggaguugcccaacuccuuagaggagcucggagacgggcuagccauggguaucaugaugcucaagcugcugacggaguuccagccccaucagcucuggaccacccuguuaagccuaaccuuuaucaagacgacccuguccuuggacuaugccuggcggaccauggccaugguccucucaaucgugucuuuguucccccugugccucagcacuacuucccaaaagaccaccugguuaccugugcuccucggcucuuucgggugcaagccccugaccauguucuugaucacggagaauaagaucuggggccggaagucauggccccucaaugaggggauaauggcgaucggcaucgucucuaucuuacugagcucccuacugaagaacgacgugccccuggcggggccacucaucgccggcggcaugcugaucgccugcuauguaauuucuggcuccagcgcggaccugucccuggagaaggcagccgaggucagcugggaggaggaggccgagcauucgggcaccagccauaacauucugguagagguacaggaugacgggaccaugaagauaaaagacgaggagcgcgacgacacccucacaauacuccuuaaggccacgcugcuagcugucucaggcgucuauccuaugagcauccccgccaccuucuucgugugguacuucuggcagaagaagaagcagcgcuccgggguccugugggacacacccuccccgccugagguggagcgcgcggugcuggacgacggaauuuaccggauucuccaaagaggucugcuuggccggucccaagucggcguggggguguuccaggacggcgucuuccacaccauguggcacgugacgcgcggggccguacugauguaucaaggcaagcggcucgagcccucuugggccagcgucaagaaggaccugaucagcuacggcgggggauggcgcuuccaggggaguuggaacaccggcgaggagguccaggugaucgccguggagcccgguaaaaacccgaagaauguacaaacuacccccggcacguucaagacaccggaaggugaggugggggccaucgcgcuggacuucaagcccggcacuuccgguuccccaaucgucaaucgggaaggcaagaucguaggccucuacgggaacgguguggucaccacgagcggaaccuacgugucggccaucgcucaagccaagaccucccaggaggguccgcuuccagagaucgaggaggagguuuucaagaagcgaaaccuuaccauuauggaccuccacccggggagcgguaaaacacggagguaccugccagccaucguccgggaggcaaucaagagaaaguugcgcacacucauauuagcccccacccgggugguagccuccgagauggccgaggcguugaagggcaugcccauucgcuaccagaccacggccgucaaaucagaacauaccgggcgugagaucguggaccucaugugccaugccaccuucaccaugagacuccugucucccgugaggguaccgaauuacaacaugaucauuauggacgaggcccacuucacugacccugccagcaucgcggcccgcggauacaucuccacccggguggggaugggugaggcggcugccaucuucaugaccgcgacgccacccgggagcguugaggcauuuccccaauccaacgccgucauccaggacgaggagcgcgacaucccugagcggagcuggaacuccggguacgacuggaucacggacuuccccggaaagaccgugugguucguccccagcauuaaguccgggaacgacaucgccaacugccugagaaagaauggcaagagaguuauacaguuaagccgcaagaccuucgacaccgaguaccagaagacacggaauaacgauugggacuacguggugaccaccgacaucuccgagaugggggccaacuuccgcgcggaccgggucaucgacccucgccggugccugaagccagugauccucaaggacggccccgagcgggugauccuggcagggccgaugccggucaccguggccagcgccgcgcagagaagaggccgaaucggacgaaaucagaauaaggaaggggaccaauacguauacaugggccagccccugaacaacgacgaggaccacgcacacuggacggaggccaagaugcuccuggacaacaucaacacgcccgaagggauuaucccugcccuguucgagccggagcgcgagaaauccgcagcgauagacggcgaauacagacuacgcggagaggcccggaagaccuucguggagcugaugcgcagaggugaccuucccguguggcucaguuauaaggucgcauccgagggcuuccaguauucagacaggcgguggugcuucgauggugaacgcaacaaucaggucuuggaggagaacauggacguggagauuuggaccaaggagggcgagcggaaaaagcugcgcccccgguggcucgacgcccgcacguacagcgacccguuggcccuuagagaguucaaggaguucgcagcaggacgccgcuccgugagcggcgaccucauucuggagaucggcaagcugccccagcaccugacccuacgagcgcaaaacgcccuggacaaccucgugaugcuacacaauuccgagcagggcgggaaagccuacagacacgcuauggaggaacugccggacaccaucgagacccucaugcuguuagcacucaucgccgugcugaccgguggcgucacuuuguucuuccucagcgguaagggacugggcaagaccuccaucggauuacuuugugucauggcgagcuccgcgcugcuguggauggcuaacguagagccccacuggauugccgccagcaucauccucgaguuuuuccugaugguccugcucaucccggagcccgaccgccagcggacgccucaggacaaccaacuggcauacguggugaucggacuacucuucaugauacugaccgucgcugccaacgagauggggcugcucgagacaaccaagaaggaccuggggaucgggcauguugccgccgagaaccaacaccacgccaccaugcuggacguggaccuccgccccgcguccgccuggacccuguacgccgucgccaccacuguuauuaccccaaugaugcgccacacaaucgagaacacgacagccaauaucagucugaccgcgaucgccaaccaggccgcaauccucaugggccuagacaaaggauggcccaucuccaagauggacauuggggugccccugcucgcccugggcugcuacucacaagucaacccgcugacccucaccgcagcuguccugaugcugguagcccacuacgccaucaucggacccggccuccaggcgaaggccacccgggaggcccaaaagcgcaccgcggccgggaucaugaaaaacccgaccguugacgguaucgucgcgauagaccucgaccccguggucuaugacgcaaaguucgaaaagcaguugggccagaucaugcugcugauccugugcacuucccagauccuccugaugcgaaccaccugggcucugugcgaguccaucacccuugcuacggggccgcugaccacccugugggaaggcagucccgggaaauucuggaacaccacaauugccgugagcauggcgaacauuuuccggggaaguuaccucgccggugccgggcuggccuuuagcuuaaugaagucacuuggcgggggccggcgcgggaccggagcccagggcgagacccugggggagaaguggaagcggcaacuuaaucagcuaaguaagagcgaguuuaacaccuauaagcgcuccggcauuauggagguggaccggagugaggcuaaggaggggcugaaacgcggcgagacgacaaaacacgccgucucuagagguaccgcuaagcugaggugguucguggaaagaaaccucgugaagccagagggcaaagucaucgaccugggcugcggcagagguggauggagcuacuauugcgccggccugaagaaagugacugaggugaagggguacacaaagggcggccccgggcacgaggagccgauccccauggccaccuacggcuggaacuuagucaagcucuacucugggaaagacguuuucuuuacgccgccagaaaagugcgacacccugcugugcgauaucggcgaguccaguccaaaccccacuaucgaggaggggcggacgcuccgcgugcugaagauggucgagccauggcugcggggcaaccaguucugcaucaagauacucaacccuuacaugccgagcgugguggaaacccuggagcagaugcagcgcaagcacggcgggaugcugguacggaacccccucucuaggaacagcacccacgagauguauuggguguccuguggcacagggaacaucguuagcgcaguaaacaugacgucacgcaugcugcugaaucgguuuaccaugacccaucgcaagcccaccuaugaaagggacguggaccucggcgccgguacgagacauguggccgucgagccugagguggccaaccucgacaucaucgggcaacggaucgagaacaucaagaacgagcacaaguccaccuggcauuacgacgaggauaauccguacaagaccugggcguaucacggcuccuaugagguuaagcccagcggguccgcaagcucaauggucaauggugugguccggcugcucaccaagccaugggaugugauuccuauggugacucagaucgcaaugaccgacacaaccccguucgggcagcagagagucuuuaaggagaagguugacacccgcacgccucgugccaagcgcgguaccgcacaaaucauggaagugacagcgaagugguuauggggcuuccucagccggaacaagaagccccgcauuugcacgcgggaggaguucacgcgcaagguacguagcaacgccgcuauuggggccguauucguggacgaaaaccaguggaacuccgccaaggaggccgucgaggacgagcgcuucugggaccucgugcaccgcgagcgcgagcugcacaagcagggcaagugugcuacaugcguguauaacaugauggggaagagggagaagaagcugggcgaguucggaaaggccaaggggagccgcgccaucugguacauguggcucggagcgcgguuccuggaguuugaggcacugggguuuaugaacgaagaccacugguucucccgagagaacagcuuuuccggcguggaaggggagggccugcauaaauuagguuacauccugcgcgacauuagcaagaucccgggcggaaacauguacgcggaugacaccgccgggugggacacccgcaucaccgaggacgaucuccagaacgaggccaagaucaccgacaucauggagccugaacacgcgcugcuggccaccuccaucuucaaauugacguaccagaacaaggugguucgcguccagcggcccgccaaaaacgguacugugauggacgugaucucaaggagagaucaaagaggcuccggccagguuggcaccuaugggcugaacaccuucacuaacauggaggugcagcugauaaggcagauggagagcgaggguaucuuucuccccuccgagcuagaaacgccgaacuuagcggaacgggucuuaaacuggcuggaaaagcacgguaccgagcggcugaagcgcauggccaucagcggcgacgacugcguggucaagcccguggacgaccgguucgccaccgcccucaucgcccucaaugacauggggaaggucagaaaagacaucccccagugggagcccagcaagggcuggaacgacuggcagcaggucccguucugcucgcaccauuuccaucagcucauuaugaaagacggccgcgagaucguggugcccugccgcaaccaggacgagcucguggggagagcacgugugucccagggcgcgggcuggagccugcgagagaccgcgugccugggcaagucauaugcccagauguggcagcucauguacuuccaccgucgagaccugcgcuuggccgcaaacgccaucugcagcgcgguucccguggacugggugcccacgagccgcaccaccugguccauccaugcccaucaccaguggaugaccaccgaggacaugcucagcgucuggaaucggguguggaucgaggagaacccguggauggaagacaagacccaugugucgagcugggaggagguccccuaccuggggaagagagaggaccaguggugcggcucccugaucggccuaaccgccagagccaccugggcgacgaacauacagguggccauaaaccaaguucgccgccugaucgggaacgagaacuaucuugacuacaugaccucaaugaagcgcuucaagaacgaguccgauccugagggcgcccucugguga

SEQ ID NO: 24012 - RNA, 9879 nt, Artificial Sequence
  derived and/or modified CDS sequence (opt11) from DENV-1__FJ205874__SS-prME
ucaguaaccaugcuucuaauguuacuucccacagugcuggccuuccacuugacgacacggggaggggaaccccacaugauaguugggaaacaagaacggggcaagagcuuacuauucaaaaccuccgcgggagucaacauguguacgcucauagcuauggaccucggcgagcugugcgaagauacgaugacauauaaaugcccacgcauaacagaggcggaaccggacgacguggauugcugguguaacgccacggauacaugggucaccuacgggacaugcucucaaacaggugaacaucgccgcgacaaacgcuccguagccuuagcgccccacguaggccuggggcuagagaccaggacagaaacauggaugaguagcgaaggcgcauggaaacaaauacaaaaaguagaaacgugggcacugagacacccaggauucacaguaauagccuucuuuuuagcgcacgccauuggaaccucaaucacacaaaaagguauaauauucauccuccucaugcuaguaacacccucuauggcaaugcgaugcgugggaauagggaaccgagacuuuguggagggucuaagcggagcgacauggguugacgucguacucgaacacggcagcugcgucacuaccauggccaaaaauaaaccaacacuagauaucgaacuucucaaaaccgaggucaccaaccccgcaguacuaagaaaacuguguaucgaagcaaaaauaaguaauacgaccacagacuccagaugcccaacccaaggggaggccacccugguggaagaacaggacgcgaacuucgugugucgucgcacguucguagaccgcggauggggcaacggcugcggguuauucgggaaaggaagccucuuaacaugugcuaaauucaaaugcgugacuaaacuggaggguaagaucgugcaauaugaaaauuugaaauacuccgucaucgucacugugcacacaggagaucaacaccaagugggaaacgagacaaccgagcacggcaccaucgcgacuauaacaccacaagcaccaacaagugaaauccaauuaacggacuacggcgcacucacacuugacuguucaccgcgcacgggccuagacuuuaacgaaaugguccuauuaaccaugaaggaaaagagcuggcucgugcacaaacagugguuccuugaucuaccauuaccauggacaaguggagccaguacaucacaggagacuuggaaccgacaggaccuucuagucaccuucaaaacugcacacgcgaagaaacaagagguugugguacuaggaucacaagaaggagcuaugcacacagcccuuacgggagcgacagaaauccaaaccagugguaccacaacaauauucgcgggccaccuaaagugccgucuuaagauggacaaacuuacacuaaaaggcaugagcuacgugauguguacgggcaguuuuaagcucgagaaagagguggcagaaacgcaacacggaaccgugcucguacaagucaaguacgaagggacggaugcaccuugcaagaucccgcugucaacucaggacgagaagggaguaacucaaaacggacgccugauaaccgcgaacccaaucgugacagacaaagaaaagccggucaacauagaaacagagccuccuuuuggagaaagcuacaucaucgucggggccggagaaaaggcgcucaaacucagcugguucaagaaagggaguucuaucggaaaaauguucgaggcaacagcgcguggggcaagaagaauggccauccuaggagacacagcaugggacuucgggagcauaggcgggguguucaccagcguaggaaagcuaguccaccagguuuucggcacugccuauggcguccucuuuagcggcgucuccuggaccaugaaaaucggaaucgggauccuucuaaccuggcuuggacugaauagccgaagcgcaucucucaguaugacgugcaucgcgguuggaaugguaaccuuguaccucgguguuaugguacaagcagacaguggcugcguaauuaauuggaagggaagggagcucaagugcggaucgggaaucuucgugacaaaugagguccacaccuggaccgagcaauacaaauuccaagcugacagcccuaaacgacuaucugcugcaauaggcaaggccugggaagagggagucugcggcguccgaagcgcuacccggcuggagaacaucauguggaaacaaauaagcaacgagcugaaccauauccuacucgaaaacgacaugaaauucacuguggucguuggcgacgccaacggcaucuuagcgcaggggaaaaagaugauccgaccccaaccuauggagcacaaauacuccuggaaaucuuggggcaaggcaaaaauaaucggcgcagacauacagaacacaacauucaucauagacgggccggacacaccugagugccccgacgaccaacgagcauggaauaucugggagguggaggacuauggcuucggaaucuucacuaccaacauaugguugaagcuacgcgacuccuacacucaaaugugcgaucaccggcucaugucggcagccauaaaggacagcaaagcuguacaugcagacaugggguacuggaucgagagcgaaaagaacgagaccuggcgacuugcacgggccucauucauagaaguuaagaccugcaucuggcccaaaagccauacauuauggucaaacggcguccuagaauccgaaaugauaaucccaaagaucuacgggggaccuauuucacagcacaacuacagaccaggcuauuucacacagacugccgguccguggcaccuaggaaagcuagagcuggauuuugaucucugugagggaaccacagucgucguggacgagcacugcgguaaucgcggcccaucucuacggacuaccacaguuacagggaaaaucauccaugaguggugcugcagaaguugcacgcuaccaccccuacgcuucaggggcgaagacggaugcugguaugggauggagauacgcccaguaaaagaaaaagaagagaaucugguaaggagcaugguaucggcggggagcggcgaaguggacucuuucucacuaggcauacuaugcuuaaguauaaugauagaggaagucaugcgcucccgcuggucgcgcaaaaugcuaaugacugggacucucgcaguauuuuugcuguuaaucaugggacaacugacauggaacgacuugauaaggcugugcaucauggucggcgccaacgcuagugacaggauggggaugggaacaaccuaucuugcgcuuauggcaaccuuuaaaaugcgcccgauguucgccgucgggcucuuguucagacgucuuacgagccgggaaguucuguuguugacaauuggucugucccuagucgcaucagucgagcuacccaacagccuagaagaacuuggagacgggcuggcaauggguauaaugaugcucaagcuacugacagaguuccaaccgcaccaguuguggacgacgcuacuuagccugaccuucauaaaaacuacccugucacuagacuaugcauggaaaacgauggcaaugguccucaguaucguaucgcuuuucccccucugccuuuccaccaccagucagaaaacuaccuggcugccggugcuucuagguaguuuuggcugcaaaccgcuaacaauguuccucauaaccgagaacaaaaucugggggaggaaaucauggccacucaacgaggguauaauggcaauaggaauagucagcauacuccugucaagccuccugaagaacgacguaccccuagccggaccccucauagcugggggcaugcucauagcgugcuaugugauuaguggcagcagcgcugaccuuagucucgagaaagcagcagagguaagcugggaagaagaggcagagcacagcggcacgucacacaauauacuggucgaggugcaagaugacggcacgaugaaaaucaaggacgaggaaagggaugacacccugacgauucuccucaaggcgacguugcucgcuguguccggagucuaccccaugaguaucccagccacacuuuucguaugguacuucuggcaaaagaagaaacagcgaagcggcguauuaugggacaccccguccccaccagaaguggagcgcgcuguccuagacgacggcauauaccgcauccuacagcgcgggcuguuaggucgcucgcaaguggggguuggagucuuucaagacggaguauuccauaccauguggcaugugacgcgaggggcaguacugauguaccagggcaaaagauuagagcccagcugggcgucagugaaaaaggaccuaauuaguuacggagguggguggcgguuccaaggcagcuggaacaccggggaagaagugcaggucauugccguagaaccaggcaaaaaucccaaaaacgugcagaccacaccaggaaccuucaaaacgcccgaaggcgaagucggggcagucgcauuagacuucaagcccgguacgagcggcucucccaucguaaaccgagaaggaaagaucgucggcuuauacggcaauggaguagucacgacaaguggaacauauguaagugcaaucgcacaggccaaagcgucacaagagggaccacuaccagagauugaggacgagguguucaagaaaaggaaucucacgauaauggaccugcauccaggcucuggcaaaacgcgccguuaccuacccgcgaucguucgagaagcgauaaaaaggaaacugcgaacacuaaucuuagcgccgacccgagugguggccagugaaauggcagaagcccuaaaaggaaugccuauacgauaccagacaacagccguaaagagcgagcacaccggacgcgagauuguagacuugaugugccacgcuacauuuacgaugagacugcuaagcccgguaaggguaccgaacuacaacaugauuauuauggacgaggcgcacuuuacagaucccgcuuccauagcggcgcguggauauauaagcacgcgcgugggcaugggagaggccgcugcgaucuucaugacagccaccccaccggguaguguggaagcguucccccaaaguaacgccguaauccaggaugaggaaagagauaucccggagaggucguggucuagcggguacgacuggauaacagacuucccagguaagacggucugguucguccccucaauuaaaagcggcaaugacaucgccaacugccuuaggaagaauggaaagcguguuauccaacucucaagaaaaacauucgauaccgaguaccagaaaacgaaaaauaacgacugggacuacguuguuacuaccgauaucagcgaaaugggggccaacuuccgcgccgacagagugauagacccgcggagguguuuaaagccggugauacuaaaagauggaccagagcgcgucauccuagcugggccgaugccagugacaguugcaucugcagcacagcgcagaggccgaaucggccgcaaccagaacaaagaaggagaccaauauguguauauggggcaaccccuaaacaaugaugaagaccacgcucacuggacugaggcgaagaugcugcuggacaacaucaacacaccagagggaauaauccccgcccuauucgaacccgagcgcgaaaagagcgccgcuauagacggagaguacagacugcgaggagaagcgcgcaaaacuuucguggaacuaaugaaaagaggagaccuacccguauggcuaucauacaagguagcauccgagggcuuucaauacagugaccgccgauggugcuucgacggagaacguaauaaucaaguguuagaggagaacauggacguagaaauauggacgaaagaaggggaacguaagaaacuccgcccgcgcuggcuagaugcgagaacauacagugacccccucgcuuugagagaauuuaaagaguucgcagcgggccgccgcucagugucuggggaccucauucucgaaauaggcaaacuuccacagcaccucacacuacgggcgcagaacgcauuagacaaccucgugauguugcauaacuccgagcagggcggcaaggccuaccgucacgcaauggaggaacuccccgauacaaucgagacccuaaugcugcuggcacugaucgccguucuaacgggcggggucaugcuauucuucuuaagcggcaagggucucggcaagacaucgaucggccuccuaugcgugauggccaguucagcccuucuauggauggcaucggucgaaccgcacuggauagcggcaagcauuauacucgaguucuuccugauggugcuacuuauaccugaacccgaucggcaacggaccccucaggacaaccaacuagcauacgucgucauagggcuucucuucaugauacuaacaguggccgcaaacgaaaugggauugcuagaaaccaccaaaaaggaucucgggauaggucaugucgccgccgaaaaccaccaccacguaacaaugcuggacgucgaccuaagaccugccuccgccuggacgcuauaugccguagcgaccacaguaauaacgccuaugaugcgacacacaauagaaaauacgacagccaacaucagcuuaaccgcaauagcaaaucaggccgcgauccuuaugggcuuagacaaaggauggccgauaucaaaaauggacaucggcgucccccuccucgcccucggcugcuacucccaagucaacccucuaacccuaacagccgccguccugaugcucguggcacacuaugcaaucauaggcccaggcuugcaggcaaaagccaccagagaagcacagaaaaggacagcagcaggaaucaugaagaacccaaccguagacggcauaguagcaaucgaucuggacccaguuguuuacgacgcuaaauucgaaaagcagcuagggcaaauaaugcucuuaaucuuaugcaccucacaaauacugcucaugcguacgaccugggcauugugcgaaaguaucacgcucgccacaggaccucucaccacccugugggaaggcucccccgggaaauucuggaacacaaccauugcagucagcauggcuaacaucuuccgcgggaguuaccucgcaggggcgggguuagcguucagccugaugaaaucccugggcggcggucgcagaggaaccggcgcccaaggcgaaacacuuggugagaaauggaagagacaauugaaccagcugaguaaaucagaauuuaacacguacaaacgaagcgggaucauggaagucgacagaucggaagcuaaggagggucucaaaagaggcgagaccacuaaacacgccguuagucgcgggacagcaaaacuacguugguucguagaacggaaccucguaaaaccagagggaaagguuaucgaccuggggugcgguagaggaggcuggaguuacuauugugccgggcucaaaaagguuacagagguuaaaggcuacaccaaggguggaccggggcaugaggagccaauuccgauggccaccuaugguuggaacuuagugaagcugcauucaggaaaagacguauuuuucacaccaccagaaaagugcgacacacuccuuugcgacaucggggaaucgaguccaaauccuacgauagaggaagggcgaacccuacgaguucuaaaaaugguggagccauggcuaagggggaaccaguucuguauaaaaauacuuaacccuuauaugcccucagucgucgagacccuagaacaaaugcaaagacgccacggcggcaugcuaguacgaaauccgcucagcagaaauucgacccacgagauguacuggguaucaugcgggaccggcaacauugucucagcaguaaacaugaccucccggaugcugcucaacagauucacuauggcccaccgaaaaccaacauacgagcgcgauguggaccuaggagccggcacgagacacgucgcgguggaacccgagguagccaaccugggcauaauaggacaaagaaucgaaaacauaaagaacgaacacaaaaguacguggcacuaugacgaagacaaccccuacaaaaccugggcauaucacggauccuacgaagucaaaccauccggauccgcaagcucuauggugaacggaguaguacgauuacucacaaagcccugggacguuauccccaugguaacacaaauagccaugacggacacaacaccauuuggacaacaaagaguguucaaggagaagguugacacgagaacuccccgagcgaaaagggggaccgcccagaucauggaagucacggccaaaugguuaugggacuucuugucacggaauaagaaaccccgaauaugcacgcgagaggaauuuaucaggaaggugagaagcaacgcagccauuggggcagucuucguagacgaaaaccaauggaacagcgcaaaggaggcgguugaagaugagcgauucugggaccucgugcacagggaacgcgaacuccacaaacaaggcaagugcgcgacgugcguauacaacaugauggguaaacgagagaagaaacucggugaguucgguaaagccaaaggcucaagggcaaucugguacauguggcuaggagcgagauuccucgaguucgaggcccuaggauucaugaacgaggaccauugguuuaguagggaaaauucgcucucuggagucgagggagaaggguugcacaaacuaggguacauacucagagauauaagcaaaauccccggaggaaacauguaugcggacgacacggccgguugggacacacgcauaacagaggaugacuuacagaacgaagcaaagaucacggauaucauggagcccgaacaugcucuacucgcgaccagcaucuucaaacugaccuaucagaacaaggucgugcguguacagagaccggccaaaaauggcacuguuauggaugucauuucgagaagagaccaaagaggguccgggcaagucgguacauacgggcugaauaccuuuaccaacauggaaguccaacuaauccgacaaauggagucagaagguaucuuccucccguccgaacucgaaacaaccaaccuugcggagcggguacuagacuggcuggagaagcacggagucgaacgguuaaaacggauggcaaucaguggggacgacugcguggugaaaccgauagacgaccgauucgccacggcccucaucgcauugaacgauaugggcaaggucaggaaggauaucccacagugggaaccaucaaaaggcuggaacgacuggcaacaagugccguucuguucacaucauuuccaucaauugaucaugaaagauggacgcgaaaucgucgugcccugcaggaaucaggacgagcuugucggcagagcaagaguuucccagggagcaggcuggagccugagggagacagcaugccucgggaagaguuacgcucaaauguggcagcugauguauuuccauaggcgggauuugcgcuuagcagccaacgcuaucuguagcgcggucccgguagacuggguaccgacaucccguaccaccuggaguauacaugcgcaccaccaauggaugacaacugaagacauguuaagcguauggaaccgcguguggauugaggagaacccauggauggaagacaaaacucacguaaguucgugggaagagguaccguacuuaggcaagcgagaagaccaauggugcggaucacucauagggcuuaccgcccgcgcaaccugggcaaccaacauccaaguagccaucaaucaagugcgccgguuaauaggaaacgaaaacuacuuggauuauaugaccucgaugaaaagguucaaaaacgaguccgacccagagggcgcacugugguag

SEQ ID NO: 24013 - RNA, 9879 nt, Artificial Sequence
  derived and/or modified CDS sequence (opt11) from DENV-1__FJ205875__SS-prME
agugugacaaugcuguugaugcugcugcccacagcucucgccuuucaccucaccacgcguggcggggagccccacaugauugugagcaagcaggagcgggguaagagccucuuguuuaagaccagcgccgggaucaacaugugcacacugaucgccauggaccuaggggagcucugcgaggacaccaugaccuacaagugcccccggauaaccgaagccgaacccgacgacguggacugcuggugcaacgccaccgacaccugggugaccuacgggaccuguagccagaccggcgagcaccggcgcgacaagcgguccguugccuuagcuccccacgugggacugggucucgagacccggaccgagaccuggaugagcagcgagggcgccuggaagcagauccagaagguggaaacgugggcucugcggcacccuggauucacggugaucgcccuguucuuagcgcacgccauuggcaccucgaucacccagaaggggaucaucuucaucuugcugaugcuugugacccccuccauggcaaugcgcugcguugggaucggcaaccgggacuucgucgaggggcugagcggagccacguggguagacgugguccuggagcacggguccugcgugacaacuauggccaaggacaagcccacacucgacaucgagcuacugaagacggaggugacuaaucccgcgauucugcgcaagcuguguaucgaagccaagaucaguaacaccaccacggacucucggugcccgacccaaggcgaagcgacccuggucgaggagcaggacgccaacuucgugugccgccggacuuuuguggaucgcggcugggggaacggcugcggccuauucggcaaagggagccugcugacgugugccaaguucaagugcgucacaaaacuagaaggcaagaucguccaguacgagaacuugaaguacuccgucaucgucaccgugcauacgggggaccagcaccaggucgggaacgagacgacggagcacggcacuaucgccacaaucacgccccaagcccccaccagcgagauccaacugaccgacuauggggcccucacccuggauugcucuccucggaccggccuagacuuuaacgagaugguccuccugacgaugaaggagaagucuuggcugguccacaagcaaugguuucuggaccucccccugcccuggacguccggggccucaaccagccaggagacuuggaaccgucaggaccuccucgucacuuucaagaccgcccacgcgaaaaagcaggaggucguggugcuggggucccaagagggcgcuaugcauaccgcgcucacuggggccacggagauccagaccagcggcacaaccacgauuuucgcggggcaccucaagugccggcuaaagauggacaaacucacacugaagggcauguccuacgugaugugcaccgggagcuucaaauuagagaaggagguggcggaaacccagcacggcacggugcugguccaggugaaguacgaaggcaccgacgcccccugcaagauccccuucuccacccaggacgagaagggugucacucagaacggccgccucaucacggccaacccgaucgugacugacaaggagaagcccgugaacaucgagacagagccgcccuucggcgagagcuacaucgucgugggcgccggugaaaaggcgcugaaacuuucaugguucaagaaggggagcuccauagggaaaauguucgaggcuaccgccagaggggcacgucggauggcuauccucggagacacggcgugggacuuugggagcaucggaggcguauucacguccgucgggaaguuaguucaccagguguucggcaccgccuacgguguccuguucagcggcguguccuggacgaugaagaucgggaucggcauacugcugacgugguuaggccucaacagccgcuccacgagcuuauccaugaccugcaucgcaguggggauggucacccuauaccugggugugaugguccaggccgacagcgggugugucaucaacuggaagggccgagagcucaaguguggguccggcauuuucgugacgaacgaggugcacacuuggaccgagcaguacaaguuccaggcugauagcccgaaaaggcuaagugcggcaauagggaaggccugggaggagggggucugcgggauacgguccgccacccggcucgagaacaucauguggaaacagaucagcaacgagcugaaucacauccuguuagagaacgacaugaaguucaccgugguggucggagacgccaacggcaucuuggcgcaggggaagaaaaugauccgcccccagccaauggagcacaaguacuccuggaaguccuggggcaaggcaaagaucaucggcgcggacauccagaacacgaccuucaucaucgacgggcccgacacaccggagugccccgaugaccagcgggccuggaacauuugggagguggaggacuacggcuucgguaucuucaccacgaacauuuggcugaagcuccgggacuccuacacccagaugugcgaucaccgacugauguccgcagccaucaaggacucgaaggcgguucacgcagacaugggcuacuggaucgaaucugagaagaacgaaaccuggaagcuggcccgcgcgucauucaucgaagucaaaacuugcaucuggcccaagagccacacgcucugguccaacggcguguuagagagcgaaaugauaauccccaagaucuacgggggccccauaucccagcacaacuaccggcccggguacuucacccagaccgcaggccccuggcaccuagggaagcuggagcuggauuucgaccugugcgagggcaccacggugguaguggacgagcacugugguaaucgcgggccgagccuccggacgacuaccgugacgggcaagauuauacacgagugguguugucgcuccugcacccugccgccccugcguuuccgcggggaggacggcuguugguaugggauggagauccggcccgucaaagagaaggaggagaacuuagugcgcagcauggugucagcaggcagcggcgaagucgacucuuuuucgcuggggauccugugcgugagcaucaugaucgaggaggugaugcguucccgcugguccaagaaaaugcucaugacuggcacccuggccgucuucuuacuccugaucauggggcaguugacguggaacgaccucauccggcugugcauaauggugggcgccaacgcguccgaccgcauggggauggguaccaccuaccuggcacucauggccaccuucaagaugcggccgauguucgccguggggcugcuauuccggcgccucacgagccgggaaguacugcugcucacaaucggucugucccugguggcuagcguggagcucccaaauuccuuagaggaguugggcgacggucucgcgaugggcaucaugaugcugaaguuacucaccgaguuccagccccaccagcuguggacgacgcuacucucccugaccuucaucaagaccacccuuuccuuagacuacgccuggcgcacgauggcgaugguccucucaaucguaucccuguucccacugugccugucaaccaccucccagaagacaacguggcugccgguccucuuaggcagcuucgggugcaagccccugaccauguuccucaucaccgagaacaaaauuuggggccggaagucguggccacugaacgaagggauuauggccaucggcauaguaagcauacuccucucaucguuacugaagaaugacguaccccucgcugguccacugauugccggcggcaugcuaauugccugcuacgugauuagcggguccagcgccgaccucaguuuggagaaggccgcggaggugagcugggaagaggaggccgagcacucaggcaccucucauaacauucugguggagguccaggacgacgggacgaugaaaaucaaggacgaggagcgcgacgacacacucacaauucugcugaaagccacacuccuggcaguauccggaguguacccuaugagcaucccagccacacucuucgucugguacuucuggcagaagaagaagcagagauccggggugcucugggacacgcccagcccacccgagguggagcgcgcgguccuggacgauggcaucuaccggauccuucagcgcggccuccucgggagaucucaagugggcguaggggucuuucaggacggcguguuccacaccauguggcacgucacccgcggggccguacugauguaucagggcaagcggcuugagcccagcugggcuagugugaagaaggaucucaucagcuacggcgggggcuggagguuucagggguccuggagcacaggcgaggagguucagguuaucgcaguggagcccgggaagaacccgaagaacgugcagacgacccccggaacuuucaagacacccgaaggcgaagucggggcgaucgcgcuagacuuuaaaccgggcacauccgggucgccaaucgugaaccgggagggcaagaucgugggccuguacgggaauggcguugugaccaccuccgggaccuacgugagcgccauugcacaggccaagaccagccaggagggcccgcucccggagaucgaggacgaggucuucaaaaagcgcaaccugaccauaauggacuuacacccgggauccggcaagacgcggcgcuaccuccccgccauugugcgggaggccaucaagcgcaaauugcgcacccuaauccucgcccccacucgcguggucgccagugagauggccgaggcucuuaagggcaugcccauccgcuaccagacaaccgccgugaagucggagcacaccgggcgggaaaucguggaccuuaugugccacgccacguucacaaugcgguuacugagcccaguccgggugcccaauuacaacaugaucaucauggacgaggcccacuucaccgacccggccuccaucgcugcccgcggcuacaucucgacccgggucgggaugggagaggccgccgccauauucaugacggcgacgccgcccggguccgucgaggccuucccccagagcaacgccgugauccaggacgaggaacgcgacauccccgaacgaagcuggaacagcggcuacgauuggauuaccgauuuucccggaaagaccgugugguucgugccuuccaucaaaucagggaacgacauugccaacugucugagaaagaauggcaagcgggugauccaguuaucccguaaaacguucgacaccgaauaccaaaagacgaagaacaacgacugggacuacguggucaccacggacaucucugaaaugggggcaaauuuccgggccgaccgcgugaucgaccccaggcgcugccucaagcccgugauacuaaaggacggccccgagcgggucaucuuggccgggccgaugcccgugaccguggcaucagccgcacagcgaaggggccgcauuggccggaaucagaauaaagagggggaccaguacgucuauaugggccagccccugaacaacgacgaagaccacgcccacuggaccgaggccaagauguuacucgacaacaucaacacacccgaggggaucauccccgcucuguuugagccagagcgcgaaaagagugccgcaaucgacggcgaguaccgccugagaggggaggcccgaaaaacguucguagagcucaugcggcgcggcgaucuacccgucuggcuguccuacaaaguugccucggaggguuuccaguacuccgaucggcgcuggugcuucgauggggagcggaacaaccaggugcuugaggagaauauggacgucgaaaucuggaccaaggagggggagcgcaagaagcugcgcccccgcuggcuggacgcccggaccuacagugacccgcucgcacugcgcgaguucaaggaguucgcugccggccggcgcucgguauccggcgaccuaauccucgagaucggcaaacugccccagcaccuuacccuccgugcccagaacgcgcuggacaaccucguuaugcuccacaacucagagcagggcgggaaagccuaccgccaugcgauggaggaacugccugauaccauugaaacgcugaugcucuuagcgcuuaucgccguucucacagggggcguuacccuauucuuuuuguccgggaaggggcucgguaagaccagcauuggauuacugugcgucauggcuucgucugcgcuccuuuggauggcgaacgucgaaccccacuggaucgcagccucuaucauccuggaguucuuucuaauggugcugcugauuccggagccggaucggcagcgcacgccccaggacaaccagcuggcguauguggugaucggccugcuguucaugaucuuaaccguggcggccaacgagauggggcugcuggagaccaccaagaaggacuuaggcaucgggcauguagcagccgagaaucaccaccacgccacgaugcuggacgucgaccugagaccggccagcgccuggaccuuguacgccguggcgaccacgguuaucacgcccaugaugcgccacaccaucgaaaauaccaccgccaacaucucccuaacagcgaucgccaaccaggccgcuauccugaugggacucgacaagggcuggcccaucucuaagauggacauuggggugccccugcuggccuugggcugcuacucacaggugaauccuuugacccugaccgcggcugugcucaugcuggucgcccacuacgccaucaucgggcccggccugcaggcaaaggccacccgugaagcccagaaacgcacugccgccgggauaaugaaaaaucccaccguggacggcaucguggcuaucgaucuggaccccgucguguacgacgcgaaguucgaaaagcagcugggacagaucaugcugcucauccuaugcaccucucaaauccugcucaugcguaccacuugggcauugugcgagaguauuacccuggccaccgggccacucaccacgcuaugggagggcagccccggaaaguucuggaauacuaccaucgccgugucaauggcgaacaucuuucggggcagcuaccuggccggcgccggguuagccuucucccugaugaaaagccugggcgggggccgacgggggaccggugcccagggugagacguugggugagaaguggaaacgccagcugaaccagcugaguaaaagcgaguuuaacaccuacaagcgaagcggcaucauggaggucgaccgcuccgaggcgaaagagggacucaagagaggggaaaccaccaaacaugcggugagcagaggcacggcgaagcugcgguggcugguagagcgcaaucuggucaagcccgaaggcaagguuaucgaccucggcugcggccguggcgggugguccuacuacugugccggccugaagaaggugaccgagguuaagggguauaccaagggaggccccgggcacgaggaaccgauccccauggccaccuacggauggaaccuagugaagcucuacucagggaaggauguguucuucacgccgcccgagaagugcgacacacugcugugcgacauaggcgaauccucaccuaauccaaccauugaagaagggcgcaccuugcggguccuuaaaaugguggagcccuggcuucgcggcaaccaauucugcaucaagauccucaaccccuauaugccguccguggucgagacccuggaacagaugcaacggaagcacggcgggaugcugguacgcaacccucucagccggaacagcacgcacgaaauguacugggugucuugcgguacagguaauaucgucuccgccguuaauaugaccagccguaugcugcuaaaccgguucacaauggugcaccgcaagcccacguacgagcgcgacgucgaccucggggcgggaacccggcacguggccguggaacccgaggucgccaaucuggacaucaucggacagcgcauagagaacauuaagaacgagcacaaguccacguggcacuaugacgaggacaacccuuacaaaacgugggcguaccauggcagcuacgaggugaagcccuccgggucagccuccagcaugguaaauggagucgugcgucugcucacuaagcccugggacgucaucccaaugguuacucagaucgccaugaccgacaccacgccauucgggcagcagcgcgucuucaaggagaagguugacacccggacgccccgggccaaacggggcacggcccagaucauggaaguaacggcuaaguggcuguggggcuuccugucccgcaacaagaagccccggauauguacgcgcgaggaguucacgcggaaggugcgaaguaacgcggccaucggugccgucuucguagacgagaaccaguggaacagcgccaaagaggcgguugaggacgagcgguucugggaccucguccaccgcgagcgggagcugcacaaacagggcaaaugcgcaaccugcguguauaacaugaugggaaaacgcgagaagaaacugggcgaguucggcaaggccaaagguucccgggcgaucugguauauguggcuuggcgcgcgcuuccuggaguucgaagcccugggguucaugaacgaggaccacugguucagccgggaaaauuccuucucggggguagagggagacggcuuacacaagcuggguuacaucuugcgcgacaucuccaagaucccgggcggcaacauguacgcugacgacacggccgggugggauacgcggaucacggaagaugaucuucagaacgaggcgaagaucacagacauaauggagcccgagcacgcgcugcuugccacgucaaucuucaaacucacauaccagaacaaggucgucagaguucagcgaccugcuaagaacggcacggucauggaugugaucucccggcgugaccaaagagggagcggccaggugggcaccuacggguuaaauacuuucacuaacauggaagcccaacugauuaggcaaauggaguccgaaggcauauuccuccccagcgagcuggaaacuccuaaccuggccgagcggguauuagacuggcuggagaagcacgggaccgagcgccugaagcggauggcgaucuccggcgacgauugcgucgugaagcccguggaugaccgcuucgccacggcccucaccgcgcugaacgacauggggaaaguucggaaggacauuccccaaugggaacccaguaagggcuggaacgacuggcaacaggugccguucugcucgcaccacuuucaccagcucaucaugaaggacggccgcgagauugucgugcccugccggaaccaggacgagcucguggggagagcgcgggucagccagggggcgggguggucucugcgcgagaccgccugcuugggcaagaguuacgcccaaauguggcagcucauguauuuccaccggcgcgaccuucggcuagcugccaacgcgaucugcucagcagugcccgucgacugggugcccaccagccgcaccacguggagcauccacgcccaucaccaguggaugacaacagaggacaugcucuccguauggaaccggguguggaucgaggaaaauccguggauggaggacaagacgcacgucagcuccugggaggaggugccguaucuggggaaaagagaggaucaguggugcgguagccugaucggccucacggcccgcgcgaccugggccaccaacauucagguagcgaucaaccaaguccggcgccugaucgggaacgagaacuaccuggacuacaugaccuccaugaagcgcuucaagaacgaaagcgaccccgaaggugcccuuugguga

SEQ ID NO: 24014 - RNA, 9879 nt, Artificial Sequence
  derived and/or modified CDS sequence (opt11) from DENV-1__FJ410173__SS-prME
ucuguaaccaugcugcucaugcuacuucccacagcccucgccuuccaccugacgacccgggguggggaaccccauaugaucgucagcaagcaagagcggggcaagagccuccuguuuaagaccagcgcagggaucaacaugugcacgcugaucgcaauggaccugggggagcucugcgaggacaccaugaccuacaagugcccccggaucacagaggcggagccagacgacguggacugcuggugcaacgccaccgacacgugggucaccuacgggaccugcagccagaccggcgagcaccggcgggacaagcgguccgucgcccuggcgccccacgugggccuggggcucgagacgcgcaccgaaacguggaugucaagugagggcgccuggaaacagauccagaagguggagaccugggccuuacggcaccccggguucacggucaccgcccuguucuuggcgcacgccauaggcaccuccaucacccagaaagggauaaucuucauccugcugaugcucgugacgccauccauggccaugcgcugcguugguaucgggaaccgggauuuugucgaggggcugagcggugccaccuggguugacgugguccuggagcacgguaguugcgugacgaccauggcaaaggacaaacccacguuggacaucgaguuauuaaaaacugaggugaccaacccggcgguccuccgcaagcugugcaucgaggccaaaaucagcaacaccacaacugacagucggugccccacacagggcgaggccacccugguggaggagcaggacucaaacuucgugugccgccggacuuucgucgaccguggcugggggaacggcugcggccucuucggcaaggggucccuacugaccugcgcuaaauucaagugcgugaccaagcucgagggcaagaucgugcaguacgagaaccugaaguauucagucauagugacugugcacacuggcgaccagcaccaagucgggaaugagacuaccgaacacggcacuaucgccaccaucacgccccaggcgcccaccaccgagauccagcugaccgacuacggggcccucacucuggauugcagcccacggaccggccuggacuuuaaugagauggugcucuugaccaugaaagagaagucuuggcugguccacaagcaaugguuucucgaccugccgcugcccuggaccuccggggccuccacgagccaggagaccuggaaccgccaggaccuccuggugaccuucaagacggcgcacgccaagaagcaggagguggucguguugggcucccaggagggcgcaaugcacacggcguugaccggggccaccgagauccaaaccagcgggacgaccaccaucuucgccgggcaccugaagugucggcugaagauggacaagcucacccugaagggaauguccuaugugaugugcacggggagcuuuaagcuggagaaggaggucgccgagacgcagcacggaaccgugcuggugcagguaaaguacgagggcaccgacgcgccgugcaaaauacccuucuccgcccaggacgagaagggggugacgcagaacggccgccuaaucaccgccaauccgaucgugaccgacaaagaaaagcccgucaacaucgagacggaaccgcccuucggcgagagcuacauuguugugggcgccggcgaaaaagcccugaagcuguccugguucaagaaggggagcucgauuggcaagauguucgaggccacggcccggggggcccgccgcauggccauccucggcgauacagcgugggacuuugggagcaucggcggggucuucaccucgguggggaagcucguucaccaggucuucggcgccgccuacggggugcuauucagcggcgugucguggacaaugaagaucgggaucggaaucuuacuuacguggcuuggccucaacagccguuccaccagccuguccaugaccuguaucgccgucgggauggugacgcuguaccucggcguuaugguccaggccgacagcgggugcgugaucaacuggaaggggcgugagcugaagugcggguccggcaucuucgugacgaacgagguccacacguggacagagcaguacaaauuucaggcggacaguccgaagcggcugagcgccgccauuggcaaggccugggaggaggguguguguggcauccgcagcgccacgcggcucgagaauaucauguggaagcagaucucaaacgagcugaaccacauccugcucgaaaacgacaugaaguuuaccgugguugugggagacgcgaacgggauccuggcgcagggcaagaagaugauucgcccccagcccauggaacaccgguacagcuggaaguccuggggcaaggccaaaaucaucggcgccgacauccagaacaguacauucaucauugacgggcccgacaccccggagugccccgacgaccagcgugcauggaacaucugggaaguggaggacuacggcuucggaaucuuuaccacuaacaucuggcugaagcuccgggacucguacacgcaaaugugcgaccaucgccugaugagugccgccaucaaggacagcaaggccguccaugcagacaugggcuacuggaucgagagcgagaaaaacgagaccuggaagcuggcgcgggccagcuucaucgaagugaaaaccugcaucuggcccaagucccacacgcucuggagcaacggcguucuagaguccgagaugaucauccccaagaucuacgguggcccaauuagccagcacaacuacagacccggguacuucacgcagaccgcaggccccuggcaccuggggaagcucgagcuggacuuugaccugugcgagggcaccaccgucguggucgacgagcauugcggcaaccgggggccgucgcuccgcacaaccaccgucaccggcaagaucauacaugaguggugcugccggagcugcacgcugcccccccugcguuuccgcggggaggacggcugcugguacgggauggagauccgcccugugaaggaaaaggaggaaaaccucgugcgguccauggucagcgccggcagcggcgagguggacuccuucagccuggggauccugugcguguccaucaugaucgaggagguaaugcgcagccgguggucacggaagaugcucaugaccggcacucuggccguguuccuguugcugaucauggggcagcugaccuggaacgaccucauccgccugugcaucauggugggcgcgaaugccagcgaucggauggggaugggcacgaccuaccuggcacucauggcgaccuucaagaugcgcccgauguucgccgucggguuacuguuccggcgccucaccucccgggaggugcuguugcucacgaucggguuaagccugguggcgucagucgaguugcccaacagccuggaagaacugggcgacgggcuggccaugggcaucaugaugcugaagcuucucaccgaguuucagccgcaccagcuguggaccacccugcucucccuuacguucauaaagaccacacugagccucgauuacgccuggcggacaauggccaugguguuguccaucguaucacuguucccccucugccugucgaccacgucacaaaagacgacguggcugccggugcuccugggcuccuucgggugcaaaccguuaacaauguuccucauuacggagaacaaaaucuggggccgcaagagcuggcccuuaaacgaggggaucauggcuaucggcaucgugaguauccugcucagcagccugcugaagaacgaugucccccucgccggaccgcuuaucgcaggcggcaugcugaucgccugcuaugugaucuccggguccagcgccgaccuuucgcuggagaaggcagccgagguauccugggaggaagaggccgagcauucaggcaccucccauaacauccugguggaggugcaggaugacgggacuaugaagauaaaggacgaggagcgcgacgacacccucacgauccugcugaaggccacucugcuggcgguaagcggcgucuaccccaugucgaucccggcgaccuuuuucgugugguacuucuggcagaaaaagaaacagcggucuggggugcugugggacacccccuccccgcccgaggucgagcgcgcggugcucgaugacgguaucuacagaauacuccagcgcgggcugcucgggcguagccaggugggcgucgggguuuuccaggacgggguguuccacacgauguggcacgucacucgcggugcagugcuaauguaucagggcaagagacuggagcccagcugggccagcgugaagaaagaccugauuuccuacggaggaggcuggcgcuuccaggggaguuggaacaccggcgaggagguccaggugaucgccguggagcccgggaagaacccuaaaaacguacagacgacgcccggcaccuucaagacccccgagggagaggugggggcgauagccuuggacuucaagcccggcaccuccgggaguccgauagugaaccgcgaaggaaaaaucgucggccuguacgggaacggcguggugacgaccuccggaacauaugucagcgccaucgcccaggccaagaccagccaggagggcccccugcccgagaucgaggaggagguguucaagaaacgaaaucucacaaucauggaccugcacccgggguccggcaagacccggcgcuaccugccagcgaucgugcgggaggccauaaaacgcaagcuccgcaccuuaauccuggcacccacccgggucguggccagcgagauggccgaggcccucaagggcaugcccauccgguaccagacgacagccgugaagagcgagcacaccgggcgagagaucguagaccugaugugccaugccaccuucacgaugaggcugcucagcccggugcggguucccaacuacaacaugauuaucauggaugaggcccacuuuacugacccugcguccaucgccgcccgcggcuacaucagcacccgggucggcaugggcgaggcugcggcgaucuucaugaccgcuacgcccccgggauccguagaggccuucccacagagcaacgccgugauccaggacgaggagcgcgacauacccgagcggaguuggaacagcggcuacgacuggaucacggacuuccccggcaagacugucugguucgugccguccaucaagucgggaaacgauauugcaaacugcuuacgcaagaacggcaagagggugauacagcugagccgcaagaccuucgacacugaguaccagaagacccggaacaacgacugggacuacgucguaaccaccgacaucucagagaugggggcgaacuuucgcgccgaccgggugauugacccccggcggugccucaagcccguuauccugaaggacggccccgagcgcgucauccuggcugggccgaugcccgugacggucgccuccgcggcccagcggcgcggccgcaucggccggaaccagaacaaggagggcgaccaguacguauacaugggccagccccucaacaacgacgaggaccacgcccacuggaccgaggccaaaaugcuguuagacaacaucaauacccccgagggcaucaucccggcacuguucgagcccgagcgcgagaaguccgcggcgauagacggcgaguaccggcuuaggggggaggcccggaagacauucgucgagcugaugcgcagaggugacuuaccgguguggcuguccuacaagguggccagcgagggguuucaguacuccgaucgccguuggugcuucgacggggagcgcaacaaccaggucuuagaagagaauauggacguggagauuuggacgaaggagggcgagcggaagaagcuccgcccccgguggcuagacgcccgcaccuacucggacccgcuggcgcuccgggaguucaaggaguucgccgccggucgccggucagugucgggagaccugauucuggagauuggcaagcucccccagcaucugacccugcgcgcccaaaacgcccuggacaaccugguaaugcugcacaacagugagcagggaggcaaggcguaccgccacgcgauggaggagcuccccgacaccaucgagacccugaugcugcucgcccugaucgccguccugaccgggggggugacccucuucuuccugucggguaaggggcuuggcaagacgaguaucgggcuccugugugucauggcgaguucugcccugcuuuggauggccaacguggaaccccacuggaucgccgccuccaucauccuggaguucuuccugauggugcuccugaucccggagcccgaccgccagcggacgccucaggacaaccagcuugccuacguggugauaggccugcuguucaugauccugacgguggccgccaacgagaugggccuccuggaaaccaccaagaaagaucugggcaucggccauguagccgcggagaaccagcaucacgcgaccaugcucgacguggaccugcgcccggccagcgccuggacguuauaugccguugccaccaccgucauaaccccuaugaugcgccacaccaucgagaacaccaccgcuaauaucagccucaccgccaucgccaaccaggccgccauccugaugggccuggacaagggauggccuaucagcaagauggacaucggggugccacuccucgcucugggcugcuacucccagguuaacccgcucacgcugaccgcagccguccuaauguuaguggcccacuacgcgauuaucgggccuggccuucaggccaaggccacccgggaggcucagaagcgcacugccgcggggauaaugaagaaccccacgguggacggcaucguagccaucgaccuggaucccgugguuuaugacgccaaguucgagaagcagcucggccagaucaugcugcugauccucugcaccagucagauauuacugaugaggaccacaugggcacucugugaguccaucacgcuggccaccgggccguuaaccacccucugggaggggagcccagggaaguucuggaacacgacuauugcggucuccauggccaacauuuuccgcggcagcuaccuggccggcgccgggcuggccuucucccucaugaaaagucugggcgggggacggcgcgggaccggcgcucaaggcgagacccugggggagaaguggaagcggcaauugaaccagcuguccaaaagcgaguucaacacguacaagcgcagcggcaucauggagguggaucgguccgaggccaaggaggggcuaaagcgcggcgagaccacuaagcacgccgugagccgggggaccgccaagcuccgcugguucguagagcggaacuuggugaagccagaaggaaaggugauagaucugggcugcgggcgaggcggcuggagcuacuacugcgcgggcuuaaagaaggucaccgaggugaagggguauaccaaaggcggcccgggucacgaggagccgaucccaauggccaccuacggcuggaaccucgugaaguuauacucugggaaagacgucuuuuucacuccgcccgaaaagugcgauacacugcugugcgacaucggcgaguccagcccuaaccccaccauagaagaggggcggacccugcgcguguuaaagaugguagagcccuggcucaggggaaaccaauucugcaucaagauccugaaucccuauaugccuucaguuguggagacccuggagcagaugcaacgcaaacauggugggaugcucgugcggaacccccugagccgcaacuccacccacgagauguacugggugagcugcggcaccgggaacaucguguccgccgugaacaugaccagucgcaugcugcuaaaccgguuuaccaugacccaccgcaagcccacuuacgagcgggacguggaccugggcgccggcacccgccacguggcgguugagccagaggucgccaaucuagacaucauugggcagcggaucgagaacaucaagaaugaacacaaguccaccuggcacuacgacgaggacaacccauauaagaccugggccuaccacggcagcuaugaggugaagcccuccgggucggccucaagcauggugaacggugucgugcgccuccuuacgaagcccugggacgucauccccauggugacccagaucgccaugaccgacaccacgccguuugggcagcagcgaguguucaaggagaaggucgacacccgcacgccgcgugccaagcguggaaccgcucagaucauggaagugacggccaaauggcucuggggcuuccucucccggaacaaaaagccccguaucugcacccgggaggaguucaccaggaaggugcggaguaacgcugccaucggggccgucuucguggacgagaaccaguggaauagcgcaaaagaggccguggaggacgagcgcuucugggaccugguccacagagagcgugagcugcacaagcagggcaagugcgcgaccugcguguacaacaugauggggaagcgggagaagaagcucggcgaguucgggaaagccaagggcucccgcgcgauaugguauauguggcugggcgcccgguuccuggaguucgaggcccuuggguucaugaacgaggaccacugguucagccgcgagaauuccuuuagcgggguggagggggagggucuccacaaacugggguacaucuugcgcgacauauccaagaucccaggcggcaauauguacgccgacgacacagccgggugggacacccggaucacagaggacgaucugcaaaacgaggccaagaucacggacaucauggagccggagcacgcccugcuggccacgagcauauuuaagcugaccuaccagaacaaggucgugcgggugcagcggcccgccaagaacggaaccguuauggacgugauuucccgcagggaucagcgcgggagcggccagguggggaccuacgggcugaacacguucacuaacauggagguccagcucauccggcagauggaguccgagggcaucuucuuacccucagagcuggagaccccgaaccucgccgagcgugugcugaauuggcuggagaaacacgggaccgagcggcucaagagaauggcgaucuccggcgacgacugcguggucaagcccguggacgaccgguucgccacugcccuaaucgcgcugaacgacauggggaaggugcgcaaggacaucccccagugggagcccagcaagggcuggaacgacuggcaacaaguuccguucugcucccaccacuuccaccagcucauaaugaaagacggccgugagaucguggugcccugccgcaaccaagaugaacuggucgggagagcccgggugagccagggugcaggguggucccugcgggagacagccugucucggcaagagcuacgcacaaauguggcagcugauguacuuccaccgccgggauuuaaggcucgccgccaacgcgauuugcuccgccguccccgucgacugggugcccaccagccgcacaacguggagcauccacgcccaccaccaguggaugacgacagaggacaugcuguccguguggaaccgggucuggaucgaggagaacccguggauggaggacaagacgcacgugagcagcugggaggaggugcccuaccuggggaagcgcgaggaccaguggugcggcagccucauaggccuaacggcccgggcgacgugggcuaccaauauccaggucgcgauuaaccagguacgccggcugaucggcaacgagaacuaccucgauuacaugaccucuaugaagcgcuucaagaacgagucagaccccgaaggggcccugugguga

SEQ ID NO: 24015 - RNA, 9879 nt, Artificial Sequence
  derived and/or modified CDS sequence (opt11) from DENV-1__FJ410174__SS-prME
agcgugacaaugcugcucaugcugcugccgaccgcgcucgcuuuucaccugaccacacgcggcggagagccgcauaugaucgucucgaagcaagaaagggggaagucacugcuauucaagaccagcgccgggaucaacaugugcacccugaucgccauggacuuaggcgaguugugugaggacaccaugaccuacaaaugccccaggaucacagaagccgagcccgacgacguggacugcugguguaaugccaccgacacuuggguuacguacgggacgugcucacaaaccggagagcaccgacgggacaagcgguccguggcccuggcgccccaugugggccuggggcucgagacccggacugagaccuggaugagcuccgagggugccuggaagcagauacagaaggucgagaccugggccuuacggcacccgggguuuaccgucacagcccuguuucucgcgcacgccauuggcaccucaaucacgcagaagggaaucaucuucauucugcugaugcugguuacgcccucaauggcgaugcggugcgugggcaucggcaaccgggacuucguugagggguuaucaggcgccacguggguggaugugguauuagagcacggaucuugcgugaccacuaucgcuaaggacaagcccacccuugacauugagcuacugaagaccgaggugacuaaccccgcggugcuccgaaagcucugcaucgaggccaagauuagcaacacaacgaccgacagucgaugucccacccaaggugaggcuacccugguggaggagcaggacagcaacuuugugugucgccggacguucgucgaccgcggcugggggaauggcugcggccuguuuggcaaggggucgcuccugaccugcgcaaaguuuaagugcgugacaaagcucgaggguaagaucgugcaguaugagaacuugaaguacagcgucauaguaaccgugcacacgggagaccagcaccaggucggcaacgagacaacugaacacggcacuaucgccaccaucaccccccaagcccccacgagugagauccagcugacagacuacggggcacucacgcuugacugcagcccgcggacgggccuggacuuuaacgagauggugcuccuaaccaugaaggaaaaguccuggcugguccacaagcagugguuccucgaccugccacugccauggaccagcggggccagcacaucacaggaaaccuggaaccgccaggaccuucuggugacuuucaagacagcccacgcgaaaaagcaagagguggucguucugggcucccaagagggggcaaugcacacggcucuaacgggggcgaccgagauccagaccagugguacaacgaccaucuucgccggucaccugaagugccgucugaagauggacaagcuaacucuuaaggguauguccuacgugaugugcacgggguccuuuaaauuagagaaagaggucgccgagacucaacaugguaccguguuaguucaggucaaauacgagggcacagacgcaccaugcaagauccccuucagcgcacaggacgaaaagggugugacucagaacggccgucugauaacugcgaacccgauugugacagacaaggagaaaccugucaauaucgagaccgaaccgcccuuuggggaguccuacaucgugguaggggccggcgagaaggcgcucaagcuaagcugguucaaaaaagggagcagcauuggaaagauguucgaggccaccgcacguggagccagacggauggccauucucggcgacacggcgugggauuucggauccauuggcggcgucuuuaccagcgucgguaaacuggugcaucagguguucggcgccgcuuaugggguguuguucucgggcgugagcuggaccaugaagaucgggauuggaauacucuugacauggcugggcuuaaacucccgcaguacaucccugagcaugacguguauugccgucggcauggugacccuguauuugggcguuaugguccaggccgacuccgguugcgugaucaacuggaagggccgcgaacugaagugcgggucggguaucuucgugaccaacgaaguucauacuuggacugagcaguacaaguuccaagcggacucgcccaagagacucuccgccgccaucgggaaggccugggaggaaggcgugugcgggauccgcagugcaacgcgcuuggagaacauaauguggaagcagaucucgaacgaacugaaccacauauugcucgagaacgacaugaaauucaccguugucguaggcgacgcgaacggcauacucgcgcaggguaaaaagaugauucguccgcaacccauggaacaucgguacucauggaagaguuggggcaaggccaagaucaucggcgccgacauucagaacacaacauucauaaucgacgggccugacaccccggagugccccgaugaccagagggcguggaacaucugggaggucgaggacuauggcuucgggaucuucaccacgaauauauggcugaagcuccgagacagcuacacacagaugugugaccacagacugaugucagccgccauaaaggacucaaaggccguucacgccgacaugggcuacuggaucgagagugagaaaaaugagacuuggaagcuggcccgcgccucauucaucgaggugaagaccugcauuuggccaaagucacacacccuauggaguaacggcgugcuggaguccgagaugaucaucccgaagaucuacgggggccccaucucucagcacaacuaccgccccggguacuucacccagaccgccggccccuggcaccucggcaaacuugagcuggacuuugacuugugugaggggacgacggucguuguggacgagcacugcgguaaccgggggccgucacuucgcacuaccacggucacgggcaaaaucauccacgagugguguugccggagcugcacgcuuccuccucugcgcuuccgcggcgaggacggcugcugguaugggauggaaauucgccccgugaaagagaaggaggagaaucucgugcgguccauggucuccgccggcagcggcgaagucgacuccuucagccucgggaucuugugcgucagcaucaugaucgaggaggugaugcgcagcagguggucccgcaagauguuaaugacggggacccuggccguuuucuuacuccugauuaugggacagcugaccuggaacgaccugaucagauugugcaucauggugggcgccaacgccucagaccggauggggaugggcaucacguacuuggcccugauggccacguucaagaugcgccccauguucgccgucggccuguuauuccgaagacugaccucuagggaggugcugcugcucacgaucgggcugagccugguggcguccguggagcuacccaacucacuagaggagcugggggacggccucgcaaugggcaucaugaugcugaagcugcucacggaguuccagccgcaccaguuguggacuaccuugcucucccugaccuucauuaagacgacccuaagccucgacuacgcguggaggaccauggcaauggugcuguccaucguaagccuguucccccuuugccugaguaccacaagccagaagacgaccuggcugcccgugcuccugggguccuuugguugcaagccgcugaccauguuucucauuacagagaacaagaucugggggagaaagagcuggccccugaacgaaggcauuauggcuauaggcaucgucuccauccugcucuccucucugcugaaaaacgacgugccacuagccgggccucuaaucgccggcgguaugcugaucgccugcuacgugaucuccggaucuagcgccgaccuaucgcuggagaaggcggccgagguauccugggaggaagaggcagagcauagcggcaccagccacaacauauuaguugaggugcaagacgacgggacuaugaaaaucaaggaugaagagcgcgacgauacccucaccauacugcugaaggccacgcugcuugcggugagcggcguauaccccauguccauccccgccacuuuguucgugugguacuucuggcagaaaaagaagcagcggagcggcguccuuugggauacgccauccccgcccgaaguagagagagcgguucuggacgauggcaucuaccgcauccugcagcggggccuucucgggcggagccagguagggguugggguguuccaggacggcgucuuccacaccauguggcacgucacucgcggggccgugcuuauguaccagggcaagcgguuggaacccucgugggccagcgugaagaaggaccucaucuccuacggcgggggauggcgauuccaggguagcuggaacacuggggaagaagugcaaguaaucgcggucgagcccgggaagaaucccaaaaauguccagacaacccccggcacuuuuaagacacccgagggcgaggugggggcgaucgcucuggacuucaagcccggcacgaguggcagccccauugugaaccgcgaaggcaagauugucggccuguacggaaacggcguggugaccacuuccgggacuuaugucucggcaaucgcgcaggcaaaaaccagccaggagggcccccucccugagaucgaggaggaaguguucaagaagagaaaccugacaaucauggaccuacacccugggucuggcaagaccaggcgauaccuccccgcgaucgugcgggaggccauuaaacgcaagcuucguacccugaucuuagcacccacgcgggucguugccagcgagauggcugaggccuuaaagggcaugcccauccguuaucagaccacggcugugaaaucggagcacaccggaagggaaaucgucgaucugaugugccacgcaaccuuuacgaugcgacuccuuagcccggugcgggugcccaacuauaacaugaucauaauggacgaggcccauuucacugaccccgcgaguaucgccgccagggguuacauaucaacucgugucgggaugggcgaggccgccgccaucuucaugacggccacuccgccugguuccgucgaggcauucccccagucgaacgccgugauccaggacgaggagcgcgacauaccugagcgguccuggaauagcggcuacgacuggaucacggacuucccgggcaagaccgugugguucgugcccuccaucaagagcggaaacgacauagccaacugccugaggaagaauggcaagcgggugauccagcucucccgcaagaccuucgacacggaguaucagaaaacaaagaacaacgacugggacuacguugucaccaccgacaucucagaaaugggggcgaacuuucgggccgauaggguaaucgacccgcgccggugccugaagccagucaucuuaaaggacgggccugaaagaguaauccucgcagggccgaugccugucacugucgcauccgcggcccagcgccggggucgcaucggccgcaaccagaacaaagagggugaccaguauguguacaugggccaaccccugaauaacgacgaggaccaugcucacuggacggaggcaaagauguuacucgacaacauaaacacccccgaggggaucaucccggcccuuuuugaacccgaacgggagaaguccgcggccaucgacggggaguaucgccugcgcggggaggcccgcaagaccuuuguggagcuaaugagacguggcgaccuuccgguguggcugucguacaagguggccuccgaaggcuuccaguacucggaucgacgcuggugcuucgauggcgagcggaacaaucagguccuagaagaaaacauggauguugagauauggaccaaggaaggagaacguaagaagcugcggccccgguggcuggacgcacguacguacagcgacccucucgcguugcgcgaguucaaggaguucgccgccggccggcgcucggugucaggggaccucauccucgaaauuggcaagcugccucagcaucugacccuccgggcccaaaacgcauuggacaaccuggucaugcuacacaauucggagcaaggcgggaaagcguaccgacacgccauggaggagcucccugauacgaucgagacccugaugcuucuggcccugaucgcuguccugaccggaggagugacacuguucuuuuuaucggguaagggcuuaggaaagaccucaauaggcuuacugugugucauggcgucuagcgcccuccuauggauggcaaauguugagccucauuggauagcugccagcauuauucuggaguucuuccucaugguacugcugauuccagagccugacagacagaggacaccgcaggacaaccaguuggcguacguggugauugggcugcuguucaugauucucaccgucgccgcgaacgagauggggcuucuugagacgacgaagaaggaccucgguauagggcacgucgccgccgagaaucagcaccacgccaccaugcuggacguagaucugcgcccggcgagcgccuggacccuauacgccguggccacgaccgucaucaccccgaugaugcgccacaccaucgagaauaccacugcgaacauaucucugacggccauugccaaccaagcggcuauucucaugggucucgacaagggcuggcccaucucuaagauggauaucggggugccccugcuggcgcucggcugcuauucgcaggugaacccacugacccugacggcugcaguucucaugcugguggcccacuacgcgaucaucgggcccggccugcaggccaaggccacccgcgaagcacagaagagaaccgccgcugggaucaugaagaaccccaccgucgacggcaucguugcgaucgaccucgaccccguggucuacgacgcgaaauucgagaagcagcugggccagaucaugcugcucauccugugcacgagccagauccuucucaugcgcacgacgugggcccuuugcgaaaguauaacccuagccacugguccgcuaacgaccuugugggagggcucccccgggaaguuuuggaacacuacgaucgcggucuccauggcaaacaucuucagagggagcuaccuggccggcgccgcgcucgcguucucacugaugaagucucuagggggugggcgccggggcaccggggcccagggggagacucucggcgaaaaguggaagcgacaacugaaucagcucucuaaaagcgaguucaacaccuauaagagaagcggaauaauggagguggaccguuccgaagcgaaggagggacuaaagagaggggagacaaccaagcacgcuguuuccagaggaaccgcaaaacugcggugguucgucgagcgcaacuuagucaaacccgagggcaaggugaucgaccuggguugcggcaggggcgggugguccuacuacugcgccgggcucaagaaagugaccgaggugaagggcuacacgaagggcgggcccgggcacgaagagccaauucccauggccaccuacgguuggaacuuggugaaacuguacagcgguaaggacgucuucuucacgccgcccgagaaaugugacacccuccuuugcgacauaggggaguccagcccgaauccgaccauagaggagggucgcacgcugcguguucuuaaaauggucgagccauggcuacgcgggaaccaguuuugcaucaagauccucaaccccuacaugccguccgucgucgagacucucgagcagaugcaacggaagcacggcggaaugcuggugcgcaauccucugagccggaacuccacacaugagauguacugggucagcugcgggaccggaaacaucguauccgccgucaauaugacgagccgcaugcuccugaaccgcuucacaaugacccaccggaaaccgaccuaugagcgcgacgucgacuugggcgcaggcacgcggcacguggcgguagagcccgaagucgcaaaucucgacaucaucggccagcgcaucgagaauaucaagaacgagcacaaguccaccuggcauuacgacgaggacaacccguauaagaccugggccuaccauggcagcuacgaggugaagccaucggguagcgccagcucaauggugaacggggucgugcggcugcugacuaagccaugggacgucauaccaauggugacgcagaucgcaaugaccgauaccaccccguuuggacaacagcgcguguuuaaagagaaggucgacacacggacgccacgggcgaaacgggggaccgcccagauaauggaggugaccgccaaauggcucuggggcuuccugucgcggaacaaaaagccccggauuuguacgcgcgaggaguucacccggaaggugcgaagcaacgcggcgauuggagccgucuucguggacgagaaucaguggaacagcgccaaggaagcaguggaggacgaacgcuucugggaucugguccaccgugagcgugaauuacacaaacaagggaagugcgcgaccuguguguacaacaugauggggaaacgggagaagaagcugggggaguucggcaaggcgaagggcucccgggccaucugguacaugugguuaggcgcacgcuuucuugaguucgaggccuugggcuucaugaacgaggaccauugguucuccagggagaacuccuucagcgggguggagggggagggacuucacaagcucggauacaucuuacgcgacaucuccaagauccccggggggaacauguacgcggacgacaccgcgggcugggacacgcgcaucaccgaggacgaccuacagaacgaagccaagauuacggauauuauggaagccgaacacgcccuccuggcgacaagcaucuuuaagcugacguaccaaaacaaggucguucgggugcagcgcccagcgaagaauggaaccguuauggaugugaucucccggcgcgaccagcggggaagcggccagguugggaccuauggccucaauacuuucacgaacauggaaguccagcugauccgacagauggaauccgaggggaucuuccugcccuccgagcuggagaccccaaaccucgccgagcggguccuggauuggcuggagaaacacggcaccgagcgccugaagcguauggccaucucuggggaugacugcguggucaaaccaguggacgaccgcuucgccaccgcgcugaucgcgcucaacgacauggggaaagugcggaaggauaucccccagugggagcccagcaaaggguggaacgacuggcagcagguucccuuuugcucucaccauuuccaccagcugaucaugaaagacggccgcgagauuguggucccaugccggaaucaagacgagcugguaggcagggcgcgugucagccagggagccggcuggucccuccgcgaaacggccugcuugggcaagagcuacgcccagauguggcagcuaauguauuuccaccgccgcgaucuccggcucgcggcaaaugccaucugcuccgcggugcccgucgacugggugcccacuagccgcacaacguggucgauccacgcgcaccaucaauggaugacgacggaggacaugcuguccguguggaaccgggucuggaucgaagagaaccccuggauggaagacaagacccacgugagcuccugggaagagguaccauaccucggcaagcgggaggaccaauggugcggcucucucaucggccucaccgcucgcgccacuugggccacaaacauucaaguggccauuaaccaaguccggcgccucaucgguaaugagaacuacuuagauuauaugaccuccaugaagcgguucaaaaaugaaagcgauccugagggggcgcuaugguaa

SEQ ID NO: 24016 - RNA, 9879 nt, Artificial Sequence
  derived and/or modified CDS sequence (opt11) from DENV-1__FJ410175__SS-prME
ucggucaccaugcuccucaugcucuugcccaccgcccuagcuuuccaucuuacgacucggggaggagagccccacaugaucgugagcaagcaagagagaggcaaaagccuauuauucaaaaccagcgcugggaucaauaugugcacccugaucgccauggaucugggcgaacuuugcgaggacacgaugaccuacaaaugcccccgcaucaccgaggccgagcccgaugacguggacugcuggugcaaugccaccgauacgugggugaccuauggcacauguagccagaccggugagcacaggcgggacaaacgguccguagcacucgcgccucaugugggucugggccuggagacgcgcacggagaccuggaugagcuccgaaggagccuggaagcaaauccagaaaguugagacgugggcccuacggcacccgggguuuacagucacggccuuguuccucgcacaugccauaggcaccagcauaacccagaaggggaucaucuucauccuccugaugcuagugacgcccuccauggcuaugcgcugcguugggauuggaaaccgugauuucguggagggacuaaguggcgccaccuggguggaugugguacuggagcacgguuccugcguaacuacgauggcuaaagacaagccgacguuagacaucgagcugcugaagaccgaagugaccaaucccgccguccucagaaaauuguguaucgaggcaaagauaagcaacaccaccaccgacucacggugcccgacucaaggcgaggccacauuaguggaagaacaggacaguaauuuuguuugccgccgaacauucgucgaccggggcugggggaauggcuguggguuguucggcaagggaucgcugcugacaugcgccaaauuuaagugcguaacaaaacuugaaggcaagaucguacaguacgagaaucuaaaguacagcgucaucgugaccguacacacgggggaccagcaucaaguuggcaacgaaaccaccgaacacgguaccaucgcgacaaucacgccgcaggcaccaacuuccgaaauccagcugaccgacuacggagcccucaccuuagauugcagcccccgaacgggccuggacuucaacgaaaugguguuacucacgaugaaggagaaaagcuggcuuguucauaagcagugguucuuagaccucccgcuccccuggaccuccggggcaucgacuucccaggaaacguggaacaggcaggaucugcuggugaccuuuaagacggcccacgccaaaaagcaggagguuguaguguugggaagccaggagggcgcuaugcauaccgcguugacgggggccacugagauccagaccucggguaccacgaccaucuuugccgggcaccugaagugucgguugaagauggacaaacucacccucaaaggcaugagcuacgugaugugcaccggauccuucaagcuggagaaagaggucgccgaaacccaacauggcacgguucuuguacaggucaaguacgaaggcaccgacgcgcccugcaaaaucccguucagcgcccaagacgagaagggagugacccagaacggccgccugaucacagccaauccgauugucaccgacaaggagaagcccgucaacaucgagaccgagccgccauucggggagagcuacaucgugguuggugccggcgaaaaagcgcugaaacuuagcugguucaagaagggguccagcaucggcaagauguucgaagcaacugcccgcggggcccgccgcauggccauacuaggcgacacugccugggauuucggguccaucggaggcgucuucacuagcguggggaaguugguccaccaggucuucggagccgcuuacgggguacuguucuccggcgugagcuggacuaugaagauagggaucggaaucuuacugacauggcucggccuuaauucucggagcacgucccugucuaugaccuguaucgcgguugguauggugacccuauaucucggcgugaugguccaggccgacucuggguguguaauaaacuggaagggucgcgaacugaagugcgguagcggcaucuucgugacuaacgagguacauacuuggaccgagcaguacaaauuccaggcggacagcccgaagcggcuguccgcugcgaucggaaaggcuugggaggagggagucugcggaaucaggagcgccacacggcucgagaacauaauguggaagcagauauccaacgaacugaaccacauacuccucgagaacgauaugaaauucaccgugguaguuggggaugcaaacggcauccuugcacaggggaagaagaugauccgaccucagccgauggagcaccgguacagcuggaaguccuggggcaaggccaagaucaucggugcagauauccagaauaccacuuucaucauagaugggcccgacaccccggagugcccagacgaccagcgcgcauggaacaucugggaaguggaggacuacggcuucgggaucuuuaccaccaacaucuggcugaagcuccgugauagcuacacgcaaaugugcgaucaccgccuuaugucagccgccauaaaggauagcaaggcaguacacgccgacaugggcuacuggaucgagucugagaaaaaugagaccuggaaacuggcgcgagcaaguuucauagaggugaagacuuguaucuggcccaaaucucacacucucuggucuaacggcgugcuggaaagugaaaugauuauaccgaagauuuacggcggcccgaucagccaacacaauuacaggcccggauauuucacgcagaccgccggcccuuggcaucuggggaagcuagagcuugacuucgaucugugugaggggacgacugucgugguggaugaacauugcggcaacagggguccgucgcuccgcacaaccacggugaccggcaaaaucauccacgaauggugcugccggucgugcacgcugccgccucugcgcuuucgcggggaggacggcugcugguacgguauggagauccgcccagugaaggagaaggaagaaaaucuaguacggucaauggugagcgccggaucgggcgaggucgacucuuuuagucugggaauccugugcgucuccaucaugauagaggaaguuaugcgcucgagauggucccgcaaaauguuaaugaccggcacccuggccguguuucugcucuugauuauggggcagcucaccuggaacgaucuuaucagacuguguaucauggugggugcgaacgccagcgacagaauggggaugggcaccacauacuuagcccucauggccacauucaaaaugcgcccaauguuugccguaggccuccuuuuucgaagacuaacaucucgggaggucuugcuuuugaccaucgggcugucucugguggcguccguagaacuccccaacagucuggaggagcuuggcgacgggcuagccaugggcaucaugaugcuaaagcugcuaaccgaguuucagccacaccagcucuggaccacccugcucucccugacuuucaucaaaaccacccuuagccuagauuaugccuggcgcaccauggcaaugguccuuagcaucguaagucuguucccccucugccuguccacgaccucucagaagaccacauggcugccggugcuauuaggcuccuucggcugcaagccccugacgauguucuugauaaccgagaacaagaucuggggaagaaagagcuggccacugaacgaggggaucauggcgaucggcauagucuccaucuuacucagcagccugcugaagaacgacguuccacucgccgggccgcugaucgcaggcgggaugcucaucgcuugcuaugucauaucuggaagcuccgcagauuugagccuggaaaaggcagccgaggucagcugggaggaggaagcugaacacaguggcaccagccacaacauccugguugaaguucaagacgacggaacaaugaagauuaaagaugaggagcgggacgacacccucacaauacugcugaaggcgacccuccuggccgugagcgguguauauccgauguccaucccugcgacccuguuugugugguacuucuggcagaagaagaaacagcggagugggguccugugggacaccccguccccgcccgagguagagcgugccguucuagacgacgguaucuaccguauacuccagcgcggucuucucgggcggagccaaguaggaguaggcguuuuucaagaugguguauuccacaccauguggcacgucacgagaggagccguccugauguaccagggcaaacggcuugagcccuccugggccucugugaagaaggaucugaucuccuacggcgggggcuggcguuuucaggggagcuggaacacaggcgaggagguccaggugauugccguggagccugguaagaauccgaagaacguccagaccacgcccggcacuuucaagaccccagagggcgaaguuggugcgauugccuuggacuucaagcccggcacuuccgggucaccaaucgugaaucgggaggggaagaucgucggucuauacgggaauggcguggucacgaccucggggaccuacgucagugccaucgcccaggcaaagaccagccaggaaggaccucugcccgaaauagaagaagaaguguuuaaaaagcgcaaucuaacgaucauggaucuccacccuggauccggcaagacacggagguaccuccccgcgauagucagggaggccaucaagcguaagcugcgcacccugauacucgccccaacccgggucguggccucagagauggcggaggcacugaaggguaugcccauucgcuaccaaacgacagcugugaagagugagcauaccgggcgcgagaucguugaccuaaugugccaugcuaccuucacgaugcgccuccugagcccgguucgugugccaaauuacaacaugaucaucauggacgaagcccacuuuacggaccccgccuccauagccgcccgaggcuauaucaguacccgagucggcaugggcgaagccgccgcgauauucaugaccgcaacaccgccugggucaguggaggccuucccccagucgaacgccgugauccaggacgaggagcgagacauacccgagcgguccuggaacucaggcuaugacuggaucaccgacuuccccgguaaaacugucugguuuguccccuccaucaagucggggaacgauauagccaauugcuuacggaaaaaugguaaaagagugauccaacucucccgcaaaaccuucgauacggaguaccagaagacaaagaacaaugacugggauuacgucgugacaaccgacaucuccgaaaugggggcgaacuucagagcagaccgcguaauugacccgcggcggugccugaaaccuguaauacugaaagacggccccgagcguguuaucuuagcugggccgaugccaguuacggucgcauccgcggcacaacgacggggcagaauuggccgcaaucagaacaaagagggagaucaauauguguacauggggcagccccuaaacaacgacgaggaccacgcucauuggacugaggcaaaaaugcuccucgacaacauuaacaccccagaaggcaucauaccggcguuguucgagcccgaacgggaaaagagcgccgcaauugacggcgaauaccgccugcgaggagaggcccgcaaaaccuuuguugagcucaugagacgcggcgaucugccgguuuggcuguccuacaaaguggcuagugagggcuuccaguacuccgaccgacgauggugcuucgacggagagcggaacaaucaaguacuagaggaaaauauggauguggaaaucuggacgaaggagggcgagagaaagaaacuccggccccgcuggcuugacgcgagaacuuacucugacccauuagcgcugcgcgaauuuaaagaguucgcagccgggcgccguagcgucuccggcgauuuaauccuggagauaggcaagcugccgcagcaccuuacgcucagagcccagaacgcccuggauaaccuggucaugcuccacaauagcgaacagggcgggaaggcauacaggcacgccauggaggagcugcccgacaccaucgaaaccuugaugcuccuagcccugaucgcagugcuaacaggaggcgugacgcuauuuuuccugucgggaaaaggguuggggaagacgagcauagggcugcugugcgucauggcgaguagcgcccuccuguggauggcgaacguggaaccgcacuggauugccgccucuaucauacuagaguucuuccuaaugguucugcuuaucccugagcccgaccggcagcgcacgccucaagacaaccagcuggcguacgucgugauaggccugcuguucaugaucuuaacgguggccgccaacgagauggguuuguuagagaccacgaagaaagaucucgggaucgggcacgucgccgccgagaaccagcaccacgcaacgauguuggacguagaccuacgaccugccagcgcuuggacgcuuuacgcgguggcgaccacggucauaaccccuaugaugcgccauacgaucgagaacacaaccgcgaacauaagucugacugcuaucgccaaccaagccgcgauccugaugggccucgacaagggcuggcccaucucgaaaauggacauuggggugccccuacuggcucuuggcuguuacucgcaagugaacccccuuacacuuaccgccgcggucuugauguugguagcccacuacgcuauaaucgggcccggacugcaggcuaaggcaacuagggaggcccagaaacggacugcggcugggaucaugaagaacccgacgguugacgguauagucgcgaucgaucucgaccccguaguguacgacgccaaguucgagaagcagcuuggccaaauuaugcugcugauucugugcaccagccagauccugcuuaugagaacuacuugggcccugugcgaguccauaacucuggccacagggccgcugacuacccugugggagggaagccccgggaaauucuggaacaccaccauagcggucaguauggcgaacauuuuucgcgggagcuaccuggcaggcgcaggucuugcuuucuccuugaugaaauccuuaggaggcggccgccggggaaccggggcgcagggcgagacgcucggagaaaaguggaagcggcaacucaaccagcugagcaagucagaauuuaacacguacaaaagauccggcauuauggagguggaucgcuccgaggcgaaggaaggcuuaaagcgcggugagacuaccaaacacgccgugagccgcggaacagcaaagcugcggugguucgucgaacgcaaccugguuaagccagagggcaagguuaucgaucuuggaugugggcgggguggcuggaguuacuacugugcgggccugaagaaggucacggaggugaaagguuauaccaaaggcggcccugggcacgaggagccaauccccauggcgacauauggguggaaccuugugaagcuguacucugggaaggacguguucuuuaccccgccggagaagugugacacgcuccugugcgauaucggggaguccagcccgaacccaacuaucgaggaaggacgcacucuucgggucuuaaagaugguggaacccuggcuacgaggcaaccaguuuugcaucaagauucugaacccuuauaugccauccgucguugagacccucgaacagaugcaacggaaacacggcgggaugcuggugaggaacccccugagccggaacuccacacacgagauguauuggguuagcugugggaccggcaacaucguuuccgccgucaacaugacgagccgcaugcucuuaaaccguuucaccaugacccacaggaaacccacguacgagagagacgucgaccugggcgcuggcaccaggcacguggcgguggagcccgaggucgcuaaucucgacaucauagggcagagaaucgagaacaucaagaaugagcacaaaaguacguggcacuacgaugaggacaaccccuacaaaaccugggccuaucacggcuccuaugaggucaagccguccgggucagccagcucuaugguuaauggggucgucagacugcuaacgaagccuugggaugugauccccauggugacccagauugcaaugacugacacgacccccuucgggcagcaacggguuuucaaggagaagguugacacacgcacgccgcgggcgaagcgggguacugcgcaaauaauggagguaacggccaaguggcuauggggcuuucugagucgcaacaagaagccucggauauguacgcgggaagaguucacccgaaaaguccgcagcaacgcugcaaucggugcuguuuucgucgaugagaaucaguggaacagcgcaaaagaggccguagaagacgagagguucugggacuugguccaccgcgagcgugagcuccacaaacaagggaaaugcgcuacuugcguguauaacaugauggggaagagggagaaaaagcugggcgaguucgggaaagcuaaaggcucccgugccaucugguauauguggcugggugccagguuccucgaguucgaggccuuaggguuuaugaacgaggaccacugguuuucccgugagaacuccuucaguggaguggagggugagggccugcauaagcucggguacauuuuacgagauauuuccaaaaucccggguggcaacauguaugcagacgauacggcgggcugggauacgaggauuacagaggaugaccugcagaaugaagcgaggauuacugauauuauggagccagagcacgcacuccuggccacgagcaucuucaagcucacauaccagaauaaagucgugcgcguucagcggccagccaagaauggcacugucauggacgugaucucgcgcagggaccagcgcggcucgggccaaguuggcacuuacggucucaauaccuucaccaauauggaaguccagcugauccgccagauggaguccgaggggaucuuccugcccagcgaguuagagaccccaaaucuggcggagcgcgugcuggacuggcuagagaagcacgggacugagcggcugaagcgcauggcgaucuccggcgaugacugcguggucaaaccuguggaugacagauuugccacagcccugaucgcccugaaugacaugggaaaggugcgaaaggacauuccgcaaugggagcccucuaagggcuggaacgacuggcaacaggugccguucugcucccaccacuuucaccaauugaucaugaaggacggccgggaaaucguagugccgugucggaaccaagacgaacuugugggacgcgcgagggugucccagggcgcaggguggucauugcgggagacugcgugccugggaaaauccuacgcucagauguggcaacugauguauuuccaccggagggaucuaaggcucgccgcgaacgccaucugcuccgcggugcccgucgacugggugcccaccucacguacuaccuggagcauccacgcucaucaccaguggaugacgacagaagacaugcuguccguguggaaccgugucuggaucgaggaaaauccauggauggaagacaagacacacgucagcuccugggaggaggugccguaccuuggaaagcgcgaggaccaauggugcggcagccugauuggguuaaccgccagagccacgugggcuacgaacauccagguggccaucaaccaagugagacggcuaauuggaaacgagaauuacuuagacuacaugacgucgaugaagcgcuucaaaaacgagucugaccccgaaggcgcauuaugguga

SEQ ID NO: 24017 - RNA, 9879 nt, Artificial Sequence
  derived and/or modified CDS sequence (opt11) from DENV-1__FJ562105__SS-prME
agcguaaccaugcugcucaugcuccugcccaccguucucgccuuccaccucaccacccggggcggcgagccccacaugaucguuggcaagcaagagcguggcaaaagccuccuauucaagaccagcgccgggguaaacaugugcacccugaucgccauggaccugggagaacucugcgaggacacaaugaccuacaagugcccccgcaucaccgaggcggaacccgacgacguggacugcuggugcaacgcgaccgacacaugggugaccuacgggaccuguucccagaccggcgagcaccggcgggacaagcgcucgguggcccuggcgccccacguugggcugggccucgaaacucgcaccgagaccuggauguccagcgagggggcauggaagcagauccagaagguggaaaccugggcucugcggcauccgggauucaccgugaucgccuucuucuuggcccacgcgaucgggaccuccaucacucagaagggcaucaucuucauccuacugaugcuggucacccccagcauggcuaugaggugcgugggcaucgggaaccgggacuucguggagggcuugucgggggcuacgugggucgacguagugcuggagcacgggagcugugucaccaccauggccaagaacaagccgacucuugauauagaguuguuaaagacggaggugaccaaccccgccgugcuccgcaagcucugcaucgaggcgaagauuaguaacaccaccacagacucgcggugccccacccagggcgaggccacgcuggucgaggagcaggacgccaacuucguuugccgcagaacuuucguggaccgcggguggggcaacgggugcggacuguucgggaagggcucccuccugacgugcgccaaguucaaaugcguaaccaaacuggagggcaagaucguccaguacgagaaccucaaguacucggugaucgucaccgugcacaccggagaccagcaccaagucggcaacgagacgaccgaacacgggacuauagccacaaucacgccccaagcucccaccuccgagauacagcugaccgauuacggcgcgcugacccucgacugcagccccagaacggggcuggauuucaacgagaugguccugcuuacgaugaaggagaaauccuggcuggugcacaagcagugguuccuugaccuccccuuacccuggaccagcggcgccuccacgagccaagagaccuggaaccgccaggaucugcucguaacauucaagaccgcccacgcuaagaagcaagagguagugguccugggcagccaggagggggcgaugcacaccgcacugaccggcgcuacggagauucaaaccuccgggaccaccacgauauucgccgggcaccucaagugucggcugaagauggacaaacucacccucaaagggaugucuuacgucaugugcaccggcucguucaagcuggagaaggagguggccgagacccagcacggcacgguccuuguccagguuaaguaugaagggaccgaugcucccugcaagaucccucugagcacccaggacgaaaaaggcgucacucagaacgggcgccucaucacggccaacccgaucgugacagauaaggaaaagcccgugaacaucgagaccgagccgcccuucggcgaauccuacaucaucgucggcgccggggagaaagcccugaagcugucaugguucaagaagggcuccucuauaggcaagauguucgaggcaaccgccagaggcgcucgccggauggcuauacucggagauacggccugggacuucggcucuauuggcgggguguucacaagcguggguaaacuuguccaccaaguauucgggacagcguacggcgugcuguucuccggggucagcuggaccaugaagaucgggauuggcauucuccucacuuggcugggucuaaacucccgcagcgccagccugagcaugaccugcaucgcagugggcauggugacccuguaccucggcgucauggugcaggccgauuccggcugcgugaucaacuggaaggggcgggagcugaagugcggcagcggaaucuucgucaccaaugaggugcacacauggaccgagcaguauaaguuucaggccgacucccccaagcggcugagcgcggccaucgggaaggcaugggaggaaggcgugugcgggguccgcagcgcaaccaggcucgagaacauuauguggaagcagaucuccaacgaacucaaccacauccuguuggaaaaugacaugaaguucaccgugguggucggugacgcaaacgggauccuggcgcaggggaagaagaugauucgcccccagcccauggagcauaaguacagcuggaagucauggggcaaggccaagaucauuggggccgacauccaaaacaccacguucaucaucgacggaccugacaccccggagugccccgacgaccagagggcauggaacaucugggaaguggaggacuacgguuucggcaucuucaccaccaacaucuggcugaagcuccgcgacucguacacgcagaugugcgaccacagacugaugagcgcggccaucaaggacucaaaggcugugcacgcggacaugggcuacuggaucgaguccgagaagaacgagacuuggaagcuggcccgcgcgucauucauagaggucaagacaugcaucuggcccaagagucacaccuuaugguccaacggggugcuggagagcgagaugaucauccccaagaucuacggcgguccgauaagccagcacaacuaccggcccggauacuucacgcagaccgccgggcccuggcaccugggcaaguuagagcucgacuucgaccugugcgagggcacuaccguggugguggacgagcacugcgggaaccgcggcccgucacuccggacgacaaccgucaccgggaagaucauccacgaguggugcugccgcagcugcacgcugccgccucugcgguucagaggagaggauggguguugguacggaauggagauccgccccgucaaggagaaggaggagaaucucgugcgcucgauggugagugcggguuccggggaggucgacagcuuuagccuggguauucugugccucucgaucaugauugaggaagugaugcggagccgcuggucccggaagaugcugaugacugggacccuggccguguuccuccuacugauaauggggcagcuuaccuggaacgaccugauucgccugugcaucaugguaggcgccaacgccagcgaccgcaugggcaugggcacaaccuaccucgcgcugauggccacuuucaagaugcggccgauguucgccgugggucuccuguuucgccggcugacuucacgugaggugcugcuccugacgaucggcuuaagccucgucgccaguguggaguugcccaacagccuagaagagcuaggggacggcuuagcgaugggcaucaugaugcugaagcuucugaccgaguuccagccccaccagcuguggacgacccuccugucccuaacguucauuaagaccacccuuagccuggacuacgccuggaaaaccauggccaugguucuguccaucgugagccucuucccccugugccugagcacgaccagccagaagaccaccuggcucccggugcugcuggggucuuucggcugcaagccccucacgauguuccugaucacggagaacaagaucugggggagaaaaagcuggccccugaacgagggcaucauggccaucgggaucgucuccaucuuguugagcucccugcucaagaacgaugugccccuggcgggcccccugaucgccggcgggaugcucaucgccugcuacgugaucagcgggucauccgccgaucugagccuggagaaggcugcggagguuuccugggaggaggaggccgagcauagcgggaccucccacaacauucucguugaggugcaggacgacgguaccaugaagaucaaggaugaggagcgcgaugacacccugacgauccugcucaaggcgacccugcuggccgucagcgggguguacccuaugagcaucccagcuacccucuuugucugguauuucuggcaaaagaagaagcagcggagcggcguccugugggacacccccagcccacccgagguggagcgcgcggugcuagacgauggcauauaccggauccugcagaggggguuacugggccggagccaggucggggugggcguguuccaggaugguguuuuccacacgauguggcauguaacgcgcggcgccguucugauguaccagggcaagcgguuagagcccucuugggcgagcgucaagaaggaccugaucuccuaugggggcggauggcgcuuccagggcagcuggaacaccggggaggagguacaggugauagccgucgagcccggcaaaaacccaaaaaacguacagacuacccccggcaccuucaagacccccgagggugagguuggcgccguugcauuggacuucaagcccggaaccuccggcagcccgauagucaaccgcgagggcaagaucgugggucuauacggcaacggugucgugacgaccuccggcaccuaugugagugccaucgcgcaggcaaaagccucucaggaggguccccuccccgagauugaggacgaggucuucaagaagcgcaaccugaccaucauggaccuccacccgggcagcggcaagacgcgacgcuaccugcccgcgaucguacgggaggccauaaagcgcaagcugcggacucucaucuuggccccgacacgcguagucgccagcgagauggcagaggcccugaaggggaugccaauccgcuaccagaccacggccgugaaguccgagcacaccggccgggagauugucgacuuaaugugccacgcgaccuucaccaugcgcuuacugagcccggugcggguucccaacuauaacaugaucaucauggaugaggcccacuucacggaccccgcguccaucgccgcccggggguacaucucgacacgggugggcaugggggaggccgcggcgaucuucaugaccgcuacgccgcccgggucagucgaagccuuuccucagagcaaugccgugauccaggacgaagagcgcgauauccccgagcggagcuggaacagcggauacgacuggaucacggacuucccuggcaagaccgugugguucgugcccuccaucaagagcggcaaugacaucgccaauugccugcgcaagaaugggaaacgggugauccagcugucccgcaaaaccuucgacaccgaguaccagaaaacgaagaacaacgacugggacuacguggucaccacggauaucagcgagaugggcgcgaacuuccgggcagaucgcgugaucgacccaaggcgcugccuuaagcccgugauccucaaggaugggccagagcggguuauccuggccggccccaugcccgugacggucgccucagcggcgcagcgccguggccgcauaggacggaaucagaacaaggaaggagaccaguacgucuacauggggcagccccugaacaaugacgaagaccacgcucacuggacggaggccaagaugcucuuggacaacaucaacacccccgagggcaucaucccggcgcuguucgagccggagcgcgagaaguccgcggccaucgacggggaguaucggcuccggggcgaggcgcggaagaccuucguggagcugaugcggcgcggcgaccugcccgucuggcucuccuacaagguggccucagagggguuccaauauuccgaucgucgcugguguuuugacggcgagcggaacaaccagguguuggaggagaacauggacgucgagauuuggacaaaggagggggagcgcaagaagcugcgaccacgcuggcucgacgcaaggacguacagcgauccucuggcgcugcgcgaauucaaagaauucgccgccggccggcgcucugugagcggcgaccucauacuugagaucggaaaguugccccagcacuuaacccuacgggcucagaacgcccuggacaaccuggugaugcugcacaacagcgaacagggggggaaggcguaccgccacgccauggaggagcugcccgacaccaucgagacccucaugcuguuagcccucaucgccguccugacaggcggaguuaugcuguucuuccucuccggcaagggccugggcaagacgagcauaggccugcucugcgugauggcguccucagcccuccuguggauggccuccgucgaaccccacuggauugccgcuucaaucauccuggaguucuuccugaugguccugcuaauuccggagcccgaccggcagcgcacgccccaggacaaucagcuggcguacguggugaucgggcuccuguucaugaucuugacaguggccgccaacgagaugggccugcucgagaccacgaagaaggaccucgggaucggccacguggccgccgaaaaccaucaccacguuacuaugcuugacguggaccuacggccggcguccgcuuggacccuguacgcuguggccaccacaguuauuacccccaugaugcgccacaccaucgagaauaccacggccaauaucagccugaccgcgaucgccaaccaggccgccauccucaugggccucgauaagggguggcccauuuccaagauggacaucggugucccccugcucgcgcugggguguuauagccaggugaacccucugaccuugaccgcugcgguccugaugcugguggcccacuacgcaaucauaggccccgggcuccaggcgaaggcaacgagagaggcccagaagcgcacugccgcaggcauuaugaagaauccaaccguggacggcauugucgcuaucgaccuggacccugugguguaugacgccaaauucgaaaagcagcuggggcagaucaugcuccuaauccugugcaccucgcagauccuccugaugcgcacgacuugggcccugugcgaguccaucacccucgccaccgggccgcugacgacccucugggaggggucccccggcaaauucuggaacaccaccaucgccgucucuauggcgaacaucuuccggggcuccuaccucgccggcgcgggcuuagccuucucgcuaaugaagucucucggcggcggucgccggggcacgggcgcccagggagagacccugggcgaaaaauggaagcgccagcugaaccaguugagcaaauccgaguuuaacaccuacaagcggagcgggaucauggaaguggauaggagugaggcaaaggagggccugaagcgcggagagaccacgaaacacgccgugucccgcggcaccgccaaacuacggugguucguagagcgcaaccuggugaagcccgaaggcaaggugauagaccuugggugcgggcgcgguggguggagcuauuacugcgcuggguuaaagaagguuaccgagguuaaaggguacaccaagggcgggcccgggcacgaggagccgauccccauggcgaccuacggcuggaaccugguuaaacuccacuccggcaaggacguuuucuucacgccgcccgagaaaugcgacacccuguuaugcgacaucggggagagcuccccgaaccccaccaucgaagagggacgcaccuuacgggugcugaagaugguggagcccuggcugggcgggaaccaguucugcauaaagauccucaaccccuacaugccgagcgucguggagacgcuggagcagaugcagcgcaagcacggcgggauguuggugcggaacccccucucucgcaacucgacccacgaaauguacugggucuccuguggcaccgggaacaucgugagcgcagugaauaugacgucccgaaugcugcucaaccgcuucacgauggcccaccggaagcccaccuacgagcgcgacguugaccucggggccggcacucgucacguugccguggaacccgaggucgcgaaucugggcaucauuggccagagaaucgagaacaucaagaacgagcauaaguccacauggcacuacgacgaggacaacccauauaagacgugggcuuaccacggguccuacgaggugaagcccagcggcuccgccucgucgauggucaaugguguggugagacugcucaccaagcccugggacgucauccccauggugacgcagauagccaugaccgacacgaccccuuucgggcaacagcggguguucaaagagaaggucgacacccgcacgcccagggcuaagcgcggcacggcgcagaucauggaggugaccgccaaguggcugugggacuuccuaagccggaacaagaagccccgcaucugcaccagggaagaguucauacggaaggugcgguccaacgcggccaucggggccgucuuuguggacgagaaccaguggaacuccgcgaaagaggccguggaggacgaacgcuucugggaccucguccaccgggagcgcgagcugcacaagcagggcaagugcgcgaccuguguguauaacaugauggggaagagggagaagaagcugggcgaguucggcaaagccaaggggagcagagcaaucugguacauguggcucggugcccgguuccuggaguucgaggcgcugggguuuaugaacgaggaccacugguucuccagagagaacagccuauccggcguggagggcgagggucugcacaaauugggcuauaucuuacgugauaucucuaaaauccccggaggcaacauguaugccgacgacaccgccgggugggacaccagaaucacggaggacgaccugcagaacgaggccaaaaucaccgacaucauggagcccgaacacgcccugcucgccacauccaucuuuaagcugacuuaccagaacaaggucgugcgggugcagcgccccgccaagaacggcaccgucauggacguuaucagcagacgggaccagcgcggcuccgggcaggugggcacuuacgggcucaacacguucaccaacauggagguccagcucauccggcagauggagagcgagggcaucuuucugccuuccgagcuggagaccaccaaccucgccgaacgcguacuggacuggcuggagaagcacgggguggaaaggcucaagcgaauggcgaucagcggcgacgacugcguagugaaaccgaucgaugaccguuucgccacugcccugaucgcccucaacgauaugggcaaggugcgcaaagacauaccccaaugggaacccagcaagggguggaacgacuggcaacagguccccuucugcucgcaccacuuccaucagcuaaucaugaaggacggccgggagaucguagugccgugccggaaccaggacgaauuggucggacgggcccgcgucucccagggcgcgggguggagccugagagagaccgccugccucggcaagucguacgcccagauguggcagcugauguauuuccaccgccgggaccuucgccuggcagccaacgcuaucugcagcgcugugcccgucgacugggugccaaccucgagaaccacguggagcauccacgcgcaccaccaguggaugacgaccgaggacauguugagcguauggaaccgcgucuggaucgaggagaaccccuggauggaggacaagacccaugucucaagcugggaggaagugccguaccuuggcaagcgggaggaccaguggugcgggucccucaucggacuaaccgcccgcgcaacgugggccaccaacauccaggucgcgaucaaccaagugcgccggcucaucgggaaugaaaacuaccuugacuacaugaccagcaugaagcgcuucaagaaugaauccgaccccgagggcgcccugugguga

SEQ ID NO: 24018 - RNA, 9879 nt, Artificial Sequence
  derived and/or modified CDS sequence (opt11) from DENV-1__FJ562106__SS-prME
uccgugacuaugcuucucaugcugcugcccaccgcacucgccuuccaucugacaacccggggcggagagccacacaugaucguguccaagcaggagcggggcaagagucugcuguucaaaaccagcgcgggggugaacaugugcacccucaucgccauggaccugggcgagcucugcgaggacacgaugaccuacaagugcccccggaucaccgaggccgagcccgacgacguagauugcuggugcaacgccaccgacacgugggugaccuacgggaccugcagccagaccggcgaacaccggcgcgacaagcgguccguggcccuggcgccccacgugggccuggggcucgagaccaggaccgagaccuggaugagcuccgagggcgcuuggaagcagauccaaaagguggagaccugggcccuuaggcaccccggguuuacagugaucgcccuguuucucgcgcacgccaucggcaccagcaucacccagaaggggaucaucuucauccugcugauguuagugacccccuccauggccaugcgcugcgucggaaucggcaaccgggauuucguggaggggcucagcggcgccacauggguggacgucgugcuggaacacgggucaugcgugaccaccauggcuaagaacaagccuacccucgacaucgagcugcugaagaccgagguuaccaaccccgcgguguuacgcaaguuaugcaucgaggccaagaucagcaacaccaccacggacucccggugcccgacccagggcgaggccacccugguggaggagcaggacgccaacuucgucugcaggcggaccuucguggaccgcgggugggggaacggcugcggccucuucggcaaggggagccugcucacgugcgccaaauucaagugcgugaccaagcucgaggguaagaucgugcaguacgagaaccugaaguacuccgugaucgugaccguccacaccggcgaccagcaccagguggggaacgagacgaccgaacauggcacaaucgcgacaaucacgccacaggcacccacgagcgagauccagcugaccgacuacggggcccucacgcuggacugcagcccccggaccggccuggacuucaacgagaugguacuccugacgaugaaagagaaguccuggcuggugcacaagcagugguuccucgacuugccgcugcccuggaccuccggggcaagcaccagccaggagaccuggaaccgccaggaccuccugguaacguucaagaccgcccacgcgaagaagcaggaggucguggugcugggcucccaggagggcgccaugcacaccgcgcugacuggggcuacggagauucagaccagcggcaccacgacgaucuucgccgggcaccugaaaugucgacucaagauggacaagcucacccugaagggcaugucauacguaaugugcacggggagcuucaagcuggagaaagagguggccgagacccagcacggcacggugcugguccaggugaaguacgaaggcaccgacgcccccugcaagauucccuucuccacacaagacgagaagggggugacccagaacggccgccucaucacggcaaauccgauugucacagacaaggagaagccuguuaacaucgagaccgagccgcccuucggggagucauauaucauggugggcgccggagagaaagcccugaagcuguccugguucaaaaaggggagcuccaucggcaagauguuugaggccaccgcccgcggggcgcgccggauggccauacucggcgacacggcgugggacuucgggagcaucggcggcguguuuaccuccguggggaaacuggugcaccagguguucggcaccgccuacggggugcuguucucgggcgugucguggaccaugaaaaucgggaucggcauccuacugacguggcugggacucaacucucgcuccgccucucugucaaugaccugcaucgccgucgggauggugacacuguaccucggcgugaugguccaggccgacagcgggugcgugaucaacuggaagggccgggagcugaagugcggguccggcaucuucgugaccaacgagguccacacguggaccgagcaguauaaguuccaggcggacuccccgaagcggcugagcgcagcuaucgggaaggccugggaggaaggggugugcggcaucagguccgcaacccgucuugagaacaucauguggaagcagaucagcaacgagcugaaucacauccuucucgagaacgacaugaaguucaccgucgucguuggggacgcgaauggcauccuggcucaggggaagaaaaugauucgcccccagcccauggagcauaaguacucauggaaguccuggggcaaggccaagaucaucggcgcugacauccagaacaccacguuuaucaucgacgggcccgacaccccggagugccccgacgaccagcgggcguggaacaucugggaaguugaggacuacggcuucgggaucuucaccaccaacaucuggcugaagcuccgcgacagcuacacgcagaugugcgaccaucggcugaugagcgccgccaucaagaacucuaaagccguccacgccgacaugggcuacuggaucgagagcgagaaaaacgaaaccuggaagcuggcgcgcgccuccuucaucgaggugaaaaccugcaucuggcccaagagccacacccucugguccaacggcguacuagagucggagaugauuauacccaagaucuacgggggcccaaucucccagcacaacuaccggcccggguacuucacgcagaccgccggcccuuggcaccuggggaaacuugaguuagauuucggccugugcgaaggcaccaccgucgugguggacgagcauugcgggaaccgaggccccucucuucggacgacgacagucaccgggaagaucauccacgaguggugcugccgcuccuguacgcuaccgccacugcgguuccgcggugaggaugggugcugguauggcauggagauccggcccgugaaggagaaggaggaaaaccucgugcgcagcauggucuccgcaggcagcggggagguggacagcuucucccugggcauccugugcguguccaucaugaucgaggaggugaugcgguccagauggucgaggaagaugcucaugaccgggacccuggccguguuucugcuccugaucaugggccagcugaccuggaacgaccucauccggcugugcaucauggugggggcgaacgccuccgaccgcauggggaugggcacgaccuaccuggcacucauggccaccuucaaaaugcgcccgauguucgccguaggguugcuauuccgccggcucaccagccgcgaggugcugcugcucacgauuggccugucccugguggcgagugucgagcuacccaauucacuggaggagcugggggacggccucgcuaugggcaucaugaugcugaagcugcucaccgaguuccagccccaccagcuguggaccacccugcucagccugacguucaucaagaccaccuucucccuagacuacgccuggaaaacaauggcuauggugcucucuaucgucucgcuauucccccugugucucagcacgaccucccagaagaccaccuggcugccggugcugcucgggagcuucggcugcaagccccugacuauguuccugaucaccgagaacaagaucugggggcggaaguccuggccccucaacgagggcaucauggcgaucggcaucgugagcauccugcuguccagccuccucaagaaugacgucccccuggccggcccgcucaucgccggcgggaugcugaucgccugcuacgucauuucgggcucaagcgccgaccugucccucgagaaggcggccgaggugagcugggaggaggaggccgagcacucagguaccagccacaacauucucgucgaggugcaggacgacgguacuaugaagauuaaggacgaggagcgcgaugacacccugacgauccuccuaaaggccacccugcucgccguguccggggucuacccaaugagcauccccgcgacccuguucgugugguacuucuggcagaagaagaaacaacgguccggcgugcugugggacacacccaguccucccgagguggagcgcgccgugcucgaugacggcaucuaccggauccugcagcgcgggcuccugggccggucccaggugggagucggcguguuccaggacgggguguuccauacgauguggcacguaacccgcggcgccgugcucauguaccagggcaaacgucuggagcccagcugggccagcgugaaaaaagaccugaucaguuacgggggcggguggcgcuuccagggcuccuggaacaccggggaggagguccaggugaucgccguggaacccgggaagaacccaaagaacguccagacuacucccggcacguucaagacccccgagggggaggugggggcgaucgcccuagacuucaagcccggcaccagcggcuccccaaucgucaaccgggagggcaagaucgucgggcuguacggcaacggcguggugacgaccucaggcaccuacgucuccgcuauagcccaggccaaggcaagccaggaggggccccugcccgagaucgaggacgagguguucaagaaacgcaaccucaccaucauggaccugcacccuggcagcggcaaaacgcggcgcuaccugcccgccauugugcgggaggcaaucaagcgcaagcuccggacacuaauccuggcccccacuagagucguggccuccgagauggccgaggcccucaaggggaugccuauccgcuaccagaccacggccgucaagagcgagcacaccggccgggagauugucgaucuaaugugucacgccaccuucaccaugcgccugcucuccccggugcgggugccgaacuacaauaugaucaucauggacgaggcgcacuucacggacccugccagcaucgccgcuagaggguacaucuccacccgugucgguaugggggaagccgcggccaucuucaugaccgccacgccacccggcagcguugaggccuucccccaguccaacgcagugauccaggacgaggagcgggacaucccugagcggagcuggaacuccggcuacgacuggaucacggacuucccggggaagaccgucugguucgugcccagcauuaaguccggcaacgauaucgcgaacugucugagaaagaacggaaagcgggugauacagcuaagccgcaagaccuucgacaccgaguaccagaagacaaagaacaacgauugggacuacgucgugaccaccgauaucuccgagaugggcgccaacuuccgggcagaucgcgugaucgacccgcggcgcuguuugaagcccgucaucuugaaggacgggccugagcggguaauccuggcaggcccuaugcccgugacagucgcgagcgccgcccagaggagaggccgcaucggaaggaaccaaaacaaggagggcgaccaauacguguacauggggcagccccucaacaacgaugaggaucacgcacacuggacggaggccaagauguugcuggauaauaucaacacccccgagggcauaaucccggccuuguucgagcccgagcgcgagaaguccgccgcgaucgacggggaguaucgccugcggggcgaggcccgcaagaccuucgucgagcugaugcggcgaggcgaccuccccguguggcuguccuacaaaguggccuccgaaggguuccaguacagcgaccggcgcuggugcuucgacggcgagcggaacaaucagguccucgaggagaacauggacguggagaucuggaccaaggagggggagcgcaagaaauuacggcccagauggcuggacgcgcggacguacucggacccgcuggcccuacgcgaauucaaggaguucgccgccggccggcgcagcgucagcggcgaccugauccuggagaucgggaagcucccccagcacuuaacccugcgggcccagaacgcgcucgacaaccuggucaugcugcacaacuccgagcagggcgggaaggccuaccgccacgccauggaggagcuccccgacaccaucgagacccugaugcuucucgcccugauagcugugcugacaggcggggucacccuauuuuuccuguccggcaagggccucgggaagaccucgaucggccuccucugcgucauggccagcuccgcgcugcuauggauggccuccguggaaccccacuggaucgccgcguccaucauccuggaguuuuuccugauggugcuccuuaucccggaaccggaccggcagcgcacgccccaggacaaccaguuggccuacgugguuaucgggcuccuguucaugauccugaccguggccgcaaacgagaugggccuccuggagacaaccaagaaggaccugggaaucggccacguggccgcggagaaccaccaccacgccacuaugcucgacguggaccugaggccggccagcgccuggacccuguacgccguggccacaacggucaucacccccaugaugcgccacaccaucgagaacacgaccgccaacaucucccucaccgccaucgccaaccaggccgcgauccucaugggccuggacaagggguggcccaucucuaaaauggacaucggcgugccccuccuggcccuggggugcuacagucaggucaauccgcucacccugaccgccgccguucuaaugcuaguggcgcacuaugccaucaucggccccgggcugcaggccaaggccacccgggaggcccagaagcgcaccgcggcaggcaucaugaagaaccccaccguagacggcaucgucgccaucgaccuggaccccguaguuuacgaugccaaguucgagaaacagcucgggcagaucaugcugcugauccucugcacgagccagauccuguugaugcgcaccaccugggcccuaugcgaguccaucacccuggccacaggcccgcugaccacccucugggaggggagcccugguaaguucuggaacaccacgaucgccgucuccauggccaacaucuuccggggcagcuaucuggccggggcuggcuuggcguucucccucaugaagucccucggaggcgggagacgggggaccggcgcccagggggagacccucggcgagaaguggaagcggcagcucaaccaguuguccaagagcgaguucaacaccuacaagcggagcgggauuauggagguggaccgcuccgaggccaaagagggccugaagcgcggggagacgaccaagcacgccguuagccgcggcaccgcgaagcugcggugguucgucgagcgcaaccuggucaaaccggaggguaaggugaucgaccuggggugcggacgcgggggcugguccuacuacugcgccggucuaaagaaggucaccgaggugaagggcuacacgaagggggggcccggccacgaagagccgauucccauggccaccuauggguggaaccucgugaagcugcacagcggcaaggacguuuucuucacgccgccugagaagugcgacacccuucuaugcgacaucggggaguccagcccgaaccccaccaucgaggagggccgcacccugcgggugcucaagaugguggagcccuggcuccgcggcaaccaguucuguaucaaaauccugaaccccuacaugccuaguguaguggagacgcuggagcagaugcaaagaaagcacgggggcaugcucguccgcaacccacugagcagaaacucuacccacgagauguacugggucagcugcgggaccggcaacaucguguccgccgugaacaugacgagccgcaugcugcucaaccgguuuacaauggcccaccgcaagccuaccuaugaacgugacgucgaccugggcgcggggaccaggcacguagccguggagccugaggucgccaaccuggacaucaucgggcagcgcaucgagaacauuaagaacgagcacaaguccacguggcacuacgacgaggacaacccguauaagaccugggcauaccacgggucguacgaggugaagcccuccggcagcgccuccagcauggugaacggagucgugcggcuccugaccaagcccugggacgucauccccauggugacccaaaucgccaugacggacacuaccccguucggccaacaacgcguguucaaggagaaggucgacaccaggacgccccgcgcgaagcggggcaccgcucagaucauggaggugaccgccaagugguuguggggguuccucucccgaaacaagaaaccgcggauuugcacacgcgaggaguucacccggaaggugcgcagcaacgccgcgaucggcgcagucuucguagacgaaaaccaguggaacagcgccaaagaggccguggaggacgagcgguucugggaccugguacaccgcgagcgggagcugcacaagcaggggaaaugcgcgaccugugucuauaacaugaugggcaagcgcgagaaaaagcucggggaguucggcaaagccaagggcucccgggcaauuugguacauguggcugggggcccgcuuccuagaguucgaagcccucggcuucaugaaugaggaccacugguucagccgagagaacucccugagcgggguggagggcgaggggcugcacaagcucggguacauccugcgcgacaucuccaagauaccgggcgguaacauguacgccgaugacaccgccggcugggacacccggaucacugaggacgacuuacagaacgaggccaaaaucacggacauuauggagcccgagcacgcacucuuggccacaagcaucuucaagcugaccuaccaaaacaagguugugagaguacagcggcccgcgaaaaacgggacugucauggacguaauuucccggcgcgaccagcgaggaagcggccagguggggaccuacggucucaacacguucaccaacauggaaguccagcugauccgccagauggaguccgaggggaucuuccugcccugcgaacucgagacgccgaaucuggccgagcgugugcuggacuggcucgagaagcacggggccgagcgucugaagcggauggccauaaguggggacgacugcguggucaagcccaucgacgaccgcuucgccaccgcgcugaucgcccucaacgacaugggcaaggugcggaaggacaucccccagugggagccuuccaagggcuggaacgacuggcagcaggucccguucugcucucaccauuuucaccagcugauaaugaaggaugggcgcgagaucguugugcccugccggaaccaggaugagcuggugggcagggcccgggucucacagggggccggcuggagcuugcgcgagaccgccugccucgggaaguccuacgcacagauguggcaguuaauguacuuccaccggcgcgaccuccggcuggccgcgaaugccaucugcagcgcaguaccaguggacugggucccgaccucccgcacgacauggagcauacacgcccaccaccaauggaugaccaccgaagacaugcugagcguguggaaccggguguggaucgaggagaacccguggauggaggacaagacccacgucuccagcugggaggaggucccauaccucggcaagcgcgaggaccaguggugcggcuccuugaucgggcugacgacccgcgccaccugggcaaccaacauccagguggccaucaaccaagugcggcgccuaauuggcaacgagaacuacuuagacuacaugacgagcaugaagcgguuuaagaaugaauccgaccccgagggggcgcugugguga

SEQ ID NO: 24019 - RNA, 9879 nt, Artificial Sequence
  derived and/or modified CDS sequence (opt11) from DENV-1__FJ410179__SS-prME
uccguaaccaugcugcucaugcugcugcccacggcccucgccuuccaccugaccacgcguggcggggagccccacaugauagugucuaagcaggagcggggcaagagccuccuguuuaaaaccucugcugggauaaauaugugcacgcugauagcaauggaucugggcgagcucugcgaggauacgaugaccuacaagugcccccggauuacggaggcggagccugacgacguagauugcuggugcaacgccacggacacuugggugacuuacgggacgugcagccagaccggcgagcaucggcgcgacaagcgauccgucgcucuggcgccccaugugggccuaggguuggagacccgcaccgagacguggauguccuccgagggcgccuggaaacaaauccaaaagguggagaccugggcacugcggcaccccggguucacggugaccgccuuguuccuagcccaugccaucggaaccaguaucacccagaaggggauaauauucaucuuauugaugcucgugacgccgagcauggccaugcgcugcguggggauaggaaaccgcgauuucguggaaggcuugucgggcgccaccuggguggacgugguccuggaacacgguuccugcgucaccacaauggcgaaggacaagcccacgcuagacauugagcuguugaagaccgaggugaccaacccggcgguccuccgcaaacuaugcaucgaagccaaaaucaguaacaccaccacggacuccagguguccgacgcagggcgaagccacccugguggaggagcaagacuccaacuucgugugccgccggaccuucgucgaccgcgguugggggaacgguuguggccucuucggaaagggcucucugcugaccugugccaaguucaagugcguaacuaaacucgagggcaaaauuguacaguacgagaauuuaaaauacagcguuaucgucaccguacacacaggcgaccagcaccaagucgggaacgagaccacggaacauggaaccaucgcgaccaucacgccccaggcgcccaccuccgagauccagcugacggauuacggggccuugacccuggacugcucgccucgcacgggccuggacuucaacgagauggugcuacugaccaugaaagagaaguccuggcugguccacaagcaaugguuccucgaccugccccugcccuggacaagcggggccagcaccucccaggaaacguggaaccgacaagaccugcuggugaccuucaagacggcccaugcgaagaaacaggagguggucguacuggguagccaggaaggcgcgaugcauacugcccucacaggggccaccgagauccagaccuccggcaccaccaccauauucgcagggcacuugaagugccgguugaagauggacaaauuaacucugaagggcaugagcuacgugaugugcaccgggaguuuuaagcuagagaaggaagucgccgagacgcaacacggaaccgugcucguccaggucaaguacgagggcaccgacgcgccguguaagauacccuucagcgcccaggacgagaagggugugacccaaaacggucgcuuaaucacggccaauccgaucguuacggacaaagagaagccugucaacaucgaaacggagccgcccuucggugaguccuauaucguggucggcgcaggagaaaaggcacugaagcugagcugguucaagaaggguucuagcauagguaagauguuugaggccacagcccgcggggcgcgacggauggccauucucggugacacggcgugggacuucggguccauaggcgguguauucacuagcgucggcaagcucgugcaucagguauucggcgcugccuacggaguguuguucaguggcgugagcuggacuaugaagaucgggaucggcauccuccugaccuggcugggccucaacucccguucgacgagccugagcaugaccuguaucgcaguugggauggugacccuguaccucggcguaaugguccaggcugauagcgguugcgugauuaacuggaaaggccgagagcugaagugugggucgggaaucuuugugacaaacgagguccacacguggacggagcaguacaaguuccaggcggacagcccgaagcgucuuuccgccgcgaucggcaaggcuugggaggaggggguuugcggcauucgcagcgccacgcgucucgagaacauuauguggaaacagaucagcaacgaguugaaccacauccuuuuagagaacgacaugaaguuuacuguggucgugggggacgcuaacggcaucuuagcgcaagggaagaaaaugauccggccccagccuauggagcacagguacagcuggaaguccuggggaaaggccaagaucauaggcgccgacauccaaaacaguaccuucaucaucgacgggccugacacgcccgaaugccccgacgaccagcgcgcguggaauaucugggaaguagaggacuacggguuugggauuuuuacgaccaacauuuggcugaagcuucgggacuccuacacccagaugugugaccaccgccugaugagcgcagccaucaaagacuccaaggccguccacgcagacaugggguauuggauagagucggaaaaaaacgagacuuggaagcuagcgcgcgccuccuucauugagguaaagaccugcaucuggccuaagucgcacacccucugguccaacggggugcuggagagugagaugaucauccccaagauguacggagguccgauuucccaacacaacuaccgccccggguacuucacucagaccgcgggcccguggcaucugggcaagcucgagcuggacuucgaccugugugaagguacaacugucguagucgacgaacacugcggcaaccggggcccgucgcuccgcacuacgaccgucacugggaaaaucauccaugaaugguguugucgguccugcacgcugccgccgcugcgcuuccgcggugaggacggcuguugguacgggauggagauccgccccgugaaagagaaggaggagaacuuggugcggucaaugguaagcgcaggguccggggagguugacagcuucagccuugggauccucugugugagcauaaugaucgaggaggucaugagguccagauggagcagaaaaaugcugaugacgggcacccuggcgguguuccuccucuuaaucauggggcagcucacuuggaacgacuuaauaaggcugugcauuauggugggggcgaacgccuccgaccgaauggggaugggcaccacguacuuggcccucauggccaccuuuaagaugcgccccauguucgccgucgggcugcuguuccggcggcucaccucucgggaggugcugcuccucaccaucgggcugucgcugguggccucgguugagcuuccuaacagucuggaggagcugggugacgggcuagccaugggcaucaugaugcucaagcuuuuaacggaguuucagccucaccaacuguggaccacccuacucagccugacguucaucaagaccacccugucccucgacuacgccuggcgcaccauggccaugguguugagcaucgucucccuguuccccuugugccuaucgaccaccucccagaagacuaccuggcugccagugcuccugggcucguucgggugcaagccccugaccauguuccucaucacugagaacaagauauggggcagaaagaguuggccgcugaacgaaggcauuauggcaaucggcauagugagcauccuguugagcucccugcugaagaacgacguuccccucgccgggccacuuaucgcugguggcaugcuuaucgccugcuacgucaucucgggaucgagugcagaccucucccuagagaaagcggccgaggugagcugggaggaggaggcggagcacuccggcaccucgcauaacauuuuagucgaggugcaggaugacggcacgaugaagaucaaggacgaggaacgcgaugacacacugaccauccugcugaaggcuacguuacuggccaucuccggcguguaccccaugagcauuccugcgacacuauucguaugguacuucuggcagaagaaaaagcagcggucuggaguccucugggauaccccaagcccgcccgagguggagcgggccgucuuggacgacggcauuuaccggauccugcagcgcggucuccucgggaggucccaggugggagugggugucuuccaggacgguguauuccauacgauguggcacgugacgcgcggggccgugcugauguaucaaggcaagagacuggagcccucaugggccuccgugaagaaggaccuaaucagcuacggcggaggcuggcgguuccaaggcuccuggaacaccggcgaggaggugcaagucaucgccguggaacccgggaagaacccgaaaaaugugcagaccaccccuggcacguucaagacucccgagggcgaggucggagcgaucgcccuugacuucaaaccuggcaccaguggcucccccaucgugaacagagagggcaagaucgugggccuguacgggaauggcguuguaaccacgagcggcaccuacguuagcgccauugcccaagcaaaaaccucccaggagggcccccuccccgagauagaggaggaggucuucaaaaagagaaacuugaccaucauggaccuacaccccgggucaggcaaaacgagaagguaccuccccgcgaucguacgggaggcuaucaagcgcaagcugcgcacccugauucucgccccuacgcguguugucgccuccgagauggcggaggcacugaaggguaugccaauccgcuaccaaaccacugcugucaaguccgagcauaccgggcgagagaucguugaccugaugugccacgccaccuucaccaugcgccugcuaucuccgguccgggugcccaacuacaacaugaucaucauggaugaggcgcauuuuacugaccccgcgucgaucgccgccagagguuacaucuccaccagaguggguaugggcgaggccgcugcgaucuucaugacggcgaccccgccagggagcgucgaggccuuuccccaguccaacgccguaauccaggacgaggagcgcgacauccccgagcggagcuggaacucugguuaugacuggaucacggacuucccuggcaagaccgugugguucguccccagcaucaaguccgggaacgacauagcuaacugccugcgcaagaauggcaagcgugugauccagcucagccgcaagacguuugacacggaguaccagaaaacgcggaauaacgacugggacuacguuguaaccaccgacauuuccgagaugggggcgaacuuccgcgcggaccgagugaucgacccccgccggugccugaagcccgugauauuaaaggacggccccgagcgcgucauccucgccgggccaaugcccgugaccguggcaagcgcugcccagcggcgcggacgcaucggccggaaccaaaacaaagagggggaucaguacguuuauauggggcaaccccugaacaacgaugaggaccacgcccacuggacggaggccaagaugcugcucgacaacaucaacacccccgaagggaucaucccggcucuguucgagcccgagcgugagaaguccgcggccaucgauggugaguaccgucugcgcggggaggcucggaagaccuucguggagcucaugcgcaggggcgaccugcccguuuggcuuagcuauaaaguggccagcgaaggauuucaguauagcgaccgccgauggugcuucgacggggaacgcaacaaucaaguccucgaagagaacauggacguagagaucuggacuaaggagggcgagcggaagaaguugcgcccacgguggcuggaugcucgcacguacucagacccucucgcgcugcgugaauucaaggaguucgccgcuggucgcagaucggugagcggcgaccugauccucgagauaggcaagcugccccagcaccugacccuccgcgcgcagaacgcacuagacaaccuggucaugcuccacaacuccgagcagggcgggaaggcguacaggcacgccauggaggaguugccggauaccauagagacacugaugcuacuggcgcucauagcgguccucaccggcggcgugacucuguucuuccugagcggcaaaggccucggcaagaccuccaucgggcugcugugcgugauggcgagcagugcgcuccuguggauggccaacguugagccucauuggaucgccgccagcaucaucuuagaauuuuuccucauggugcuucugaucccugagccggacaggcagcggaccccccaggacaaccaauuagccuacguggucaucggacugcuguucaugauucucaccguggccgcaaacgagaugggucugcuagaaacgaccaagaaagaccucggcaucggucacguggccgccgagaaccaacaccacgccaccaugcuggacguugaucugcgcccggccucggccuggacgcuguaugccguggccacaacagugaucaccccuaugaugcgccauacaaucgaaaacacgacugcuaacauuagccugacggccauugcuaaccaggccgccauccugaugggccucgacaagggcuggcccaucucgaaaauggacaucgggguaccacugcuggcgcucggcugcuacucgcaagugaacccucugacuuuaacugccgccgugcucaugcuggucgcccauuacgcgauuaucggccccggacugcaggccaaagcgaccagagaagcccaaaagcgcaccgccgccgggaucaugaagaaccccacaguggacgguauagucgccaucgacuuggaccccgucguguacgacgccaaguucgagaagcagcugggccagauaaugcuguugaucuuaugcacgucccaaauacuucugaugcggacgaccugggccuugugcgagagcaucacccuggccacggggccuuuaacuacucuaugggagggcucccccgggaaguuuuggaauacgacaaucgcggugagcauggcaaacaucuuccgaggauccuaccuggcaggcgccgggcuugcauuuagcuuaaugaagucccugggagggggccggcgggggaccggcgcgcagggcgagacgcucggcgagaaauggaagcggcaacugaaucagcucucgaagagcgaguucaacaccuacaaacgcucagggaucauggaggucgaccggagugaggccaaagaggggcucaagcgcggcgagacgacuaagcacgccgucucccgggggaccgccaagcugcgcugguucguggagcguaaccuggucaagccggaagguaaggugauagaccugggaugcgggaggggcgguuggagcuacuauugcgcgggccucaagaaggugacggaagucaagggguacacgaaaggcggccccgggcacgaggagccgaucccgauggccaccuacggauggaaccuuguuaagcuguacuccgggaaggacguguucuucacgccgcccgagaaaugugacacccuacuaugcgacaucggcgagagcuccccgaaucccaccaucgaggaggggcggacgcuucgcgucuugaagaugguggagccauggcugagaggcaaccaguucugcauuaagauucugaaccccuacaugccgagcgucguugagacccucgagcagaugcagcgcaagcacggcgguaugcuggugcggaacccccugucccgcaacucgacgcacgagauguacuggguaucaugcgguaccggcaacauugucagcgccguaaacaugacgucccgcauguugcugaacagauuuacuaugacccaccgcaagccgaccuacgagcgggacguggaccucggcgccggcacgcgccauguugcggucgaaccugaggucgcuaaccucgacaucaucgggcaacggaucgagaacaucaagaaugagcacaagucuaccuggcacuaugacgaagacaacccuuacaagaccugggcauaucacggcuccuacgaggucaagcccucaggauccgcaagcucaaugguaaacggcgugguucggcugcugacaaagcccugggacguaauccccauggucacgcaaauagccaugaccgacaccaccccguuuggacagcagcggguguucaaggaaaaaguggacacgcgcacgcccagagccaaacgagggaccgcccagauaauggaggucaccgccaaguggcucugggguuuccugucucggaacaagaaaccgcgcaucugcacgagggaggaguucacacgcaaggugcgcagcaacgccgccauuggugccguguucgucgacgagaaucaauggaacucagcuaaggaagcgguggaggacgagagauucugggaccuugugcaucgggagagggagcuccacaagcagggcaagugcgcgaccugcgucuacaacaugauggggaagcgagagaagaagcugggagaguucgggaaggcuaagggcagccgcgccaucugguacaugugguuaggcgcccgguuucucgaguucgaggcucugggguucaugaacgaggaccacugguucucccgcgaaaacagcuucuccggcguggagggggagggacugcacaagcucggguacauccugagggauauaagcaagaucccaggcggcaacauguaugccgacgauaccgccgguugggacacgcggaucaccgaggacgaccugcaaaacgaggcgaagaucacugacauuauggagcccgagcacgcgcucuuagcgaccuccaucuucaaacugacguaccagaacaagguggucagggugcagcggccggccaagaacggcaccgugauggacgucaucagccggcgugaccaacggggguccggccaaguaggcaccuacgggcucaacaccuucacgaacauggaagugcagcugauacggcaaauggaguccgaaggaaucuuccugccguccgagcucgaaaccccgaaucuggcggagcgcguguuggacuggcuggaaaaacacgggacugagcggcugaagcgcauggcgaucucaggagacgacugcguggugaagccggucgacgaccgguucgccaccgcucugaucgcucucaaugauauggggaaggugcggaaggacaucccccagugggagcccucaaaaggcuggaacgacuggcagcaggucccauuuugcucccaccacuuccaccagcugaucaugaaagauggcagggagauagucgugccgugccgcaaccaggacgaacuaguagggcgcgcccgcguaucccagggcgcgggguggucucuccgggagacagccugccugggcaaguccuacgcccagauguggcagcuuauguacuuccaccgccgagaccuucgcuuagcagccaaugcgauuugcagcgccgugccagucgauuggguucccaccagccgcaccaccuggucaauccacgcacaccaccaguggaugacaaccgaggacaugcuuagcguguggaaccgcguguggaucgaggagaacccguggauggaggacaagacucacgucucuagcugggaggaaguaccauaccuggggaaacgcgaggaccaaugguguggaagccugaucggcuugaccgcccgggcgaccugggccacgaauauccaggucgcuaucaaucaaguacgacgucucauagguaacgaaaacuauuuggauuacaugaccuccaugaaaagguucaaaaacgaguccgauccagagggggcccucugguag

SEQ ID NO: 24020 - RNA, 9879 nt, Artificial Sequence
  derived and/or modified CDS sequence (opt11) from DENV-1__FJ410181__SS-prME
ucggugacaaugcuucucaugcugcuccccacggcucucgccuuccaucucaccacacggggcggagagccccacaugaucgucucaaagcaggagcgggggaagagccugcuguucaagacgucgguugggaucaacaugugcaccuugaucgccauggaccugggugagcucugcgaggacaccaugacguacaagugcccccgaaucacggaggcugagcccgacgacguggacugcuggugcaacgcaaccgacacguggguaacguacggcaccuguucgcagaccggggagcaccggcgggacaagcgguccguggcccuggcgccccacgugggccugggccucgagacaaggacugagacauggaugagcuccgagggcgcuuggaagcagauacagaaggucgagacuugggcucuccggcacccuggguucaccgugaccgcccuguucuuagcccacgcgaucggcaccagcaucacccagaaggggauaaucuucaucuuacucaugcucgugacgcccuccauggccaugcgcugugucgguauuggcaaucgggacuucguggagggguugagcggcgccaccuggguggaugucgugcuggagcacggguccugcgugacuacgauggcaaaagacaaacccacgcucgacauagaguuacugaaaaccgaggucaccaaccccgccguacuccggaagcugugcaucgaggcuaagauuuccaauacaaccacagacagccggugucccacgcagggagaggccacccugguggaggagcaggacagcaacuucgucugccgccggacguuuguggaccgcggcugggggaacggcugcggccucuucggcaagggcagccugcugaccugcgccaaguucaagugcgucacgaagcuugagggcaagaucguccaguacgagaaccugaaguacucagugaucgugacagugcacacaggcgaccaacaccagguggggaacgagaccaccgaacacggcacuaucgccaccauuacgccccaggccccuacguccgagauccagcugaccgacuacggggcgcucaccuuagauuguucuccaagaacgggucuggacuucaaugaaaugguccuccugaccaugaaggagaagucguggcuggugcacaagcagugguuccuagaccuaccgcugcccuggaccaguggggccagcacgucccaggagacguggaaucggcaggaccuccugguuaccuuuaagaccgcccacgccaagaagcaagaggucguggugcugggaucccaagagggugcgaugcacaccgcucucacaggggccacagagauccagaccucaggcacgacuaccaucuucgccggccaccugaagugcaggcugaagauggauaagcucaccuugaaagguaugagcuacgucaugugcaccggcuccuucaagcuggagaaggaaguagccgagacgcagcacgggacggugcucguccaagugaaauaugaggguaccgacgcaccguguaaaaucccguuuagcgcgcaagacgagaagggggugacccagaacggccgacucaucacggccaacccgaucgucaccgacaaggagaagccggugaauaucgaaacggagccgcccuucggugagucauauaucgugaucggcgccggcgagaaggcccucaagcugucaugguuuaagaaaggguccagcauuggcaagauguucgaagcgaccgcaagaggggcccgccgcauggcuauacucggcgacacggccugggacuucgggucgaucggcggcgucuucacaaguguagggaagcuugugcaccagguuuucggcgccgccuaugggguguuauuuucuggcgugucauggaccaugaaaaucgggaucggcauucugcugaccuggcuuggccuaaacucccguagcacaucccuaagcaugacaugcaucgcgguggggaugguuacgcuguaucucggggugaugguccaggccgauuccgggugcgugauuaacuggaagggcagagagcugaagugcggcagcggcaucuuuguuaccaacgagguccauacguggaccgaacaguacaaauuucaagccgauagcccaaagcggcuguccgcggcuaucggcaaggccugggaggaaggggucugcggcauccgcucugccacccggcucgagaacauaauguggaagcagaucucuaacgagcugaaccacauccugcucgagaaugacaugaaauucaccgugguagugggugacgcgaacggcauccuggcgcaggggaagaagaugauucgcccgcagccuauggagcauagguacaguuggaaguccuggggcaaggccaaaauuaucggcgccgauauccagaacaccaccuuuaucaucgacgguccggacaccccggagugucccgacgaucagcgugccuggaacaucugggagguagaggacuacgguuucgggaucuucacuacuaacaucuggcuuaaguugcgagacuccuacacgcaaaugugcgaucaccgccugaugucagcggccaucaaggauagcaaggccguccacgccgacaugggcuacuggaucgaaucagaaaagaacgagacuuggaagcuagcccgggccaguuucaucgaagugaagaccuguaucuggccuaagucucacaccuuguggagcaacggcgugcuggaaagugagaugaucauccccaagaucuaugggggcccuaucucacagcacaacuaccgcccaggguacuuuacgcagacagcaggccccuggcaccuggggaagcucgaacuggacuucgaccugugcgaggggacuaccguggugguggacgagcacugcggcaaucggggcccgucccuccgcacgacgacagucacgggcaaaaucauccacgaguggugcugccggagcugcacgcuaccgccucugcgauucagaggcgaggacggcugcugguacgggauggagauccgcccggugaaggagaaggaggaaaaccucgugcgguccaugguuagcgccggcagcggcgagguggacuccuucagccuggggauccugugcguuuccauuaugaucgaagaggucaugcgcagccguuggucccguaagaugcuaaugaccgguacccuggcugucuuccuucugcugaucaugggucaacuaaccuggaacgauuuaaucaggcuaugcauuaugguaggggccaacgcgagcgacagaauggggaugggcacgaccuaccuggcucugauggccacguucaagaugcgccccauguucgccgucggucugcuauuucggagacucaccucccgggaggugcuacugcucacuauugggcuaucacugguggcgucgguugagcucccaaacucacuggaggagcugggggacgggcucgcaauggggaucaugaugcugaagcugcugaccgaguuccagccccaucagcuguggaccacccugcucucccuuacguucaucaagaccacccuuucacuugacuacgcauggagaaccauggccaugguccugaguaucgucagccuguuuccguugugccugagcacgaccucccagaagaccaccuggcugccggugcuccugggcuccuucggguguaaacccuugacgauguuccucaucacggagaacaagaucuggggccgcaagagcuggccccugaacgaggguaucauggccaucggcaucgucuccauucuccugaguagucugcugaagaacgaugucccccucgcugggccgcugaucgccggcggaauguuaaucgcguguuacguuauuuccggguccuccgcagaccucagccuggagaaggccgcggaggugucaugggaggaagaggcugagcacagcggcacaucccauaacauucuggucgaggugcaagacgacggcaccaugaaaauuaaggaugaagagcgcgacgacacucucacgauauuauugaaggccacccuccuggccgugucaggcgucuaccccaugucaaucccggccacccuguucguuugguauuucuggcagaagaagaagcaacggucaggggugcucugggacacccccagcccccccgaggucgagagagcaguccuggacgacggcaucuaccggauccugcaacguggcuuguuaggucgaucucaagugggaguugggguuuuccaagacggcguguuccauacgauguggcacguuacccgcggggccgugcucauguaccaaggcaaaaggcuagagccuuccugggccucagugaagaaggaccucauaucuuacggcggggguuggagguuccaggguucguggaacacuggagaggagguccaggugaucgcaguggagccggggaagaauccgaagaacguccagaccacgcccggaaccuucaagaccccugagggcgaggugggugccaucgcguuagacuucaagccaggcaccuccggaucgccuaucgugaaccgugaggggaagauagucggacuguacgguaacggcguagucaccaccuccgggacauaugucucggccaucgcccaggccaaaaccucucaagaaggccccuuacccgagaucgaagacgagguguucaagaagcggaaucugacaauuauggaucugcacccgggguccggcaagaccaggcgcuaccucccugcaauaguccgggaggcgaucaagcgcaagcugcgcacacucaucuuggcccccacccgggucguggcgagcgagauggccgaggcguugaagggcaugcccauucgcuaccagacaaccgcagugaaguccgagcacaccggacgggaaaucguagaccugaugugccacgccacauucacgaugcgucuccugagccccguaagggugcccaacuacaauaugaucaucauggacgaggcucacuucacugaucccgcuucuauagcggcccgcggguauaucagcacccgggucgggaugggcgaggccgccgccauuuucaugacggccacgccuccggggucgguggaggccuucccccagagcaacgcugugauacaggacgaggagcgcgacauaccugagcgguccuggaacagcggcuacgacuggaucaccgacuuucccgggaagaccguaugguucgugcccuccaucaagucggggaacgacaucgccaacugccuucgcaagaacggcaaacgggugauccagcucucccgaaagaccuucgacacggaguaucagaagacuaaaaacaacgacugggacuacgugguuacaacagacaucagcgagaugggggcgaacuuccgagcugacagagugaucgacccccgacgcugccuuaagccggucauccugaaggacggcccggagcgggugauccucgcagggcccaugccugugacagucgcauccgcugcccagcgccggggcagaauaggccgcaaucagaacaaggaaggggaccaguacguguacaugggccagcccuugaacaaugacgaggaccacgcacacuggaccgaggcaaaaaugcuguuggacaauauuaacacccccgaggggaucauuccggcgcuguucgaacccgagcgggagaaguccgcugcgauagacggcgaguaccgccugcgcggggaggcucgcaagaccuucgucgaacuaaugcgccgcggggacuuacccguguggcuguccuacaagguggcuagcgagggguuccaguacucagacaggcgguggugcuucgacggggagcgcaacaaccagguccucgaagagaacauggacguggagauuuggacgaaggagggcgagcgcaagaaacucaggccccgcuggcuagacgcccgaacuuauagugauccgcucgcacugcgcgaauucaaagaguucgccgccggacggaggucugucucaggagaucugauccucgagauuggcaagcugccccagcaccuuacacuccgggcccagaacgcacuagauaacuuggucaugcuccacaacuccgagcagggugggaaagccuaccgccaugcaauggaggagcugccugacaccauugagaccuugaugcuccuggcccugaucgccgugcucaccggcggggugacccuguucuuccuguccggaaagggguuaggcaagacaucaaucgggcugcugugcgucauggcuucgagcgcgcuccuguggauggcuaacguggaaccccacuggaucgcggccuccaucaucuuggaguuuuucuugauggugcugcugauccccgagcccgacagacagcguacgccccaggacaaccagcucgccuacgucgugauuggccuguuguuuaugauccucacggucgcagcgaacgagaugggacugcuggagaccaccaagaaggaccucgggaucgggcacguugcggcugagaaccaacaccacgcaaccaugcuggauguggaucuucggccggcaucggcauggacucucuacgccgucgcaaccaccgucaucacccccaugaugcgccacacgaucgagaacaccaccgcuaacaucucccugaccgcaauugcuaaccaggcugccauucucaugggccucgacaagggauggccuaucagcaagauggauaucggagugccccugcuggccuugggcugcuauucccaggugaacccgcucacgcugaccgcugccgugcucaugcucgucgcucacuaugccaucaucggccccggacugcaggcuaaagccacccgugaagcacaaaaacgaaccgccgccgguaucaugaagaaccccacuguggacggcauagucgcaaucgaccucgaccccguggucuacgaugccaaguucgagaagcaguuaggccagaucaugcugcucauauuauguacaagccaaauccugcucaugcgcacuaccugggccuuaugcgaaucgaucacgcuggccaccgggccgcuaacuacccucugggaaggcagccccgggaaguuuuggaacacuacuauugccgucagcauggcgaauaucuuccggggcagcuaccuggcaggcgccgggcucgccuuuucccucaugaagucccucggcgguggacgacggggaacgggcgcccagggcgagaccuugggggagaaguggaagcggcaacugaaccaacugaguaagagcgaguuuaauacguacaagcguagcggcaucauggagguggaccgcuccgaggcgaaggaaggguuaaagcggggcgagaccaccaagcaugcagugagccgagggaccgccaagcugcguugguucguggagcgcaaccuggugaaaccugagggcaaggugauugaccugggauguggucggggaggguggucauacuauugcgccggccuuaagaaggucacggaggugaagggguacacuaagggcgggcccgggcacgaggagccgauccccauggcgaccuacggcuggaacuuagugaagcuguacagcggaaaggacgucuucuucacgccgcccgagaagugcgauacccuacucugcgauaucggugaguccagcccuaaccccaccaucgaggagggccgcacacugcgggugcuuaagaugguggagcccuggcugcgcgguaaccaguuuuguaucaagauccugaaccccuauaugccguccgucguggagacacucgagcagaugcaaaggaagcacggcggaauguuagugcgaaaucccuugagccggaauuccacacacgagauguacuggguuagcugcggaacggggaacauuguuuccgccgugaacaugacgucucggaugcucuuaaaccgcuucaccauggcccacaggaagcccaccuacgaaagagacgucgacuuaggagccggcacucggcacguggccguggagccagaaguggcgaaccucgacaucauuggucagcgcaucgagaauaucaaaaacgagcacaaguccaccuggcacuacgacgaggacaacccguauaagacaugggccuaucacggaagcuacgaagugaagccuuccgggagcgcaucgagcaugguuaauggcgucgugagacugcugaccaagcccugggaugucauccccauggugacgcagaucgccaugaccgacaccaccccuuucgggcaacagcgcguguucaaagaaaaggucgacacgcggacgccccgggccaagaggggcacagcgcagauuauggaagucaccgccaaauggcucugggguuuccugucccguaacaagaagccccggauaugcacgagagaagaauucacccggaaagugagaagcaacgcagccaucggggcagucuucguggacgagaaccaguggaacagcgcgaaggaagccguggaagacgagcgguuuugggaccugguuuaccgcgagagagaauuacacaagcaaggcaagugcgcgaccugcgucuacaacaugauggggaagcgcgaaaagaagcugggcgaguucgggaaggccaagggcucgcgggcgaucugguacauguggcugggcgcgagguuucucgaguucgaggcccugggauuuaugaaugaggaccacugguuuagccgggagaacuccuucagcggcguggaaggggaaggccugcacaagcugggauacauccugcgcgacaucuccaagauccccggugggaacauguacgccgaugacaccgccgggugggacacgcgcaucacugaggacgaccugcagaacgaggcgaagaucaccgauauaauggagccggaacacgcauuacuggccacuuccaucuucaaacuuacauaccagaacaagguagugcgggugcagagaccggcuaagaauggcacagucauggaugugaucucccggcgcgaucagcgugggagcggacagguuggcaccuacgggcucaacaccuucacgaacauggagguacaguugauacggcagauggagucugaggggaucuuccuucccagcgagcucgagaccccuaaccuggccgaaagaguucucgauuggcucgagaagcacgggaccgaacgacugaagagaauggcgaucaguggcgacgacugcguggucaagccuguggaugaccgcuuugccaccgcccuuaucgcgcugaaugacauggggaaggugcgaaaagauaucccccaaugggagcccaguaaaggcuggaacgauuggcagcaggucccauuuugcagucaucacuuccaccagcugaucaugaaggacggccgagagaucgucgugcccuguaggaaccaagacgagcuggucgggcgcgcgcgggugagccagggcgcgggguggucccuacgcgagacggccugucugggaaagagcuacgcccagauguggcaacugauguacuuucacagacgcgaucuccggcuggcagcaaacgccaucugcuccgccgugcccgucgauugggugcccaccagccgcacuaccuggaguauccacgcgcaccaccaguggaugaccacggaagacaugcuuucuguuuggaaccgcgucuggaucgaagagaacccguggauggaggauaagacccacgugagcaguugggaggaggugccguaccucgggaaacgggaggaccaguggugcggcagcuuaauuggccugacggcucgagcgaccugggccaccaauauacaagucgccaucaaccaggugaggcgccucaucgggaaugagaacuaccuggacuacaugacuucgaugaaacgguuuaaaaaugagagcgacccugagggcgcccugugguga

SEQ ID NO: 24021 - RNA, 9879 nt, Artificial Sequence
  derived and/or modified CDS sequence (opt11) from DENV-1__FJ547086__SS-prME
uccgugaccaugcugcucaugcugcugccaaccgcccuugccuuccaccugaccacccggggcggggagccgcauaugauagugucgaagcaggagcgcggcaagagccuccucuuuaagaccagcgcuggugugaacaugugcacgcugaucgccauggaccugggcgagcucugugaggauaccaugaccuacaagugcccccggaucaccgaggccgagcccgacgacguugacugcuggugcaacgccaccgacacgugggugaccuacggcaccugcucgcaaacgggagaacaccggagagacaagcgguccguggccuuagcuccgcacgugggacuugggcuugagacucgcacagagacauggaugagcuccgagggcgccuggaagcagauccaaaaggucgagaccugggccuugcggcaccccggguucacggucaucgccuucuuucuggcgcacgccaucggcaccagcaucacccagaaggguauuaucuuuauccuccugauguuggugacccccuccauggccaugcgcugcgucgguaucgggaaccgggacuucguggagggacucagcggggccacguggguggacguugugcuggagcacggguccugcgugaccaccauggccaagaacaagcccacccuggacaucgagcuccugaagacggaggucaccaacccggcagugcugcgcaagcucugcaucgaggcuaaaaucagcaacaccaccacugacucccgaugcccgacccagggcgaggcgacccuggucgaggagcaggacgccaacuucgucugccgccggaccuucguggaucgcggcugggggaauggaugugggcuguucggcaaggggagcuuacugacgugcgccaaguucaagugcguaaccaaacucgagggcaagaucgugcaauacgagaacuuaaaguacuccguaaucgucaccguccacaccggcgaccagcaucagguggggaacgagacgaccgagcacggcaccauugcgaccauaacgccccaggcccccacaagcgagauccagcucacggacuacggcgcucugacauuggacugcagcccaaggaccggccuggauuucaaugagaugguccugcucacgaugaaggagaaguccuggcuggugcacaagcagugguuccuggaccucccgcugcccuggacuagcggggccagcacaagucaagaaacguggaaccgccaggaucugcucguuacguucaagaccgcccacgcuaagaagcaggaggugguggugcugggcucccaggagggagccaugcauaccgcccuaaccggggcgacggaaauccagaccagcggcaccaccacaauuuucgccgggcaccucaaaugucgccuaaagauggacaaguugacccucaagggcauguccuacgugaugugcaccgggagcuucaagcuggagaaagagguagcggaaacccagcacggcacuguccugguacaggucaaguacgagggcaccgacgcccccuguaagauacccuucuccacccaggacgagaagggugugacccagaauggccgccuuaucacggccaauccgaucgucacugacaaggaaaagccagugaacaucgaaacugaaccgccuuucggggagucuuacaucauggugggcgcuggcgagaaagcccucaagcuguccugguucaaaaaggggagcucgaucggcaagauguuugaggccaccgcucgcggcgccaggcgaauggccauucugggcgacaccgcgugggacuucgggucaaucggcggcgucuucaccucaguggggaaacucgugcaccaggucuuuggcacugccuacggaguacuguucagcggcguuuccuggaccaugaagaucgguaucggcauccugcucacguggcugggccugaacagccgcuccgccagccucuccaugaccugcaucgccgucgguauggucacccuguaccugggcguuaugguucaggccgacagcgggugcgcgaucaacuggaagggccgcgagcucaaauguggguccggcaucuuugugaccaaugagguucacacguggaccgagcaguacaaguuucaggccgacagcccgaaacgguugucagccgccaucggcaaagcaugggaggaggggguaugcgguauucgcucugcuacccggcuugagaacaucauguggaagcagauaaguaacgagcucaaccacauccugcuggagaacgauaugaaauuuaccgugguggucggggacgccaacggcaucuuggcccaggggaagaagaugauccgcccccaacccauggagcacaaguacucuuggaaaucauggggcaaggccaagaucauuggcgcggacauucagaauacuacauucaucaucgaugggcccgacaccccggagugccccgacgaucaacgggccuggaacaucugggagguugaggacuacggcuucgggaucuucaccaccaacaucugguugaagcugcgcgacuccuauacgcagaugugcgaccaccgacucaugagcgccgccaucaaagacuccaaggcugugcacgccgacaugggcuauuggaucgagagcgagaagaacgagaccuggaagcuggcccgcgccuccuuuaucgagguuaagacuugcaucuggcccaaaagccacacccuuugguccaauggugugcucgagagcgagaugaucauccccaagaucuacgggggcccuaucagucagcauaacuaucggcccggguacuucacgcagaccgccggacccuggcaucuagggaaguuagagcucgacuuugacuuaugcgagggcaccaccguggucguggacgagcauugcggcaaccgcgggccgagccugcguacaaccaccgugaccggcaagaucauacaugagugguguugccgguccugcacucugccgcccuuacgguuccgcggggaggacggcugcugguacggaauggaaaucagacccgucaaggagaaggaggagaaccuggugcgcuccauggugucugcgggaucuggcgagguagacagcuucagucucggcaucuugugcgucucaaucaugauugaggaggugaugcggucccgcuggagccggaagauguuaaugaccggcacccucgcggucuuuuuacugcuaauaauggggcagcucaccuggaacgaccugauccgcuuaugcaucaugguuggggccaacgccuccgacagaauggggaugggcacgaccuaucuggcccugauggcaacauucaaaaugcggccuauguucgcggugggccugcuguuccgccggcugacuucccgcgagguguuacuccugacgaucgggcucucccuggucgccagcguggagcugcccaauucccucgaagagcuuggcgacggguuagcaaugggcaucaugaugcucaagcuucugaccgaguuccagccccaccagcucuggaccacccuacugagcuugacuuucauuaagacuacccugagccuggacuacgccuggaaaacgauggcgaugguccucagcaucgugucccuguucccccugugccucucaacaacuucacagaagacgaccuggcugccuguacuuuuaggcagcuucggcugcaagccccugacgauguuccugaucaccgagaacaagaucuggggccggaaguccuggccccucaacgaggggauuauggccaucggcaucguuagcauccugcuguccagccuacugaaaaacgaugugccccuggccgggccgcucauagccgggggcaugcugaucgccuguuaugucaucucuggguccagcgcggaccugucccucgagaaagccgccgagguaucuugggaggaggaggccgagcacucgggcaccagccacaacauccugguggagguccaggacgacgggaccaugaaaaucaaggacgaggagcgcgaugacacuuuaacuauccuccugaaggcuacccugcucgcgguguccggcguauaccccaugagcauccccgccaccuuauucgucugguacuucuggcagaagaagaagcagcgguccgggguucucugggacacccccucaccgcccgagguggagcgcgccguccucgacgaugggauauaccggauccugcagaggggccuguuggggcggucccagguuggcgugggggucuuucaggacggcguguuccacacgauguggcacgugacccgcggggccguccucauguaucaaggcaagcgguuggaacccagcugggccuccgugaagaaggaccugaucagcuauggggggggauggagauuccagggguccuggaacaccggggaggaaguccaggucaucgcgguggaacccgggaaaaacccgaaaaacgugcagaccacgccaggcaccuuuaagacccccgagggcgaggucggggccauagcucucgauuuuaagccaggcaccagcgggucaccgaucgugaaccgggagggaaagaucguaggccuguacgggaacggugucgugacaaccuccgggaccuacgugagugcuauugcacaggcgaaggccagccagcaaggcccccugcccgagauagaagacgagguuuucaagaaacgcaaccugaccaucauggaccugcacccggggagcggcaagacgcgacgcuaccugcccgccaucgugcgggaggcaauaaagagaaaguugcggacgcugauucuggcgcccacgcgcguuguagccuccgagauggccgaagcccucaagggcaugccuauccgcuaucagaccacggccgucaagagcgagcacaccgggcgugagaucguugauuugaugugccacgcgaccuucaccaugcgccugcucucccccguccgggugcccaacuacaacaugaucaucauggacgaggcccauuucacagaccccgcaagcaucgccgccagaggcuauauauccacccggguggggaugggcgaggcggccgcgaucuucaugaccgcaacgccaccagggagcguugaggccuucccacaguccaacgcugugauccaggaugaagagagagacauccccgagcggagcuggaauuccggcuaugacuggaucacggacuuccccggcaagaccgugugguucgugcccagcauaaaguccgggaacgacaucgccaauugcuugagaaagaauggcaagcggguaauccaacugucucgcaaaaccuucgacaccgaguaccagaaaaccaagaacaaugacugggacuacguggucaccacggacaucuccgagaugggggccaacuuccgggccgaucgcguuaucgacccccggcgcugucucaagcccguaauucugaaggacggccccgagcgggucauccuggcuggaccgaugcccguuaccguggccagcgccgcccagcgccggggucgaaucggcagaaaucagaacaaagagggggaccaguacguuuacaugggccagcccuugaacaacgacgaggaccacgcccacuggacggaggcgaaaaugcugcuagauaacaucaauacccccgaagggauuaucccggcccucuucgagcccgagcgcgaaaaguccgccgccaucgacggcgaguaccggcucaggggcgaggcccgcaagaccuucguggagcuuaugcggcgcggcgaccuccccgucugguuaagcuauaagguggcguccgaaggcuuccaguacagcgaccggagauggugcuucgacggggagcggaacaaccaggugcuggaggagaacauggacgucgagauuuggaccaaggagggcgagaggaagaagcuccggccccgguggcuagaugcccggaccuacucagacccacuggcccuccgcgaguucaaggaauucgcugccgggcggcgcagcguuagcggggauuugauccuggagaucgggaagcucccccagcaccugacacugagagcgcaaaacgcccuggacaaccuggugaugcugcacaauuccgagcagggcggcaaagcauaccgccacgcuauggaagaacuccccgacaccaucgagacccuuaugcuucucgcgcuaaucgccgugcugaccgggggcgugacucucuucuucuugagcgggaagggccugggaaagaccuccaucgggcuacugugcguuauggcuagcuccgcccugcuuuggauggccagcgucgagccccacuggaucgccgccuccaucauacuugaguucuuccugauggugcuccugauaccggagccugaccggcaacgcacgccgcaggacaaccaacuggcauacgucguaaucgggcuccuguucaugauccugacgguagccgcaaaugagaugggucuccuggagacgaccaagaaggaccugggcauugggcacguggcagcggagaaccaucaccacgcaaccaugcucgacguggaccuucggccggccagcgcguggacucuguacgcgguggccacuaccgugaucacccccaugaugcgccacaccaucgagaauacgaccgccaacaucuccuuaaccgccaucgccaaccaggcggccaucuuaaugggccuggacaagggcuggcccaucagcaagauggacaucggggucccccucuuggcccuggguugcuacucccaggugaacccgcucacccugacggccgcugugcugaugcucgucgcccacuacgcgaucauaggacccggcuuacaggccaaggccacccgggaggcgcagaagcgcacugccgccgggaucaugaagaaccccaccgucgacggcaucguggccaucgaccuggaccccgucguguaugacgccaaguucgagaagcagcucggacagaucaugcugcugaucuuaugcacgagccagauccuccugaugcgcaccacuugggcgcucugcgaguccaucacccuugccacggggccgcuuaccacccucugggagggcagcccggggaaguucuggaacaccacgauagccguuuccauggccaacaucuuccggggcucuuaccuggccggcgcgggcuuagccuucucccucaugaaaagccugggcggaggccgccgagggaccggcgcccagggcgagacccugggggaaaaguggaagcgccagcucaaccagcuguccaagagcgaguucaauacuuacaagcggagcggcaucauggaagucgaccgcuccgaggcuaaggaggggcugaagcggggcgagacgacuaagcacgcgguuagccgcgggaccgccaagcuccggugguucguggagcgcaaccugguaaagccugaggguaaggugaucgaccugggaugcgggcggggcgggugguccuacuacugcgccggccugaagaagguuaccgaggucaagggguacacgaagggcggacccggucacgaggaaccgauccccauggccaccuacggcuggaaccucgugaagcuacacagcgggaaggauguguucuuuacgccgcccgagaagugcgacacuuugcucugcgauauuggcgagucaagccccaaccccaccaucgaggaggggcgcacgcugcggguccugaagaugguggagcccuggcuccgaggcaaccaauucugcaucaagauccugaacccguacaugccguccguuguagagacccuggagcagaugcaacggaaacauggcggcaugcucgugcgaaacccccugucucggaacucuacucacgaaauguacuggguaagcugcggcaccgggaauauugucuccgccguuaacaugacgagccgcaugcugcucaaccgguuuaccauggcccaccgaaagcccacuuacgagcgcgacguggaucuaggcgccggcaccagacacgucgccguggagcccgagguggccaaucuggacaucaucggucagcggaucgagaacauuaaaaaugagcacaaguccacauggcacuaugacgaggauaacccauacaagaccugggcauaccacgguagcuacgaggucaaacccuccgggagcgcgaguucgauggugaacggcguaguccggcuccugaccaagccuugggacguuauccccauggucacucagaucgccaugacggacaccaccccguucgggcagcagcgcguguucaaagaaaagguugacacacggaccccccgcgccaagcgggguaccgcccagaucauggaggucaccgccaaguggcucuggggcuuccucucucguaacaagaagccccggaucugcacccgcgaagaguucacucggaaggugcgcagcaacgcugccaucggggcuguguucgucgacgaaaaucaguggaacagcgccaaggaggcaguggaggaugagcgguucugggaucuggugcaccgcgagcgggagcugcacaagcaaggcaagugcgcaaccugcgucuacaauaugauggggaagagggagaagaagcucggcgaauucgggaaggcgaagggcagccgcgccaucugguacaugugguuaggggcccgcuuccuggaguucgaagcgcucggguucaugaacgaggaucacugguucagccgggagaacucgcugagcgggguugagggggagggccugcauaaauugggcuauauccugcgcgacaucucuaagaucccgggcggcaacauguaugccgacgacaccgccgggugggauacccggaucacugaggaugaccugcagaacgaggcuaagaucaccgacauuauggagcccgagcacgcacuccuggcgaccagcaucuuuaaguuaacauaccagaacaaggugguccgcgugcagcgccccgccaagaauggcacgguaauggaugucaucucccggcgcgaccaacgggggagcgggcaggugggcaccuacggguuaaacaccuucaccaacauggaggugcagcugauucgacagauggaguccgagggaaucuuccugcccugcgagcucgagacgcccaaccucgccgagcgggucuuagauugguuggagaagcacggggccgagcgccucaagcggauggccaucagcggcgacgacugcguugugaaacccaucgacgaccgcuucgcgaccgcccugauagcccucaacgacauggggaaaguacggaaagacaucccccaaugggagccuuccaaaggcuggaaugacuggcagcaagucccguucugcagccaccacuuccaccagcugaucaugaaagacggccgcgagauagugguccccugccggaaccaggacgaacugguggggcgcgcccgggugucccagggugccggguggagccugcgcgagaccgcuugccugggcaagucuuacgcccagauguggcagcugauguacuuccaccgaagagaccuccgacuugccgcuaacgcgaucuguuccgccguacccguggacugggugcccaccagccgcacuaccuggagcauccacgcucaccaccaauggaugaccaccgaagacaugcugagcgucuggaaccggguguggauugaggagaaccccuggauggaggacaagacccacgucucuuccugggaggagguucccuaccucgggaaacgcgaggaccaguggugcggcucccugaucggccugaccgccagagcgaccugggcgaccaacauccagguggccauaaaucagguccgucgccucaucgggaacgagaacuaccuggauuauaugaccagcaugaaacgguucaagaaugagucuaacccagagggcgcccugugguga

SEQ ID NO: 24022 - RNA, 9879 nt, Artificial Sequence
  derived and/or modified CDS sequence (opt11) from DENV-1__FJ410183__SS-prME
uccgugacuaugcugcucauguuauuacccacugcccucgcauuccacuugaccaccaggggcggcgaaccccauaugaucguguccaagcaggagcgggguaagagccucuuguuuaagacauccgccgggaucaauauguguacccugaucgcgauggaccugggggagcucugcgaggacaccaugaccuauaaguguccccgcaucaccgaagcagagccggacgauguggacugcugguguaaugcaaccgacaccuggguaacguacgggacgugcagucagaccggcgagcaccgccgggacaagcgguccgucgcccuggcgccccacgugggccuggggcucgaaacgcguaccgaaacguggaugagcuccgagggcgcauggaagcagauccagaagguugagacgugggcucugcggcaccccggguucacggucacugccuucuuccuggcgcacgccaucggcaccagcaucacgcagaaggggaucaucuuuauccuccugaugcuggugacgccuucaauggccaugcgcugcguggggaucggcaaccgggacuucguugaaggccuuagcggugcaaccuggguggacgugguccuggaacacggguccugcguaaccaccauggcuaaggacaagcccacccuggacaucgaacuccugaagaccgaagugacuaaucccgcuguacugcgcaaacucugcaucgaggccaagaucagcaacaccacgaccgacucacggugcccgacgcagggcgaggccacccuggucgaggagcaggacucgaauuucgucugccgccgcacguucgucgauagaggcugggggaacggcugcggucuguucggcaaggggucccuccugacaugcgccaaguuuaagugcgugaccaagcuggagggcaagaucgugcaguacgagaaccucaaguacagcguaaucgugacagugcacacgggcgaccagcaccaggucgggaacgagaccaccgagcacgguacgaucgccacuauaacgccccaggcgcccaccuccgagauccagcugacggacuauggggcccugacccucgacugcagcccccggacaggccuggacuucaaugagaugguccugcucacuaugaaggagaaaucguggcugguccauaagcagugguuccuugacuugccgcugcccuggaccagcggggcaagcaccucccaggagacauggaaccgccaggaccugcucgugaccuucaagaccgcccacgccaagaaacaggaaguggucguuuuggggagccaggagggcgcgaugcacaccgcgcugacgggugccaccgagauccaaaccuccgguaccacaacgaucuucgccgggcaccucaaguguagacuaaaaauggacaaacuuacgcuaaagggcaugagcuacgugaugugcaccggguccuucaagcuggagaaagaggucgccgaaacgcaacacggcaccguucugguacaagucaaguacgagggaaccgaugccccuugcaagauaccuuucagcgcccaggaugagaagggugugacccagaacggacgccugaucacggccaauccgaucgugaccgacaaggaaaaacccgugaacaucgagaccgagccgcccuuuggcgaauccuacaucguggugggggccggggagaaggcauuaaaacuuagcugguucaaaaagggcuccagcaucggcaagauguucgaggccaccgcgcgcggggcccgccggauggcgauccuaggcgauacagccugggacuucggguccaucggaggcgucuucaccagcguggggaaacucgugcaucagguguucggggcagccuacggggugcuguucaguggugugaguuggaccaugaagauagggaucggcauccugcucacuuggcuggggcuaaauucccgcagcacuucccuuagcaugaccugcaucgcugucgggauggugaccuuauaucugggagugauggugcaagccgacucgggcugcgucaucaacuggaagggccgcgagcucaagugcgggagcggaaucuucguuaccaacgagguccacacauggacugagcaguacaaguuccaggcggacagcccgaagagguuguccgccgccauaggcaaggccugggaagaaggagugugcggcauucgcucggcaacgcggcuugagaauauaauguggaagcaaaucuccaacgagcucaaccacauccuacucgagaaugacaugaaguucaccguggucgugggugacgcgaacggaauccucgcacagggcaagaagaugauccguccccagccgauggagcaccguuauagcuggaaguccuggggcaaggccaagaucaucggagccgacauacagaacaccaccuucauuaucgacgggcccgacaccccugagugcccagaugaccagagagcguggaacaucugggagguggaggacuacggcuuugggaucuucaccaccaacauuuggcugaagcugagggacucauacacgcagaugugcgaccaccgccucauguccgccgccaucaaggacagcaaagccguacacgccgauaugggcuauuggaucgaguccgagaagaacgagaccuggaagcuggcucgggcuagcuucaucgaagugaagacauguaucuggcccaagucgcacaccuuguggagcaauggcgugcuggagucagagaugaucauacccaagauguacgggggcccgacgagccagcacaauuaucgcccgggguacuucacccaaaccgccggccccuggcaccuggggaaguuggagcucgacuucgaccugugcgagggcaccacgguuguggucgacgagcacugcggaaaucgggguccgucccugcgcaccaccacagucaccgggaagaucauccacgaguggugcugucggagcugcacccugccgccccuccgauuccgcggggaggacgggugcugguaugggauggagauccgcccggugaaggaaaaggaggaaaacuuggugcgguccauggugagcgcuggcagcggugagauggacuccuucagcuuaggaauccuuuguguuagcaucaugaucgaggagguuaugcgcagccggugguccagaaagaugcugaugaccggcacccucgccguguuccugcuacuaaucaugggucagcucacguggaaugaccugauccgacucugcaucauggucggcgcuaaugccagcgaccggauggggaugggcacgacuuauuuagcccugauggcuacuuucaagaugagaccaauguucgccgugggucuccuguuccggcgcuugacgucccgggaaguccuccugcuuaccaucgggcucagccucguggcuuccguggagcugccuaacagccucgaggagcuaggcgacggacuggcuauggggaucaugaugcugaagcugcugaccgaguuccagccccaucaacucuggaccacguuacugucccucaccuuuaucaagacgacccugagcuuggauuacgccuggcgcaccauggccauggugcuuuccaucgugagcuuguucccccugugccucuccaccaccagccagaagacaacguggcuuccgguccugcucggcuccuucggaugcaagccacugaccauguuccugaucaccgagaacaagauuuggggccgaaagagcuggccucucaacgaggggaucauggcgauagguaucguguccauccugcucagcucgcucuuaaagaaugacgugccccuggccgggccucuaaucgccggcggcaugcugaucgcaugcuacgucaucuccggcagcucugccgaucugucacucgaaaaggcggcagagguguccugggaggaggaggccgaacacagcggcaccucccacaacauccugguggagguccaagacgacgggaccaugaagaucaaggacgaggaacgcgacgacacgcugaccauccuccugaaggccaccuuacuggcuguaagcggcguguaccccauguccauaccagcgacccuguucguuugguacuucuggcagaagaagaagcagcggagcggggugcugugggacacacccucacccccugagguugagagggcagucuuggacgacggcaucuaccggauccugcagcgcggccugcuugggcggagccaggugggcguaggggucuuccaggacgguguguuccauacuauguggcacgugacucgcggggccgugcucauguaucaggguaagcggcuagaaccuuccugggccagcgugaaaaaggaccugauuuccuacggcgggggcuggagauuccagggcagcuggaauaccggcgaggaggugcaggucauugccguggagcccgguaagaacccuaaaaacgugcagacgacaccuggcacuuucaagacaccagagggcgaggucggggcaaucgcgcucgacuucaagcccgguacguccgguucgccgaucgugaaccgggagggcaagauagugggccuuuacgggaauggggucguuacaaccucugggaccuauguguccgccaucgcccaagcuaagacgucccaggagggcccgcuucccgagaucgaggacgagguauucaagaaacgcaaccucaccaucauggaccugcacccgggguccgggaagacccggcgcuaccugcccgcuaucgugcgggaagcuauaaagcgcaaguuacgcacccuaauacucgcccccacccgggugguugccagcgagauggcggaagcccucaagggcaugcccauccgcuaccaaacaaccgccgugaaguccgagcacacaggaagggagaucguggauuuaaugugccacgccacauucacgaugagacuguuaagcccuguccggguucccaacuacaacaugauaaucauggacgaggcgcacuuuacugaccccgcgucgaucgccgcccgcggcuacauauccacccggguggggaugggcgaagccgcugcuauauuuaugacggcgacaccgcccggguccgucgaggcguucccccagagcaacgcaguuauccaagacgaagaacgugacauaccggagcgcuccuggaacucgggauacgacuggaucaccgacuuccccggcaagaccgugugguuuguacccuccaucaaaucugggaaugacaucgcgaauugccugaggaaaaacgggaagcgggucauccagcucucgcgaaagacguucgacaccgaguaccagaagaccaagaacaaugauugggacuacgugguaaccacggacauuagcgagaugggggcgaacuuccgggccgaccgggugaucgauccccgccgcugccucaagccagugauccuuaaggauggccccgagcgggucaucuuagccggcccgaugccggugaccguggccuccgcggcccaacgccgggggcgcaucggccgcaaccagaacaaggagggggaccaguacgucuacaugggccagccccucaacaacgacgaggaccacgcccacuggaccgaggccaaaauguuguuggacaacauaaacaccccagaaggaaucaucccggcgcucuuugagcccgagcgggagaaauccgcggcgauagauggcgaguacaggcugcggggcgaggcccgcaagacguuuguggagcugaugcgucggggcgaccucccggucugguuguccuauaagguggccagcgagggcuuucaguacuccgaccgucgcuggugcuucgacggggagcggaacaaccaaguguuagaagagaacauggaugucgaaaucuggacuaaagagggcgagcgcaagaagcuccgccccaggugguuagacgcccggaccuacagcgacccgcuggcgcuccgcgaguuuaaggaguuugccgccgggcggcgcagugucuccggagaucugauccuggagauaggcaaacucccccagcaccuaacccugcgggcccagaacgcccuagacaacuuggugauguugcacaacagugaacagggagggaaggcguaccggcacgcaauggaggagcuaccggacaccaucgagacccugaugcuguuagcccugaucgcgguacugaccgggggcgugacucuauucuuccuguccgggaagggccugggcaagaccagcaucgggcuccugugcgugauggcgaguagcgcccuucucuggauggccaacguagagccacauuggauugccgccuccauuauccuggaguucuuccugauggugcuccugaucccggagcccgaccggcagcggacgccccaggauaaccaguuagcguacgugguaaucggccuccuguucauuauccugacgguggccgcuaaugaaauggggcuccuggagaccacuaagaaagaccugggcaucggucacguggccgccgaaucacaacaucacgccacgaugcucgacgucgaccuacggccggccuccgccuggaccuuguacgccguggccaccacuguaaucacgccgaugaugcgccacaccaucgagaacaccaccgcgaauauaucucuuaccgccaucgccaaccaagccgcaauccugaugggccuggacaaaggauggcccaucuccaagauggacaucggggucccccuucuggcgcugggcugcuauagccaggugaauccucucacccugaccgcagccguguugaugcuagucgcccauuacgcgaucaucgggcccgggcugcaggccaaggccacccgagaagcccagaagcggacggcagcggggaucaugaagaaucccaccgucgacgguaucgucgccauagaucuggaccccgucguguacgacgcgaaguucgagaagcagcucgggcagauuaugcuucuuauccucugcaccucccagauccuccugaugcgcaccacgugggcccucugcgagagcaucacgcuggccaccgguccacugaccacguuaugggagggcucccccggcaaguuuuggaacaccaccauagcagucagcauggcaaacaucuuccggggcuccuaucuggccggcgccggacuggccuucagccucaugaagucccuaggagggggccgucgggggaccggcgcgcagggcgagacgcugggggagaaguggaagcgccagcucaaccagcugagcaagagcgaguucaacaccuacaagcgguccggcaucauggaggucgaccgcagcgaggccaaagagggacuaaagcggggcgagaccaccaagcacgccgugucccgcgggaccgccaagcuccggugguucguggaacgcaaucuggucaaacccgagggaaagguaauagaccugggcugugggagaggcggguggagcuacuacugcgcgggccugaagaaagugaccgagguaaagggguauaccaagggcggccccgggcacgaggagcccaucccgauggccacauacggguggaacuuggugaagcuguacuccgggaaagacguuuucuucacgccgcccgagaagugcgacacgcugcucugcgacaucggcgagagcucuccgaaccccacuaucgaggaggggcgcacccugcggguucuuaaaaugguagagcccuggcuccguggcaaccaguucugcaucaaaauccugaaccccuacaugccgucugucguugagacccuggaacagaugcagcggaagcacggagggaugcuggugcguaauccccuguccagaaauuccacgcacgagauguacuggguguccugcggcacagggaacaucgugagcgccguuaacaugaccucccgcaugcuguuaaaccgcuucacgauggcccaucggaagcccacguacgagcgcgacguggaccugggcgccggcacacgccacgucgcgguugaacccgaaguagccaacuuagacaucauuggccagcgcauugagaauaucaagaacgagcacaagagcaccuggcauuacgaugaggacaacccauauaagaccugggccuaccacggcuccuacgaagucaagcccagcgggagcgccucguccauggugaacggcguggucaggcucuuaacgaagcccugggaugugauucccauggucacccaaaucgccaugaccgacaccacgccguucgggcagcagcgcguguucaaagagaagguggacacccggacgccccgggcgaagcggggcaccgcccaaaucauggaggucacggccaaguggcuguggggcuuccucagccgaaauaagaagccccggaucugcacgagagaagaguucaccagaaagguccgcuccaacgccgccauuggggcgguuuucguugaugagaaccaguggaacuccgccaaagaggccguggaggacgagcgguuuugggaccuggugcaccgcgagcgggagcugcacaagcagggcaaaugcgcgaccugcgucuacaacaugaugggaaagcgagaaaagaagcucggcgaguucggaaaggcgaagggaagccgggcaaucugguacauguggcugggagcccgauucuuggaguucgaagccuuaggguucaugaaugaggaccacugguucucccgugaaaauucguucuccggcguggagggggagggacugcacaagcuggguuauauccucagggacaucucuaaaauaccggguggcaacauguaugcugacgacacugcggggugggacacacgcaucaccgaagacgacuuacagaacgaggccaagaucaccgacaucauggagcccgagcaugcccucuuagccacguccaucuucaagcugaccuaucaaaauaagguggugcgggugcagcgccccgccaagaacggcaccguaauggacgucaucagcaggcgcgaccaacgggggucaggccaaguggguaccuacggguugaacacguucaccaacauggagguucagcucauccgccagauggagagugaaggcaucuuucugccauccgagcuugagaccccaaaccucgcugaacggguacuggacugguuagaaaagcacgguaccgaacgccucaagagaauggccaucagcggagacgacuguguugugaagccagucgacgaccgcuucgccacggcccugauagcacuaaacgacauggggaaagugcggaaggauaucccucagugggagcccuccaaagguuggaacgacuggcagcaggucccguucugcagccaucacuuccaccaacucaucaugaaggacggccgcgagaucguagugcccugccgaaaccaagacgagcugguaggucgcgcgcgggucucccagggcgccggguggagccugcgcgagaccgccugcuuaggcaaauccuaugcccaaauguggcagcugauguacuuucaccggcgcgaccugcgguuagccgccaacgccaucugcagcgccgugcccguagacugggucccgacuucccgcaccaccugguccauccaugcccaccaccaguggaugacgaccgaggacaugcugagcguguggaaccgcguguggaucgaagaaaaccccuggauggaggauaaaacgcacgucagcaguugggaggaggugcccuaccuggguaagcgcgaggaucaguggugcggcucccucaucggccugacggcgagagccacgugggcaaccaacauccagguggccaucaaccaggucaggcgccugauagggaacgagaacuaccucgauuacaugacuagcaugaagcgguucaagaacgaauccgaccccgaaggagcccugugguga

SEQ ID NO: 24023 - RNA, 9879 nt, Artificial Sequence
  derived and/or modified CDS sequence (opt11) from DENV-1__FJ410184__SS-prME
ucagucaccaugcuacucaugcuauugcccaccgcccucgccuuccacuugaccacccggggcggggagccccacaugauagugucaaagcaagaacggggcaaaagccuccuguucaagaccagcgccgggaucaacaugugcaccuuaauugcaauggaccuuggcgagcugugugaggauacgaugacauauaagugcccucgcaucaccgaagccgagcccgacgacguagacugcugguguaacgccacugacacaugggugaccuacgguacgugcagccagaccggggagcaccggagggauaagcggucagucgcguuggcaccucacgugggcuuaggccucgagacacgcacggaaaccuggaugagcuccgagggcgccuggaaacagauccagaagguggagacuugggcccugcgccaucccggguucacgguaauugcccuguucuuagcgcaugcuauuggcacuagcaucacccagaaggggaucaucuuuauacugcugaugcucgucaccccaucaauggccaugcgcuguguugguauaggcaaucgggacuuugucgaaggucucagcggcgcgacauggguggacgucguccuggagcacggauccugcgugacuaccauggcgaaggacaagcccacucuagacaucgaguuacugaaaaccgaaguaaccaaccccgcgguccuccgcaagcucuguauagaggcgaagauuucuaacaccaccacggauucccggugccccacccaaggcgaggccacccugguggaggagcaggacgccaauuucguguguagaaggaccuucguggaccgcggcugggggaauggcuguggccuguucgggaaggggucucugcugacgugcgccaaguucaaaugcgugaccaagcucgagggcaagaucgugcaguacgagaaucugaaauacagugucauuguaaccgugcauacgggcgaccagcaccaggucgguaacgagaccaccgagcacgguacuaucgccaccaucacgccucaggcccccacgagcgaaauacagcugacggacuacggggcccucaccuuagauugcaguccccggaccggcuuagacuucaaugagauggugcuucuaaccaugaaggagaaguccugguugguucacaagcagugguucuuagaccuuccccugccguggacuaguggggcaucuaccagccaagagaccuggaaccgccaggaucucuugguuacuuucaagacugcacacgcgaagaaacaggagguaguagugcugggcagccaagagggcgccaugcacaccgcccucaccggggccacggaaauccaaaccucgggcaccacuacgaucuucgcugggcaccugaagugccggcugaaaauggauaaguugacgcugaaaggcaugaguuacguaaugugcaccgguagcuucaaacuggagaaggagguggcggagacucagcacggcacggugcuugugcaagucaaguacgaggggaccgaugcccccugcaagauccccuucuccgcacaagacgagaaggggguaacacagaacggucgccucaucacggcuaauccgaucgugacagacaaggagaagcccgucaacaucgagaccgagccgcccuucggggaaagcuauauagucgugggcgcgggagagaaggcccuuaagcuauccugguuuaagaaggggucauccaucggcaaaauguuugaggccaccgcccgcggggcucgccggauggcgauacucggcgacaccgcgugggacuucggaagcaucgggggggucuucacguccguuggaaagcuggugcaccaaguuuucggcaccgccuacggggugcuguucagcggugugaguuggaccaugaagaucgggaucggcauccuccugaccuggcugggccucaacagccgcucaacgagccucucuaugaccugcaucgccgucgggauggugacccuguaccucgguguaaugguccaggcggacagcgggugcguuaucaacuggaagggccgcgagcuaaagugcggaucgggcaucuucgugaccaacgagguccacacguggacugagcaguacaaauuccaggcggauagcccaaaacggcugagcgccgccaucgggaaggccugggaagaggggguguguggcauacgcucggcaacccggcuugagaacaucauguggaagcagaucagcaacgaacugaaccacauucugcucgaaaacgacaugaaauucacgguggucgugggugacgcgaacgguauccuggcucagggcaagaagaugauucgcccccagccgauggagcaccguuacuccuggaaauccuggggcaaagccaagaucaucggcgcugacauccaaaacaccacguucauuaucgacgggcccgacaccccggagugccccgacgaccaacgugcguggaauaucugggaaguggaggacuacggauucgggauauucaccaccaauaucugguugaagcuacgggacuccuacacacagaugugcgaucaccggcugaugagcgccgccaucaaggauuccaaggccguccacgcagauaugggauacuggaucgagagcgagaagaacgagacguggaaguuggcgcgggcuuccuuuaucgaggugaagaccugcaucuggcccaagagccacacgcugugguccaacggaguucuggagagcgagaugaucauccccaagaucuauggaggcccgauuucccagcacaacuaccgucccggguacuucacgcagacugccggccccuggcaucuggggaaacuagaacuggacuuugaccugugcgagggcaccacggucguaguggacgagcacugcgguaaccgggggccgagccuccgcacaaccaccgucaccggcaagaucauucacgaauggugcugccguuccugcacccugccaccucugcgcuucagaggggaggacggaugcugguaugguauggagaucaggcccgugaaggagcgggaagaaaaucucgugaagagcauggucuccgccggccugggugaaguggacagcuucagccuggguauccuuugcguguccaucaugaucgaggaggucaugcgcucacguuggucccgaaagaugcugaugaccgggacccuggccgucuuccuccugcugaucauggggcagcucacguggaacgaccugauccgacugugcaucauggucggcgcgaacgcaagcgacaggauggggaugggcacaaccuaccucgcccugauggccacuuuuaagaugcgaccaauguucgccgucggccuucucuuccggcgccuaacuucccgggaggugcugcuccugacgaucgggcugagccucguggcguccguugagcuacccaauucacuggaggaacuuggcgacggacuggccaugggcaucaugaugcugaaacuucugaccgaguuucagccccaccagcucuggaccacccuccugucccugacuuucaucaagaccacccucucucuggacuacgccuggaagacaauggcuaugguguuaucgaucgucagccuuuuucccuuaugccugucgacgacuagccaaaagacaaccuggcucccggugcugcugggcagccucgguugcaaaccccugacgauguuccucauaaccgagaacaagauuuggggccgcaagagcuggcccuugaacgaggguaucauggcgauaggaauagugagcauccuacugagcucccucuuaaagaacgaugucccccuggccgggccgcucauagccggcggcaugcugauugccugcuacguaaucucgggguccucggcggaccugagucucgagaaagccgccgaagucuccugggaagaggaggccgagcacucgggcaccucacauaacauccugguggaggugcaagaugauggcaccaugaaaaucaaagacgaggagagggacgauacccuuacuaucuugcuuaaagcgaccuuauuagccgugagcggcguauacccaaugucgauaccugccacccuguucgugugguacuucuggcagaagaaaaaacaacgcagcggggucuugugggauacccccucaccgccugaggucgagcgcgccgugcuggacgacggcaucuaccgcauccugcaaagaggccugcugggucgcagccaggugggcgucggcguguuucaagauggcgucuuucacacgauguggcaugucacccgcggggccgugcucauguaccaaggcaagcgccuggagcccagcugggcguccgucaagaaggaccugaucuccuauggcgggggguggcgguuccagggggccuggaauaccggcgaggaaguccagguaaucgcgguggagcccggcaaaaacccgaagaacguccagaccacgcccggcacauucaaaacccccgagggcgaggugggggccaucgcacuugauuucaagccgggaaccagcgguucccccaucguuaaccgcgaaggcaagauuguuggccuuuaugggaauggcguggugacgacuagcggaaccuacgugagcgccaucgcgcaagcaaagaccagucaggaggggucccuucccgagauugaagaugaggucuucaagaagaggaaccuaacgauaauggaccuccaccccgggagcgguaagacccgccgguaccugcccgccaucgugcgagaggccaucaagcggaaguuacgcacccugauccuugccccaacccgcgucguggcaucugagauggccgaagcccucaaggggaugcccauucgguaccagacgaccgcugugaaaucugagcacaccgggcgcgagaucguugaccuuaugugucacgccaccuucacgaugcgguugcuuagccccgugcgagugccgaacuacaacaugauuauaauggacgaggcgcacuuuaccgaccccgccuccaucgccgcucgugguuacaucagcaccagggucgggaugggugaggccgcagccaucuucaugaccgccacgccgcccggcucuguggaggccuuuccccagucaaaugccgugauccaggacgaggaacgggacaucccugagcgcuccuggaauagcgguuacgacuggaucaccgacuuuccggggaagaccgucugguucguaccuaguaucaagagcgggaaugacaucgcaaacuguuugcgcaagaacgggaagcgcgugauccagcugucccggaagacuuuugacacugaguaccagaagaccaagaacaaugacugggacuaugucgugaccaccgacauuagcgagaugggggccaacuuuagagccgaccgggugaucgacccgcgccggugccuaaagcccgucauccugaaagauggcccagagcgcguuauccuggccggccccaugccugugacagucgcauccgccgcccaacggagaggccgcaucggccgcaaucaaaacaaggaaggggaccaguacguauacaugggccagccccucaacaacgacgaagaccacgcacacuggaccgaggccaagauguuacuggacaacaucaauacacccgagggcaucauccccgcccucuucgagcccgagcgcgagaaguccgcugccaucgacggcgaauaccggcugcgcggggaagccagaaagaccuucgucgaacugaugagacgcggggaucugccggucuggcuguccuacaagguagcuagcgagggauuccaauacuccgacaggcgguggugcuucgacggagagcguaacaaucagguucuggaggaaaacauggacguagagaucuggacaaaggagggugagcggaagaagcuuaggccgagguggcuggaugcgcgcaccuacagcgacccccuggcccuccgugaguuuaaggaguucgccgcugggaggcggucgguuagcggcgacuugauccucgagauaggaaagcucccgcagcaucugacccugcgcgcccaaaacgcgcucgacaaccucgucaugcuucacaacucugagcaaggcgggaaggccuaucggcacgcuauggaggaacuccccgacacaaucgagacucugaugcugcucgcacugaucgccgugcuaaccgguggggugacgcucuucuuccuguccgggaaggggcugggcaaaacaucuaucgggcuccugugcgucauggccuccucugcccugcucuggauggccuccguggaaccccacuggauugccgccagcaucauccuggaguucuuccucaugguguugcucauucccgagccggaucgccagcggacgccacaggacaaucagcuggcauacgucgugaucggucuccuguucaugauccuaacaguggccgccaacgaaaugggguuacuggagaccacgaagaaggaucuggguaucggguauguagcggcggagaaccaccaccacgccaccauguuggauguagacuuacgccccgccucugcguggacccuguaugccguggcgaccacugucaucaccccaaugaugagacacaccaucgaaaacacgaccgcaaauaucucacugaccgccauagcgaaccaggccgcgauacugaugggacuggacaaggguuggcccaucuccaaaauggauaucggggugccccuccuggcacugggaugcuacucgcaggugaauccauuaacccugaccgcagccguacuaauguugguugcucacuaugcaauuaucgggccgggucuucaggccaaagccaccagagaagcccaaaaacgcacagcggcaggcaucaugaaaaaccccacgguggacggcaucguggcuaucgaccuugaccccguuguguacgaugccaaguucgagaagcagcucgggcaaaucaugcugcugauccuaugcaccucgcaaauccugcugaugcggaccaccugggcccucugcgagagcaucacccuggcgaccgggccucuaaccacccucugggagggauccccggggaaguuuuggaauacgaccaucgccgugagcauggccaacauauuccgcggcucguaucuggcaggagccgggcuggcguucagccucaugaaaucccuuggcggcggacggcgcgggaccggcgcccagggcgagacccugggugagaaguggaagagacagcucaaccagcucagcaagucugaguucaacacguacaagcgcagcgguaucauggagguugaccggagcgaggcuaaggaggggcugaagaggggcgagaccacgaagcacgcaguuucccgggggaccgcgaaacugcgcugguucgucgagcggaaucucguaaagccagagggcaaggucaucgaccuaggaugcggccgcggcggauggagcuacuacugugccggacugaaaaaagucacggaggugaagggguacaccaaaggcgggcccgggcacgaggagccgaucccuauggccaccuacgguuggaaccucgugaagcugcacucggggaaagacguauucuucacaccccccgagaagugugauacacuccucugcgacaucggcgaaucuuccccaaacccuacuaucgaagaggggcggaccuuacgcgugcugaagaugguggagcccuggcuacggggcaaccaguucugcaucaagaucuuaaaccccuacaugcccagcgucgucgagacccuggagcagaugcaacgcaaacacggcggcaugcucguccggaacccucuguccagaaauagcacccacgagauguauugggucuccugcggcacggggaauaucgugagcgcaguuaacaugaccucucggauguuacuaaaccgcuucacgauggcccauaggaaacccaccuaugaacgggaugucgaucugggcgccggaacgcgacaugucgccguagagcccgaggucgcaaaucuggacaucauugggcagcggaucgagaacaucaagaacgagcacaagucaaccuggcacuacgacgaagauaacccuuauaagaccugggcguaccacggcuccuaugagguuaagccgaguggcagcgccucauccauggucaacggcgugguucgccuccuaaccaagccuugggaugugauccccauggugacgcaaaucgcgaugacugacacaacacccuucggucaacaacggguguucaaggagaaagucgacacgcgcacuccgcgggccaaacgcggcaccgcccaaaucauggaagugaccgccaaauggcuuuggggcuuucucaguaggaacaaaaagccccguaucugcacgcgggaggaguucacucgcaaagugcgguccaaugcugcaauaggggcggucuucguggacgaaaaucaguggaacucggcaaaggaggcuguugaagacgagcgguucugggaucugguccaccgagaacgcgagcugcacaaacagggcaaaugcgcgaccuguguguauaacaugauggggaagcgggagaagaagcucggcgaguucgggaaagccaaggguagccgcgccaucugguacauguggcuuggagcccgguuccuggaguucgaagccuugggguuuaugaaugaagaccacugguuuucccgcgagaacucguuuuccggcguggagggcgagggccugcauaagcugggguacauccuccgggacaucagcaagaucccagggggcaauauguacgcggaugacacggccgggugggacacgaggaucaccgaggacgaucugcagaacgaggcuaagaucaccgacaucauggagcccgagcacgcccuucuggccaccaguaucuucaaacugaccuaucagaauaaggucgugcgagugcagcggcccgcuaagaacggcacagucauggacguuaucagcaggagagaccaacgcggguccggccaggugggcaccuacggucugaacaccuuuacgaauauggagguacagcucauccggcagauggagucagagggcaucuuccuuccauccgagcuggaaacccccaacuuagcugagaggguauuggauuggcuggagaagcacgggacggagaggcucaaacguauggccaucagcggcgacgauuguguggucaagccgguggaugaccgguucgccaccgccuuaauugcccugaacgacauggggaaggugcgcaaggauaucccccagugggagcccuccaagggcuggaaugauuggcagcagguccccuucuguagucaccacuuucaccagcucauuaugaaggacgggcgggagaucgugguaccgugccgcaaccaggaugagcuggucgggcgggcgcgggugucucagggcgccgguuggucgcugcgggagacggcgugccucgguaaguccuacgcgcaaauguggcaguugauguacuuccaccgccgggaccugagacucgcggccaacgccaucugcagcgcaguacccgucgacugggucccaaccucccgcaccaccuggagcauacacgcgcaccaccaauggaugaccaccgaagacaugcugagcguguggaaccgagucuggauugaggagaaccccuggauggaggacaagacccacguauccagcugggaggaggugccguacuuggggaagcgcgaagaccaguggugcggcucacucauaggccugaccgcccgggccaccugggccacaaacauucaggucgccauuaaccaggugcgccgacugaucggaaacgagaauuaccuugacuauaugacuagcaugaagcgcuucaagaacgaguccgaccccgagggcgcacugugguga

SEQ ID NO: 24024 - RNA, 9879 nt, Artificial Sequence
  derived and/or modified CDS sequence (opt11) from DENV-1__FJ410185__SS-prME
agcgugaccaugcuucuaaugcucuuacccacggcacucgcuuuccaccugacuacccggggcggugaaccucacaugauugugaguaagcaggaacggggaaagagccugcuguucaagacuagcguggguaucaacauguguacccugauagcgauggaucugggcgaguuaugugaggacaccaugacguacaaguguccccggaucacugaggccgagcccgaugaugucgacugcuggugcaacgcuacggauaccugggucaccuacgggaccugcucccagacuggcgagcaccgacgggauaagcgguccguggcucucgcgccccacgugggacuugggcuagagacucggaccgaaaccuggaugaguuccgagggcgcuuggaaacagauccagaaggucgagaccugggcgcuacggcacccggguuucacuguaaucgcccuguuccucgcccacgcgaucggcaccagcauaacccagaaggggaucauauucauacugcugaugcucgucacccccagcauggcgaugagaugcgucgggaucggcaaccgcgacuucguggaggggcugagcggcgccacguggguggacgugguucuggagcaugggaguugugugaccaccauggcuaaggacaagcccacuuuggauaucgagcuucugaagacggaagucaccaaccccgccgugcuacgcaaguugugcauagaagcuaagaucuccaacaccaccacggauucccgcugcccgacccaaggugaggccacccuggucgaggagcaggacagcaacuucguuugccgccggaccuucguggaccguggcugggggaacggcugcggccucuuuggcaaagggucccugcugacgugugccaaguuuaaaugcgugaccaaacucgagggaaaaaucguccaauacgagaaccugaaguacagcgucaucguuaccguucacaccggcgaccagcaccagguggggaaugagacgaccgagcauggaaccaucgcgacgaucacuccucaggcccccacguccgagauccaauugacugacuacggggcgcucacucuggacugcagccccagaaccggccuggacuucaacgagaugguccuccugacaaugaaggagaaaagcuggcuagugcacaagcagugguucuuagaucugccgcugccuuggacuagcggggccagcaccucccaggaaaccuggaaucgacaggaccuacuggugaccuucaaaaccgcccacgccaagaagcaagaagucguggugcuaggcagccaggagggcgcgaugcacaccgcacuaacgggggccacagagauccagaccuccggcaccaccacgaucuucgccgggcaccugaaaugccggcugaaaauggacaaguugacucugaagggcaugagcuacgucaugugcaccgggucguucaaacuggagaaggagguggccgagacucagcacggcacggugcuaguccaggugaaguacgaggguaccgacgcccccugcaagaucccguucucagcgcaagacgaaaagggggugacccaaaacggccgccucaucaccgcgaauccgaucgucacugacaaagagaagcccgugaacaucgaaaccgagccgccauucggcgagucauacaucgugauaggagccggcgagaaagcccugaagcugagcugguucaagaagggguccagcauugggaagauguucgaggcuaccgcccgcggcgcgcgccgaauggcaauccucggcgauacugcgugggacuuuggguccaucggcggcgucuucacguccgucgggaaacuggugcaccagguguucggcgccgcuuaugggguccuguucuccggcgucagcuggaccaugaaaauagggaucggcauccuccugaccuggcugggauugaacucccgcagcaccucuuugaguaugacgugcaucgccgucgggauggugacccuguaccucggcgugaugguacaggccgacuccggaugcgugauuaacuggaagggccgcgagcuuaagugcggcucugggaucuucgugacgaacgagguccacaccuggacggagcaguacaaguuccaggccgauucucccaaacgccugagugcggccaucggcaaggcgugggaggagggggugugcgggauccgcagcgccaccaggcucgagaacaucauguggaaacagaucucgaacgaacugaaccauauucugcucgagaacgacaugaaguucaccguugucguaggggacgccaacggcauccuggcgcagggcaagaagaugauccgcccccagcccauggagcaccgguacagcuggaaaaguuggggcaaggcgaagauaauaggcgccgauauccagaauacaaccuucaucaucgacggucccgacacgcccgagugccccgacgaucagcgagccuggaacaucugggaaguggaggacuacggcuucgggaucuucacuaccaacauauggcuuaaguugcgggacagcuauacucagaugugcgaccaccgccuuauguccgcugccaucaaagacuccaaggcaguucacgccgauaugggcuacuggaucgaaucagagaaaaacgagacguggaagcuggcccgggcgucuuuuaucgaagugaagaccugcaucuggccaaagucccacacccucuggaguaauggagugcuggaguccgagaugauaaucccgaagaucuacgggggcccgaucucccagcacaacuaccgccccggguacuucacacagacggccggcccuuggcacuuggggaagcucgagcuggacuuugaccugugcgagggcaccaccguugucguggacgagcauugcgguaaucgugggccgagucuccgcacaaccaccgucaccggaaagauuauccaugaguggugcugucggagcugcacccugccgccucugcgcuuccgaggggaggauggcugcugguacgggauggaaauccgccccgugaaggagaaagaggagaaucucgugcgguccauggugagcgccgguagcggcgagguggacuccuucagccuggggauccuguguguguccaucaugaucgaagaagucaugaggucacggugguccaggaaaaugcucaugacgggcaccuuagccgucuuccugcuucuuaucaugggacagcugaccuggaacgauuuaaucagguuauguaucauggucggcgccaaugcgagcgacaggauggggaugggcacuacguaccuugccuugauggccacguuuaagaugcggccgauguucgcugucggccugcuguucagacgccugacgucccgcgaggugcugcugcucacuaucgggcugucucuggucgccucugucgagcuccccaacagucuggaggagcugggcgacgggcucgcaaugggcaucaugaugcugaagcuccucacggaguuccagccccaucagcuguggaccacguuacucucccuaaccuucaucaagacuacucuaagccucgacuacgccuggcguacuauggccauggugcugagcaucgucagccuguucccccucuguuuaucaaccacuucgcagaagacgaccuggcugccuguguugcugggaaguuuuggcuguaagccccugacuauguuccucaucacggagaauaagaucuggggccgcaagagcuggccgcugaacgaagggauaauggccauaggcauugugucuauucugcucagcucacuccugaagaacgacgucccccuggcggguccccugaucgccggcggcaugcugauagccugcuacgugaucuccgggaguuccgccgaccucagccuagagaaggccgccgaaguguccugggaggaggaggccgagcacucgggaaccucccacaacaucuuagucgaggugcaggacgacgggaccaugaaaaucaaggacgaggaaagagacgacacgcucacaauccugcuuaaggcaacguugcuggccgugagcgguguauaccccauguccauucccgccacccucuucgucugguacuucuggcagaagaagaagcagcguucugggguccuuugggauacccccucaccacccgaagucgaacgagcgguauuagacgauggcaucuacaggauccugcagcgcggccugcucggucggagucagguaggcgucgggguguuccaggacggugucuuccauaccauguggcacgugacucggggagccguacugauguaccagggcaagcgacuggaacccuccugggcaagcgugaagaaggaccugaucuccuauggcgggggcuggcgcuuucaagggagcuggaauaccggcgaggagguacaggugaucgcaguggagccagggaagaacccgaagaacguccaaaccacucccgggacauucaagacccccgagggugaagugggggcuaucgcucucgauuucaagcccggaacaaguggcagcccuauuguaaaucgggaggagaagaucgucgggcuguacggcaacgggguggucaccacauccggaaccuacgucucugcaaucgcccaagccaaaacuagccaggaggggccucuccccgagauugaagaugagguguucaaaaagcgcaaccugacuaucauggaccugcacccgggguccgggaaaacucggcgcuaccuccccgccaucgugcgagaggcuaucaagcgcaagcugaggacucugauucucgccccaacccgagucguggccagcgagauggccgaagcgcugaagggcaugccaaucagauaccagacuaccgcggugaaguccgagcauacuggacgcgagaucgucgacuugaugugccaugccaccuucaccaugcgcuuacugaguccgguccgcguucccaacuacaacaugaucauuauggacgaggcccacuucacggaccccgcguccaucgcagccaggggguacaucagcacccgagucggcaugggggaagcagccgccaucuuuaugaccgcgacgccaccaggcuccguagaggccuucccgcagagcaacgccgugauccaggacgaggaacgcgauauaccagaacgguccuggaacagcggguacgacuggaucacagacuuccccggcaagaccguaugguuugugcccuccauuaagucgggcaacgacaucgccaacugccugcgcaagaacgggaaacgggugauccaacucucccgcaagaccuuugacaccgaguaccagaagacgaagaacaaugacugggacuacgucguaaccaccgacaucucggaaaugggcgccaauuuucgugcggaucgcgugaucgacccccgacgcugccugaaacccgucauccugaaggacgggccggaacgggugauccuugccggcccgaugcccgugacaguugccuccgccgcgcagcgacgggggcgcaucggaagaaaccagaacaaagaaggggaccaguacguguauauggggcagccacugaacaaugacgaagaccacgcccauuggacggaggccaagaugcugcucgacaacaucaacacacccgaggguaucaucccggcccuguuugagcccgagcgggagaaguccgccgcgauagacggugaauacagacugcggggugaggcacggaagaccuucgucgagcucaugcggcgcggggaucuccccgugugguuguccuacaagguggccagcgaaggcuuccaguacuccgauagacgcuggugcuucgacggggaaagaaacaaccagguccucgaggagaacauggacguggagaucuggaccaaggagggggagcgcaagaaacugcguccgcgcugguuagacgcuaggacguacagcgacccgcucgcgcucagagaguucaaggaguuugcggcgggccggcgcucggucagcggggaccugauccuugaaaucggcaaguuaccccagcaccuuacucuccgggcccaaaacgcccuggacaaucuggucaugcuucacaacagcgagcagggcgggaaagccuaccgccacgcgauggaggagcugcccgacacgaucgagacucugaugcuccuggcccugauagccgugcucacaggcggggugacgcuguuuuuccugagcggaaaggggcucgggaagacgagcaucggccugcugugcguuauggcgucgagcgcguugcuguggauggccaacguggagccccacuggauugccgccuccaucaucuuggaguucuuucuaauggugcuucugaucccggagccugacagacagagaaccccucaggacaaucagcucgccuacguagugaucgggcuccuguucaugaucuuaaccguagcggccaacgagaugggccugcucgagacuacuaagaaggaccucgggaucggccacgucgccgccgagaaccagcaccacgcaaccaugcuggacguagaucugcggccggcaagcgcauggacccucuacgcaguggccacaaccgugauaacacccaugaugcgccacaccauugagaacacgaccgcuaauauaucauugaccgcaauugcaaaccaggccgccauucugauggggcucgacaagggauggcccaucagcaagauggacauaggcgugccguugcuggcccugggcugcuacucacaagugaacccacugacccugacugcggccguucuaaugcuuguggcucacuacgccauaauaggccccggcuugcaggcgaaggcuacuagggaagcccagaagcggaccgccgccggcauaaugaagaaccccacuguggaugggaucguagcuaucgaccucgacccugugguauacgacgccaaguuugagaagcaacugggacagauaauguuacugauccugugcacgagucagauccuucucaugcgcaccaccugggcacucugcgagucaaucacacuggccacgggaccacucaccacccugugggaggggagccccgggaaguucuggaacaccacgaucgccguaagcauggcaaacaucuuccgggggagcuaccuggccggggccggccucgcguucagucugaugaaaucacucgggggcggucgccgggggacuggggcccagggggagacccuuggcgaaaaguggaagcgccagcugaaccaacuguccaaaucggaguucaacacuuacaaacgcucggguaucauggagguggaucgcagcgaggcaaaggagggacuuaagagaggggaaacgaccaagcacgccgugagucgaggcaccgccaagcugcggugguucgucgagcgaaaccuugugaagcccgaggggaaggucaucgacuuaggcugcggccgcggcgguugguccuacuacugugccggccucaagaaagucaccgaggugaagggguauacgaaaggugggccugggcacgaagaaccgauccccauggcgaccuacggguggaaccuggugaagcuguauucgggcaaggacgucuucuucaccccgcccgaaaagugcgauacccuccugugugacaucggggaguccagccccaacccgaccaucgaagagggccgcacgcugcgugugcuaaagaugguggagcccuggcugaggggaaaucaguuuugcaucaagauccugaaccccuacaugccaucggucguggagacacucgagcagaugcagcggaaacacggcggcaugcuggugcgcaacccccuuagccggaacucuacccaugagauguauugggucagcugcgggaccggcaacaucgugucagcaguuaacaugacgagcagaaugcuccugaaucgcuucaccauggcccaccggaagccaacauacgagagagacguugaucugggggccggcacucggcacguggcuguggaaccagagguagcgaacuuagacaucaucggccagaggauagaaaacaucaagaaugagcacaaguccacguggcacuacgacgaggacaaccccuacaagacgugggcguaccacggcuccuaugagguuaagccaucagguagcgccaguagcauggugaacgggguagugcggcugcugacuaagccgugggacguuauaccaauggugacccagaucgccaugacggacaccacuccauucggccaacagcgcgucuucaaggagaaggucgacacccggacaccccgggccaagagggggaccgcccagaucauggaggucacugcuaaguggcucuggggcuuucugagccgcaacaaaaagccccggaucugcacccgggaggaguucacgcggaagguucgcucuaacgcggcuauuggcgccguuuucguggacgagaaccaguggaacagcgcgaaggaggcuguggaggacgagcguuucugggacuugguccaucgcgagcgggagcuccacaaacaggggaagugugcgacaugcguguacaacaugaugggaaagcgcgagaagaagcugggggaguucggcaaggccaaaggguccagggcaauuugguacauguggcugggcgcgcgcuuucucgaguucgaggcccucgguuucaugaacgaagaccacugguucucucgggagaacuccuucagcgggguggagggggagggucuccacaaacuugguuacaucuugcgugacaucucgaagaucccaggggguaacauguacgccgacgacaccgcuggcugggacacccgcaucacugaggaugaccugcagaacgaagcgaagaucaccgacauaauggaacccgagcacgcccugcucgcgaccagcauuuucaagcugacauaccagaacaaaguagugcguguacagagaccggcaaagaacggcacggugauggacguaaucuccagacgugaucagcgggggagcggccaggucggaaccuacggccucaauaccuuuacgaacauggagguccagcugauccgccagauggaguccgaggggaucuuccugccaagcgaacucgagacuccgaaccucgcggagcgggugcuggauuggcucgagaaacauggcacugagcgccugaagcggauggcgaucuccggugacgacugcguggucaagcccguggaugaccgcuucgccacggcccugauugcacucaacgacaugggcaagguacggaaggauaucccccagugggagcccagcaaaggguggaacgacuggcagcaggucccguucuguucccaccacuuucaccagcugaucaugaaggaugggcgcgagauaguggugcccugucggaaucaggacgagcuggucggccgagcccgaguaagccagggggcgggcuggucccuccgcgaaaccgccugccugggcaagagcuacgcccagauguggcaacugauguacuuccaccggcgcgaccuccggcuggccgccaacgcgaucugcuccgccguacccguggauuggguacccacaagccgcaccacauggagcauccacgcccaccaccaguggaugacuaccgaggacaugcuguccguguggaaccgcguauggaucgaagagaauccguggauggaggacaagacgcacgugagcuccugggaggaggugccguaccuuggcaagcgugaagaccaauggugcggaagccuaaucggccugaccgcccgagcgaccugggccacuaacauccaaguagccauaaaccaagugcgccgacuuauaggcaacgagaacuaccuggacuacaugacguccaugaagcgguucaagaacgagagcgauccugagggugcccugugguaa

SEQ ID NO: 24025 - RNA, 9879 nt, Artificial Sequence
  derived and/or modified CDS sequence (opt11) from DENV-1__FJ547087__SS-prME
ucggugaccaugcugcucaugcuguugcccacggcccucgcuuuccaccuaaccaccaggggcggggagccccacaugaucguuagcaagcaagagcgggggaagagccuccuguucaagacuucggcuggggucaacaugugcaccuuaauugccauggaccugggcgagcucugcgaggauacuaugaccuacaagugcccccggauuaccgaggccgaacccgacgacguggacuguugguguaacgccacugacacgugggugaccuacggaacuugcagccaaaccggcgaacaccgacgcgacaaaagguccguggcucuggcaccccacgugggccuaggguuggagaccagaacagagaccuggaugagcuccgagggcgccuggaagcagauccagaaggucgagaccugggcucugcggcaccccggguuuacggugaucgcucuauuucuggcgcacgccaucggcaccucuaucacucagaaaggcauaaucuucauacuccuaaugcuagugacccccagcauggccaugcgcugcgucggcaucggcaaccgggacuucguggagggucugagcggagccacguggguggacgucgugcuggagcacggaagcuguguuaccaccauggccaagaacaagcccacccucgacaucgagcugcucaagacggaggugaccaaccccgcugugcuccguaagcugugcaucgaggccaagaucagcaacaccacaacugacaguagaugcccgacccagggagaggccaccuuaguggaagagcaggacgccaacuuuguaugccgccgaaccuuuguugaccgcggcugggggaacggcugcggucuauucggcaagggaucccuccugaccugcgccaaguucaagugugugaccaaacuugagggcaagaucguucaguaugagaaccugaaguacuccgugauugucaccguccacacaggggaccaacaccaaguagguaacgagacgaccgagcauggcaccaucgcgaccaucacgccgcaggcccccacgucagagauccagcugaccgacuacggcgcucucacccuggauuguagcccccggaccggcuuagauuucaacgaaauggucuuacucacgaugaaggagaaguccuggcuggugcacaagcagugguuccucgaccugccgcugccuuggacuuccggugccucaaccagccaggagacauggaaccgccaggaucuccuggugacauuuaagacugcccacgcgaagaagcaggaggucguugugcugggcucccaggagggagccaugcauaccgcccucacuggggccacggaaauucagaccagcggcaccacuacgaucuucgcuggacaucugaagugccgguuaaagauggacaagcugacauuaaagggcauguccuacgucaugugcaccgggagcuucaaacuggagaaggagguggcggaaacccagcauggcaccgugcucguccaggugaaguacgagggcaccgaugcccccuguaagauccccuucagcacccaggacgagaagggagugacucagaacggccgccuuaucacggcaaacccgauagucaccgacaaagagaagcccgugaacaucgagacggaaccacccuucggggaaucguacauuauggugggugcaggagagaaagcgcugaaacuauccugguucaagaaggggagcucaauaggcaagauguucgaggccaccgcccggggggcacgucggauggcaauccucggcgacaccgcgugggacuuugggucaauuggaggcguuuucaccucgguggggaaacucguucaccaggucuucggcaccgccuacgggguguuguucagcggcguuuccuggaccaugaaaaucgggaucggcauccuccugacguggcugggccucaacagcaggagugcgagcuuguccaugaccuguaucgcagucgggaugguuacgcuguacuuaggagugaugguccaggccgauagcggaugcgugaucaacuggaaggggcgcgagcugaaguguggguccggcaucuuugugacaaacgaaguccacacguggaccgagcaguacaaguuucaggccgacuccccgaagcggcugagcgccgccaucggcaaggccugggaggagggggugugcgguaucagguccgccacucggcucgaaaacauaauguggaagcagaucagcaaugagcugaaccacaucuugcucgagaacgacaugaaguucaccguggucguuggggaugcgaacgguauucuggcccaggggaagaagaugauccggccccaacccauggagcacaaguacuccuggaaguccuggggcaaggccaaaaucaucggcgccgacauccagaacaccaccuucaucauagacgggccugacaccccggagugcccugacgaccagcgggcguggaacaucugggagguggaggacuauggcuucggcaucuucacgaccaacaucuggcugaagcuccgagauuccuacacgcagaugugcgaucaucggcuaaugagcgccgccauaaaagacuccaaggccguccaugccgauaugggcuacuggaucgaaagugagaagaacgagacauggaaguuggcucgcgccuccuucaucgaagugaagaccugcaucuggcccaaaucucacacccucugguccaacggcgugcuagagucagagaugaucaucccgaaaaucuacgggggcccgauuucccagcacaacuacaggcccgguuauuucacgcagaccgcgggucccuggcaccuugggaagcucgagcuggacuucgacuuaugcgagggcacgaccgucgugguggacgagcacugcgggaaccgcgggcccagccuccggacuacgaccgucaccggcaagaucauccacgaauggugcugccggaguugcacgcugccaccccuccgguuccgaggggaggauggcuguugguacgggauggagauucggcccgugaaggagaaggaggagaaccucgugcgguccaugguuuccgccggcagcggcgagguggauucuuuuucccuggggauccugugcgucagcaucaugaucgaagaggucaugcggucccgcuggagccggaagaugcucaugacggguacgcuggccgucuuccugcuccugaucauggggcagcugaccuggaacgaccuaauccgccugugcauaaugguaggggcuaaugcauccgaucgcauggguauggggaccaccuaccuggcccucauggcaaccuucaagaugagaccgauguucgcagucgggcugcuguucagacgacucacaagccgcgagguguugcugcuuacgauugggcuguccuugguggcuucaguugagcuccccaacuccuuggaagagcugggcgauggccucgcuaugggcaucaugauguugaagcuccucaccgaauuccagccccaccagcuuuggaccacccugcucagccugaccuucaucaagaccacacugucccucgacuaugccuggaagacgauggcuaugguuuugagcauuguuucacucuucccccucugccugagcacgaccucccagaagaccacuuggcugccggugcuccugggcucauucgggugcaagcccuuaacgauguuccuuauuaccgagaacaaaaucuggggccggaaguccuggccucugaaugaggggaucauggcgaucggcaucguaagcauccugcuguccagcuugcugaaaaaugacgucccccucgccgggccgcuuaucgccggcggcaugcugaucgcuugcuauguaaucaguggguccagcgcggaccucucccucgagaaagcugccgaggugucgugggaggaagaggccgagcacucagguaccucgcauaacauccuggucgaggugcaggacgauggaaccaugaagauuaaagaugaggagcgggacgauacccucacgaucuuacugaaggcuacccuccuggccguguccggcgucuacccgaugagcauacccgcgacccuguuugugugguacuucuggcagaaaaaaaaacagcgguccgggguccucugggauacucccagcccgcccgaggucgagcgcgcuguacuggacgauggcauuuauagaauccugcagagaggccugcucggcaggagucaggugggcgucgggguguuccaggacggcguuuuccacacgauguggcacguaacccgcggggccguguugauguaccaggguaagcgauuagagcccuccugggccagugugaagaaggaucucaucagcuacggcgggggguggcgcuuccagggcuccuggaauaccggcgaggaggugcaggucaucgccgucgagcccgggaagaacccgaaaaacguucagaccacacccgguaccuucaagacgcccgagggggaggugggcgcgauugcccuggacuucaagcccggcacaagcgggucuccgaucgugaaccgggagggcaagauuguuggccuguacgggaacggcgugguaacuaccagugggacauacgucuccgccauagcccaagccaaggcgagccaggauggaccccuccccgagauugaggacgaaguuuucaagaagcguaaccugaccaucauggaccuacacccuggaagcggcaagacgcggagauaucuccccgcuaucgugcgggaggcaaucaaaaggaagcuacggacgcuaauccuggccccaacccgcgucguggcgagcgagauggcugaagcgcucaagggcaugccgauccgcuaccagaccacggccgucaagagcgagcacaccgggcgggagaucguugaccugaugugccacgccaccuucaccaugcgccuccuguccccggugcgggugccaaacuauaacaugaucaucauggacgaggcccacuucacugaccccgccagcaucgccgcccgcggcuacaucuccacccgggucgggaugggcgaggccgcggcgaucuucaugaccgccacgccacccggaagcguggaagcguuuccacagucuaacgccgugauccaggacgaagagcgcgacaucccggagcggucuuggaacuccggcuacgacuggauaaccgacuuccccggcaagacggucugguucgugccgagcauaaagucagggaacgauauagccaacugcuugcgcaagaacggcaagcggguuauccaguuaagccgcaagacuuucgacaccgaguaccagaagaccaaaaacaacgacugggacuacgucgugaccaccgauauauccgagaugggggcaaacuuccgggcagaccgcgugaucgacccccggcgaugccugaagccagucauuuugaaggacggccccgaacgggugauccucgccgggccgaugccagugacugucgcuagcgcugcacagcgucggggucgcaucggccggaaccaaaacaaagagggggaucaauacguguacaugggucagccccugaacaacgaugaggaucacgcacacuggacggaagcaaagaugcugcucgacaauaucaacacccccgaggggauaaucccugcacuauucgagcccgagagagaaaagagugcugccaucgacggcgaguaccgacugcgcggggaggcccgcaagaccuucgucgagcucaugcgacgcggcgacuugcccguguggcugucguacaaaguugcuuccgaaggcuuccaguauagcgaccgccgauggugcuuugacggcgagcgaaauaaccagguacuugaagagaacauggauguagagaucuggacaaaggagggggagcgcaagaagcugcggccccgcuggcuagacgcacgcacuuacuccgacccgcuugccuugcgcgaguucaaggaguucgccgccggccggcgcagcguuuccggcgaccugauccucgagaucgggaagcugccccagcaccugaccauucgggcccagaacgcgcucgacaaccucgucauguugcacaacuccgagcagggcggaaaagccuaucgccacgccauggaagaacuccccgacaccaucgaaacccugaugcuacuagcucugaucgcggugcugaccggcggcgugacccuguucuuucugagugggaagggcuugggcaagacgucuaucgggcuccugugcgucauggccagcucagcccuacucuggauggccuccguggagccacacuggauagccgcguccauaauucuggaguucuuccuuauggugcuccugaucccggagcccgaccggcaacgcacgccacaggauaaccagcuggccuacguugugaucggccuccuuuucaugaucuuaaccguggccgccaacgagauggggcuucucgagacgacgaaaaaggacuuggguaucgggcauguugccgcggaaaaucaccaccaugccaccaugcucgacguggaccuucggccagccagcgccuggacccuguacgccguggcaacgacugucaucacccccaugaugcgccacaccauagagaacacaaccgccaacaucucccucaccgcgaucgccaaccaagccgcgaucuugauggguuuagacaaaggcuggcccauuucgaagauggacaucgggguaccccuccuggcucugggcugcuacagucaggugaacccccucacucugacugccgccguccugaugcucguggcgcauuaugccauaauugggcccggccugcaggccaaggccacccgggaggcgcagaaacgcacagcggcugggauuaugaagaacccaaccgucgauggcaucguugccauagaccuggacccugugguguacgacgcgaaguucgagaagcaguuaggccagaucauguugcugauacuaugcacgagccaaauccugcugaugcgcaccaccugggcucucugcgaguccaucacccuggcgacggggccgcugaccacccuuugggagggcagccccggaaaauucuggaacacaacgaucgcuguaagcauggccaacauuuuccggggcagcuaccucgccggugccgggcuggcguuuucccucaugaaguccuugggaggggggcgccgggggaccggcgcgcagggcgagacgcugggggaaaaguggaagaggcagcucaaucagcuguccaagagcgaguucaacaccuacaagcgaagcgggaucauggagguagauaggucagaggccaaggaaggccugaagcggggcgagacgacaaagcacgccgugucacgcgggaccgcgaagcuccgcugguucgucgagcgcaaccucgugaagccggagggcaaagugauagaccugggaugcggccguggcgggugguccuacuacugcgccggccugaagaaggugaccgaggucaagggguacacaaagggcggccccggucacgaagagccgaucccuauggccaccuacggcuggaaccuggugaagcugcacagcgggaaagacgucuuuuucacaccgcccgagaagugugacacccuucucugcgacaucggggaguccagcccgaaucccaccaucgaggagggccgcaccuugcgcguucugaagaugguggaacccuggcugcgcggcaaccaauucugcaucaagauuuuaaaucccuacaugccgucgguuguggaaacccuggaacaaaugcagcggaagcacggcggcaugcucgugcgcaacccccugagcaggaacucaacgcacgagauguacuggguuagcugcggcaccgggaacaucgugucagccguuaauaugacgagccgcauguugcucaaccgguucaccauggcccacaggaagccuacuuaugagcgcgacguggaucugggcgcuggcaccaggcauguugccguagagcccgagguggccaaccuggacauuauaggucagcgcauugagaacauaaaaaaugagcauaaguccacguggcacuacgacgaggacaacccguacaagacuugggcuuaccacggcuccuacgaggugaaacccuccgggagcgcauccagcauggugaacggagucgugcguuugcugaccaagccgugggaugucauccccauggucacacagaucgccaugacggauacaaccccguuugggcaacagcgcguauuuaaagagaaggucgauacaagaacuccccgcgcaaagcgggguacggcccagaucauggaggugaccgccaaauggcuauggggcuuccucuccaggaacaaaaagccccggaucugcacccgcgaagaauucacgaggaaggugcgcagcaacgccgcgauaggcgccgucuucguggaugagaaccaguggaacagcgccaaggaggccguggaggacgagcgguucugggaucugguccacagagaacgggaacugcacaagcagggcaagugugcgacgugcguguacaacaugauggggaagcgcgagaagaagcucggcgaguucgggaaggcaaagggaucccgggccaucugguacaugugguugggcgcccgcuuucuggaguucgaagcauuggguuucaugaacgaggaccauugguucagccgagagaacucgcugagcggcgucgagggcgaaggccugcacaagcucggguacauccugcgcgacaucuccaagaucccgggcggcaacauguacgcggacgauaccgcggggugggacacccguauaacggaggaugaccugcagaacgaggccaagaucaccgacauaauggagcccgaacaugccuugcuggccaccagcauuuucaagcugaccuaccagaacaaggucguccgcgugcagaggcccgcgaagaacggaacggucauggacgugauuucccgcagggaccagcgcgggagcggacaggucggaacauacgggcucaacaccuucaccaacauggagguucaacugauccgccagauggagucugagggcaucuuucugcccugcgaauuggagacgccgaaccuugccgagaggguguuagauuggcucgagaaacacggggcggagcgccuaaagcguauggccaucagcggcgacgacuguguggugaagcccaucgacgaccgguucgccaccgcucugaucgcccucaacgauaugggaaagguucggaaggacaucccccagugggagccguccaaaggcuggaacgacuggcagcaggucccuuucuguucucaccacuuccaccaacugaucaugaaggacggccgcgagaucgucgugcccugccggaaccaggacgagcugguggggcgggcccgggucucccagggcgccggguggagccuacgcgagaccgcgugccucggcaaguccuacgcgcagauguggcagcugauguacuuucaccgccgugaccuccggcuggccgcuaacgcgaucugcagcgcgguucccguggacugggucccaaccucccgcacgacauggagcauacacgcccaccaccaguggaugaccaccgaggauaugcuuuccguguggaaccggguguggauugaagagaacccguggauggaagauaagacacacgucuccagcugggaggaggugcccuaccuagggaagcgcgaggaccaguggugcggcucccugaucggguuaaccgcccgcgccaccugggccaccaacauccagguggcgauuaaccagguccggcgccucauuggaaacgagaacuaccuggacuacaugaccagcaugaagcgguucaagaacgaguccgaccccgaaggcgcccucugguga

SEQ ID NO: 24026 - RNA, 9879 nt, Artificial Sequence
  derived and/or modified CDS sequence (opt11) from DENV-1__FJ410186__SS-prME
agcguuaccaugcuguugaugcugcuaccgaccgcucucgccuuccaccugacaaccagaggaggggagccucauaugauagugagcaagcaggagcgaggcaagagucuucucuucaaaaccagcgcaggggugaacauguguacgcuuaucgccauggauuugggugagcuaugcgaagauacuaugacauacaagugcccccggaucacagagguugagcccgacgacgucgacuguuggugcaacgccaccgauacgugggugacguacgggaccugcagccaaaccggcgagcaccggcgcgacaaacgcuccguggcccuggcgccccacgucggccuggggcucgagacgcgcaccgagaccuggaugagcuccgagggcgccuggaaacagauccagaagguggaaaccugggccuuacgacacccgggguuuacuguaaucgccuuuuuccuggcucaugcgaucgggaccagcaucacccagaaggggaucaucuuuauccuucugaugcugguaacccccaguauggccaugcgcugugugggcaucggcaaucgcgacuuuguggaggggcucagcggugccacgugggucgaugugguguuggaacacggguccugcguuaccaccauggccaagaauaagccgacacuggacaucgagcuccuaaagacggaggucacaaaccccgcuguccugcgcaagcucugcauagaggcgaagaucucuaauaccaccacggacagcaggugccccacucagggggaggccacccuggucgaggagcaggacgcuaauuucgugugucgccggaccuuuguugacagggggugggggaacggcugcgggcuguuugggaaggggagccuucugacuugugccaaauucaaaugugucaccaaacuggagggcaagaucguucaguaugagaacuuaaaguacucagugaucguaaccgugcacacaggagaccaacaucagguugggaacgagacgacagagcauggaaccaucgccaccaucacaccccaggcgccgaccagcgagauccaguugaccgauuacggggcccugacuuuagacuguagcccccggaccggucuggacuucaacgagaugguguugcugacgaugaaggagaaauccuggcuggugcauaagcagugguuccuagaccucccucugcccuggacauccggagccucgacuagccaggagaccuggaaucgacaagacuuacucgucacguucaagaccgcgcacgcuaagaagcaggaggugguuguccuugguagucaagagggcgcgaugcacaccgcccuaaccggggccacagaaauccaaaccagcggcaccaccacuauauucgcaggucaccucaagugcaggcugaagauggacaagcuaacccuuaagggcauguccuacguuaugugcaccgguucguuuaagcuugagaaggagguugcugagacgcagcacggcacuguccugguccaggugaaguacgaaggcacggacgccccauguaagauaccuuuuuccacucaggacgagaaaggggucacccagaacggacgccuuauaacggccaacccgaucgugaccgacaaagaaaagccgguaaauauugagaccgagccgcccuucggcgagagcuacauuaucguaggcgcaggcgagaaggcccuaaagcuguccugguucaaaaaggggagcuccauaggcaagauguuugaagcgaccgcccgcggggcccgccgcauggccauacuaggugacacggccugggacuuugggagcaucggcggcguauucacuucuguggggaaguuaguacaccaaguguucggcacagcauacgggguguuguucagcggugucuccuggaccaugaagaucgggauaggaauccuacucacguggcucggccugaacagccgcucggcuucacucaguaugaccugcauagccguggguauggugacucuguaucugggcgucaugguucaggccgacagcgggugcguuaucaauuggaagggucgcgagcugaagugcggaagcggcaucuucgucacaaacgaggugcacacuuggacugagcaguauaaauuucaggcggacagcccgaaacggcugagcgcggccaucggcaaggcgugggaggaaggugucugcgguauccguagcgccacccgucuggagaacaucauguggaagcagaucagcaacgaguugaaucauauccugcucgagaacgacaugaaauucaccgucguggugggggacgccaacgggauccucgcgcaggggaaaaagaugaucagaccccagccaauggagcauaaguacuccuggaaguccuggggcaaggcgaagauaaucggcgcugacauucaaaacacgacuuuuaucaucgacgggccagacacgccggagugcccggacgaccagcgagcuuggaauaucugggaggucgaggacuacggcuuugggaucuucacaacgaacaucugguuaaagcuaagagacuccuacacgcagaugugcgaccaccgccuuaugucagcggccaucaaagacuccaaggcggugcacgccgacaugggguacuggaucgagagcgagaagaacgagaccuggaaacucgcccgggcgucuuucauagaaguaaaaaccuguaucuggcccaagucccacacucuuuggucaaacggcgugcucgaaagcgaaaugaucaucccgaagaucuaugggggaccgacgucacagcauaauuacagacccggguacuucacccagaccgccggaccauggcaccugggcaagcuggagcucgacuuugaccuaugcgagggcaccacgguggugguggacgaacacugcggcaacagagggccgucgcugcggacaaccaccgugacgggcaaaaucauccaugagugguguugucgcucgugcaccuuaccgccguugcgguuccgcggggaggacgguugcugguacgggauggagauacggcccgugaaggagaaagaggagaaccugguucgguccaugguguccgcugguucaggugagguggacagcuucucccucgggauccugugcgucucgaucaugaucgaggaggucaugcggucacgcuggucgcguaaaauguugaugacugggacguuagcgguguuccuacuccucauaaugggacaguugacuuggaacgaccugaucaggcucugcaucauggucggcgcgaacgcguccgacaggauggguaugggcaccaccuaccuggcccuuauggccacuuucaaaaugagaccgauguuugccgugggccuccuguuccgccggcucaccucacgcgagguccuccuguuaaccauagggcucagucugguugccuccguggaacugcccaacucccucgaagagcuaggcgauggucuggcaaugggcaucaugauguuaaaacugcuaaccgaguuccagccacaccagcucuggacuacccugcugucgcucaccuucaucaagacgacccuguccuuggacuaugccuggaagacuauggccaugguccuaagcaucgucagucuguucccacugugucucagcaccaccucucagaaaacaacauggcugccggugcuguuaggcagcuucgguugcaagcccuuaaccauguuccugauuaccgagaauaaaaucuggggccguaaguccuggccccugaacgaaggcaucauggcaaucggcaucguuagcauccugcucuccucgcuccugaagaacgacguuccuuuagcagggccccucauugcaggcggcaugcugaucgccugcuacgugaucucggguucuagcgcagacuuguccuuggagaaggccgcggaaguuagcugggaggaggaggccgagcacuccggcaccagccacaacaucuuaguggaggugcaagacgaugggacuaugaagauuaaggacgaggagcgcgacgacacucugaccauccuccuaaaggccacgcugcucgcugucagcggcguuuacccaaugagcauucccgccacccuguucgugugguacuucuggcagaagaagaagcagcgguccggcguccugugggauacgcccucgcccccugagguggagcgggcggugcuagaugacggaauauaucggauucuucagcguggauuacugggacggucccagguuggcguggggguguuccaggauggcgucuuccacaccauguggcacguuaccaggggcgcuguucucauguaccaggguaagagacuggagcccagcugggccagcgugaagaaggaccugauaagcuacggugggggauggcguuuccaggggcuuuggaacaccggugaggagguacaggucauagccgucgagccgggcaagaacccuaagaacgugcagacgaccccgggcaccuuuaaaacgcccgagggagagguaggugcgaucgcgcuggacuucaagccgggcacguccgggucuccuaucgucaaucgugaggguaaaauugugggccuuuacgggaacggcguggucaccaccuccgggacguacgugucugccaucgcccaggccaaggccucccaggaaggaccacuuccggaaauagaggacgaaguguucaaaaagcgaaaucugacgaucauggacuugcacccagggagcggcaaaacccggagauaccuccccgcuaucguccgcgaagccaucaaacgcaagcugcggaccuugaucuuggcgcccacucgcguggucgccagcgagauggcggaggcccugaagggcaugcccauccgcuaccagacaaccgccgugaaguccgagcacacggggcgggagaucguggacuugaugugucacgccaccuucacgaugcgucuacuaagcccggugcgggucccaaacuacaacaugaucaucauggacgaagcccacuucaccgacccagcguccaucgccgcucgcggcuacauaucuacccguguggggaugggcgaggccgcugcuauuuucaugaccgccacccccccgggguccguagaggccuuuccccagucaaacgcugucauccaggacgaggagcgagacauccccgagagguccuggaacaguggcuaugauuggauuaccgacuucccuggcaagaccgugugguucguuccguccaucaagucugggaacgacauagccaacugccugcgcaagaacggcaaacgggucauccagcucagcagaaagaccuuugacacggaauaccaaaagaccaagaacaacgacugggacuaugugguaacgaccgacauuucagagaugggggcgaacuuccgggcagaccgcguuaucgauccccggaggugccugaagccagugauucugaaggacgggcccgaaagagugauccuagccgguccgaugcccgucacgguggccuccgcggcucagcgccggggucgcauaggccgcaaucagaacaaggaaggggaucaguacguguacaugggacagccccugaacaacgacgaggaccaugcgcacuggacagaggcgaagauguugcucgacaauauaaacacccccgaggggaucauaccagcccuauuugaaccagagcgagagaaauccgcagccauugacggcgaguaccgccugcgcggggaggcacgaaaaaccuucguugagcucaugcgacgcggagaccuacccguauggcuguccuacaaggucgccucugaaggcuuucaguacucagaccgccgcuggugcuucgacggggaacgcaacaaccaaguccucgaggagaacauggauguggagauauggacaaaggagggugagcgcaagaagcugcguccccgcuggcucgaugcgcggacauacucggauccgcucgcgcuucgcgaguucaaggaauuugccgccggucggcgcuccgucagcggcgaccugauucucgaaauugggaagcuuccucagcaccuaacccuccgggcacagaacgcccuggauaaccuugugauguuacacaauagcgagcagggcgggaaggcauaucgccacgcaauggaggagcugccagacacaaucgaaacguuaaugcuccucgcacugauagccguccucacggggggcgucacccuauucuuccuuucggggaagggccugggaaagaccagcaucgggcugcugugcgugauggcuucaagcgcguugcuuuggauggccuccguggaaccccacuggauagccgccuccaucauccuagaauucuuccuaauggucuuacugaucccggagcccgaccggcaacgcacgccgcaggauaaccaguuagcguauguagugaucggccuguuguucaugauacuuacugucgcagcaaacgagauggggcugcuugagaccaccaagaaggaccucggcaucgggcacguggccgcagagaaccaucaucacgcgacuaugcuggacguggacuugcggccggccagugcguggacguuauacgcugucgccaccaccgugauuacgcccaugaugcgacacacgaucgagaauacuaccgcgaacauaucgcugaccgcaaucgcaaaccaggcugcaauccugaugggucuagauaagggcuggcccaucuccaagauggacaucggugugccccugcuggcgcucggcugcuacucgcaagugaacccacugacucuuaccgccgccguacucaugcuagucgcacacuacgcgauaaucggacccgggcugcaggcccgggccacacgcgaggcccagaagcgcacagccgcagggaucaugaaaaaccccaccgucgacggcaucguagcuauagaucuugaccccgugguuuaugacgccaaguucgagaaacagcuggggcagauuaugcugcugaucuugugcaccagccaaauccugcucaugaggacuaccugggcccugugcgaaagcaucacucuagccacagggccgcuaaccacccugugggaagguucgcccgggaaguucuggaauacuaccaucgcugugucuauggccaauaucuuccguggcucauaccuugccggcgccgggcuugccuucagucugaugaagucucugggcgggggccgacgcgggaccggcgcgcaaggcgaaacgcucggggagaaguggaagcggcagcuuaaccagcuguccaaguccgaguucaacacguacaaacgcagcgguaucauggagguugacaggagcgaagccaaggagggacuuaagcgcggugagaccaccaagcacgcggucagccgggggaccgcaaagcugcguugguucguggagcgcaaccuggugaagccugaaggcaagguuaucgaucugggcuguggcaggggaggguggaguuauuauugcgcgggacucaagaaggugaccgaggugaaggguuauaccaaggggggcccagggcaugaggagccuauuccgauggccacuuacggcuggaaccuagucaaacugcauucugggaaggacgucuucuucacgccacccgaaaagugcgacacccuccucugugacaucggagagagcuccccaaaccccacgaucgaggaggggcggacccugagagugcucaaaauggucgaaccguggcugcggggcaaccaguucugcaucaagauacugaacccauacaugccuagcguugucgagacccucgagcagaugcagcguaagcauggcgggaugcugguucggaacccguuaucccgcaacagcacccacgaaauguacuggguguccugcggaacgggcaacaucgugagcgccgucaacaugaccucccggaugcuccugaaccguuuuacaauggcgcacagaaagccaaccuacgagagagacguggaccugggcgccggcacgcggcacgucgcgguagagcccgagguggccaacuuggauaucaucgggcagcggauugagaacauuaaaaacgaacauaaaagcaccuggcacuacgaugaggacaacccuuacaagaccugggccuaccacggcuccuacgaagucaagccuagcgggucggcgagcuccauggucaacggcguaguccgccugcugaccaagccuugggacgugaucccuauggugacucagaucgccaugaccgacaccacgccguucggccagcagaggguauucaaggagaagguggacacgcgcacgccccgggcgaagcgcgggaccgcacagauuauggaagugacagccaagugguuauggggauuccugagcaggaacaagaaaccccgcauauguacgcgcgaggaguucacccgaaaaguccgcucgaacgcagccaucggcgcgguguuuguagacgagaaccaguggaauagcgccaaggaggccguggaagacgagcgcuuuugggaccugguacggagggaaagggaguugcacaaacagggcaagugcgcaaccugcguuuacaacaugaugggaaagagggaaaagaaguuaggggaguucgggaaagcuaagggcaguagggcuaucugguacauguggcuaggcgccagguuucucgaguucgaggcccugggcuucaugaacgaagaccacugguucucccgggagaacuccuuauccggaguagaaggugagggccuccauaagcuaggguacauccugagggauaucucgaagaucccgggcgggaacauguacgccgacgauaccgcggguugggauacgcgcaucaccgaggaugaccuccagaacgaggccaagauaacagauaucauggagcccgagcacgcacuauuggcuaccucgauauucaagcuaaccuaccagaacaaggugguccgggugcaacgccccgccaagaauggcaccgugauggaugugaucagucggcgagaucagcggggaucuggccaggucgguacuuacggucugaacaccuucacaaauauggaagugcaguugauucgccagauggagagcgaagggaucuuucuucccucugagcuagagacccccaaccucgccgagagagugcucgauuggcuggaaaaacauggggccgagcgguugaaacggauggcuauuagcggggaugacugcguggugaagccggucgacgaccgauucgccaccgcacucauugcguugaacgauauggggaagguccggaaggacauuccccagugggagcccaguaagggcuggaaugacuggcaacaggucccguuuugcagccaucacuuccaccagcugaucaugaaggacggacgcgagaucguggucccuugccguaaccaggaugaguuggugggcagagcccgggugucacagggcgccggguggagccuaagagaaacugccugucucgguaagaguuacgcucaaauguggcagcucauguacuuccacaggcgagaccugcggcuggcggccaacgccauaugcagcgccgauccggucgacugggugccaacgucccgcaccaccuggucaauccacgcgcaccaccaauggaugaccacugaagauaugcucagcguguggaaucgcgucuggauugaagaaaacccguggauggaggacaagacgcacgucuccagcugggaggaggugcccuaccuggggaaacgggaggaccaguggugcggaagucugaucggacucaccgcccgcgccacgugggcuaccaacauucaggucgccauuaaucagguucggaggcugauugggaaugagaacuaccucgacuacaugaucagcaugaagcgguucaagaacgaauccgaucccgagggcgcguugugguga

SEQ ID NO: 24027 - RNA, 9879 nt, Artificial Sequence
  derived and/or modified CDS sequence (opt11) from DENV-1__FJ410187__SS-prME
ucagugaccaugcugcucaugcuguugcccaccgcuuuagccuuucaccugaccacccgggggggggagccccacaugauuguuuccaagcaggagcgggguaagagccuccuguucaagaccuccgccgggaucaacaugugcacccugaucgccauggaccucggagagcucugcgaggacaccaugacauacaaaugcccccggaucaccgaggccgagccggacgacguggacugcuggugcaacgccacagacaccuggguaaccuacgguaccuguagccagaccggugagcaccggcgcgacaagcgguccgucgcccuagcgccccacgugggccuggggcucgaaacccgcaccgagaccuggaugagcuccgaaggcgccuggaagcagauccagaagguggagacuugggcauugaggcaccccggguucacggucacggcccuguuccucgcgcacgccaucggcaccaguauaacccagaaggggaucauuuucauacugcugauguuagugacgcccuccauggccaugcgcugcguuggcaucggcaaccgggacuucguggaggggcuuagcggugccaccuggguggauguggucuuagagcacggguccugcguaaccaccauggcaaaggacaagcccacgcucgacaucgaguuacuuaagaccgaggugaccaaccccgcgguccuccgcaagcugugcaucgaggccaaaaucagcaacaccacaaccgacagucggugcccuacccagggcgaggccacccugguggaggagcaggacagcaacuucgugugccgccggacguucgucgaccgcggcugggggaaugguugcggccucuucggcaaggggucccugcugaccugcgccaaguuuaaaugcguuaccaagcucgagggcaagaucguacaguacgagaaccuuaaguacagcgucaucgucacagugcacacgggcgaucagcaccaggucggcaaugaaaccaccgagcacggcaccaucgcaaccaucacgccccaagcgcccaccuccgagauccagcugaccgauuacggggccuuaacccuggacuguagcccgcggacgggacuggauuucaacgaaauggugcuccugacgaugaaggagaaguccuggcugguccacaagcaaugguucuuagaccugccgcugccauggaccaguggggccagcaccucccaggagacguggaaucgccaggaccuccuagucaccuucaagaccgcccacgcgaagaaacaggagguagucguacugggcucgcaagagggcgcuaugcacaccgcccucacgggagcaacagagauccagaccucagguacaaccaccauauucgccgggcaccugaagugucggcugaagauggacaagcucacccugaagggcaugagcuacgugaugugcacgggauccuucaagcuggagaaggagguagcagagacgcagcacggcaccgugcuggugcaggucaaguacgagggcaccgacgcgcccugcaagaucccauucagcgcccaggaugagaagggggugacccagaacggccgccucauaaccgcaaacccgaucgugaccgacaaggaaaagccggucaacauugagacugagccgcccuucggggagagcuacaucguggucggcgccggugagaaggcccugaaguuaagcugguucaagaagggguccagcauaggcaagauguucgaggccacggccagaggggcccgucggauggccauccucggcgacacggcgugggacuucggcucuaucggcggcguguucaccagcguggggaaguuagugcaccaggucuucggcgccgccuacggagugcuguucagcggcgugagcuggacuaugaaaauugggauuggcauccuccugaccuggcugggccucaacuccaggagcacgucccugagcaugaccugcauagccgucgggauggugacccuguaccucggcgugaugguccaagcugacuccgggugcgugaucaacuggaagggccgagagcugaagugcgggagcggcauuuuugugaccaacgagguucacacauggaccgagcaauacaaauuccaggcagacagcccuaaacggcuuuccgccgccaucggcaaggcuugggaggagggugugugcggcauccgcagcgccaccagacucgagaacaucauguggaagcagaucuccaacgagcugaaucacauccugcucgagaacgacaugaaguucaccguagucgugggcgacgcgaacggcauccuggcccagggcaagaagaugauccgcccccaacccauggagcaccgguacaguuggaaguccuggggcaaggccaagaucaucggcgccgacauacagaacagcaccuucaucaucgacgggcccgacacgccggagugccccgacgaccagagagcguggaacaucugggaaguggaagacuacggcuucgggaucuucaccaccaacaucuggcugaagcuccgggacuccuauacucagaugugugaccaccgccucaugagugccgccaucaaggacuccaaagccgugcacgccgacaugggcuacuggaucgagagcgagaagaacgagacguggaagcuggcgcgggccuccuucaucgagguuaagaccugcaucuggccuaagagccacacccucugguccaauggcgugcuggagagugagaugaucaucccgaagaucuacgggggcccgaucucucagcacaauuacaggcccggguacuucacccagacggccggacccuggcaccuggggaaguuagaacuggacuucgaccugugcgagggcaccaccgucgugguggaugagcacugcggcaacagagggccgagccuccgcaccacgaccgucaccgggaagaucauccacgaguggugcugccgguccugcacccugccgccccugcgcuuccgcggggaagauggguguugguacgggauggagauccgucccgugaaagagaaggaagagaaucucgugcggagcauggucagcgcggguuccggcgaaguugacuccuucuccuuagggauccugugugugagcaucaugaucgaggaggucaugcgcagucgguggucccgcaagaugcucaugacgggcacccuggccguuuuucugcucuuaaucauggggcagcugacuuggaacgacuugauccgccugugcaucaugguuggcgcgaacgccuccgaucggauggggaugggcaccacguaucucgcacucauggccaccuucaagaugcgaccuauguucgccgucgggcuccuguuccggcgucucacuagccgggagguacugcugcucaccaucgggcugucccugguggcgagcgucgagcuccccaacagucuggaggagcugggcgacggccucgcuaugggcaucaugaugcugaaauugcucacagaauuccaaccccaccagcuguggaccacccugcucucccugaccuucaucaagacaacccuaucccucgacuacgccuggcgaaccauggccaugguguuaagcaucgucucccuguucccgcucugccuguccaccacgucccagaaaaccaccuggcugccggugcuacugggaucuuucgggugcaaaccccugaccauguuccucaucacggagaacaagauaugggggcggaagucguggccccugaacgaggggauaauggcaaucggcaucgugagcauuuuguuaagcucccugcucaagaaugacgucccucucgccggcccgcucaucgcaggcgggaugcugaucgcuugcuacgugauuagcgguuccucugccgaccucucccuggagaaggcggcagaggugagcugggaagaggaggccgagcacucugguacaagccacaauauccuggucgaagugcaggacgaugggacaaugaagauaaaggacgaggagcgagacgauacgcucaccauccugcugaaggccacguuacuggccgugaguggcgucuaccccaugagcauccccgcgacccuguucgugugguacuucuggcagaagaagaagcagcgguccgggguccuaugggacacccccagcccgcccgaggucgaacgcgccgugcuggacgacgggaucuaccggauccugcagcgcggccugcucgggcguucccaggugggcgucgggguguuccaagacggcguguuucacaccauguggcacgucacgcgcggggccguuuugauguaccagggaaaacggcucgagcccagcugggccucugugaagaaagaccucauaucauacggaggaggcuggcgcuuccaagggagcuggaauaccggcgaggagguccaggugaucgccguggagcccgggaaaaacccgaagaacguccagaccacccccggcacguucaagacccccgagggcgaggugggggcgaucgcgcuggacuucaagcccgguaccagcggguccccgaucguaaaucgggagggcaagaucgucggccuguacgggaacggcguggugaccaccagugggaccuacgucagcgccaucgcccaggcgaagaccucccaggaaggcccucucccagagaucgaggaggagguguucaagaagcgcaaccucaccaucauggaccugcacccgggcagcggcaagacucggcgcuacuugccagcgaucgugcgggaagccaucaagcgcaagcuucgcacuuugauccucgcccccacgcgggucguggccuccgagauggcggaggcccugaaggggaugccaauccgcuaccagaccacggccgucaagagcgagcacacugggagagagaucgucgaccugaugugccacgccacuuucacuaugcgucuccuguccccggugcgggugcccaacuacaacaugaucaucauggaugaggcccacuucacggacccagcuagcaucgcggcgcgcggcuacaucuccacuagggucgguaugggcgaggccgccgcgaucuuuaugaccgcuacgccgcccgggagcguugaggcguucccccaguccaacgccgugauccaggaugaggagcgugacauacccgagcggagcuggaacuccggcuacgauuggauuacggacuuccccggcaagaccguaugguucguacccagcaucaaguccgggaacgacaucgccaacugucuucguaagaacgguaagcgggugauccagcucagccgcaagaccuucgacaccgaguaccagaagacgcggaauaacgacugggauuacguggugaccaccgacaucucagagaugggggcgaacuuccgcgccgaccgggugaucgacccccgucggugccugaaacccgucauccugaaggacggccccgagcgcguaauccucgccgggccgaugcccgugacaguggccagcgcggcacagcggcgcggacgcaucggccggaaccagaacaaggagggugaccaguacguguacauggggcagccacugaacaaugacgaggaccacgcccacuggacggaggccaaaaugcuucuggacaacauuaacacccccgaggggaucaucccagcccuauucgagcccgagcgcgagaaguccgcugccaucgacggcgaguaccggcugcgcggggaggcccggaagacuuuugucgaacucaugcgccggggagaccuacccguguggcugagcuacaagguggccagugaaggcuuccaguacucggaccgcagaugguguuucgacggcgaacggaacaaucagguacucgaggaaaacauggacguagagauauggaccaaggagggcgagcggaagaagcugcgcccccgguggcuggacgcacgcaccuacagcgacccgcuugcacugcgggaguucaaggaguucgccgccgggcgccgguccgugagcggcgaccugaucuuagagaucgguaagcugccacagcaccuuaccuugcgcgcccagaacgcuuuagacaaccuggucaugcuccacaauuccgagcagggagggaaggcguaccggcacgccauggaagaacuccccgacaccaucgaaacccugaugcuccuggcccugaucgcugugcucaccgggggagucacucuguucuuucugagcggaaagggccucggcaagaccuccaucgggcugcugugugucauggcgucuuccgcccuccucuggauggcuaacguggagccccacuggaucgccgccagcaucauacuggaguucuuucucauggugcuacugaucccggagcccgacaggcaacggacgccccaggacaaccaguuggcuuacgucgugaucggccuguuguucaugauccucaccguggccgccaaugagauggggcugcuggagacgaccaagaaggaccucggaaucggucacgucgccgccgagaaucagcaccacgcgaccaugcuggacguggaucugcgcccggccucagccuggacccucuacgccgucgcaacgaccguaaucacccccaugaugcgccacacaaucgagaacacaaccgcgaauaucagccugacggccaucgccaaccaggccgccauucugaugggccucgacaagggcuggcccaucuccaagauggauauuggggugccccugcuggcgcucggcugcuacagccaggugaauccuuugacccugacggccgcaguucucaugcugguggcacacuacgcgauaaucggacccggucugcaggccaaagccacccgcgaggcccagaagcgcacagccgccgggaucaugaagaaccccacuguggacggcaucgucgccaucgaccucgaccccguggucuaugacgccaaguuugagaagcagcugggccagaucaugcugcuuauccugugcacgucccagauucugcucaugcggaccacgugggcccugugcgagagcauuacgcuggccacggggccgcucacuacccugugggagggaucccccgggaaguucuggaacaccacgaucgcggucaguauggccaauauauuccgcggauccuacuuagccggcgcagggcucgcuuucagccugaugaagucucuggguggaggccggcgggggaccggcgcgcagggcgagacccucggcgagaaguggaagcggcagcugaaucagcuaucuaagagcgaguucaauaccuacaagcgcucuggcaucauggagguggacagaagugaggccaaagaagggcuuaagcguggcgagacgacgaagcacgccgugucccgggggacugccaagcugcgcugguucguagagcggaaccuggugaagcccgagggcaaggugaucgaccugggcugcgggagaggcggguggagcuacuacugcgcgggccucaagaagguuacugaggugaagggguacacgaagggcggccccgggcacgaggagccgauaccaauggccaccuacggcuggaacuuagugaaguuguacuccggaaaggacgucuuuuuuacgccgcccgagaagugcgacacacuccugugcgacauuggcgagucaucgccgaaccccaccaucgaggaggggcggacacugcgcguauuaaagaugguggagcccugguuacgggguaaccaauucugcauaaagauacuaaacccuuacaugccgagcgucguagagacccuggaacaaaugcagcgcaagcacggcgggauguuagugcggaacccccuuucccggaacagcacccacgagauguacuggguguccugcggcacugguaauaucgugucggcggugaacaugacgagccgcaugcuccugaaccgguucacaaugacccaccgcaagcccacguacgaacgggacgucgaccugggcgccggcacgcgccacgucgccguggagcccgagguagcgaaccucgacaucaucgggcagcgaaucgagaacaucaagaacgagcacaagagcaccuggcauuaugaugaggacaacccauauaagaccugggccuaccacggcuccuacgaggucaagcccagcggguccgcuagcuccauggugaacggcguuguucgacugcugaccaagccuugggacgucauacccauggugacccagauagccaugacugacaccacucccuucggccagcagcggguguucaaggagaaggucgacacacgcacgccccgugccaagagaggcaccgcccagauaauggaaguuaccgcgaaauggcucuggggcuuccugagccggaauaagaagccccggaucugcacgcgggaagaguuuaccaggaaggugaggucgaacgccgcuaucggggccgucuucguggacgaaaaccaguggaacagcgcaaaggaggcuguggaagacgagagauucugggaccugguccaucgggagcgcgagcuccacaagcaggguaagugugcgaccugcguguauaacaugauggguaagcgggagaaaaagcugggagaguucggcaaggccaagggcagcagggcgaucugguacauguggcugggcgccagauuucucgaguucgaggccuugggguucaugaaugaagaucacugguucucccgcgagaauagcuucuccggcgucgaaggggagggccugcacaagcucggcuauaucuugcgcgacauaucgaagaucccgggcggcaacauguacgcagacgacacugcugggugggacacgcggaucaccgaggacgaccuccagaacgaggcgaaaauaacggacaucauggagcccgagcacgcccuccuggccaccuccaucuuuaaacucacguaccagaacaagguaguacgcgugcagaggccugccaagaacggcaccguaauggaugugaucagccgccgggaucagcgcggauccggccagguaggcaccuacggguugaacaccuucacgaauauggagguccaacugauccggcagauggagagcgagggcaucuuccugccuuccgagcucgagaccccgaaucuggccgagcgcgugcuggacuggcuagaaaagcacgggaccgagcgacugaagcgcauggcgaucucuggcgacgacugcguggucaagccgguggaugaucgguucgccaccgcccugaucgcucucaacgacauggggaaagugcgcaaggacaucccucagugggaacccagcaaaggcuggaacgacuggcagcaggucccguucugcagccaccacuuccaucagcugaucaugaaggacggccgggagauaguggugcccugccgcaaccaggacgagcuggucggucgagcccgcgugucccaaggcgcaggguggagccuacgggaaacggccugccugggcaaguccuacgcccaaauguggcaacugauguacuuucaccgucgcgaccuuagacuagccgcaaacgcaaucugcagcgccgugcccgucgacugggugcccaccagccgcacgaccuggucaauccacgcccaccaccaguggaugaccacggaggacaugcugagcguuuggaaccgggucuggaucgaggaaaacccguggauggaggacaaaacucacguguccagcugggaagaggugcccuaccucgggaagcgcgaggaccaauggugcggcucccugaucgggcucaccgcccgggcgaccugggccacgaauauccaggucgccaucaaccaggugcgccgcuugaucgggaacgagaacuaccuggauuacaugaccagcaugaagcgcuucaaaaacgaguccgaccccgagggcgcccugugguga

SEQ ID NO: 24028 - RNA, 9879 nt, Artificial Sequence
  derived and/or modified CDS sequence (opt11) from DENV-1__FJ478457__SS-prME
ucaguuaccaugcuccuaaugcugcugcccaccgcgcucgccuuccaucugaccaccagagguggcgagccucauaugauagugagcaaacaggaacggggcaaaagccuccuguucaagaccucagcggggguaaacauguguacgcucaucgcuauggaccuuggagaguugugcgaggacacaaugacauacaagugcccccgcaucaccgaggccgagccagaugauguggauuguuggugcaaugccaccgacacaugggucaccuaugggaccugcagccaaacgggcgagcaccggagagacaaacgguccguggcucuggccccccacgugggccuggggcucgagacgcgcaccgagaccuggauguccuccgaaggcgcauggaagcaaauccagaagguagaaacaugggcccuacggcaccccggguucacgguuaucgcccuguuccucgcgcacgccaucggcaccagcaucacccagaaggggaucaucuucauccuguuaaugcucgucacccccuccauggccaugcgcugcguaggcaucggcaaccgggacuucguggaggggcucagcggcgccaccuggguggacguagugcuggagcacggguccugcgugacaaccauggccaagaauaagcccacccuggacaucgagcuccugaagacggaggucaccaaccccgcggugcuccgaaagcucugcaucgaggcgaagauaaguaacaccacuacggacagucggugcccgacccaaggagaagccacgcucguagaggagcaggacgccaauuucgucugucgccggacauuuguggacagggggugggggaacgggugcggccuguucggcaagggcucucugcugacuugcgccaaauucaaauguguuaccaagcucgagggcaagauuguccaacaugaaaaccuaaaguauuccgugauagugaccgugcacacaggcgaccaacaccaggugggcaaugagacgaccgagcacggcacaaucgccaccaucacgccccaggccccgacaagcgaaauacagcugaccgacuacggagcccucacccuggacugcagcccccggaccggccuggauuucaacgagaugguccuccugacuaugaaggagaaauccuggcuggugcauaagcagugguuccuggacuugccacugcccuggacguccggugccaguaccagccaggaaacguggaaccgccaggaccucuuggugacguuuaaaacagcucacgcgaagaagcaggaggucguggugcugggcucccaggagggcgcgaugcauacggccuuaacuggggccacggagauccagacgagcggcaccacuacgauauucgcggggcaccugaagugccggcugaagauggacaagcucacccugaaaggcauguccuacgucaugugcaccgggagcuucaagcuggaaaaggagguggcggaaacucagcacggcaccgucuuaguccaaguaaaguacgaggguaccgaugccccuugcaagauccccuuuuccacccaggacgagaaaggggugacgcaaaacgggcgccucaucacggcaaaccccauagugaccgauaaagagaagccggugaacaucgaaaccgagccgcccuuuggugagucguacauuguggucggugccggcgagaaggcccugaagcuaaguugguucaagaaaggaucauccauuggcaagauguucgaggcgaccgcccgaggggcccgacggauggcaauccucggcgacacggcgugggauuucgggagcauuggcggcauguucacauccguugggaagcugguucaccagguauucggcacagccuauggggugcuguucagcggcguguccuggacaaugaagaucgggauuggcauccuccugacguggcugggccucaacucccgcucgacgagccuguccaugaccuguaucgccgucgggauggugacccucuacuuagggguaaugguccaggccgacuccgggugcgugauuaacuggaaaggccgcgagcuuaagugcggguccggcauuuucgugacgaacgagguccauacguggacugagcaguacaaguuucaggccgacucaccgaagcgccugucggcggccaucggcaaggccugggaggaaggggugugcggcauccgcucugcaacacggcucgagaacaucauguggaagcagaucucaaacgaacuaaaccacauccugcucgaaaacgauaugaaguucacaguagucgugggcgacgccuccggaauccuggcccaagggaagaagaugauccgaccgcaaccaauggagcacaaauacagcuggaaaucauggggcaaggccaagaucaucggugccgauauccagaacaccacguucaucaucgacgggcccgauaccccggagugcucggaugaucaacgggcuuggaacauuugggagguggaggacuacggcuucggcauauucaccacgaacaucuggcucaaacuacgagauuccuacacccagaugugugaccaccgacugaugagcgcggccaucaaagauuccaaggcaguccacgcagacaugggcuacuggauagagagugagaagaacgagaccuggaagcuggcgcgugcgucauuuaucgagguuaagaccugcaucuggccaaagagccacacgcucuggaguaauggcgugcuggagagcgagaugaucauacccaagaucuacgggggacccauuucccaacauaacuaucgaccgggguacuucacgcagacugccggucccuggcaccuggggaagcuagagcuagauuuugaccugugcgagggcaccacggucaucguggaugaacacugcggcaaucgcggccccucucuccggaccacaaccgugacgggaaaaauuauccacgaguggugcugucgcucuugcacccugccgcccuugcgguuucgcggggaggacggcugcugguacgggauggagauacggcccgucaaggaaaaagaagaaaacuugguucgcagcauggucagcgccggcagcggcgaggucgauagcuucucccugggaauccugugcguguccaucaugaucgaggaagugaugcgguccagguggagccggaagaugcucaugaccggcacccuggccguauucuuacuccugaucauggggcagcuaacguggaacgaccucaucaggcugugcaucauggugggugcgaacgcaucagaccggauggggaugggcacgacauacuuggccuugauggccacuuucaaaaugcggccaauguucgccgucgggcugcuguucaggagacucacgagccgggagguccuuuuacucacgauaggacugucccuggucgccagcguggagcucccgaacucccuggaggaguugggggacgggcucgcaaugggcaucaugaugcugaaacuacuaaccgaguuccagccccaccagcuguggacgaccuuacucucccugaccuuuaucaaaaccacucugucccucgauuacgccuggaaaacgauggccauggcucugagcaucgucucccuguuuccccucugccuguccacuacuucccagaaaaccacgugguugcccgugcuccuuggcucguucgggugcaagccuuugaccauguuccucaucaccgagaacaagaucuggggucggaaguccuggccccugaacgaagggauaauggcgaucggaaucgucagcauccuacucagcucccuacugaagaacgacgugccccuggccggcccccugaucgccggcgguaugcugauugccuguuacgugaucuccggguccucagccgacuuaagucuggaaaaggcggccgaaguaagcugggaggaagaagccgagcacuccggcaccagccauaacauguugguggagguucaggacgacgguaccaugaaaaucaaggacgaggagcgcgacgacacuuuaaccaucuuacugaaagccacucucuuagccgucuccggcguguauccgaugagcauccccgcgacgcuguucgugugguacuucuggcagaaaaagaaacagcgguccgggguccucugggacacgcccuccccgcccgagguggagcgcgccgugcuggacgacggcaucuaccgcauccugcaacguggccuucucgggcggucccaagucgggguggggguguuccaggacggcgucuuccacaccauguggcacgugacacgcggggccguguuaauguaccagggcaagcggcucgaacccagcugggccuccguuaagaaggaucucaucagcuacggcgguggguggcguuuccagggguccuggaacaccggugaggaaguccaggugauagccguugagccggguaagaaccccaagaacgugcagacaaccccagguaccuuuaaaaccccagaaggcgaggugggggccauugcccuggacuucaagcccggaacgagcgggucccccauuguuaaccgagagggaaagaucgugggccuauacgggaacggcgucguuaccacaucugggaccuacgugagugccaucgcacaggcgaaggcgucccaagagggcccgcucccagagaucgaagaugaggucuuccguaagagaaaccugacgaucauggacuuacaccccgguagcggcaagacccgcagguaucuacccgccauugugcgcgaagccaucaagcggaagcugcgcacccugauccucgcccccacccgcguaguggcauccgagauggcagaggcccugaaagguaugccgauucgguaccagacgaccgccguaaagagcgagcacaccgggcgagagaucguggaccucaugugucaugcgaccuucacgaugcgucucuuaucccccgucagagucccgaacuauaacaugaucauaauggaugaggcucacuuuaccgaccccgccagcaucgccgcccgaggguacaucuccaccagaguaggcaugggcgaggccgcggcaauauucaugaccgccacuccgcccgggagcgucgaagccuucccgcaaucaaacgccgucauccaggacgaggagcgggacaucccagagcgcagcuggaauucugguuacgacuggaucaccgacuucccgggcaagacugugugguucgugccuagcaucaagucggggaacgacaucgccaacugccugcggaagaacggcaaacgcgucauucagcuuagccggaaaaccuucgacacggaguaccaaaagacaaagaacaacgacugggauuaugugguuaccaccgauauaagcgaaaugggggccaacuuucgcgcagaccgggucaucgacccgcgacguugucugaagcccguuauccuaaaggacggccccgagcgagugauacucgccggucccaugccggucacaguagccagcgcagcccaacggcgcggccguaucgggcggaaucagaacaaggagggggaccaguacgucuacaugggccagccccugaacaacgacgaggaccaugcucacuggacugaggccaagaugcugcucgacaacauaaacacccccgaggggaucauccccgcccuguuugagccggagagggagaaguccgccgccaucgacggcgaauaccggcuucguggggaggcacggaagacauucguagaguugaugcgcagaggcgaucugcccguguggcugagcuacaaggucgcaagugaggguuuccaguacucugaucgucgguggugcuucgauggugagcgcaacaaucaggugcuggaagagaacauggacguggagaucuggacaaaggagggcgaaagaaaaaaacugaggccgcgauggcuggacgcgcguaccuacucagacccccucgcccugcgggaguucaaggaguucgccgccgggcggcggucggucagcggcgaucugauucucgaaaucggcaagcucccgcagcaucuuacucuucgcgcacagaacgcgcuggacaaucuaguaaugcuccauaacuccgaacagggagguaaggccuaccggcacgccauggaggagcugcccgauaccaucgagacgcugaugcuccuagcccugaucgcgguguuaaccgggggggucacucuguucuucuugucggguaaggggcucgguaaaacauccauugggcugcuaugcgugauggccaguuccgccuugcuguggauggcgagcguggagccccacuggaucgccgcguccaucauccuggaauucuuccucaugguccuacucaucccggagccggaccgccagcggacgccccaggauaaccagcucgcguacguggugaucggccugcuauucaugauccucacggucgccgccaacgagauggggcugcuggaaaccaccaagaaggaccuuggcaucgggcacguggccgcggagaaucaccaccacgccaccaugcuggacguugaccugcgcccagcaucggcauggacgcucuacgcagucgcgacgacagugaucaccccgaugaugcggcacacgaucgagaacacaaccgcuaacaucucuuugaccgccauagccaaucaggccgcgauccucaugggccucgacaaagguuggcccaucucuaagauggacauaggggugccccuguuagcccucggcugcuacucccaggucaacccccugacgcugaccgccgccgugcucauguugguggcccacuacgccaucaucgggccgggccugcaggccaaggcgacccgcgaggcccagaagcgcaccgcugcggggaucaugaagaacccaacggucgacggcaucguggccaucgaccucgaccccguggucuacgaugcaaaguucgagaagcaauuaggccagaucaugcuauugauccucugcaccagccagauacugcucaugcggaccacgugggccuugugcgaauccaucacgcuagcgaccgguccccucaccacccuaugggagggcagcccgggcaaguucuggaacacgacgaucgcgguaucgauggccaacaucuucagaggcagcuaccuggcaggggccgggcuagcguucucccugaugaaaucccugggcgggggccgucgcgggacaggggcccagggggagaccuugggagagaaauggaagcgccagcugaaccaacugagcaaguccgaguucaauacuuacaaacgcucuggcaucauggagguggaccggucugaggccaaggaggguuuaaagcgcggcgagaccaccaaacacgccgucagcaggggaaccgcgaaacuacgcugguucgucgagcggaaccuggugaagcccgaaggcaaagugaucgaccugggaugcggacgcggaggcugguccuauuacugcgccggcuuaaagaagguuacggaggugaaaggguacaccaagggcgggccagggcacgaggagcccauuccuauggcuacuuacggcuggaaccugguaaagcugcacagcggcaaagacguauucuucacuccgccugagaagugugacacccuucugugcgauaucggcgagaguucccccaacccgacgauugaagaggggcggacacugcgcguguugaaaauggucgagccuugguuacgggggaaccaguucuguaucaagauccugaaccccuauaugcccuccgugguagagacccucgagcagaugcagcgaaagcacggggggaugcuuguccggaacccgcuuagccgcaauuccacacaugagauguacugggugaguugcggcacggggaauaucguuuccgccgucaauaugacuagccggauguuacucaaccgauucaccauggcccaccgcaaacccaccuaugagcgggacguugaccugggcgcgggcacgcgccacguagccgucgagccggaggucgcgaacuuagacauaaucgggcagaggauagagaacaucaagaaugagcauaagucgaccuggcacuacgacgaggacaacccuuacaagaccugggccuaccacgggagcuacgagguaaaaccguccggaagcgccaguucgauggucaacggagugguccgccugcugaccaagccuugggacgucauacccauggugacgcagaucgcgaugacggauacgacccccuuugggcagcaacgggucuucaaggagaagguugauacaaggacuccccgggccaaacggggcacggcgcagguaauggaagucaccgcgaaguggcucuggggcuuucucagucggaauaagaagccccgcaucugcacacgagaggaguucacccgcaaagugcgauccaaugccgcgauaggugcaguguucgucgacgagaaucaguggaauucugccaaggaagcuguugaagacgagaaauucugggaucuagugcacagagagcgggagcuccacaagcagggcaagugcgcgaccugcguuuacaacaugaugggaaagcgcgaaaagaaguuaggggaguucggcaaggccaagggcucccgggcuaucugguacauguggcugggagcccgcuucuuagaguuugaggcccugggguucaugaacgaagaccacugguucucgcgugagaacucgcugucgggcguggaaggggaaggacuccacaaacugggcuauauccugagggacaucuccaagauucccggaggaaacauguacgcggacgauaccgcgggcugggacacccgaauaaccgaggacgaucuccaaaacgaggcaaagauaaccgacauaauggagccggaacacgcccugcucgccaccagcaucuucaaacucacguaccaaaacaagguaguacgagugcagcgaccagcgaagaacggcaccgugauggacgucaucagucggcgcgaccagcggggcucgggccaagugggcaccuacgggcugaacacguucacaaauauggaggugcagcucauucggcagauggaaucggaaggcaucuucuugcccagcgagcuggagacucccaaccuugccgaacggguccucgacuggcuugagaagcacgggaccgagcgccugaagcggauggccaucuccggcgacgacugcguugucaagccgauugacgaccgcuucgccacggcccucaucgcgcugaacgauauggggaagguccgaaaggacauuccacaaugggagcccagcaagggcuggaacgaguggcagcaagucccauucugcagucaccacuuccaccagcugauaaugaaggacggccgcgagaucguggucccguguagaaaucaggacgagcucguggguagggccagagugucucagggggccggguggucccugcgcgagaccgccugccugggaaaaagcuacgcccagauguggcagcucauguauuuccaccggcgcgaccugcggcuagcagccaaugccaucugcagcgccguccccguggauuggguucccaccucccgaacgaccuggagcauccacgcccaccaccaauggaugacuacggaggacaugcucuccgucuggaaccggguguggaucgaggagaacccuuggauggaggacaagacccacgugaguuccugggaggaggucccguaccuggggaagcgcgaagaccaguggugcggaagccugaucgggcucaccgcacgcgccaccugggccaccaacauccaaguugcaaucaaccaggugcggcgacugaucggaaacgagaacuaccuugacuauaugaccuccaugaaacgguucaaaaacgagucggaccccgagggcgcgcuuugguga

SEQ ID NO: 24029 - RNA, 9879 nt, Artificial Sequence
  derived and/or modified CDS sequence (opt11) from DENV-1__FJ410188__SS-prME
ucggugaccaugcugcucaugcugcugcccaccgugcucgcuuuccaccugaccacuagagggggugagccgcacaugauagucagcaagcaggagcggggcaagagccucuuauucaagaccuccgccggggugaacaugugcacccugaucgccauggaccugggcgaacucugcgaggacaccaugacguacaagugcccccguaucaccgaggccgaacccgaugacguggacugcugguguaacgccaccgacacaugggucaccuacgggaccugcagccagacuggcgagcaccggagggacaagcgguccguggcccuggcgccccacgucggccuggggcucgagacgaggaccgagaccuggaugagcuccgagggggccuggaaacagauccagaagguggagaccugggcccugcggcaucccggguucacggugaucgcgcuguucuuggcccacgcaaucggcaccagcauuacccagaaggggaucaucuucauccugcugaugcuggugacccccuccauggccaugcgcugcgugggcaucggcaaccgggacuucgucgaggggcugagcggcgcgacauggguugacgugguccuggagcacggcuccugcgucaccaccauggcuaagaacaagcccacccucgacaucgagcugcugaagacggaggugaccaaccccgccgugcuccgcaagcugugcauagaggcuaagaucagcaacacgaccacggacucccggugucccacccagggcgaggccacccuggucgaggaacaggacgccaacuucgugugucgccggaccuuuguggaccgggggugggggaacggaugcggccucuucggcaaggggagccugcugacgugcgccaaguucaagugcgucaccaagcucgagggcaagaucguccagcacgaaaaccugaaguacuccgugaucgucaccguccacaccggcgaccagcaccaggucgggaaugagacgaccgagcacggcaccaucgccaccauaacgccccaggcgccaacgucagaaauacagcugaccgacuacggggcgcucacacuggacugcagcccccggaccggccuugauuucaacgagauggugcuucugacgaugaaggagaaguccuggcuggugcacaagcagugguuccucgaccugccgcugccuuggaccuccggggcuagcacgucacaggagaccuggaaccgccaggaccuccuggucacguucaagaccgcccacgccaagaagcaggagguggugguccugggcucccaggagggcgccaugcacaccgcucucaccggggccacggaaauucagacuagcggcaccaccacgauuuucgccgggcaccugaaaugccggcugaagauggacaaacucacccugaaaggcauguccuacgugauguguaccggguccuucaagcuggagaaggagguggcggagacccagcacggcaccguccugguacaggugaaguacgagggcaccgacgcgccaugcaagauacccuucuccacccaggacgagaagggggucacccagaacggccggcuaaucacggccaacccgaucgugaccgacaaggagaagcccgugaacaucgagaccgaaccgcccuucggggaguccuacauugucgugggcgcaggcgagaaggcacugaagcuguccugguucaagaagggaagcuccaucggcaagauguucgaagcuaccgcccgcggggcccgccgaauggccauccucggcgacacugccugggacuucgggagcauuggcggcauguucaccuccguggggaagcugguucaccagguguucggaaccgcguacggggugcuguucagcggcgucuccuggaccaugaaaaucggaaucggcauccuccugacguggcugggccuaaacagccgcuccacuagccuguccaugaccugcaucgcaguggggauggugaccuuguaccucggugucauggugcaggccgacagcgggugcgugaucaacuggaagggccgcgaacugaagugcggcuccggcauuuucgugacuaacgaggugcauaccuggaccgagcaguacaaguuccaggcggacagcccgaagcggcuaagcgccgcgaucggcaaggccugggaggaggggguuugcggcauccguuccgccacccggcucgagaacaucauguggaagcaaauuagcaacgagcugaaccacauccugcucgagaacgauaugaaguucaccgucguugugggggaugccucgggcauccucgcucaagggaagaagaugauccgcccccagcccauggagcacaaguacucguggaaguccuggggcaaggcgaagaucaucggcgccgacauccagaacaccacguucauaaucgacgggcccgacaccccggagugcagcgacgaccagcgggccuggaacauuugggaggucgaggacuacggcuucgggaucuucacuacgaauaucuggcugaaauuacgcgacuccuacacccagaugugcgaccaccggcugaugagcgccgcgauaaaggacucuaaggccgugcaugccgacaugggauacuggaucgagagcgagaagaacgagaccuggaagcuggcgcgcgcuucguuuaucgaggugaagaccuguaucuggcccaagagccacacgcucugguccaacggcguauuagagagcgagaugaucauccccaagaucuacgggggucccaucucccagcacaauuaccggccgggguacuuuacccagacugcgggcccauggcaccuggggaagcucgagcucgacuucgaucugugcgagggcaccacggugaucguggacgagcacugcggcaaccgcgggcccucccuccggaccaccacugucacgggcaagaucauccacgaguggugcugccgcuccuguaccuuaccgccccugcgguuccgcggggaggacgguugcugguacgguauggagauccggcccgugaaggagaaggaggagaaccucguucggagcauggucagcgccggcuccggcgagguagauagcuucuccuuagggauccugugcgugagcaucaugaucgaggaggucaugcggucgcguuggagccggaaaaugcucaugaccggcacccuggccguuuuccuacuccugaucauggggcagcugacguggaacgaccucauccgccuuugcaucauggugggcgccaacgccuccgacagaaugggaaugggcaccacguaccuggcucucauggcuaccuucaagaugcggcccauguucgccguaggacugcuguuccgccggcucacgagccgcgaggugcugcugcucaccaucgggcugucccugguggccagcguagagcugccaaauuccuuggaggagcuaggcgacgggcucgcaaugggcaucaugaugcugaagcugcucaccgaguuccagccccaucagcuguggacgacgcugcucagccugaccuucaucaagaccacccugucccucgacuacgcguggaagacgauggcuauggcccugagcaucgucucccuguuuccccuuugccuuagcaccaccucccagaagaccacguggcugcccguccuccugggcucauucggguguaagccgcugaccauguucuugaucaccgagaauaagaucugggggcggaaguccuggccccugaacgagggaauaauggccaucggcauugugagcauccugcucagcucccugcugaagaacgacgugccgcucgcggggccucugaucgccggcgguaugcugaucgccugcuacgucaucagcggguccagcgccgaccucucccuugagaaggccgcggaggugagcugggaggaggaggccgagcacuccggcacuagccacaacaugcugguggagguccaggacgacgggacgaugaagaucaaggacgaggagcgugacgacacgcucaccauccugcugaaggccacccuccuagcuguguccggcguguacccaaugagcaucccugccaccuuauucgucugguacuucuggcagaagaagaagcagcguuccgggguguuaugggacacgcccuccccgcccgagguggaacgcgcggugcuggacgacggcaucuaccggauccugcagcgcggccuguuagggcggucccaggugggcgugggagucuuccaggauggcguauuccacaccauguggcacgugacccgcggggcaguucuaauguaccagggcaagcggcuggaacccagcugggccuccgugaagaaagaccugaucucauauggagggggcuggagguuccagggaagcuggaacaccggcgaggaggugcaggucaucgccguggagcccgggaagaaccccaagaacguccagacgaccccggggaccuucaagacccccgagggcgagguuggggccaucgcccuggauuucaagccuggcacgagcggguccccuaucgugaaucgggagggcaagaucgugggccuguacgggaauggcgucgugaccaccagcgggacauacgugagcgccaucgcccaagccaaggccucccaggagggcccgcucccugagauagaggacgaggucuuccgcaagcggaaccuaacgaucauggaccugcaucccgggagcggcaaaacccgccgguaucucccggcgaucgugagagaggcuaucaagcggaaguugcgcacgcugauccucgcccccacacgcguggucgccuccgaaauggcggaggcccucaagggcaugcccauccgguaccagacgaccgccguaaagagcgagcacaccgggcgcgagaucguggaccugaugugucacgccaccuucacgaugaggcuucugucccccguccgcgugccgaacuacaauaugaucaucauggacgaggcccacuucaccgacccggcgagcaucgccgcccggggcuacaucagcacccgcguugggaugggggaggccgccgcgaucuucaugaccgcaacgccgcccgggagcgucgaggccuucccacagaguaacgccgugauccaggaugaggagcgagacauccccgagcgcagcuggaacuccggguacgacuggaucaccgacuuccccggcaagaccgugugguucguccccagcaucaagucagggaacgacaucgccaacugccugcggaagaacggcaagcgcgugauccagcucagccggaagaccuucgauaccgaguaccagaagaccaagaacaacgauugggacuaugugguuaccacugacaucuccgagaugggcgcaaacuuccgcgccgaccggguaaucgacccgcgccggugccugaagccagugauacugaaggacgggcccgagagggucauccuagccgggcccaugccggugacgguggccagcgcagcccagcggcgcggccggaucggcaggaaccagaacaaggagggggaccaguacguauacaugggccaaccccugaacaaugacgaggaucacgcccacuggaccgaggccaagaugcugcucgacaacaucaacacccccgaggggaucauccccgcacuguucgagccggagcgcgagaaguccgcggcgaucgacggggaguaccggcugagaggggaagccagaaagaccuucguggaguugaugcgccggggcgaucugcccgucuggcugagcuauaagguggccuccgagggguuccaguacagcgacagacgauggugcuuugacggggagcgcaacaaccagguguuagaggagaacauggacguggagaucuggacgaaggagggcgagcggaagaaacuccgcccccgguggcuggacgcccgcacguacagcgacccccucgcucugcgggaguucaaagaguucgcagccgggagacgguccgugagcggcgaccuuaucuuagagaucggcaaguugccgcagcaccuaacccuccgugcccagaacgcccuggacaaccuggugaugcuccauaacuccgaacagggagggaaggcguaccggcacgccauggaggaguuacccgacaccaucgagacccugaugcuccuggcacugaucgccguccuuaccggcggggugacccuguucuuccugagcgggaaagggcucggcaagaccuccaucgggcugcugugcgugauggcgagcuccgcgcuccuguggauggccagugucgagccccacuggaucgccgccuccaucauccuggaguucuuccucauggugcugcugauccccgagccggaccgacagcggacgccccaggacaaccagcucgcguacgugguuauugggcugcuauuuaugauccucacgguggccgccaacgagauggggcugcuggagaccacgaagaaggaccucggcaucgggcacguggcagccgagaaucaccaccacgcgaccaugcuggacguggaccugcgucccgcgagcgcuuggacgcucuacgccguggccaccacggugaucaccccuaugaugcggcacacgaucgagaacaccaccgcuaacauaucccugaccgccaucgccaaucaggcggcgauccugaugggccucgacaagggcuggcccaucagcaagauggacaucggggucccccugcuggcgcucggcugcuacagccaggugaacccccugacgcugaccgccgccgugcucaugcuggucgcccauuacgccaucaucgggccgggacugcaggccaaggccacccgcgaagcccaaaaacgcaccgccgcggggaucaugaagaacccaacgguggacggcauaguggccaucgacuuagacccagucguuuacgacgccaaguuugagaagcaguuaggucagaucaugcuuuugauacugugcaccagccaaauccugcucaugcgaaccaccugggcccugugcgaguccaucacgcuggcgaccgggccccucacuaccuuaugggaggggagcccggggaaguucuggaacacgaccaucgcgguguccauggccaacaucuuccguggcucuuacuuggccggcgccgggcucgccuuuucacugaugaagucccugggcgguggccggagagggaccggagcucaaggcgagacccucggggagaaguggaagcggcagcugaaucaguuaucuaaguccgaguucaacacguacaagcgcagcggcaucauggaggucgacagguccgaggcuaaggaggggcuaaagcgcggcgagacaaccaagcacgccgugagccgcgggaccgccaagcugcgcugguucguggaaaggaacuuggucaagcccgagggcaagguuaucgaucugggcugcgggcgcggcggaugguccuacuacugugcgggccucaagaaagugacggaggucaaggguuacaccaagggcggccccgggcaugaggaacccaucccgauggccaccuacggcuggaaccugguuaaacugcacagcggaaaggacguguucuucacgccgcccgagaagugugacacccuacugugcgacauaggcgaguccagccccaacccgacgauugaggaggggcgcacccugcgcguacucaagauggucgagcccugguuacgaggcaaucaauucuguaucaagauccugaaccccuacaugccauccguggucgaaacccucgagcagaugcagcgcaagcauggagggaugcuggugcggaacccgcugagccgcaauaguacacacgagauguacugggucagcugcggcacggggaacaucgucagugccgugaacaugaccucccggaugcugcugaaccgcuucaccauggcccaccgcaagcccacguacgagcgagauguggaccugggcgccggcacucgccacgucgcgguggagcccgaaguggccaaucucgacaucaucgggcagcggaucgagaacaucaagaacgagcacaagucuacauggcacuacgacgaggacaaccccuacaagacgugggccuaccauggcagcuaugaggucaaaccguccgggagcgccuccuccauggugaacggagucguucgccuguugaccaagcccugggacgugaucccaauggucacgcagaucgccaugaccgacaccacccccuucgggcagcagcggguguuuaaggaaaagguggacacacgcacccccagagcgaagcgcggcaccgcccagguaauggaggugaccgccaaguggcucuggggcuuccugagccggaacaagaagccccgcaucugcacgcgggaagaguucacccgcaaggugcggucaaacgccgcuauaggggcggucuucguggacgaaaaccaguggaacagcgccaaagaggccguggaggacgaaaaguucugggaccugguccaccgggagcgggaguuacacaagcagggcaagugcgcgaccugcguguacaauaugauggggaagcgugagaagaagcugggcgaguucgggaaggcgaagggcucccgggccaucugguacauguggcugggagcucgcuuccucgaguucgaggcccugggguucaugaacgaggaccacugguucagccgggaaaauucccugucuggcguggagggggagggccuccacaagcugggguacauccugcgcgacaucuccaagauccccggcggcaacauguacgccgacgacacugcaggaugggacacccggaucaccgaggacgaccuccagaacgaagccaagaucaccgacaucauggagccggagcacgcccuucuggccaccagcaucuucaagcucacguaucaaaacaagguggugcgcgugcagcgcccggccaagaacggcaccguaauggacgugaucucucggcgcgaccagcgggggagcggccaggucggcaccuacgggcugaacaccuucacgaacauggagguccaguugauccgccaaauggaguccgagggcaucuuccuccccucugagcuggagacccccaaccuggcggagcggguguuagacuggcuggagaagcacgggaccgagcgccugaagcggauggccaucuccggcgacgacugcguggucaagccgaucgacgaucgcuucgccaccgcccuuaucgcccugaacgacauggggaaggugcgaaaggacauaccccagugggaacccagcaagggauggaacgaguggcagcagguccccuucugcucccaccauuuccaccagcugaucaugaaggauggccgggagauagucgugccgugccggaaccaggaugagcucguggggcgcgcgcgggucagccagggagccggguggucccuccgcgagacggccugccugggcaagagcuacgcccagauguggcaguuaauguacuuccaccgccgcgaccugcggcuggccgcgaacgccaucugcagcgccgugcccguggacugggucccaaccucgaggaccaccuggaguauccacgcccaccaccaguggaugacuacggaggacaugcuauccguguggaaccggguguggaucgaagaaaaccccuggauggaagacaagacccacgucagcuccugggaggaggugccguaucucgggaagcgcgaggaccaguggugcggaagccugaucggccucaccgcgcgcgccaccugggccacgaacauccagguggcaaucaaccagguccggcgccugauagggaacgagaacuaccuggacuacaugaccucuaugaagcgguucaagaacgagagcgacccagagggcgcccucugguaa

SEQ ID NO: 24030 - RNA, 9879 nt, Artificial Sequence
  derived and/or modified CDS sequence (opt11) from DENV-1__FJ478458__SS-prME
agcguaaccaugcugcucaugcugcugccaaccgcccucgcauuucaccucacaacccggggcggugagccacacaugaucgugagcaagcaggagcggggcaagagcuugcuguuuaagaccagcgcggggaucaauaugugcacucugaucgccauggacuuaggcgagcuaugcgaggacacgaugaccuauaaauguccccggaucaccgaagccgagcccgacgacguggacugcuggugcaacgccaccgacacguggguaacauaugggaccugcagccagaccggcgagcaucggcgggacaagcgguccgucgcccuugcgccucacguuggccuggggcuagagacgcgaaccgagaccuggaugagcucugaaggagccuggaagcagauccagaagguggagaccugggcacugcggcaccccggguucacggugaccgcuuuauuccucgcgcacgccaucggcaccagcaucacccagaagggaaucauuuuuauucugcugauguugguuacgcccuccauggccaugcgcugcgugggcaucggcaaccgggacuuuguugagggucugagcggcgcaaccuggguggacgugguccuggagcacggguccugugugaccacuauggccaaggacaagccgacacucgacauagagcugcuuaagaccgaggucaccaaccccgcgauacugcggaagcugugcaucgaggccaagaucagcaacacaacgaccgauucccggugucccacgcagggcgaagcgacccuggucgaggagcaggacagcaacuucgugugccgccgcacguucguggaucgcggcugggggaacggcugcggcuuguucggcaaggggucccugcugaccugugccaaguuuaagugugucaccaagcuagagggcaagauaguccaguacgagaacuuaaaguacagcgugaucgucaccguacacacgggcgaucagcaccaaguggggaacgaaaccacagagcacggaaccaucgccaccauaacgccccaggcgcccaccuccgagauucagcugaccgacuacggggcacucacccuggacugcagccccagaacgggccuugacuuuaacgaaaugguccuccugaccaugaaggagaaguccuggcugguucacaagcagugguucuuggaccugccguugcccuggacguccggggccagcaccagucaggaaacguggaaccgccaggaucuccuggucaccuucaagaccgcccacgccaagaagcaggagguggugguucugggcagccaagagggcgcgaugcacaccgcgcucacaggggccaccgagauccagaccagcggcacuacgaccaucuucgccgggcaucugaagugcagacugaagauggacaaacucacccugaaggggaugagcuacgugaugugcaccggguccuucaaacuggagaaggagguggcggagacgcagcacggcaccguccuggugcaggugaaguacgagggcaccgacgcgcccugcaagauucccuucagcgcccaggacgagaagggggucacccagaacggcagacugaucacggccaacccgauugugaccgacaaggagaagccugugaacaucgagaccgagccgccguucggggaauccuauaucguugugggcgcuggagagaaagcacugaagcuaucgugguucaaaaaagggucuagcaucggcaaaauguucgaggcuaccgcccggggggcccgccggauggccauccuaggcgacaccgcgugggauuuuggauccaucggcggcguguucacgucugucgggaagcuggugcaccaagucuucggcgcugccuacgggguucuauucuccggcguaagcuggaccaugaagaucgggaucgggauucuccugacauggcugggccucaacucccgcagcacgucccugagcaugaccuguauugccguggggauggucaccuuguaccugggcgugaugguccaggccgauuccgggugcgucauaaacuggaagggcagggagcugaaaugcgguagcggcaucuucgugaccaacgaggugcacacguggacugagcaguacaaguuccaggcugacagccccaagcgucugagcgccgcuauaggcaaagccugggaggagggggucugcggcauccgcucggccacccggcucgagaacauaauguggaagcaaaucagcaaugagcuuaaucacauccugcuugagaaugacaugaaguucacggugguggucggggacgcgaacggaauccuagcccagggcaagaagaugauaagaccgcagcccauggagcaccguuacucauggaagucuuggggcaaagccaagaucauuggcgccgacauucagaacaccacguuuaucaucgacgggcccgacaccccggagugccccgacgaucagcgagcguggaacaucugggaaguggaggacuacggcuucgguauuuucacgaccaacaucuggcugaagcuccgggacagcuacacgcaaaugugugaccaccgccucauguccgccgccauaaaagauagcaaggccgugcacgccgacaugggcuauuggaucgaaucagagaagaacgagaccuggaagcucgcgagggccagcuucauagaggugaagacaugcaucuggccuaagucacauacccucuggaguaacggaguucucgaguccgagaugaucauccccaagaucuacgggggcccgaucagccagcauaacuaccgcccaggguacuucacacagacugcggguccguggcaccucgggaagcucgaacuggacuuugaccucugcgaaggcacuaccguaguaguggacgaacacugcgggaaccgggggccgucgcuccgcacuaccaccguuacgggcaagaucauccacgagugguguugccggagcugcacgcugccgccccugcgauuccguggggaggacggcugcugguauggcauggagauccgccccgucaaggagaaggaggaaaaccucgugcgguccaugguaagcgccggcagcggcgaggucgauuccuuuagccuagggauucugugugugucgaucaugauugaggaggugaugcgcagucgguggucccgcaagaugcucaugaccgggacgcuggcggucuuucugcuccugauaauggggcagcugacuuggaacgaccucauccgcuuguguaucauggugggcgcuaaugccagugaccggauggggaugggaaccaccuaccuggcccugauggccacauucaaaaugcgcccgauguucgcagugggccugcuguuccggaggcucacaucccgggagguacuacuacucacgaucgggcugagccucguggcguccguggagcuccccaacagccuggaggagcugggcgacgggcucgccauggguaucaugaugcucaagcuguugaccgaguuccagccccaccagcuguggaccacacugcucucccugacguucaucaagaccacgcugagucucgacuacgcuuggcgcaccauggcuaugguucucuccaucgccagccucuucccucucugccuauccacgaccagccagaagacuacauggcuccccgugcuccuggguucauuugggugcaagccccugacgauguuccucaucacagagaacaagaucuggggaagaaagucguggccucuuaaugaggggaucauggcaauaggcauaguauccauccugcuaucgagccugcugaagaacgacgugccccuagcggggccguuaaucgccggcggcaugcugaucgcaugcuacgugaucuccgggagcuccgcggaccucagccuggagaaggccgccgaagucuccugggaggaggaggccgagcacagcgguacuucccacaacauucucguggaggugcaggacgaugggaccaugaagaucaaagacgaggaacgcgacgacacccugacgauccugcugaaggccacccuguuagcggucagcggcguuuauccgauguccauccccgccacccuuuucguuugguacuucuggcagaagaaaaagcagcgaucggggguccuaugggacaccccauccccgccugagguggagcgcgccgugcuggaugacgggaucuaccggauccuucagcgcgggcuucucgggcggagccaggucgguguggguguguuccaagacggcgucuuccacacgauguggcacgugacccgcggggccgugcugauguaccaggguaagcggcucgagccauccugggcaagcgucaagaaggaccucaucagcuacggcggcgguuggcgcuuccaagguucauggaacaccggcgaggagguccaggugaucgcggucgagcccgggaagaauccgaagaaugugcagacgacgcccggcaccuucaagacccccgagggcgaggugggggcuaucgcccuggacuucaagcccggcaccucggggagcccgauugucaaccgggagggcaagaucgucggccuguaugggaauggcgucgucacuacaagcgggaccuacguuagcgcuauagcccaggccaagaccagccaagaaggaccccuccccgagaucgaggaggagguuuucaagaagcgcaaccugacgaucauggauuuacaccccgggucaggcaagacccggcgcuaccuccccgccaucguuagagaggcgaucaagcgcaaacugcguacccugaucuuagcccccacucgggugguagcguccgaaauggccgaggcccugaagggcaugcccauacgcuaucagacgacggcggugaaguccgagcacaccgggagggagauuguggaccugaugugccacgccaccuucacgaugcgccuccugagcccggugcgagucccgaacuacaacaugaucaucauggacgaggcgcacuucaccgaccccgccagcaucgcagcccggggcuacauuagcacacggguggggaugggcgaggccgcggccaucuuuaugaccgccacgccuccgggauccgucgaggccuucccccagagcaaugccgucauccaagacgaggagagagacaucccugaacggagcuggaacagcggcuacgacuggaucaccgacuuccccggcaagaccgugugguucgugccguccaucaagagcgggaaugacaucgcgaacugucuuagaaagaauggcaagcgggucauccagcucucccgaaagaccuucgacacggaguaccagaagaccaagaacaacgacugggacuacguggugacuacagacaucagcgagaugggggccaacuuccgggcagaccgagucauagacccccgcagaugccuuaagcccgugauuuugaaggacggaccagagcgggugauccucgccgggccgaugcccgucacgguggcuuccgccgcccagcgccggggccgcaucggccgcaaccaaaacaaggagggggaccaauacguguacaugggccagccgcugaacaacgacgaagaccaugcccauuggacugaagccaagaugcuucuagauaacaucaacacccccgaggggauuaucccugcguuguucgaacccgagcgcgagaagagugcggccaucgacggcgaguaccgccugagaggggaggcccggaagaccuuuguugagcucaugcgaagaggcgaccuuccugugugguuguccuacaaggucgcgagcgagggcuuccaguacuccgacaggcgcuggugcuucgacggggagcggaacaaccaagugcucgaggagaauauggacguugagaucuggacgaaggagggcgagcgcaagaaacugcgaccgcgcuggcuggaugcgcggaccuacagcgacccgcucgcccuucgcgaauucaaggaguucgccgcggggcgucgcucagucaguggcgaucugauacuugaaaucggcaagcugccccagcaccugacucuccgcgcccagaacgcgcuggacaacuuggugaugcuccacaacagcgaacagggcgggaaggccuaccgccacgccauggaggagcugcccgacaccaucgagacccugaugcuccucgcucugaucgcgguguugacaggcggagucacccuguucuucuugucugggaaggggcucggcaagacuagcaucggccuccugugugucauggccaguagcgcccuccuuuggauggccaacguagagccccacuggauagcugcguccaucauccuggaguucuuccucaugguucugcugaucccggagcccgaucgacaacguacgccucaggacaaccaguuggccuacguugugaucggccugcuauucaugauacucacgguagccgccaacgagauggggcugcuggagaccacgaagaaggaccuggguaucgggcauguugccgcggaaaaccagcaccaugccacuaugcuggacguggaccugcggccggccagcgcuuggacguuauacgccguugcgaccaccgugaucacucccaugaugcgacacacuaucgagaacaccaccgccaacaucagccugaccgccaucgcuaaccaggccgcgauccuaaugggccucgacaagggcuggcccauaagcaagauggacaucgggguaccccuucuggccuuagguugcuacagucaggucaacccgcugacgcugaccgccgccgugcuaaugcugguggcccacuaugccaucaucgguccuggccugcaggccaaggccacccgcgaggcccagaagcggacagcggccggaaucaugaagaaccccaccgucgacggcaucguggccaucgaccucgaccccgucguauacgacgcgaaauucgaaaagcagcugggccagaucaugcugcucauucucuguacgucccaaauccuucucaugaggaccaccugggccuugugcgaguccauaacgcuggcgacggggccgcucacgacccugugggaggguagccccgggaaguucuggaacacgacaauugccguuucaauggccaacaucuuucggggaagcuaucuggccggcgccggacucgcguucagccugaugaagucccugggugguggcaggcgggguaccggggcacagggcgagaccuuaggggagaaguggaagcgccagcugaaccagcuguccaagagcgaguucaacacauacaaacgguccgguaucauggagguagaccgcucugaggccaaggaggggcucaaaagaggcgagacaaccaagcaugcaguaucgcguggcacugcuaagcugaggugguucgucgagcgcaaucuggugaaacccgaggguaaggucaucgauuuaggcugcgggcguggagggugguccuauuacugcgcaggccucaagaagguaacggaagugaagggguacaccaagggcggccccggccacgaggaaccaauacccauggccaccuacggcuggaaucugguuaagcuguacagcgguaaggacguguuuuucacaccgccagaaaagugugacacccucuuaugcgacauaggcgagucaagccccaauccaaccaucgaggaagggcgcacccugcgggucuuaaagauggucgagcccugguuacgaggcaaucaguucugcaucaagauccugaaccccuacaugccguccguggucgagaccuuggagcaaaugcagcggaagcauggggggaugcuggugcgcaacccccugucuagaaacaguacccaugagauguacugggugucuuguggaacggguaacaucguuuccgccgugaacaugacgagccgaauguuacugaaccgauuuacaaugacccaucggaagccgacguacgaacgcgacguggaccugggggccggcacccggcauguggcgguugagcccgaaguggccaaccucgacauuaucggacagcguauagaaaacaucaagaacgagcacaaguccacuuggcacuacgacgaggauaacccguacaagaccugggccuaccacggcagcuacgaggugaagcccuccgguagcgccuccagcauggucaauggcguggugcggcuccugacaaagccuugggacguaauccccauggugacccagaucgccaugaccgauaccacgccguucggccagcaacgcgucuucaaagaaaagguugacacgcggacgccgagggcgaagcggggcaccgcccagaucauggaggucacagccaaguggcucuggggcuuccucucccgcaacaagaagccaaggaucugcacccgggaagaguucacccggaagguccgcaguaacgccgcgaucggggcgguguucguggacgaaaaucaguggaacuccgccaaggaggccgucgaggacgagcgguuuugggaccugguccaccgggagcgggaguugcacaaacagggcaagugugcgaccugugucuacaacaugauggggaagcgggagaagaagcugggcgaguuuggcaaggcgaaggguagucgcgccauuugguauauguggcugggugcacgcuuccuggaauuugaggccuuaggauucaugaacgaggaucacugguucagccgggagaacuccuucagcggcgucgagggggagggccugcacaagcugggguacauucugcgcgauaucuccaagaucccgggaggcaacauguaugccgacgacacggcggguugggacacccgcaucaccgaggacgaucuccagaacgaagccaagaucaccgacaucauggagcccgaacacgccuuacuggccacgagcaucuucaaguuaaccuaccagaauaagguggugcggguccaacgccccgcgaagaacggcacggugauggaugugaucucccggcgcgaucagcgugguuccggccagguuggcaccuacggacuaaacacguucacuaacauggagguucaacugauuaggcaaauggaguccgaagggaucuuccugccgagcgagcucgagaccccaaaccuggcggagcgggugcuggacuggcucgagaaacacgggaccgagcgcuugaagcggauggccaucagcggggaugauugcgucguaaagcccguggacgaccgcuucgccacggcccuaaucgccuuaaacgacauggggaaagucagaaaggacauaccccagugggaacccuccaagggcuggaacgacuggcagcaggucccguucugcucccaccacuuccaccaacugauaaugaaggauggccgugagauaguggugcccugcaggaaucaggacgagcugguagggcgcgcgcgggugagccagggcgccggguggucccuccgcgagaccgccugucuaggcaagagcuacgcccagauguggcagcuuauguauuuucaccgacgcgaucuccggcuggccgcgaacgcaauuugcuccgccguucccguugauuggguucccacgagccgcacaaccuggucuauccacgcccaccaccaguggaugacgaccgaggacauguuauccgucuggaaccgcguauggaucgaggagaacccguggauggaggacaagacccacgugaguagcugggaagagguacccuaccucgggaagcgggaggaccaguggugcggcagucucauaggacugaccgcucgcgccacuugggccacuaauauccaggucgccaucaaccaaguccggaggcuaaucgguaacgagaacuaccuugacuacaugaccuccaugaagcgguuuaagaacgagagcgacccggagggugcccugugguag

SEQ ID NO: 24031 - RNA, 9879 nt, Artificial Sequence
  derived and/or modified CDS sequence (opt11) from DENV-1__FJ410190__SS-prME
aguguuaccaugcugcucaugcugcugcccaccgcccucgcguuucacuuaaccacucgcgguggggaaccccacaugauaguauccaaacaggagcgcgggaaaagucuguuguucaaaacgucgguggggaucaacauguguacgcuuaucgccauggaccugggugagcucugcgaagacaccaugaccuacaagugcccccgaauaacugaggccgagcccgaugacguagacugcuggugcaaugcgaccgauaccuggguaacguacgggacaugcagccagacaggcgagcaccggagggacaagcgguccguagccuuagcgccccacgucggccuuggccucgaaacgaggaccgagaccuggaugagcuccgaaggcgccuggaagcagauccaaaaagucgagacgugggcacuccgucacccgggcuucacaguuauagcacuuuuucucgcacacgcgauuggcaccuccaucacccaaaaggggaucaucuucaucuugcugauguuagugaccccuuccauggccaugcgguguguaggcaucgggaacagggacuucguugaggggcugagcggcgcgaccuggguggauguggugcuggagcauggguccugcgucaccaccauggccaaagacaagcccacucucgacaucgagcugcugaagacagaggucaccaauccggcagugcuacgcaagcucugcaucgaggcuaaaaucucaaacacaacuacggacucccggugcccgacccagggagaggcaacccugguggaggaacaggauuccaacuucgugugcaggcggaccuucguggaucgcggcugggguaacggcuguggccuuuucggcaaggggaguuuacuuacgugcgcgaaguucaagugcgucaccaagcucgagggcaagaucgugcaguaugagaaccugaaguacagcguuaucgugacgguccacacuggggaucaacaucaaguggggaacgagacgaccgagcacggcaccauagccaccaucacaccccaggcucccacguccgagauucagcugaccgacuacggagcgcuuacccuggacugcagcccccggaccggccuggacuuuaacgagaugguccuccugacaaugaaggagaagucgugguugguucacaagcagugguuucucgaccugccccugcccuggaccucaggugcaucgaccucccaggagacguggaaccgccaggaccuccugguuacguuuaagaccgcccacgcuaagaagcaggaggucguuguucuaggcagccaggagggagcaaugcacacugcgcucacgggagccaccgagauccagacuucaggcacuaccacgauuuucgcugggcaucugaagugccggcugaagauggauaaacucacucugaaagguaugagcuacguaauguguaccgggucuuucaagcuggaaaaggaaguggccgagacccagcacgguacggugcugguccagguaaaguacgagggaaccgacgcccccugcaagauaccguucagugcgcaggacgaaaaaggugugacacaaaacggccgccucaucacggccaacccgauagucaccgacaaagagaagccaguuaauaucgagaccgagccgccuuucggagaguccuacauugucaucggggccggcgagaaggcuuuaaaacuuagcugguucaagaaagguuccagcaucggcaagauguuugaggcaaccgcccgaggcgcccgccggauggccauacucggggauaccgcgugggacuucggcaguaucggcggcgucuuuacgagcguaggaaaacugguccaucaggucuuuggcgccgccuacgggguguuauucuccggcgugagcuggaccaugaagaucgguauagguauccuccuaacauggcugggccucaauucacgcagcaccucccugagcaugacgugcauugcagucgggauggugacauuguaccucggcgugaugguacaagccgacuccgggugcgugauaaacuggaaaggccgggaguuaaagugugggagcggcaucuuuguuacgaaugaggugcacaccuggacggagcaguauaaauuucaagccgacagcccgaagcgucuuuccgcggccaucggcaaggcaugggaggagggcguaugcggcauccgcucugcaacccgacuugaaaacauaauguggaaacagaucuccaacgaacugaaucacauccuucuagagaacgacaugaaguucacuguggucguaggggaugcgaacgggauccuagcgcaggguaaaaagaugauacggccgcagcccauggagcacagguauagcuggaaguccuggggcaaggccaagauuauaggggccgacauccaaaacaccaccuucauuauagacggacccgacacgccggagugccccgaugaccagagagccuggaauauaugggaaguggaggauuacggcuucggaauuuuuacgacaaauaucuggcugaaacuccgggacagcuacacccaaaugugcgaccaccgccugaugagcgcggccauuaaggauagcaaggccguucacgccgacaugggcuacuggauagaguccgagaagaacgagacguggaaguuagcccgggcgagcuucaucgagguaaaaaccugcauuuggcccaagucccacacccuuuggagcaacggggugcuggaguccgaaaugaucauccccaaaauuuacggcggaccuaucagccaacacaauuaucgccccggguacuucacucagacugcaggccccuggcaccuggggaagcuggagcuggauuuugacuugugcgaggggaccaccgucguagucgacgagcacugcgggaaccgggguccgagucuccgcaccaccacuguaaccggcaagaucauccacgagugguguugccggucaugcacccugccaccgcugcgcuuccguggggaggacggaugcugguacggaauggagauccgcccugugaaggagaaggaggaaaacuuagugcgcuccaugguuagcgccggcaguggggagguagacuccuuuucuuuggggauucuuugcgugucaaucaugauagaggaagucaugcgcagccggugguccagaaagaugcucaugaccggcacccuggcuguguuccugcugcuaaucauggggcagcugaccuggaacgaccucauccgccugugcaucauggugggcgcaaacgcgucugaccggauggggauggguacgacguaccuggcauugauggccaccuucaagaugcgaccgauguuugccgucggauugcuguucagacggcucacuagcagagagguccuucugcuuaccaucggguuaagccuuguggcgaguguugagcuucccaauucgcuggaagaacugggugacggacuagccauggggaucaugaugcugaagcugcucaccgaguuccagccccaccaacuuuggaccacccugcucucgcugacauucauaaagacgacccugucccucgacuacgccuggagaacaauggcuauggugcuguccaucgugagccucuucccacuaugccugagcacgacaagccagaaaacgacguggcuccccgugcuccugggcuccuucgggugcaagccacugacgauguuucuaaucacggagaacaaaaucuggggucgcaagucauggccccugaacgaggggaucauggcaauagguaucgugucaauucugcucagcagccuucuuaagaaugacguaccccucgccgggccgcuaauugcagggggcaugcugaucgcguguuacguaaucucuggcagcagcgcagaccugagccuggagaaggccgcggaggugaguugggaggaagaagccgagcauuccggcaccucccacaacauccugguggagguacaggacgauggcacuaugaagaucaaggacgaggagcgugacgacacucucacgauacugcugaaggccacccuccucgcagugagcggcguuuacccaaugucaauccccgcuacccuguucgucugguacuucuggcaaaagaagaagcagcgaucggggguccucugggacaccccaaguccgcccgaaguggaacgcgcgguccuagacgauggcaucuaucgcauccuucaaagaggccugcucgggcguagccaagucggcgucgguguguuccaagacggcguauuccacacuauguggcacgugacccgcggggccgugcugauguaucagggcaagcgucuagagcccuccugggccucggucaagaaggaccucaucuccuacggugggggcuggcgcuuccaggggagcuggaacacaggcgaagagguccaaguuauagccguggagccaggaaagaaucccaaaaauguccagacaacccccgggacguucaaaacccccgagggggaggugggggccauugcgcucgacuucaagcccggaacgaguggaagccccaucgucaacagagaagagaaaauugugggccuguacggaaacgggguggucacuacguccggcaccuacgucucugcgaucgcucaggcuaagacaagccaagaggggccccugccggaaaucgaagacgagguguucaagaaacgcaaccugacuaucauggaccugcacccgggcagcggcaaaacgagacgcuaccucccugcaaucgugagagaggcaauuaagcgcaagcugcgcacacugauccucgccccuacccgcgucguggcgagcgagauggccgaggcgcucaagggcaugccaauccgguaccaaacgacggcgguuaagagcgagcauacugggcgcgagaucgucgacuuaaugugucaugccaccuuuaccaugcgucuccugucaccggugagagugcccaacuacaauaugaucauaauggacgaggcccacuuuacggaucccgcguccaucgcggcacguggguacauuucgacacggguugggaugggggaggccgcggccaucuucaugaccgcuacaccacccggcagcguugaggccuucccccaaucaaaugcagucauacaggacgaggaacgcgacauccccgagcgguccuggaacagcggauacgauuggaucacugauuuccccggcaagaccguaugguucguacccucaaucaagagcggcaacgacaucgcaaauugccugcgcaaaaacggcaagcgcgugauucagcuuucccgcaaaaccuuugauacggaauaccagaagacgaagaacaacgauugggacuaugucgucaccacagacaucagcgagaugggcgccaacuuucgggcggaccgcgucauugacccccggcgaugccugaagcccguaauacucaaggacgggccggagcgggugauccucgccggcccuaugcccgugacugucgcuagcgccgcgcagcgccgcgggagaaucggccgaaaucagaacaaggagggggaucaguacguuuacauggggcagccacugaacaacgacgaagaccaugcacacuggacggaggccaagaugcuucuagacaauaucaauaccccggaagguaucauccccgcucuauuugagcccgagagggagaaguccgcagcuauugauggggaguaccggcugagaggcgaggccaggaagaccuucguggaacuuaugcggcggggagaccugcccguauggcugagcuacaaaguggcaucugagggauuccaguauuccgaucgacgcugguguuucgacggggagagaaacaaucagguccuugaagagaacauggacguggagauuuggaccaaggagggggaaagaaagaagcugcggccccgcugguuggacgcccggacauacagcgacccgcuagcccuacgcgaauuuaaagaguucgccgcgggucggcgcucgguguccggggaccuuauuuuggagaucgggaaguugccccaacaccugacgcuccgggcccagaacgcacuggauaaucuggucaugcuccauaauucugagcaaggagggaaagccuacagacaugccauggaggagcugccggauacaauugagacccugauguuacuagccuuaauagccguccucaccggcgggguuacgcuguuuuuccuguccggcaaggggcucggcaagacuuccaucggccuccuguguguaauggcguccuccgcgcugcuguggauggccaacguagagccccacuggaucgccgcuuccauuauacuggaguucuuccucaugguucugcuuauaccagagcccgauaggcagcgcacgccacaagacaaccagcucgcguacguaguaaucgggcuccuguucaugauccucaccguggcggcgaacgagaugggccugcuggaaacgaccaaaaaggaccuugggaucggccauguagccgccgaaaaccagcagcacgccaccaugcuagauguggaccugcgccccgcgagcgccuggacccuauaugcgguugccacgaccgugaucacgcccaugaugcggcacaccaucgaaaacacgaccgcaaauauuucccuaaccgcgauugcuaaccaggccgccauccugauggggcucgacaaaggauggcccaucucgaagauggacaucggcgugccgcugcuggcccuaggguguuacagccagguaaauccgcugacgcuaacagccgccguucuaaugcuaguggcccauuaugccaucaucggaccuggucuccaggcgaaagccacacgcgaggcacagaaaaggaccgcugccggcaucaugaagaaucccaccguagacgggauugucgccaucgaccucgacccagugguguaugaugccaaguuugagaagcaguuaggccagauuauguuacuuauccuguguacgucccaaaucuugcugaugcgcaccacaugggcucuaugugagucaauaaccuuagcuacuggcccgcucaccacccugugggaggggaguccaggcaaguuuuggaauaccacgaucgccgucuccauggcaaacaucuuucggggaagcuaccuggcaggcgccggccucgcauucucacucaugaagucucucggaggcgggcgccggggaaccggugcgcagggagagacuuugggcgagaaauggaaacgacagcuuaaccagcuguccaagagcgaguucaacacguacaagcggagcggcaucauggaaguugaucgcuccgaagccaaggagggccucaagcgcggagagacuaccaagcacgcaguuagucggggcaccgccaaacuuaggugguucguagaacgaaaccuggucaaacccgaggguaaggucauugaucugggguguggacgcggcggguggucuuacuacugcgcugggcuaaagaaagucacagagguuaagggguauacgaagggugggccgggccacgaggagccgaucccuauggcaacauacggguggaacuuaguaaagcuguauucgggcaaggacguguuuuucacgccgcccgaaaagugcgacacgcuccugugcgacaucggggaaagcagcccgaacccuacuaucgaggaaggccgcacgcugcgggugcucaagaugguggagcccuggcuaagagggaaccaguucugcauaaagauauuaaaccccuacaugccguccgucguggaaacgcucgaacaaaugcaacggaagcacggcggaaugcuagugcgcaauccccugagcagaaacuccacacacgagauguacugggugagcugcgggaccgggaacaucguauccgcugugaacaugacgagccgaaugcuucucaaucgcuucacaauggcccaccggaagcccaccuaugagcgcgacgucgaccugggcgccggaacuaggcauguggccguggagccagagguagcgaaucucgacaucaucggccagcgcaucgaaaacaucaaaaacgagcacaagucaacguggcacuaugacgaggauaauccauacaagacgugggccuaccacgggucguacgaggugaagcccuccggcagugccucuucgauggugaacggggucgugcgguugcuuaccaagcccugggaugucauucccauggugacacagaucgccaugacggacaccaccccguucggccagcagcgcguguucaaggagaaggucgacacucggacgccgcgcgcgaagcgugguacagcgcaaaucauggaggucaccgcuaaguggcuuuggggcuuucugucccggaacaagaaaccacggauaugcacucgcgaggaguucacgagaaagguucgcucgaacgcagccauaggcgcugucuucguggacgagaaccaauggaacucugcuaaggaggccguggaagacgagcguuucugggaccuuguccaccgggagagggaauuacacaagcaaggaaagugcgcgacgugcguguauaacaugauggggaagcgcgagaagaagcugggugaguucggcaaagcaaagggaucuagagcuaucugguacauguggcuuggcgcgcgcuuccucgaguucgaggcccugggcuucaugaaugaggaccauugguucucucgggagaacucguucagcggcguggagggagaggggcugcauaagcucggguacauccuccgcgauauuuccaagauaccgggaggaaacauguaugcggacgacacugccggcugggacacccgcaucacggaagacgaccuacaaaacgaggccaaaaucaccgauaucauggagcccgagcacgcacugcuagcgacuagcaucuucaaauugaccuaccagaacaaggucgugcgggugcaacgccccgcgaaaaacgggacggugauggaugugaucagucggcgugaccaacggggcagcggacagguggggacuuauggcuuaaacaccuucacaaacauggagguucagcuaauccgccagauggaguccgaggggaucuuucugcccagugaacucgaaaccccuaaucuugccgagcgcguacuggacuggcuggaaaaacauggcacggaacgccugaaaagaauggcaauauccggggacgacugcguagucaagccgguggacgaccgcuuugccaccgcccugauagcccuuaacgacaugggaaaggugcggaaagacauaccccaaugggaacccucgaagggguggaacgacuggcagcaggucccauucuguucgcaucacuuccaccaacucaucaugaaagacggccgcgagauaguggugccgugccgaaaccaggaugagcuuguaggccgcgcgcgggugucgcagggcgcgggcuggucccuccgcgaaacagccugccugggcaaaagcuaugcccaaauguggcagcugauguacuuccaccggcgagaccuccggcuggcagccaaugcaauaugcuccgcggugccgguggacugggugcccacgagccgaaccaccuggagcauccacgcccaccaucaauggaugaccaccgaggauaugcuauccguguggaaccgcgucuggauugaggagaaccccuggauggaggacaagacucacgugucguccugggaggaaguacccuaucucggaaagcgcgaggaccaguggugcgguagccugaucggacucaccgcacgcgcgaccugggccacuaauauucaggucgccaucaaccaggugcggaggcucauugggaacgaaaacuaccuugacuauaugacguccaugaagcgguuuaagaacgagagcgaccccgagggagccuugugguga

SEQ ID NO: 24032 - RNA, 9879 nt, Artificial Sequence
  derived and/or modified CDS sequence (opt11) from DENV-1__EU482591__SS-prME
agcguuaccaugcugcucaugcugcugccgacggccuuagcguuucaccugacaacuagagggggggagccucauaugauugucagcaaacaggagaggggcaagagccuccuguucaagacaucugcgggggucaacaugugcacccucaucgccauggacuugggagagcucugcgaagacaccaugacguacaagugcccccgcauaacggaggcugagccagacgacguggacugcuggugcaacgccaccgacacauggguuacauacgggacguguagccaaacuggagagcaccggcgcgagaagcgguccguugcccuggcuccacacguaggccuagggcucgaaacccgcacggagaccuggaugaguuccgagggcgccuggaaacagauacagcggguugagacaugggcccuucggcacccuggguuuacggugaucgcguucuuccuggcgcacgcuaucggcaccagcauaacccagaagggcaucauuuucauccugcuaaugcuggugacaccguccauggcgaugcggugcgucggcauaggcaaccgcgauuuuguggaagggcucagcggcgccacguggguggacgucguacuggagcaugggucuugcgugaccacaauggccaagaacaagcccacccuggacauagagcugcugaagaccgaggucacaaaccccgcgguguuacggaagcuguguaucgaagccaagaucagcaacacaacgaccgacucccgaugcccaacgcagggugaggccacccugguagaagagcaagacgcaaacuucgucugccggcgcaccuucgucgaccgggguuggggaaacggcugcgggcuuuucggcaaggggucccuacugacgugcgccaaguucaaaugcgugacaaagcuggagggcaagaucguccaguaugagaaccucaaauauuccgugaucgugaccguccacacgggugaccagcaccagguggggaaugaaacuaccgagcacggcaccauagcgacuauuaccccucaagcccccacgucugagauccaauuaacugacuacggagccuugacccucgacugcucgccccggaccggucuggacuucaacgagaugguccugcucacgaugaaagagaaguccuggcugguccacaagcagugguuccuggaccucccgcuacccuggaccucaggugcaucuacuagccaggagacuuggaaccgucaggaccugcucgugacuuucaaaacagcccacgcgaagaagcaggagguagugguucugggcucucaggaaggcgcaaugcacaccgccuugacgggcgccacagagauccagacgaguggcaccaccacgaucuuugccgggcaccucaagugccgacuuaagauggauaaguugaccuugaagggcauguccuacgucauguguacgggguccuucaagcuagaaaaggaaguggccgagacccagcauggaacgguucugguucagguaaaguacgaggguaccgacgcgcccugcaagauaccuuucaguacccaggacgaaaagggaguaacccaaaacgggcgguuaauaaccgccaaccccaucgucaccgauaaagaaaaaccugugaacaucgaaaccgagccgccauucggggagagcuauaucguagucggcgccggagagaaggcacucaagcuguccugguucaagcgcgggagcuccauuggcaaaauguucgaagccacggcacgcggggcgcgccgaauggccauccugggggacacggcgugggacuuugguuccaucggcggcguguucaccucuguggggaagcuaguucaucagguguucgguaccgcauacgguguacucuucagcggcgucucuuggaccaugaagaucgggaucggaauacugcucacuugguuaggcuuaaacucgcgguccaccagccucucgaugaccugcaucgccguggggaugguaacccuguaucugggcgucauggugcaggccgacagugggugcgugauaaacuggaagggccgagagcugaaaugcgggucuggaauauucgucacgaacgaaguucacaccuggaccgagcaguacaaguuucaggcugauucucccaaacggcuuagcgcggcuaucggcaaggccugggaggagggagugugcggcauccguucggccacccggcuagagaacauaauguggaagcagaucagcaacgagcucaaccacauccuucuggagaacgacaugaaguucaccgucguagucggggacgcaaacgguauucucgcccaggggaagaagaugauucgcccgcagcccauggagcacaaguacucguggaaguccuggggcaaagcaaagaucaucggagccgacauccagaacacgaccuucaucaucgaugggcccgacaccccggagugucccgacggccagcgggccuggaacauaugggaggucgaggacuacggguucggcguguuuacuacaaacaucugguuaaaacugcgggacuccuacacucagaugugcgaccaccggcuuaugagcgcggccaucaaggauaguaaggccgugcacgccgauauggguuacuggauugagagugagaagaacgaaaccuggaaacuugcccgcgcguccuucauugaggucaagaccugcacguggccuaagagccacacgcugugguccaaugggguucuugagagcgagaugaucauccccaagauauacggagggccgauuucccagcauaacuaucggcccggcuacuucacucagaccgccgggcccuggcaccugggcaagcuggaacuggauuucgaccuaugcgagggcacgacaguggugguggacgagcacugugggaaccgcggcccgagccuccggaccaccacugugaccggcaagauaauccacgagugguguugcagaucgugcacccugcccccucugcgguuccgcggcgaggauggguguugguacggaauggagauccggccaguaaaagaaaaggaggaaaaccuggugcgcagcaugguauccgcgggcagcggcgaggucgauaguuucucucucggaauccugugcgugagcaucaugaucgaagaggucaugcggucccgcuggagccgcaaaaugcugaugacagggacacuagccguguuccugcuguugaucaugggccagcugaccuggaacgaccucauaagacuuugcaucauggugggggcgaaugcguccgacaggaugggcaugggcaccacauaccuggcccucauggccacguucaagaugcggccaauguucgccgucggccuccuguuccgucggcuuaccagucgagaaguccuccuacugacgaucggccucucccugguggcaagcgucgagcuaccuaacuccuuggaggagcugggggacggccuagccaugggcaucaugaugcucaagcugcugaccgaguuccagccacaucaacucuggacaacauugcugagccucaccuucgugaaaaccacccuguccuuagacuacgcauggaagaccaccgccauggcccuaucuaucgugucccuguucccccuguguuugagcaccacaucccagaaaacgacuuggcugccgguccugcucgggagcuucggaugcaagcccuuaaccauguuccugaucaccgagaacaagaucuggggccggaaaagcuggccccucaacgaaggcaucauggcgaucgggauagugucuauccugcucaguagccuccugaaaaacgaugugccccuggcuggaccucuaaucgcggggggcaugcugaucgccuguuacgucaucagcggcuccucugccgacuugucgcucgagaaggcggccgagguaucaugggaacaggaggccgaacacagcggcgcaagccacucgauccucguggagguccaggacgacgguacaaugaaaaucaaagacgaggagcgggaugacacccuuaccauacuuuugaaggccaccuuauuagcagucagcgggguguacccgaugucuaucccugcaacgcuguucguaugguacuucuggcagaagaagaagcaacggagcggggugcugugggacaccccuucaccgcccgaggucgagcgcgcaguccuggacaauggcauuuaccggauccugcagcgcggccuacugggccggagccaagugggcgugggggucuuccaagacgguguguuucacacgauguggcacgugacccgaggagccguucucauguaccagggcaagcggcuugagccaaguugggcuagcgugaaaaaggacuugaucuccuaugggggcggguggcgcuuucagggcagcuggaacacaggggaggaagugcaggucaucgcgguggaacccgggaagaacccgaaaaacguccagacaacccccggcacauucaagacgccugaaggggaggucggcgcuaucgcacucgauuuuaagcccggcaccuccgguagcccgaucgucaacagagagggcaagaucguggggcuguauggcaauggggucgugaccacuaguggcacuuacgugucagccaucgcacaggccaaggcuagccaggaggguccccuccccgaaaucgaagacgaagucuucaagaagcguaacuuaacgaucauggaccugcaccccggaucugguaagacccggcgauaccugcccgcaaucgugcgggaggccaucaagcggaagcuccgcacccuuauacuggcacccacgcggguggucgcuagugaaauggcggaagcccucaaggggaugccuauucgcuaccagaccacggcggugaaguccgagcauaccgggcgagagaucguggaccugaugugccacgcgacguucaccaugcgccugcucagcccggucagagugccuaacuacaacaugauaauaauggacgaggcacacuucaccgaccccgccucgaucgccgcgcgaggauacaucucaacucgagugggcaugggugaggcggcggccaucuucaugacggcuacgccccccgggucagucgaggccuucccccagagcaaugccgugauccaggacgaggagcgcgacauccccgagagaucguggaacucgggauacgauuggaucaccgacuuccccgggaagaccgucugguuuguccccucgaucaagucuggcaacgauaucgccaacugccugcgcaagaaugggaagcgggugauacaguuaucaagaaagacguucgacacugaguaucagaagacaaagaacaacgauugggauuauguuguaaccacggacaucagcgagaugggcgccaacuucagggccgaccgcgugauagacccccggagaugcuugaaacccgugauauuaaaagacgggcccgagcgggucaucuuagcgggccccaugcccgugacugucgccucagccgcccaacgucguggucguauagggaggaaucagaacaaggaaggcgaccaguacguguacauggggcagccguuaaacaacgacgaggaucaugcacacuggaccgaagcgaagaugcugcuugacaacaucaauaccccugaaggcauuauuccggcauuauucgagcccgagagggagaagagcgcagccaucgacggagaguaccgccugcggggugaagcaagaaagacguuuguggaauugaugcgucgcggggaccuuccagucuggcuauccuacaaaguagcgagugaggguuuucaauacucagaccgucgcuggugcuuugacggcgagcgaaauaaccaagucuuagaggaaaacauggacguugagaucuggacuaaggagggugaacguaagaagcucagaccccgcuggcuugaugcccgcaccuacucagacccgcuggcccuccgcgaguucaaggaauucgccgccggcagacgcucuguguccggagaccugauccuggagaucgggaaacucccgcagcacuuaacucuaagagcgcaaaacgcguuagacaaccuugucaugcugcauaauagcgagcaaggcgggaaggcguaccgacaugccauggaggagcuccccgacacaaucgagacgcuaaugcugcucgcccuaaucgccguccuuaccggcggggugacccucuucuuuuuaucggggaaaggacuggggaagaccucaaucggccuccuaugcgugacggcauccagcgcguugcucuggauggcuuccguggagccacacuggaucgcggccagcauaaucuuagaauucuuccucaugguucuccugaucccggagccggaucgacagcguacgccccaggacaaucagcuggcguacgugguuaucgggcuccuguucaugaucuugaccguggccgccaacgagaugggccugcuggaaaccaccaagaaggaucuggggauaggguacguggcagcggaaaaccaccagcacgccaccaugcucgacguggaucuacauccggcuagugcguggacguuguaugccgucgccaccacggugauaacccccaugaugcggcacaccaucgaaaacaccacggccaacaucagccucaccgccaucgcaaaccaagcggccauccucauggggcuggauaaaggguggcccauuucuaagauggauaucggggucccucucuuagcccugggcugcuacucacagguuaacccgcucacucugaccgcugcggugcuuauguuggucgcccauuacgcgauaaucggccccggguuacaggccaaggcgacgcgcgaggcgcagaagaggaccgcggcuggcaucaugaaaaaccccaccguugauggcaucguggcgaucgaccuugaucccgucguuuacgacgccaaguucgagaagcaacuggggcagauaaugcugcugauccucuguacgucccaaauacugcugaugcggaccacgugggcguuaugugagagcauaacccuggccaccgggccgcugacgacacucugggaggguucaccaggcaaguucuggaauaccaccauugcgguuaguauggcgaacaucuuucgcggcuccuacuuggccggggcgggccuggcuuucagccugaugaagucgcucggcggaggucggagagggacgggcgcgcaaggcgagacauugggcgagaaguggaagcggcagcucaaccaacuguccaagagcgaguucaauaccuauaagagguccgguauuauggagguggaccgguccgaggccaaggaaggccugaagcgcggggagaccacgaaacacgccgugucccgaggcacagcuaagcuccgcugguucguagaacggaacuuggucaagccagagggcaaagucaucgaccuggggugcggccgcgguggcuggucuuauuacugugccgggcugaaaaaggugaccgagguaaaaggcuauaccaagggcggccccggccacgaggaacccauuccuauggccacauacggguggaaccucgugaaguuacauuccggcaaggauguguucuucaugccgcccgagaagugcgacacauuacucugcgacauaggggagagcuccccgaaccccaccaucgaggagggccggacguuacggguacugaagaugguagaacccuggcucaggggcaaccaauucugcauaaagaucuugaacccguacaugccuagcgugguagagacccucgaacgaaugcagcggaagcaugggggcaugcugguccgcaacccccuauccagaaacagcacgcaugagauguacugggucucuugcgggaccggcaacaucgucagugccgugaauaugaccucccguaugcuucucaaccgauucaccauggcacaccgaaaacccacguacgaaagggacgucgauuugggagccgguacgcggcacgucgccguggagcccgaaguggccaaucuugauaucaucggccagcgaaucgagaacaucaaaaaugagcauaagagcaccuggcacuacgacgaagacaacccguacaagacgugggccuaccacgguucguacgaggucaaacccucuggcucugcgagcucuauggugaacggaguaguacgucuccugaccaaacccugggacgugauccccauggucacccaaaucgcgaugaccgacaccacgccuuucggacagcagcgcguauucaaggaaaagguggacacccggacgccucgugccaagcggggcaccacacaaaucauggaggucaccgccaagugguugugggguuuccucucgaggaacaagaagccccggaucugcacgcgugaggaguucacccggaaagugcgcuccaaugccgcgauuggugccguguuugucgacgagaaccaguggaacagcgccaaagaagcgguggaggacgagagguucugggacuuagugcaccgcgagcgagaacugcacaaacaggggaaaugugcuaccugcgucuauaacaugauggggaaacgagagaaaaagcucggcgaguucggcaaagccaagggaagccgugcuaucugguacauguggcugggagcacgcuuccuggaguucgaagcccucggauucaugaacgaagaccacugguucagccgagagaacagccuuuccgggguggagggcgaggggcuucacaagcuuggauauaucuugcgggacaucagcaagauaccgggagguaacauguacgcggaugacaccgcaggcugggacacacguaucaccgaggacgacuugcagaacgaggccaagaucacugacaucauggagccugagcacgcauugcuggccacaagcaucuucaaacuaacauaccagaacaaggugguccgcguccagcgucccgcgaaaaacgggaccgugauggauguuauaagccggcgcgaccagcggggcuccggccagguggggacguacggccugaacacguucaccaacauggaggugcagcugauccggcaaauggaaagcgaggguaucuuccuucccagugaacucgagacccccaaucuggccgaaagagcacuggacuggcucgagaaacacggcgccgaacggcugaagcggauggccauaucuggggacgacugugucgugaagcccaucgacgaccgcuuugcgacggcucugaccgcauuaaacgacaugggcaaagugcggaaagacaucccucagugggagcccucuaagggcuggaaugacuggcaacaggugccguucugcagccaucacuuucaucagcugauaaugaaggacgggcgcgagauaguugugccaugucggaaucaagacgaacuagucggccgcgcucgggugucccaaggggccggcuggucccucagggagacggcaugcuuagggaaguccuacgcgcagauguggcaacuuauguauuuucaccgaagagaccuacggcuggccgccaaugcgaucuguagcgccgucccuguugauugggugcccaccagccgaacuacguggucuauccaugcccaccaccaauggaugaccacugaggacaugcuuagcguguggaaccgcgucuggaucgaggaaaacccguggauggaggacaagacccacguguccagcugggaagaagugcccuaccuaggcaagagggaggaccaguggugcggcagccugaucgggcugacagccagggccaccugggcgacgaacauccagguggccauaaaucaggugcggcgccuuaucggcaaugagaacuaccuugacuauaugaccagcaugaagcgauuuaagaacgaguccgacagcgaaggggccuuaugguga

SEQ ID NO: 24033 - RNA, 9879 nt, Artificial Sequence
  derived and/or modified CDS sequence (opt11) from DENV-1__EU482592__SS-prME
ucagugaccaugcuguuaaugcugcuaccuacagcccucgccuuucaccugaccacccgaggaggggaaccccacaugauaguuuccaagcaggagcgggggaaaucuuuacuauucaaaaccagcgccgggauuaacauguguacccugaucgccauggaccugggcgagcucugcgaggauacuaugacguacaagugcccccguaucacugaggccgaaccugacgacguugacuguuggugcaacgccaccgauacuuggguaacauaugggaccugcucccagacaggcgaacaccggcgcgacaagcgguccgucgcucuggcgccccauguaggccuggggcuggagacccgcaccgaaaccuggaugagcagcgagggcgccuggaaacagauccagaagguagagaccugggcccugaggcaccccggguucacggucaccgcccuguuccucgcucacgcgaucggcaccuccauaacccagaaggggauuaucuucauccugcucaugcucgugacccccuccauggcgaugcgcugcgugggcaucggcaaccgggacuucgucgaggggcuaagcggcgccaccuggguggacguggucuuggaacacggguccugugugaccaccauggccaaggacaagcccacgcucgacaucgagcuguugaaaaccgaggugaccaaccccgccguccuccgcaaacuguguaucgaggcuaagaucagcaacacgacgacagauucccggugcccgacccagggcgaggccacucugguggaggagcaggacuccaauuucgugugccggcguacauucgucgaccgaggguggggaaacggcugcggccucuucggcaaggggagucuauugacaugugccaaguuuaaaugcgugaccaaauuggagggcaagauagugcaguacgagaaccugaaguacagcgucaucgucaccgugcacaccggcgaccagcaccaggucgggaacgaaacuaccgaacacgggaccaucgccaccauuacgccccaggcacccaccagugaaauccagcuaaccgacuacggggcccucacgcuggacugcagcccccggacgggucuugauuucaaugagaugguucuccugaccaugaaggagaaguccugguuaguccacaagcagugguuccuagaucuaccgcugcccuggacaagcggggcuagcacgucccaggaaacguggaauaggcaggaucucuuagucacuuucaagacugcgcaugcaaagaagcaagaggugguugugcugggcagccaggagggugccaugcacacggcacuaacuggggccacugagauccagaccuccgggacgacgaccaucuucgcagggcaccugaagugccgccugaagauggacaaguugacacucaagggcaugagcuacgugaugugcaccgggucguuuaagcuggagaaagagguagccgagacgcagcacggaaccgugcugguccaggucaaguacgaggguaccgacgcgccuugcaagaucccguucagcgcccaggacgagaaaggugugacacaaaacggccgccucaucacggccaacccuauugugaccgacaaggaaaagcccgucaacaucgaaaccgagccgcccuucggagaauccuauaucguuguuggagcaggcgaaaaggcgcugaagcugagcugguucaagaaggggaguucgaucggcaagauguucgaggccacugcccgcggggcccgccggauggccauccucggcgacacggccugggacuucggcuccaucgggggcguuuucaccagcguggggaagcuggugcaccaagucuucggcgccgccuacgggguucuauucuccggagugagcuggaccaugaagaucgggaucggcauccuccucacuuggcugggccuuaacagcaggagcacgucccugaguaugaccuguaucgccguugggauggugacucucuaucucggggugaugguccaggccgacuccgggugcgucaucaauuggaaaggccgcgagcugaagugcgggagcgggaucuucgugacaaacgagguccacacauggaccgaacaguacaaguuccaggcagacagcccgaaaagacuuucugccgccauaggcaaggccugggaggagggggugugcggcauccgcucggcgacgcgacuugagaacaucauguggaagcagaucuccaaugagcugaaccauauccugcucgagaacgauaugaaauucacaguaguggugggggaugcaaacggaauacucgcccagggcaagaagaugauccgcccccagcccauggagcaucgguauagcuggaaguccuggggcaaagccaagaucaucggcgccgacauucagaauaguaccuuuaucaucgaugggcccgacaccccggaguguccagacgaccagcgcgcguggaacaucugggagguggaggacuacggcuucgggauuuucacuaccaacaucuggcugaagcuacgggacuccuacacucaaaugugcgaucaccgccuuaugagcgccgcaaucaaagauucaaaggccgugcacgccgacauggguuacuggaucgaauccgagaagaacgagacguggaagcuggcgcgggcauccuuuauagaggugaagacaugcauauggccuaagagccacacccucuggucuaauggcguucuggaaagcgagaugauuauucccaagaucuacgggggcccgaucucccagcacaauuaccguccgggguauuucacucagacggcggguccauggcaccuagggaagcucgagcuggauuucgaucugugcgagggcacgacagucgugguggacgagcacuguggcaaccgggggccgagccuacgcaccacgacggucaccggcaagaucauacacgaauggugcugcagauccugcacuuugccgccccugcgcuuucguggggaagauggcugcugguacgggauggagauccguccggugaaggagaaggaggaaaaccucgugcgcagcauggucucggcuggcaguggggaggucgacagcuucucgcuggggauacucugcguaagcaucaugauagaagaggugaugcggucccgguggagccgaaagaugcucaugacuggcacccuggccguguuucuacuacuaaucauggggcaacuaacguggaacgaccucauccgacuguguaucauggugggugccaacgcguccgaccggauggggauggggacuacguaccucgcgcucauggcaaccuuuaagaugcgaccgauguuugccgucggccugcuguuccgucgccucacgucacgggaaguacuguuacuuaccaucgggcugucccugguggcgucaguugagcucccuaacagccuggaagaacugggcgacggccucgcaaugggaauaaugaugcugaagcugcucacugaguuccagccgcaccagcuguggaccacccuguuaagccuaaccuucaucaaaacgacccugucccucgacuacgccuggcgcacgauggccauggugcugagcaucguaucgcuauucccccuuugucugaguaccacgucucagaagacuacuugguuaccggugcuauuaggaucauucggaugcaagccacugacuauguuccugaucacggagaacaaaaucuggggcagaaaauccuggcccuuaaacgaggggaucauggcgaucgguaucgucucaauccuccucagcucccuguuaaagaacgaugucccccucgccggcccucugaucgcaggcgguaugcugaucgccuguuacguuauaagcgggaguucagccgacuugucccuggagaaggcggcggagguaucuugggaggaggaggccgagcacuccggcacgagccauaacaucuuagucgagguccaggacgaugggaccaugaagaucaaagacgaggagcgugacgacacacucaccauccugcugaaggccacgcugcucgccguguccggaguguacccaaugagcaucccggcgacccuguuuguuugguauuucuggcagaagaagaagcagcgguccggggugcugugggacacucccucgccgcccgagguggaacgcgccgugcuugacgauggcauuuaccggauccuucagcgcggccugcuaggucgcagccaggugggcgucgggguguuccaggacggcguauuccacacaauguggcaugucacccgcggggccgugcugauguaccaaggcaagcggcuagagccgagcugggccuccgugaagaaggaccuaaucucauacggcgguggcuggcgcuuucagggguccuggaacaccggcgaggagguacaggugaucgccgucgagccagggaagaacccaaagaauguccagaccaccccaggcacguucaaaacccccgagggcgaggugggggcgaucgcacuggauuuuaagcccggcaccagugggagcccgaucgugaaccgugagggcaagaucgucggacuauacgggaacggcguagugaccacgucgggaaccuacgucagcgccauugcccaagccaagaccucccaggaggggccccucccugagaucgaggaggaaguguuuaagaagagaaaccugaccaucauggacuugcacccggggagcgguaagacgaggagguaccucccugcgauagugcgggaggccaucaagcgcaagcugcgcacacugauccuugcccccacccggguuguggcaagcgagauggcagaagcccugaagggcaugccuauccgauaccagacuacggccgucaagagcgagcacaccgggcgggagaucgucgaccuuaugugccaugcaaccuucaccaugagacuccuguccccggugcgggugcccaacuacaauaugauuaucauggacgaggcccacuucacggacccagcaagcauugccgcccgcggcuacauauccacacggguagggaugggcgaggcggccgcgaucuucaugaccgcuacgccacccgggagcguggaagccuucccccaguccaacgccgugauccaggacgaggagcgggacauacccgagcgguccuggaacuccggcuacgauuggaucacggacuucccggguaagaccgucugguucguucccagcauuaagagugggaaugacauagccaacugccugcgcaagaacgggaagcgggucauccagcucagccguaagaccuucgauaccgaguaccagaagacgcgcaacaacgacugggauuaugucgugacgacagacauuuccgagaugggagcuaacuuccgcgccgaccgggugaucgacccccgccggugccuuaagcccgucauccugaaggacggcccggagcgggugaucuuagccgggccgaugcccgugacagucgcuagcgccgcgcagcggcgcgggcggauuggacguaaccagaacaaggagggagaccaguacguuuacaugggccagccgcugaacaacgaugaggaccacgcccacuggaccgaggccaaaaugcuccuggacaacaucaacacuccagaggguaucaucccggcccucuucgagcccgaacgcgaaaaaucugcggcuaucgacggggaguaccggcugagaggggaggcacggaagaccuucgucgaacucaugcgccggggcgaccugccggucuggcugagcuauaagguugccuccgagggcuuccaguacucagaccgccgguggugcuuugacggggagcggaacaaccaaguuuuagaagagaacauggauguggagaucuggaccaaagagggcgagcggaagaagcugcgcccgcgcuggcuggacgccaggacguacagcgacccgcucgcucugcgugaauuuaaggaguucgccgccgggcgccgguccguuaguggcgaccugaucuuggagaucggcaagcugccucagcaucugacccuacgcgcccagaacgcccucgacaaucuggucaugcuccacaacuccgagcaaggugggaaggcauaccgacacgcgauggaggagcuucccgacaccaucgagacccugauguuacuagcuuuaauagccguccucaccgggggcgucacacuguucuucuuaucagguaagggccucggcaagaccagcaucggguuacugugcguuauggcgagcuccgcccugcuguggauggccaacgucgagccccacuggaucgccgccagcaucauccuggaguucuuccucaugguguuauugauaccagagccagaccgccagaggacuccgcaggacaaucagcucgcguacgucgugaucgggcuguuauucaugauccucaccguagccgccaacgagauggggcuguuagagacgaccaagaaggacuugggcauugguuacgucgccgccgagaaccagcaccacgcgaccaugcuggauguggaucugcgccccgccagugccuggacccucuacgccguggcaacgaccgucaucaccccgaugaugagacauaccaucgagaacacgaccgccaacauuagccugaccgccaucgccaaucaggccgcgauucugaugggacucgacaagggcuggcccauuucgaagauggacaucggggugccccugcuggcccucggcugcuacagccaggugaacccgcuaacccugacggccgccguacucaugcucguggcccacuacgcuaucaucgggcccggacugcaggccaaagcgacccgggaggcccaaaagcguaccgccgcggggaucaugaagaaucccaccguggacggcaucgucgccaucgaccuagaccccgucguguacgacgccaaguucgaaaagcagcuaggccaaauuaugcugcuuauucuuugcacaucccagauucugcucaugcggaccacgugggcccuuugugagagcaucacccucgcgacggggccauugaccacccuaugggaagguucccccgguaaguucuggaacacgaccaucgcugucuccauggccaacaucuucaggggcuccuaucuugcgggcgccgggcucgcguucucacugaugaagucacugggcgggggacgacgcgggaccggcgcucagggcgagacccucggcgagaaguggaagcggcagcucaaccagcugagcaagagcgaguucaacacguauaaacgcucgggcaucauggagguggaccggagugaggccaaagaagguuuaaaacgcggugagacgacaaagcacgcggugucccggggcaccgccaagcugcgcugguucguugagcggaaccuggugaaacccgaggguaaggugaucgaccuggguugcggacgcggaggauggagcuacuacugcgcuggccucaagaaggucacggaggugaagggguauacgaagggcggcccugggcacgaggagcccauccccauggccaccuacggcuggaaccuggucaagcuauacuccgggaaagacgucuuuuucacuccacccgagaagugugacacgcuccugugcgacaucggcgagagcucgccgaaccccaccaucgaggagggaagaacuuugcgggugcucaagaugguggagccuuggcuacgcggcaaccaguucuguaucaagauacuuaaccccuacaugccgagcgucguggaaacgcucgagcagaugcaacgcaagcacggugggaugcuggugcgcaacccccugucccgcaacagcacccacgagauguacuggguaucuugcggcacagggaacaucgugagcgccgucaacaugacgucccgaaugcuccugaaccgguuuaccaugacacacaggaagccaaccuacgagcgggacgucgaccugggagcaggcacacgccacguggcaguggagcccgagguagcgaacuuggacauuaucgggcagcggaucgagaacaucaagaacgagcacaagagcacaugguacuacgacgaggacaacccuuacaagaccugggccuaucacggcucguacgaagugaagcccagcggguccgccucgaguauggugaacggugugguucgccugcugaccaagcccugggaugucauucccauggugacgcagauugccaugaccgauacgacccccuucggucagcagcggguauuuaaggagaaggucgauacgaggacgccccgcgccaagcgcggcacugcucagaucauggaggugaccgcaaagugguuauggggcuuucucucacguaacaagaagccgcgcaucugcacgcgggaggaguucacacgcaaggugcggagcaacgccgccaucggggccguguucgucgacgagaaucaguggaacuccgcgaaggaggcgguggaggacgagcgcuuuugggaucucguacaccgggagcgugagcuccacaagcagggcaaaugcgcaacauguguguauaacaugaugggcaagcgcgaaaagaagcuaggugaguucggcaaggcuaaggguucccgcgcgaucugguacauguggcuaggcgcucgguuuuuagaguucgaggcacuaggguucaugaacgaggaccauugguucucacgcgagaacaguuucuccggcguugagggggaggggcugcacaagcucggguacauucugcgcgacaucucgaagaucccaggcggaaacauguacgccgacgacaccgcugggugggacacgcguaucaccgaggacgaucugcagaaugaagcgaagauuaccgacauaauggagcccgagcacgcccuccuggccacgagcauauucaaauugacguaccaaaauaaaguagugcgcguucagagaccagccaaaaauggaaccgucauggacgugaucucgcgccgagaccagcgagggucgggacaaguaggcaccuacggccuaaacaccuucacgaacauggagguccagcugauucgucaaauggagagcgaaggaaucuuccugccgagcgagcuugagaccccuaacuuggccgaaaggguccugaacuggcucgagaagcacgggaccgaaagacugaagcguauggcgaucucgggugacgauugcgucguuaaaccaguggacgaccgguucgcuaccgcacugaucgccuugaacgacauggggaaggugcgcaaggacaucccccagugggaacccaguaagggauggaacgacuggcaacagguuccauuuugcucacaccacuuucaccagcucauaaugaaggacggccgagagauuguagugcccugccgcaaccaagacgagcuggucggucgggcccgcgucagucaaggcgcuggguggagccuccgggagacugcuugccugggaaaguccuacgcccagauguggcagcugauguacuuucaccgccgggacuugcgccuugcagcgaacgcgauauguagcgcugugcccgucgacugggugccuaccucuagaaccaccuggucuauccacgcccaccaccaguggaugaccacagaggacaugcugagcguguggaacagagucuggaucgaggagaacccguggauggaggacaagacccacguguccaguugggaggaggugcccuaccucgguaaaagagaggaucaauggugcggcucccucaucggucucaccgccagagcgaccugggcgacgaacauccaggucgccaucaaccaggugaggcggcucaucggaaacgagaauuauuuggacuacaugaccuccaugaagcgcuucaagaaugagucugaccccgagggugcucugugguga

SEQ ID NO: 24034 - RNA, 9879 nt, Artificial Sequence
  derived and/or modified CDS sequence (opt11) from DENV-1__EU482609__SS-prME
agcgugaccaugcuguugaugcucuuacccaccgcccucgccuuccaccugaccaccagaggcggggaaccccacaugaucgugucuaagcaggagagggggaaaagccugcuguuuaagaccagugcgggggugaacaugugcacccugaucgccauggaccugggcgagcucugcgaggacaccaugaccuacaagugcccacggaucaccgaggccgagcccgaugauguggacugcuggugcaacgcaaccgauaccugggugacguacgggaccuguucacagaccggcgagcaucggagggacaagcggucuguggcccuggcaccccacgugggccuggggcucgaaacgcggacagagacguggaugagcagugagggcgcuuggaagcaaauccagcgggucgagaccugggcccugcggcaucccggguucacgguaaucgcucuguuucucgcccacgccaucggaacgagcaucacccagaaggggauaaucuucauacugcugaugcucgugacccccagcauggccaugcggugcgucggcauagguaaucgcgacuucguggaggggcugagcggcgccacuuggguggacgucgugcuggagcacggguccugcgugacuacgauggccaagaacaagccaacucuggacaucgagcuguuaaagacagagguuaccaacccagcggugcuccggaagcucugcaucgaagccaagaucagcaacaccaccacggacuccagaugcccgacucaaggcgaggccacccugguggaagaacaggacgccaacuucgucugucggcgcaccuucguggaucggggcuggggaaauggcugcggccucuucggcaaagggagccuccugacgugcgcaaaguucaagugcgugaccaagcucgagggaaagaucguccaguacgagaacuugaaguacucaguaaucguaaccguacacaccggggaccagcaccaaguugggaacgagacgacugagcacggcaccaucgcaaccaucacgccccaggcccccacgagcgaaauccagcugaccgauuacggggcccugacccuagacugcucaccccggaccggccuggacuucaacgagaugguccuccugacgaugaaagagaagucuuggcucgugcacaagcagugguuccucgaccugccucugcccuggacuuccggggccagcaccagccaggagaccuggaaccggcaggaccuccuggugacguuuaagaccgcacacgcgaagaaacaggaggucguggugcugggcucccaggagggcgccaugcauaccgcucucaccggggccacggagauccagaccagcggcaccaccacgaucuucgccggucacuugaaaugccguuugaagauggacaagcucaccuuaaagggcaugucguacgucauguguaccggcuccuucaagcuggagaaggagguggcggagacgcagcauggcaccguguuaguucaggugaaauacgagggcaccgacgcacccugcaagauccccuucuccacccaggaugagaaggggguaacccagaacggccgucucauaacggccaacccgaucgucaccgacaaggagaaaccagugaacauagagacagagccacccuucggggagagcuacaucguggucggcgccggcgagaaggcguugaaguuguccugguucaaaaagggaagcuccauaggcaagauguucgaggccaccgcccgaggggcacggcguauggcuaucuuaggcgacacggcgugggacuuugggagcauuggcggugucuucaccucgguggggaagcugguccaccagguguucggcaccgccuacgggguccuuuucaguggcgucuccuggaccaugaaaaucgguauaggcauccuccugacguggcuaggucuaaauucacgcuccacgagccuguccaugaccugcauagcagugggcauggucacccuguaccucggcgucauggugcaggcggacagcgggugcgugaucaacuggaaaggucgugagcuaaagugcggauccggcaucuucgucacgaacgaagugcacaccuggaccgaacaguacaaguuccaggccgacagcccgaaacgccugagcgcagcaaucggcaaagccugggaggagggggugugcggaauccggagugccacccgccucgagaacaucauguggaagcagaucagcaacgagcugaaccacauccugcucgagaacgacaugaaguuuaccguagugguaggagacgccaacggcauccuugcucaagggaagaagaugauccgcccccagccaauggagcacaaguacuccuggaagaguuggggcaaggccaagaucaucggcgccgacauccagaacacgaccuucaucaucgacgguccugacacuccggaguguccugacggccagcgcgccuggaacauaugggagguugaagacuacggguuugguaucuucaccacgaacaucuggcugaagcuccgggacuccuacacccagaugugcgaccaccgccugaugagcgcggcgaucaaagacuccaaggccgugcaugccgacaugggauacuggauagagagcgaaaagaacgaaaccuggaaacuugcccgggcguccuucaucgaagugaaaaccuguacauggcccaagucgcauacccucugguccaacgguguacuggagagcgagaugauuauccccaaaaucuacggcgggccgaucucccagcacaacuaccgccccggcuacuucacccagaccgccgggccuuggcaccugggcaagcucgagcuggacuucgaccugugcgaggguacgacggucguagucgaugagcacugcgggaacaggggcccuagccuacgaaccaccacggugacugggaagaucauccacgagugguguugccgguccugcacccugccgcccuugcgcuuccggggcgaagaugguugcugguacggcauggaaauccguccugugaaggagaaggaagagaaccucguccggagcaugguguccgcuggcagcggggagguggacucauucucccugggcauccugugcgucucaaucaugaucgaggagguuaugcggagccgguggucgcgcaagauguugaugaccgggacguuagccguguuccugcuccugaucaugggacaguuaaccuggaaugaccucauccgccugugcaucauggucggcgccaacgcguccgaccggaugggaaugggcaccaccuaccucgcucugauggccacguuuaagaugcgcccaauguucgcuguugggcugcuguuccggcgccuaaccagccgggaggugcugcugcucacaaucggccuauccuuggucgccagcguggaacuccccaacucccuggaggagcuaggggacggacucgcgaugggcaucaugaugcuaaagcugcuuaccgaguuccagccgcaccagcuguggacgacccugcucagccugaccuuugugaagaccacgcugucccuggacuacgccuggaagaccaccgccaugguguuaagcaucguuucgcuguucccccucugccugagcaccacgucccagaagaccaccuggcugccgguccuccugggcucuuuuggcugcaagccccugaccauguuccugaucaccgagaacaagauuugggggcgcaaauccuggccacugaacgaggggaucauggccauagggaucgugagcauccuguuguccagccugcugaagaaugacgugccccucgcgggcccgcugaucgcaggcggaaugcuaaucgcaugcuaugucaucagcggcuccagcgcugaccucucccuggagaaagccgcggaggugagcugggagcaggaggcggagcacucuggggcaucacacaacauacugguggaaguccaggacgacggcacgaugaaaaucaaggacgaggagcgggacgacacccucaccauccuacugaaagccacccuccuagccguauccgggguguaccccaugagcauccccgcgacgcuguuuguaugguacuucuggcaaaagaagaagcagcgcuccggugugcucugggacacucccagcccgccugagguggagcgggccguccuggacgacggcauauaccgcauccugcagcggggucugcucggccgcucccaggugggggugggcguauuccaggacgggguuuuccacaccauguggcacgugacccggggcgcaguccugauguaccagggcaagcgccuagagcccagcugggcuuccgugaagaaggaccuuaucagcuauggaggaggguggcgguuccagggauccuggaacacgggggaggaggugcaggucaucgccguggagcccggcaagaacccgaagaacgugcagaccaccccuggcaccuucaagacgcccgagggagagguaggcgcgaucgcucuugacuucaagcccgggaccagcggcuccccaaucgugaaccgcgaaggcaagauuguggggcuguacggcaacggagucgugacaaccagcggcacguacguguccgccaucgcccaggcucgcgcgagccaggaggggccccuccccgagauagaagacgagguuuucaagaagcgcaaucugaccaucauggaccugcaccccgggagcggcaagacccgccgcuacuuaccggccauugugcgugaagccaucaagcgcaagcugcgcacucugauccucgcccccacgcgggucgucgcguccgagauggccgaggcccugaaggggaugcccauacgcuaucaaacgaccgccguuaaguccgagcacaccggccgugagaucguugaccugaugugccacgccacguucaccaugcgccuccuguccccgguccgggugcccaacuacaacaugaucauaauggacgaggcgcacuucacugaucccgccucuauagccgcccgcggguacaucuccacccggguggggaugggggaggccgcggccaucuucaugacggccacgccaccgggguccgucgaggccuucccccaauccaacgccgugauccaggacgaggagagagacauccccgagagauccuggaacuccggcuaugacuggaucaccgacuuccccggaaagaccgugugguucgucccaagcaucaagucugggaacgacaucgcgaauugucugcgcaagaacgggaagcgggucauucagcucagccggaagacguucgauaccgaguaccagaagacaaagaacaacgacugggacuacgugguaaccacggacauuuccgagaugggagcgaacuuccgagcugaccgcgugauagacccccggcggugccugaagccagugauucugaaggacgggccagaacgggucauucucgccggcccgaugcccgugaccgucgcuagcgccgcccagcggcggggaagaaucgggcgcaaccagaauaaggagggcgaccaguacguguacauggggcagccgcugaacaacgacgaggaccacgcccacuggacggaggccaagaugcugcucgacaauauuaacaccccggagggcauaaucccggcgcuguucgagcccgagcgggagaaguccgccgccaucgacggcgaauaccgccugcggggcgaagcccgcaagacguucguugagcucaugcggcgcggcgaccugccugucuggcuaagcuacaagguggccuccgagggguuccaguauucggaccggcgcuggugcuucgacggcgagcgcaacaaccaggugcucgaggagaacauggacgucgaaauuuggaccaaggaaggggagcgcaagaaacuucggcccagauggcuggaugcgagaaccuacuccgauccgcuagcccugcgcgaguucaaagaguucgccgccgggcggcgcagugugagcggcgaccugauccucgagaucgggaagcugccucagcaccugacccuccgagcccaaaacgcgcuggacaaccuggugaugcuccacaacagugagcaaggagggaaggccuaucgacacgccauggaggagcuucccgacaccaucgagacguuaaugcuccuggcucugaucgcaguccuaacaggaggggugacacuguucuucuugagcggcaagggccucgggaaaaccuccauuggcuuacugugcgugacggccagcucagcacuccuguggauggccucggucgagccccacuggaucgccgcuuccauuauucucgaguucuuccucaugguguugcugauuccagagcccgaccggcagcgcacgccacaagauaaccagcucgccuacgucgucauagggcugcuguucaugauucucaccguugccgccaacgagauggggcugcuggagaccacgaagaaggaccucgggauuggcuacguggccgcagagaaccaucagcacgccacuaugcuggacgucgaucugcggccggccagcgccuggacgcucuacgccguggcgacuacugugaucacccccaugaugaggcacaccaucgagaacacgacggccaacaucucccugaccgccaucgccaaccaggccgcgauacugaugggccuagacaagggguggccuaucagcaaaauggacaucggugucccccugcuggcccucggguguuacucccagguuaacccgcugacacuuaccgcugccgugcucaugcuggucgcgcacuacgccaucaucggccccgggcugcaggccaaggcaacgcgcgaggcccagaagaggaccgcggcaggcaucaugaagaaccccaccguggacggcauaguggccauugaccuugaccccgucguguaugacgccaaguucgagaagcaacuggggcagaucauguuacucauacugugcaccagccaaauccugcuaaugaggacgaccugggcccugugcgaguccaucacgcuggcaaccggaccgcucacgacucugugggagggcagccccggcaaguuuuggaacaccaccaucgcggugucgauggcuaacaucuuccggggcucauaccuggccggcgccgggcuagcguucucccugaugaagucccucggggguggccgccgggggacgggcgcccagggggagacacucggcgagaaauggaagcgccagcugaaccagcuguccaagagcgaguucaacacguacaagcggagcgggaucauggaggucgaccgcuccgaggccaaggagggacugaagagaggggagaccacgaagcacgccgugagccgcggcaccgcgaagcugcggugguucguggagcgcaacuuaguuaaacccgaggguaaagugaucgaucuggggugcggcagagggggcuggucuuacuacugcgccgggcugaagaaggugacggaggucaagggcuacacaaagggcgggcccggccacgaggagccgauccccauggcuaccuacggguggaaccugguuaagcugcacagcggaaaagacguguucuucaugccgcccgagaagugcgacacgcuccugugugacaucggggaguccagcccgaaccccaccaucgaagaaggccgcaccuuaagaguccucaagaugguggagcccuggcugaagggcaaccaguucugcaucaagauccugaacccuuacaugccguccguggucgagacgcucgagcagaugcagcggaagcacgggggcaugcuggugagaaacccucugagcaggaacuccacgcacgagauguauuggguaagcugcgggaccggcaacaucgucucagccgugaacaugaccucaagaaugcuccuaaaccgcuucaccauggcgcaccggaaacccaccuacgagcgggacguugaccugggcgcggggacccgccacgucgcgguugagccggagguggccaaccucgacaucaucggccagaggauagaaaacaucaagaacgagcauaaguccacauggcacuacgacgaggacaacccguacaagaccugggcauaucaugggagcuaugaggucaagcccuccggcagcgccuccaguauggugaauggggucgugcgccugcuaacaaagcccugggacgugauacccauggucacccagauugcaaugaccgauaccacgcccuucggccagcagcgaguguucaaggagaagguagacacccggacgcccagggccaagagggguaccacgcagaucauggaagucaccgcccgcuggcucuggggcuuucugucccgaaacaagaaaccgcggauaugcacccgcgaagaguucacccggaaggugcgcagcaacgccgcuaucggcgcgguguuugucgacgagaaccaguggaauagcgccaaggaggccguggaggacgagagauucugggaccugguccaccgcgagcgcgaacuccacaagcaggggaagugcgcgacgugcgucuacaacaugaugggcaaacgcgagaagaagcugggagaguucggcaaggcaaagggaucccgggccauaugguacauguggcugggggcccgcuuccuagaguucgaggcuuuaggauuuaugaacgaggaucacugguucagccgggagaacucccugagugggguggagggggagggccuccauaagcugggcuacauccugcgcgacaucucaaagauaccgggcgggaacauguacgccgacgacaccgcgggcugggauacccgcaucaccgaagacgaccuccagaacgaggccaagaucacggacaucauggagcccgagcacgcacugcuggcuaccagcaucuucaaacucaccuaccagaacaaggucguccggguucagcgacccgcuaaaaacgggacggugauggacgucaucucccggcgcgaccaacgcggcagcgggcaggucgggacguacggccuaaacaccuucacuaacauggaggugcagcugauacgacagauggaaucagaagggaucuucagccccuccgaguuggagaccccgaaccuggcggagaggguccuggacugguuagagaagcauggcgccgaacgacugaagcggauggccauuagcggagacgacugcguggugaagcccaucgacgaccgcuucgccacggcccugacagcucucaacgauaugggcaagguccggaaagauauaccccagugggagccgucaaagggcuggaacgacuggcaacaggucccguucuguucgcaccacuuccaccagcugaucaugaaggacgggcgcgagauaguaguacccugccggaaccaggacgagcuggucggccgagcaagggugucccagggggccggcuggagucuccgcgagaccgcaugccuggggaagaguuacgcucagauguggcagcuuauguacuuucaccggcgcgaucuccggcuagcggccaacgccaucuguagcgccguacccguagacugggugccgacuagccgcaccacguggaguauccacgcgcaccaccaguggaugaccaccgaggacauguuaagcgucuggaaccgcguguggauagaggagaacccguggauggaggacaagacccacguauccagcugggaagaaguccccuaccucggcaagcgggaagaucagugguguggcucccugaucggucugaccgcccgcgcgaccugggccaccaacauccagguggccaucaaccaggugcggcgccucauuggcaacgagaacuaccuggacuacaugacaagcaugaagcgcuucaagaacgaauccgaccccgaaggggcgcugugguga

SEQ ID NO: 24035 - RNA, 9879 nt, Artificial Sequence
  derived and/or modified CDS sequence (opt11) from DENV-1__EU482610__SS-prME
agcgucaccaugcugcucaugcugcugcccaccgcacucgcuuuccaccugaccacccgcggcggggagccccacaugaucgugagcaaacaggagcggggcaagagccugcuguucaagaccucagcaggugugaacaugugcacguuaaucgcaauggaccugggggagcucugugaggacaccaugaccuacaagugcccccgcaucaccgaggccgaaccggacgacguggacugcuggugcaacgccacagacaccugggugaccuaugggacuugcagccagacgggcgagcaccggcgagagaagagauccgucgcccuagccccgcacgugggccucggucucgagacccgcacggagaccuggaugagcuccgagggcgcuuggaagcagauccagcggguagagaccuggguccugcgccaccccggguucacugugauagccuucuuccuagcccacgcgaucggcaccagcaucacccagaaagggaucauauucauccuccuaauguuggucacucccuccauggccaugcgaugugugggcauaggcaaccgagacuuuguggaggggcucagcggcgccacgugggucgacguaguccuggagcauggguccugugucaccaccauggccaagaacaaaccaacucuggauaucgagcuacuaaagacugaggugaccaaccccgccguucugcggaagcucugcaucgaggcgaagauaagcaacaccaccacggauucacguugcccaacccaaggagaggccacccuggucgaggagcaggacgcaaauuucguuugccggcgcaccuucguagaccggggcugggggaacggcugcggguuauucggcaaagggucccuccugacgugcgccaaguucaaaugcgucaccaagcuggaaggcaagaucgugcaguaugagaaccucaaguacuccgugaucgucaccgugcacacuggagaucagcaccaggucgggaaugagacgaccgagcacggcaccaucgcuaccauaacaccccaggcgcccacuagcgagauccagcugaccgacuacggggcacuaacccucgacuguagcccccgaaccggcuuggacuucaacgagaugguucugcugaccaugaaggagaaguccuggcuggugcacaagcagugguuccuagacuugccgcugcccuggaccuccggagcaucuaccagccaggagaccuggaaccgucaggacuugcuagucacguucaagacagcccacgccaagaagcaggaggugguuguccugggaucccaggagggcgcgaugcacaccgcccucacaggggccacggaaauccagacuagcgguaccaccaccaucuucgccgggcaccuaaagugccgccuaaagauggacaaguuaacccucaaggggauguccuaugugaugugcaccggaucguucaaacuggagaaggagguugcugagacccaacacggcacgguguugguacaggugaaauacgaaggcaccgacgcgcccugcaagaucccguucaguacucaggaugaaaagggggucacccagaacggccggcugaucacggcgaacccgaucgugacugacaaggagaagcccgucaacauugagaccgagccgccuuucggcgaaagcuacaucguagugggcgccggcgagaaggcucuuaaacucuccugguucaagcguggaagcuccaucggcaagauguuugaggcaaccgcucgcggugcccgccgaauggcgauccugggagacacggccugggacuucggaucuaucggcggcguguucacuagcguggggaaguuagugcaucagguguucggcaccgcguaugggguacuguucagcggcguuucuuggaccaugaagaucggaaucgguauccugcucacguggcugggccugaacagccgguccaccagccucucgaugaccugcaucgcugucgggauggugacucuguaccucggcgugauggugcaggccgacagcggcugcgucaucaacuggaagggucgcgagcucaagugcgguuccggcauauucgugacaaaugagguacacacguggaccgaacaguacaaauuccaggcugacagcccgaagcggcugucggcggcgaucggcaaggccugggaggaaggcgucugcggaauacgcucggcgacgagguuagaaaauaucauguggaagcagaucagcaacgaacugaaucacauccuucuggagaacgauaugaagcucaccguaguggucggggacgccaauggcauacucgcccaggggaaaaagaugauucgcccccaacccauggaacacaaguacuccuggaaguccuggggcaaggcaaagaucaucggcgccgacauccagaauacgacguuuaucaucgacgggcccgacacuccugaguguccugacggccagagagccuggaacaucugggaaguggaggacuauggguuuggcguguuuaccaccaacaucugguugaagcuccgcgacuccuauacccagaugugcgaccaccguuuaaugagcgccgcgaucaaagacuccaaggccguccacgccgacaugggcuacuggaucgagagcgagaaaaaugagaccuggaagcuggcccgcgccucauucauugagguaaagaccugcacguggccaaagucgcacacguugugguccaaugggguauuggagagugaaaugaucauacccaagaucuacggggggccgauaucccagcacaauuaucggcccggcuacuucacccaaacggcgggaccuuggcaucugggaaagcuagagcuggacuucgaucugugcgaggguacgacuguggugguggacgagcacugcgggaaccgaggcccaucgcuccggacaaccacggucaccggcaaaaucauccacgaguggugcugccgcuccuguacccugcccccccugcgguucaggggagaggacgggugcugguacggcauggagauccggcccgucaaagagaaagaagaaaaccucgugcgcucaauggucuccgcuggcaguggggagguagacucuuucucccugggcauacugugugugaguaucaugaucgaggaggucaugcggagucgcuggucucgcaaaauguuaaugaccggcacgcuggccguguuccugcuccugaucaugggccagcugaccuggaacgaucucauccgguugugcauuauggugggggccaacgccuccgaucggaugggcaugggcaccaccuaccuggcgcucauggcuacguucaagaugagaccgauguuugcagugggucuacuguuucgccggcucacuagcagagaagugcugcuguuaacgaucggccugucccucguggccagcguggagcuccccaacuccuuggaggagcuuggugauggucucgccaugggcauuaugauguuaaagcugcuuacugaauuccagccccaccagcuauggacuacccugcugagccugaccuucgugaagaccacgcuauccuuagacuacgccuggaagacgaccgccaugguccugucuaucgugucacucuucccccucugcuugagcacaacgucccaaaagacaacguggcuaccggugcuccuagggagcuuuggcugcaagccccucacaauguucuuaaucaccgagaacaagaucugggggcggaagagcuggccucugaacgaggggaucauggcaauugggaucgucagcauucugcucaguagucugcugaagaaugacguccccuuggcagguccuuugauagcuggcgggaugcucaucgccuguuacgugaucagcggcaguucagcggaccuuucccuggagaaagcggccgaggucaguugggagcaggaagcugagcauucuggggcgagccauaacauccuaguugaggugcaggacgacggcacgaugaagauuaaggacgaggagcgcgacgacacccucaccauacugcugaaggcgacccuccuggcuguuuccgggguguaccccaugucgauucccgccacgcuguucgugugguauuucuggcagaagaagaaacagcggagcggcguccucugggacacucccagcccgccggagguggagagggcugugcuggacgacgguaucuaccggauccugcagcgcggauuauugggccggucucaaguuggcguaggcguuuuucaggacggagucuuucacaccauguggcacguuacccgcggagccguguugauguaccaggguaagcggcucgaacccagcugggccuccgucaaaaaggacuuaaucagcuacggggggggguggcgcuuucagggcuccuggaauacgggggaagagguccaggugaucgccgucgagccaggcaagaacccuaagaauguacagaccaccccaggcaccuucaagacgcccgaaggggaggugggcgcaauagcgcuggauuucaagcccgggaccucugguuccccgauuguaaaucgugagggcaagaucguaggucuguacggcaacggggugguuacgaccagcggaacuuacguuucggccauugcacaggccaaggcuagccaggaggggccacuccccgagaucgaagaugagguuuucaagaagaggaaccuaaccaucauggaccuucacccgggcagcggcaagaccaggcgcuauuuacccgcgaucguccgcgaagcgaucaagagaaaacugcguacccugauccucgcacccacgcgagugguggccuccgagauggcagaggccuugaaggggaugcccauccgcuaucagacgaccgccgucaagucggaacacaccggccgggaaaucguggaccuuaugugccaugccacuuuuaccaugcgccuccuguccccgguaagagucccuaacuauaacaugauuaucauggacgaggcccacuucacugaccccgcaaguaucgcugcgcgcggguacaucucuacccgagugggcaugggagaggccgccgcaaucuucaugacagccacgccgcccggcagcguggaggccuucccacagaguaacgccguaauucaagacgaggagcgugacauaccagagcggagcuggaauuccggcuacgacuggaucacggacuucccaggcaagaccguaugguucgugcccagcauuaaguccggcaacgacaucgccaacugccugcgcaagaacgggaagcgggucauccagcucagccguaaaacguucgacacagaguaccagaagacgaagaauaaugauugggauuacgucguuaccacggauaucagcgagaugggcgccaacuuccgggccgaucgcgucaucgacccccggcgcugucugaagccagucauccugaaagaugggcccgagcgcgucauacucgccggaccgaugcccgugaccguggcuuccgcugcccagaggcggggccgcauaggucgaaaucagaacaaggagggcgaccaguacgucuacaugggccaaccccuuaacaacgaugaagaccacgcccauuggaccgaggccaaaaugcugcuugacaacauuaacacacccgagggcaucaucccggcccuguuugagcccgagcgggagaaaucugcagccaucgacggggaauaccgucugcggggcgaggcucgcaaaacguucguggagcucaugcggagaggggaccugcccguuuggcugagcuacaaagucgccucugagggcuuucaauauagugaccggcgcuggugcuuugacggcgagcgcaacaaccagguucucgaggagaacauggacguggagaucuggaccaaagagggggagcggaagaagcugcggccucgcugguuggaugcccggaccuacuccgacccgcucgcgcugagagaguucaaggaguucgcggccggccgccgguccgucucaggcgaucugaucuuggagauugggaaacugccacagcaccugacccuccgcgcccagaacgcucuggacaaccugguuaugcuccacaacuccgagcagggcgggaaggccuaccgccaugccauggaggaauuacccgauaccauagagacgcugaugcucuuggcucugauugcagugcucacgggagggguuacgcucuucuucuugagcgggaagggguuagggaagacauccaucggccuacuaugcgugaccgcgagcagcgcccuccuguggauggccucuguggagccccacuggaucgccgccucaaucaucuuggaguucuuccucaugguccugcucauuccggagccagaccggcaaaggacgccucaggacaaccaacuagcguauguggugaucgggcugcuguucaugauccucaccgucgccgccaaugagaugggccugcuggagaccacuaagaaggaucugggcaucggcuacguagccgccgaaaaccaccagcacgcuaccaugcucgacguagaccugcaccccgccagcgccuggacccucuacgccgucgccaccacagucaucaccccaaugaugcgucauaccaucgagaacaccaccgcuaacauaucccugacggccauugcaaaccaggccgccauccugaugggccucgacaaaggguggccgauuaguaagauggauaucggcgugccccugcucgcguuagguuguuacucccaggucaacccgcuaaccuuaacugccgcagugcucaugcugguggcccauuaugcgauaauuggcccugggcugcaggccaaggccacgcgcgaggcccagaaacgcacggcugcgggcaucaugaagaaucccaccguugacggcaucguggccaucgaucucgaccccgucgucuacgacgccaaauucgagaagcagcuggggcagaucaugcugcuaauccugugcaccagccagaucuugcucaugcgaacgacaugggcccugugcgaaucuaucacccuggcaaccggcccgcuaacgacccugugggagggcucgccaggcaaguuuuggaauacgaccaucgcgguguccauggccaacaucuuccgcggcagcuaccuggcuggagcaggauuagcguucucccuaaugaagucccucggcggcgggcggcgugguacuggcgcacagggggagacccucggcgagaaauggaagaggcagcugaaccaacugaguaagagugaauucaauaccuauaagcgaucggguaucauggaaguagaccgcuccgaggccaaggagggauugaagcgcggggaaaccacgaagcacgccgucagcaggggcaccgccaaguugcgaugguucguugagagaaaucuggucaagccagagggcaaaguuauugaucugggcugcggaagaggggguuggagcuacuauugcgcggggcuuaaaaaagugaccgaggugaagggcuacaccaagggcgggcccggccacgaggagccgauccccauggccaccuacggguggaaccuggucaaguugcacagcgguaaggauguguuuuucaugccgcccgaaaagugcgacacguuacugugugacauuggggaguccucaccgaaccccaccaucgaggaaggacggacccugcggguccucaagauggucgagccauggcugcgggguaaucaauucugcaucaagauucugaaccccuacaugccguccgugguggagacccucgaacagaugcaaaggaagcacggcgguaugcuggucagaaauccccugagcaggaacucaacucacgagauguacugggugagcugcggaaccggcaacaucgucuccgcggucaacaugaccagccgcaugcuucugaaucgcuucaccauggcgcacaggaagcccaccuacgagcgggacguggaucugggcgcugggaccagacacguggcgguagagcccgagguggcgaaccuggacauaaucggacagcgaauugagaauauaaagaacgagcacaaguccacuuggcacuacgacgaggacaaccccuacaagacaugggcauaccacgguagcuacgaggucaaacccucggggagcgcgaguagcauggugaacggggugguucgccugcucacgaagcccugggacgucauccccaugguaacccagauugccaugaccgacacaacuccuuuuggccagcagcgggucuucaaggagaaaguggacaccaggacgccgcgggccaagcgcgggaccacgcaaauaauggaagugacggccaaguggcucuggggauuccugagcaggaacaagaagccucggaucugcacccgugaagaguucacccgcaagguccggagcaaugcggccauuggggcuguguucguugacgagaaccaguggaacucggcuaaagaagcgguggaagacgaacgcuuuugggaccugguacaccgagagcgagaguugcacaagcagggaaagugugcgacguguguguacaauaugauggggaagagagagaagaagcugggagaguucggcaaagcgaagggcucccgcgcgauuugguacauguggcuaggggcccgguuccucgaauucgaggcccugggcuucaugaaugaggaccacugguucucacgugaaaacuccuuaucgggggucgaaggagaagggcuccacaagcucggcuauauccugcgggacaucuccaagauccccggcgggaacauguacgcugacgacaccgcuggaugggacacccgcaucaccgaagacgaccuccagaacgaggcgaagauaacggacaucauggagccagagcacgcacugcuggccacuagcauuuucaagcucaccuaccagaacaaagugguccguguccagcggcccgccaaaaacgguaccguuauggacgugaucucacgucgcgaucagcgcgguagcggccaggucgggacauacggucugaauaccuucaccaauauggaggugcaacugaucaggcagauggaguccgaggggaucuuccuccccucugaacucgagacaccgaaccuggccgagagagcgcucgauuggcuagagaaacacggcgcagagcgccuaaaacgcauggccauuuccggugacgacugcguggucaagcccauagaugaccgguuugccacggcacucaccgcgcugaacgacaugggcaaagugaggaaggacaucccccaaugggagcccaguaagggguggaacgacuggcagcaggucccguucugcucccaccacuuccaccaacugauaaugaaggacgggcgggaaaucgucguaccuugucgcaaccaggaugagcucgucggacgugcccgugucagccagggggcaggcuggucccuucgggagacugcuugcuugggaaaaagcuacgcccagauguggcaacugauguacuuucaccgccgggaccugcgccuggcggccaacgccaucugcuccgccguuccaguggacugggugcccaccucgcggaccacguggagcauccacgcgcaccaucaguggaugaccaccgaagacaugcuaucaguauggaaccggguguggauugaggagaauccguggauggaagacaagacccacguaagcucgugggaggaggugcccuaucugggcaagagggaggaccaguggugcggaagcuugaucgggcucaccgcccgggccaccugggccaccaacauccaaguggccaucaaccagguacggcggcugaucggaaacgaaaacuaccucgauuacaugacgucuaugaagcgcuucaagaacgagagcgaucccgagggggcgcucugguga

SEQ ID NO: 24036 - RNA, 9879 nt, Artificial Sequence
  derived and/or modified CDS sequence (opt11) from DENV-1__EU482611__SS-prME
agcgugaccaugcuauugaugcugcugcccaccgcccucgccuuccaucuaaccacccgcggcggggaaccccacaugauagugucaaagcaggagcggggcaagucacugcucuuuaagaccagcgccggggugaauaugugcacccugaucgcuauggaucugggggagcuaugcgaggacaccaugaccuacaaaugcccccguauuaccgaggccgagcccgacgacguagacugcuggugcaacgccacugacaccugggugaccuacgggacgugcucacagaccggcgagcacagacgugagaaacggucagucgcccuggcaccgcacguggguuuagggcucgagacccguacagaaaccuggaugagcuccgaaggcgcguggaagcagauccagcggguagagaccugggcccucagacauccgggguucacagugaucgccuucuuccuggcgcacgccaucggcacgagcauaacccagaaagggaucauuuucauacugcugaugcuggugacccccucuauggccaugcggugcgucggcauuggaaacagagacuucgucgaagggcucagcggagcaacguggguggacguggugcucgagcaugguucgugugugaccaccauggccaagaacaagcccacgcucgauauugaguugcugaaaacugaggucaccaaccccgccgugcugcggaagcugugcaucgaggccaagaucagcaacacuaccacggacucacgcugccccacgcagggcgaagccaccuuaguggaggaacaggacgccaauuucgugugccgacgcaccuucguugaccggggcugggguaauggcuguggguuauucggcaagggcucucuccugacgugcgcaaaguucaagugcgugaccaagcuggaggggaagauaguccaguacgagaaccucaaguacuccgugaucgugaccguacacacuggcgaccagcaccagguggggaacgagacgaccgagcacggcacaaucgcgaccaucacgccacaggcaccaacgagcgagauacagcuuaccgacuacggggcccugacccucgacugcucuccaagaaccggucuggacuucaacgagaugguccugcucacgaugaaggaaaaguccuggcugguccauaagcagugguuccuggaccuaccgcugccuuggaccuccggggcguccaccucgcaggagaccuggaaucggcaggaccugcucguaacauucaagaccgcccacgcaaagaagcaggaggucguggucuuaggcucccaagaaggcgccaugcacaccgcccugaccggggcgacggagauccagacgagcggaacgaccacaaucuucgccgggcaccucaaaugccgccugaaaauggacaagcucacucucaaggguaugucauacgucaugugcaccggguccuucaagcuggaaaaagagguggcggagacucagcacggcacggugcucguucaagucaaguacgaggguaccgaugccccgugcaagauacccuuuuccacccaagacgagaaggguguuacccaaaacgggcgacugaucacggccaauccgaucgucacugacaaagagaagcccgugaacaucgagaccgagccgcccuucggagagucguacauaguggucggcgcuggugaaaaggcacucaaguuauccugguucaagcgagggaguuccaucggaaagauguucgaggccaccgcgcguggggccagaaggauggcuauccugggcgacacggcgugggacuucgguagcauaggcggcgucuucaccuccgugggaaaacucguccaccagguguuuggcaccgcauacggggugcuguucaguggcgucuccuggaccaugaagaucgggaucggcauccuacucacguggcugggcuugaacagucgguccacuucucucuccaugaccugcaucgccgugggaauggugacccuguaccugggaguuaugguacaggccgacucugggugcgugaucaauuggaaaggccgcgaacucaagugugggucaggcaucuucgugacgaaugaggugcacacguggacugagcaguacaaguuucaggccgacucccccaagcggcuuucggcggcaaucggcaaggccugggaggagggagugugcgguauucgcuccgccacccggcuggagaacauaauguggaagcagaucagcaacgaacucaaccacauucugcuggagaacgacaugaaguugaccgucguuguaggggacgcaaacggcauccuugcgcagggcaagaaaaugaucagaccgcagcccauggagcacaaguauuccuggaaguccuggggcaaagccaagaucaucggcgccgacauccagaacacuaccuucaucauugacgggcccgauaccccggaaugucccgauggccagcgggcuuggaacaucugggaggucgaggacuacggguucggaguguuuaccacgaacauuuggcugaagcuccgcgacuccuacacccaaaugugcgaccaccgccugaugagugcggccaucaaggacuccaaagccgugcacgccgacaugggcuacuggaucgagagcgaaaagaaugagacauggaagcuagccagagcgagcuucaucgaggugaaaaccugcacguggcccaaaagccauacccucugguccaauggggugcuggagagcgaaaugaucauucccaaaaucuauggggguccgaucucccaacauaacuaucggcccgguuacuucacccaaaccgccgggccuuggcaccucggcaagcucgaacuggacuucgaucugugcgaggggacuacgguggucgucgacgagcacuguggcaaccgcggcccuagccucagaaccacaacgguaacggggaagaucauccacgaguggugcugccguuccuguacucuaccuccccugcgguuccgcggcgaagacggguguugguauggcauggaaauccggccagucaaagagaaggaggaaaaccucgugcgcuccauggugucggccggcucgggggagguagacagcuucagccuggguauccugugcgucucuauaaugaucgaggagguaaugcggagucgcuggagccgcaagaugcugaugaccgggacguuagccgucuuccugcuccugaucaugggccagcugaccuggaacgacuuaauccggcugugcaucaugguuggggcaaacgcguccgaccgcauggggaugggcaccaccuaccuggcccucauggccacguucaagaugcggccaauguucgccguggggcuucuguuccggcggcuaacuagccgcgagguccugcugcucacaaucggccugagccugguggccagcguggagcuccccaauagccuggaggagcugggggacggccuugcgaugggcaucaugauguuaaagcuccucaccgaguuccagccccaccagcuguggacuacccuacucagccugaccuuugugaagaccacgcugucucuggacuacgcguggaagaccaccgccaugguguugagcaucgucucccuguucccgcuuugccuaagcaccacaucccagaagaccacguggcucccggugcuccuggggagcuuuggaugcaagccccugacaauguucuugaucacugagaacaaaaucugggggcggaaguccuggcccuuaaacgagggaaucauggccaucgggaucgugucaauccuguuaucaagccugcugaagaacgacgucccccuggcaggaccgcugaucgcaggcgguaugcugaucgccugcuaugugauaagcgguucaucggcagaccucagucuggagaaggccgcggaggugagcugggagcaggaggcagagcacuccggggcaagccacaacauccugguagagguacaggacgacggcacgaugaagaucaaggacgaggaacgagaugauacacuuacaauccugcugaaggccacccuauuagccgugucaggggucuacccgaugucaauccccgcgacguuguucgugugguacuucuggcaaaagaaaaagcagcgauccggcguguuaugggacacccccuccccacccgaagucgagagagcaguucuggacgacggaaucuacagaauacuacagcgcgggcuccuaggccggucccagguggggguaggcguauuucaggacggagucuuucacacgauguggcacgucacgaggggagccguccugauguaccagggcaagcgucuggaacccagcugggccuccguuaagaaggaccucaucagcuacgggggcgguuggcgcuuccagggcucauggaacacgggggaggagguccagguuaucgccguggagcccggcaagaacccgaagaacguccagaccacccccggcacguucaaaacgcccgagggggaggugggcgccauagccuuagacuuuaaacccgggaccagcggguccccaauuguuaaucgugagggcaagaucguugggcuuuacgguaacggggucguuacuaccagcggcacguacguaagugcgaucgcccaggccaaggcuucccaagaaggaccccucccggagaucgaggaugagguauucaagaagcgcaaccugaccauuauggaucugcacccgggcucuggaaaaacccgucguuacuuaccggccauuguccgugaggcgaucaagcggaaguuacgcacccugauccuagcaccuacuagagucguggcguccgagauggccgaggcccucaaagggaugcccauacgcuaccagacgaccgcggucaaaagcgaacacaccggccgggagaucgucgaucugaugugucacgccacauucaccaugcgccuccugagcccggugcgggugccuaacuauaacaugaucaucauggacgaggcacacuuuaccgauccagccagcauagcagcaagaggguauaucaguacccgggucggaaugggggaggccgcggccauauuuaugacggccaccccgccuggcagcgucgaggcuuucccccaauccaacgccgugauccaagacgaggagcgcgacauccccgagcgaagcuggaacucuggauacgacuggauaaccgacuuccccggaaagaccgucugguucgugcccagcaucaagagugggaacgacaucgcgaacugucugcgaaagaacgguaagcggguaauccagcucagccgcaagacguuugauaccgaguaccagaaaaccaagaauaacgauugggacuacguugugacuaccgacaucagugagaugggcgcaaacuuucgagccgaccgcgugaucgacccccgucguugccucaagcccgucauacugaaggacggucccgaacgggugauacucgccggcccgaugcccgugaccguggcgagcgcggcucagcgccggggcaggaucgggcgcaaccaaaacaaggaaggggaccaguacguguacaugggacagccucuuaauaaugacgaggaccaugcccacuggaccgaggcgaagaugcugcucgacaauaucaacacccccgagggcaucaucccggcgcuguucgaacccgagagggagaagagugccgcuaucgacggggaauaccgcuuacggggagaagcucgaaagacguucgucgaguugaugcggcggggcgaccugcccguguggcugucauacaaaguggccuccgagggauuccaguacucagaccggcgauggugcuucgacggcgagcggaauaaccagguccucgaggaaaacauggacguggagaucuggaccaaggagggggaacgcaagaaacuucguccccgcugguuggacgcacggacauacucggacccgcucgcccugcgcgaguucaaggaguucgccgccggccggcgcagcguuagcggcgaucugauccucgagaucgggaaauugccccagcaucugacgcugcgggcccaaaaugcucuggacaacuuggucaugcuccacaacagcgagcaaggcgggaaagcauaccgccacgccauggaggaguugcccgacacgauugaaacguuaauguugcuugcccugauugcggucuugaccggaggcgugaccuuguucuuccugucagguaaaggacuagggaaaaccagcaucggcuugcugugcgucacugccucguccgcccugcuguggauggccucgguggaaccccacuggaucgccgcaucuaucauccuggaguucuuccucauggugcugcugaucccagagcccgaccggcagagaacgccccaggacaaccagcuagcauauguuguuaucggcuuacuguucaugauacucaccguggcagccaacgagaugggccugcuggagaccacgaagaaagaccucggcaucggcuacgucgcugccgagaaccaccagcacgcgaccaugcuagacguagaccuucauccggccucugccuggacccucuaugcgguggcgaccacgguaauuacccccaugaugaggcacacgaucgagaacacuaccgccaacaucagucugaccgccauagccaaccaggccgcuauccugaugggccuugacaagggcuggcccaucucaaagauggacaucggcgugcccuuacuagcgcucggaugcuacucgcagguuaacccauugacccugaccgcggcaguccucaugcuuguugcgcauuaugcaaucaucggacccggguuacaggcgaaagccacgcgggaggcccagaagcgcaccgcagccggcaucaugaaaaacccaacggucgacgggauagucgccauugaucucgaccccgugguguacgacgccaaauucgagaaacaacuggggcagaucaugcugcucauccugugcaccucacaaauuuugcucaugcguacaacgugggcucucugcgaguccaucaccuuggcgaccggcccgcucacuacccugugggaggggagccccggcaaguuuuggaacaccaccauugccgucucaauggcuaacauauuucgggguagcuacuuggccggagccggacucgcguucagucugaugaagagucugggaggcgggcgacgagggacuggcgcccagggcgagacauugggagaaaaguggaagcggcagcugaaccaguuaucgaaaagugaguucaacacauacaaacgcagcgggauuauggagguggaccgguccgaggccaaggagggccucaaacgcggggagaccacgaagcaugccguuagccgagguacugcgaaguuacgcugguucgucgagcggaaccuagugaagcccgagggcaagguaauugaccuggguugcggccgcggggguugguccuauuacugugcaggguuaaagaaggucacagaagugaaaggcuacacuaaaggcgggcccggccacgaggagccuauccccauggccaccuacgguuggaacuuggugaaacuucacagcggcaaagaugucuucuucaugccgcccgagaaaugcgacacgcuccugugcgauaucggggaguccagcccuaauccuaccauagaggaggguagaacccugcggguucucaagaugguagaacccuggcuacgcggaaaccaguucugcauaaagauacugaacccauacaugcccucugucguggagacccucgagcagaugcagcgcaagcacgguggcaugcuggugaggaacccccuaagcaggaacagcacgcacgaaauguauugggucaguugcggaaccggaaacaucguguccgcaguuaacaugacauccaggaugcuccucaauagguucaccauggcucaucgcaaacccaccuacgagcgggacguugaucugggcgcgggaacccgccacgucgcgguggaaccugaagucgccaaccucgacaucaucggccaacggaucgagaauaucaagaaugagcacaaaucaaccuggcacuaugaugaggauaauccguauaagacaugggccuaucacgggagcuacgaggugaagcccuccggcagcgccuccagcaugguaaacggugucgugcgcuuacugacgaagcccugggacgucauccccauggugacccagauagcgaugacggacacgacgccguucggacagcagcgaguguucaaggagaaagucgacacccgcacgccccgggcaaagcgcgguaccacccaaaucauggaagugaccgcgaaguggcucuggggguuucuaucccggaacaagaagccccgcaucugcacccgggaggaguuuaccagaaaagugcggucaaacgccgccauuggggcggucuucguugacgaaaaccaguggaauagcgccaaggaggcuguugaggaugagcgcuucugggacuuagugcaccgggaacgagagcuacacaaacaggggaagugcgcgacaugcguguacaacaugauggguaagagagagaagaaacuuggggaguucggcaaagcgaagggcucccgcgccauuugguauauguggcuaggugcacgguuccucgaguucgaggcacuuggcuucaugaacgaggaccacugguucagccgagagaacucccugagcggggucgagggagagggucugcacaagcucggcuauauauuacgggacaucuccaagaucccuggcgggaacauguacgccgacgacaccgcagguugggacacucgcaucaccgaggacgaccuccaaaacgaggccaagaucacggacaucauggaacccgagcacgcacugcuugccaccagcaucuuuaagcucaccuaccagaacaagguagugcgagugcagcggccagcaaagaaugggaccgugauggaugugauuucccgacgggaccaaagaggcagcggccagguggggacguacggccugaacaccuucaccaauauggagguccagcugauccggcagauggagagugaggggaucuuccucccuagcgaacuggagaccccgaaccuggcugagcgugcccuagacugguuggagaaacacggcgcggaacggcugaagcgcauggcgaucuccggggacgacugcguagugaagcccaucgacgaccgguuugccacugcgcucacggcucugaacgacaugggcaaggugcgcaaggacaucccacagugggagcccagcaagggcuggaaugacuggcagcaggucccguuuugcucccaccauuuccaccagcugaucaugaaagaugggcgggagauuguuguccccugccgcaaccaggacgaacucguggggcgagcccgcgugagccagggugccggcuggucccugcgcgagacugccugccucggaaagagcuacgcgcaaauguggcagcucauguacuuucaccgcagggaccuccggcucgccgcgaacgccaucugcuccgcgguccccguagacuggguccccaccagccggaccacguggucuauccacgcgcaccaccaguggaugacaacugaagauaugcucuccgucuggaaccgcguuuggaucgaggagaacccguggauggaggacaagacacauguguccuccugggaagagguuccuuaccuggguaagagggaggaccaguggugcgguucacugaucggauuaacugcccgcgcaaccugggccaccaauauccagguggcaaucaaccaagugcgucggcuuaucggcaacgagaacuaucuggauuauaugaccuccaugaaacgcuucaaaaacgagagcgacccggagggggccuuaugguga

SEQ ID NO: 24037 - RNA, 9879 nt, Artificial Sequence
  derived and/or modified CDS sequence (opt11) from DENV-1__FJ639735__SS-prME
agcguuaccaugcugcucaugcuacugcccaccgcucucgccuuccacuugacgacucgggguggggagccacacaugauugugagcaagcaagagcgaggcaagagccuccuguucaagacuagugcaggcgugaacaugugcacguugaucgcaauggacuuaggcgagcucugcgaggauacgaugaccuacaaauguccccgaaucaccgaagcugagccagaugacguggacugcuggugcaacgccaccgacacguggguaaccuacggaaccugcucacagacuggagaacauaggcgcgauaagcgguccguggcccuggcgccccacgugggcuuaggucuagaaacgcgaaccgagacguggaugagcuccgagggcgccuggaagcagauccaacgggucgagaccugggcccugcgacaccccgguuucaccgucaccgcccuguuccucgcucacgccaucgggaccagcauaacgcagaagggcaucauauucauucuucugaugcucgugacgcccuccauggccaugcggugcgucgggauaggcaaccgcgacuucguggaggggcuaaguggugccacguggguggacguggugcuggagcacggcuccugcgugaccaccauggccaagaacaagcccacgcucgauaucgagcuccugaagacugaaguaacuaaccccgcuguccuccggaagcugugcaucgaggccaagaucagcaacaccacgaccgauuccaggugucccacccagggggaggccacccuaguggaggaacaggacgccaacuucgucugcagacgcacguuuguggaccgagggugggggaacggauguggcuuauucggcaaggggagccuguugaccugugccaaguucaaaugugugaccaagcucgaaggaaagaucguccaguaugagaacuuaaaguacagugugaucguaaccguccacacgggagaccagcaccagguugggaacgagaccacugagcacggcaccaucgcgacgauuacaccccaggcccccaccagcgagauccagcugaccgacuacggggcccuaacuuuagauugcucgccccgaacaggucuggauuucaacgagauggugcuccugaccaugaaggaaaagaguuggcugguccacaaacagugguuccucgaccugccgcugcccuggaccuccggggcgagcaccucucaggagaccuggaaccggcaggaccuacuggugaccuucaagaccgcccacgccaagaagcaggagguaguggugcugggcucacaggagggcgcgaugcacaccgcucucacuggugccacagagauccagacuagcgguaccacgaccaucuucgccggccaucugaaaugcagacugaagauggacaagcugacguugaaaggcacaucauacgucaugugcacggguaguuucaaguuagagaaggaaguagcugaaacgcagcacgguaccguucugguucaggugaaguaugaggguaccgacgcccccuguaaaauccccuuuucgacgcaggacgaaaagggggugacccaaaauggacggcuuaucaccgccaacccgauagugacggacaaggagaagcccgugaacaucgaaacagagccgcccuucggggaaagcuauaucguggucggugcgggugaaaaggcuuugaaacucuccugguuuaagaaggggaguuccaucggcaagauguucgaagccaccgcccgcggggcucggcgcauggcuauacucggagauaccgcgugggacuucggaucaaucggcggcguguucacuagugugggcaagcugguccaccagguuuucggcacggccuaugggguacuguuuucuggcguauccuggacuaugaagaucgggaucggaauccuccugacgugguugggccuuaacagccgcuccaccagccuaucaaugacgugcaucgccgucgggauggucacacuguacuuggguguaauggugcaggcugacagcgggugcgugauaaacuggaagggccgggagcugaaauguggguccggcaucuucgucaccaaugaggugcacacuuggacugaacaauauaaguuccaagccgacagcccuaaacgccuuagcgcugccauugggaaggccugggaagagggcgugugcggcauucgguccgccacgcgccucgagaacauuauguggaaacagauuagcaacgaauuaaaucacauccugcucgagaaugacaugaaauucaccgucguggugggggacgccaacggcauacuggcgcaaggcaagaagaugauccgaccucagcccauggaacacaaguacuccuggaagagcuggggcaaggccaagauaauaggcgcagauauccaaaacacgacguuuauuaucgacggccccgacacgccggagugccccgaugaccaacgugcuuggaacaucugggagguggaagacuacggguucgguauauucacaacaaacaucuggcucaaacugcgggacuccuacacccagaugugcgaccaccgccugauguccgcggccaucaaggacagcaaagccguccaugcagacaugggcuacuggaucgagagcgagaagaacgagacguggaagcuggccagggcguccuucauagaggugaagaccugcaccuggccgaagucucauacccuauggucuaacggaguccuugaaagcgagaugauaauccccaagaucuacggcgggccuaucucgcagcacaacuaucgacccggguacuucacgcagacagcaggccccuggcaccuggggaagcucgagcuggauuucaaccucugugagggcaccaccguugugguagaugagcacugcggcaacagaggaccgagccuccguacuaccaccguaacaggcaaaaucauccacgaguggugcugccgguccugcacacugccuccucugcgcuuuagaggugaggacggaugcugguacggaauggagauacgcccuguaaaggagaaggaggagaaccucgucagaagcaugguuucugccggaagcggcgaggucgacucguucucccugggcauucuaugcgucagcaucaugauagaagaagugaugcguucccgguggagccgcaagaugcuaaugacuggcacgcucgccguauuccugcucuugaucauggggcaauugacguggaaugaccucauccgacugugcaucauggucggugcgaaugcgagcgaccggauggggaugggcacgacuuaccuggcccugauggccaccuuuaagaugcgcccgauguuugccguuggccugcuguuccggcgccucaccagcagggaagugcuacugcucacgaucgggcuauccuuagucgccuccguggaguugcccaacucacuagaggaguugggcgacgggcucgcgaugggaauaaugaugcugaagcugcucacggaguuucagccccaccagcuguggaccacacugcucagccugacuuucaucaagacaaccuugucacucgacuacgccuggaagacaacggcgauggcgcugagcaucgucucccuguucccccucugccugucuaccaccucucaaaagaccaccuggcugccggugcuccugggcagcuucgguugcaagccccugaccauguuccucaucaccgagaauaagaucuggggucguaaguccuggccccugaacgaagggaucauggccauugggaucgucucuauccugcuuucuagccuguuaaaaaaugacgugccccuggccgggccacugaucgccgggggcaugcuuauagccugcuacguuaucagcgggaguucugccgaccuuucccucgagaaggcggccgaaguuagcugggagcaggaggccgagcacuccggcaccagucacaauauacugguagagguucaagaugacgggacuaugaagaucaaggacgaggagaaggaugacacacucaccauacugcugaaggcgacccuguuggcagugucgggugucuacccgaugagcauucccgcgacccuguucgugugguacuucuggcagaagaagaagcagagguccggcgugcucugggacacgccuagcccacccgaggucgaacgcgccgugcuggacgacggcaucuacagaaucuuacagcgcggucucuuagggcggucucaaguaggugucggaguguuccaggacggcguauuucacaccauguggcacguaacccggggggccguucugauguaucagggcaagcggcucgagccaucgugggcauccguuaagaaagaucucaucagcuacggcgggggguggcgcuuccaggggaguuggaacaccggcgaagaaguucaggugaucgccguugagcccgggaagaacccaaaaaacguccagacgaccccuggcacauucaaaacccccgagggcgaggugggggccaucgcccucgacuucaagccgggcacaagugggucucccaucgugaaccgggagggaaagaucgucggccuguaugggaauggcguugugaccaccagcgggaccuacgucagcgccaucgcccaggcgaaggcgagccaggaggguccccucccugagaucgaagacgagguguuuaagaaacgcaaucugaccaucauggaccugcauccggggucgggcaagacccgacgguaccuccccgccaucguaagggaggcgauaaaacgcaaguuaagaacucugaucuuggcucccacacgcgucgucgcguccgagauggccgaggcccugaaaggcaugccaauccgauaccaaacuacagccgucaagagcgagcacacugggagagagaucguagaccuaaugugccacgccacuuuuaccaugcgccuccuauccccugugcgggugcccaacuacaacaugaucguuauggacgaggcgcacuuuacggaccccgccucuaucgcagcccgcggcuacaucucgacacgaguagggaugggcgaggccgcggcaaucuucaugaccgccaccccccccggguccguagaggcguuuccccaguccaacgccgucauccaggaugaggagcgcgacauacccgaacggagcuggaacuccggcuaugacuggaucaccgauuucccagggaaaaccguuugguucgugccgagcauaaaguccgggaacgacaucgcgaauugccugcguaagaacggcaagcgggucauccagcucucgcgcaagaccuuugacacugaguaccagaagacaaaaaacaacgacugggauuacgucgugaccacugacauuucugagaugggggccaauuuucgggcagaccgcguuaucgacccccgccguugccuuaagccugucauucugaaagacgggccugagagggugauccucgcggggccgaugccaguaacgguggcgagcgcugcccaacgccggggccgcauuggccgaaaucaaaauaaagagggugaccaguacguauacaugggccagccacuaaacaacgaugaagaccaugcucauuggacagaggccaagaugcugcucgacaauaucaauacccccgaggggaucauucccgcucuguucgaacccgagcgcgagaagucagcugccaucgacggcgaguaucgccucaggggugaggcccgcaaaacguucguagagcuaaugcggaggggggaucugcccgucuggcuuagcuacaaggucgccuccgagggcuuccaguauagcgaccgccgcugguguuuugauggcgaacggaacaaucaagugcucgaggagaacauggacguagagaucuggacgaaggagggcgagcgcaagaagcuccggccccguuggcuagacgccagaacguacuccgacccgcucgcccugcgcgaguucaaggaguucgccgccgggcggcgcagcgucagcggggaucugauccuggagaucgggaagcugccccagcaccugacccuccgggcacagaacgcguuagacaaccuggugaugcuccacaacucugaacaggguggaaaagcauaccgccacgccauggaggagcugccagacaccaucgagacacucaugcuauuggcccugaucgcggugcucacugggggugucacgcuguucuucuuaagugggaagggucucgggaagaccuccaucgggcuccuuugugugaccgcaagcuccgcccuccuauggauggcaagcguagagccccauuggauugcugcgucgaucauacuggaguucuuccugaugguccugcugauucccgagccugaucggcaacgcacgccacaggacaaccagcucgcguacguggugaucggccugcucuucaugauacucaccguugccgccaacgagauggggcuacuggagacgaccaagcgggaccucgggauagggcacguggcugcggagaaccaccagcacgccacuaugcuagacguggaccuacgcccugccagcgccuggacacucuacgcgguagcuacaaccgugaucacccccaugaugagacacaccauugaaaacaccaccgccaacaucucccuaacggccauugccaaccaggcggcuauacugaugggccuggacaagggcuggccuaucagcaagauggacauagggguaccacugcuagcucucggcuguuacucccaggucaacccgcuuacucugacugcugcggugcuaaugcugguagcgcacuaugccaucauugggccuggacugcaggcaaaagccacccgcgaagcccagaaacgcacggcugccgggaucaugaagaacccuaccguagacgggaucguggcaauugaccucgaucccguggucuaugaugcuaaauucgagaagcaguuaggacagaucaugcugcucauccuaugcacuucgcagaucuuacuaaugcggaccacgugggcccugugcgaguccauaacccuagcgacgggcccgcucaccacgcugugggaggggagcccagguaaguucuggaacaccaccauagcgguguccauggccaacaucuuccgcggcagcuaccuggcgggcgccgggcuggcuuucuccuugaugaagagucugggggggggccggcgcggaacgggcgcacagggagagacucucggagagaaguggaagcggcagcugaaccagcucuccaagagcgaguucaacaccuacaaaagaucuggaaucauggaaguugaccgauccgaagccaaggaggggcucaagcgcggugagacaacuaagcaugcagucagccggggcacagccaaacugagaugguucguagaacggaaccucgugaagcccgaaggcaaggucaucgaccuuggcugcgggcgcggcgguugguccuauuacugcgccggccucaagaaggugacugaagucaagggguauaccaagggcggaccgggacacgaggagccgaucccgauggccaccuacgguuggaaccuggucaagcugcacagcgguaaggauguguucuucaugccgccugagaagugugacacccuucugugcgacaucggcgagucaagcccgaacccgacaaucgaagaggggcggacacuacgcguucucaaaaugguggagcccuggcuacgggguaaccaguucugcauaaagauccugaaccccuacaugccguccguaguggaaacccucgagcagaugcagcgcaagcaugggggaaugcucgugcggaaccccuugagccgcaacuccacccacgaaauguauuggguuagcugcggcacgggaaauauugugagcgcagucaauaugacuagccgcaugcuguugaacagauuuacgauggcgcaccgcaagcccacuuacgagcgggacguagaccugggcgcggguacgcgacacguggccguugagccggagguggccaaccuagauauuaucgggcagcggauugagaacaucaagaaugagcacaagaguacuuggcacuaugacgaggacaauccguacaagacgugggcuuaccacggcucauaugaggugaagcccucagggucagcauccagcauggugaacggcgugguccgccugcugacaaagcccugggacguuauuccgaugguaacgcagauugcgaugaccgauacaacccccuucggacagcaacguguuuucaaagaaaagguugacacccgcacgccucgcgccaagcggggaacaacucagaucauggaggugacugcaaaauggcuauggggauuccugucccgaaacaaaaagccuagaaucugcaccagggaggaguucacucgcaagguucggucgaaugccgcgaucggggccguguucgucgacgagaaccaguggaacagcgcaaaggaggccgucgaggacgagcgcuucugggaucuuguccaccgggaacgcgagcuccacaagcagggcaagugugcgaccugcguguauaacaugaugggcaagcgggagaagaaguuaggcgaguucgguaaggcgaagggcucucgcgcaaucugguacauguggcucggcgcccgguuccucgaguucgaagcccugggguucaugaacgaggaucacugguucagccgcgaaaacucccugagcggcgucgagggggagggccuacacaagcuuggguacauccugcgcgacauaucgaagaucccgggaggcaauauguaugccgacgacacggcgggaugggacacacgcaucacugaggacgauuugcagaacgaagcgaagaucaccgacaucauggagcccgagcacgcguugcuggccaccucuaucuuuaaacucacuuaucaaaauaaagugguacgcguccagcggccagcgaagaacggcaccgugauggacgugaucucccgcagagaccaacgcggcucgggccaaguugguacguauggacugaauacauuuaccaacauggaagugcagcuaauccggcagauggaaagugaaggcauuuuccuacccucagaacuggagaccccgaaccuggcggaacgcgugcucgacuggcuggagaaacacggggccgagcggcugaagcgcauggccaucagcggcgacgauugcgucguuaaacccaucgacgaccguuuugccacggccuugaccgcccugaacgacauggggaaggugcgaaaggacauaccccaaugggaaccgucgaagggauggaacgacuggcagcaagugcccuucugcucccaccacuuccaccagcuuaucaugaaggacgggcgagagaucguggugccgugucgcaaccaggaugaguuggucgggcgggcccgcgugagccagggcgcgggguggucacugcgggagacggccugcuuaggcaaaucguacgcccaaauguggcaacucauguauuuccaccgacgggaccuucgccuugcugcuaacgccauuugcucagccguccccgucgacuggguacccaccucgcggaccaccuggagcauccacgcgcaccaccaguggaugacgaccgaggacaugcucucuguauggaaucgcgucuggauugaggagaacccauggauggaagacaagacacaugugucauccugggaggaagugccguaucuggguaagcgcgaggaccaguggugcggaagucucaucggucucacugcccgggccaccugggccaccaacauccagguagccaucaaucagguaaggagacugaucgggaacgaaaacuaccuggauuacaugaccucgaugaagcgcuucaagaacgagagcgaccccgaaggagcucucugguga

SEQ ID NO: 24038 - RNA, 9879 nt, Artificial Sequence
  derived and/or modified CDS sequence (opt11) from DENV-1__FJ639740__SS-prME
uccgugaccauguuguugaugcugcugccaaccgcgcuugccuuccaccuaaccacccgaggcggggaaccgcacaugaucguguccaagcaggagcgggggaagagccuccuguucaagaccuccgcgggggucaacaugugcacccugaucgcaauggacuugggcgagcuuugcgaggacaccaugaccuacaagugcccccgcaucaccgaggcugagcccgacgacguugacugcuggugcaacgccaccgacacuuggguuacauacgggaccugcagccaaacaggagagcaccggcgugacaagcgcuccguggcccuggcgccucacgugggccuugggcuagaaacgcgaaccgagaccuggaugagcuccgagggugccuggaaacagauucagcggguugagaccugggcgcugcgccaccccggguucaccgugaucgcccuguucuuggcgcacgccaucggcaccagcaucacccagaaagguaucaucuuuauucugcugaugcucgugacccccucgauggcuaugcggugcgucggaaucggcaaccgagauuucguagaaggguugagcggcgcaacgugggucgacguuguccuggagcacggauccugcgugacgaccauggccaagaacaagccaacucucgacauagaacugcugaagacugagguuacaaaccccgcagugcuacggaagcuguguaucgaggccaagaucucaaacacuaccaccgacucgagaugcccgacgcaaggcgaggccacgcuaguggaggagcaggacgccaacuucgucugcagacgcacccucguggaccggggcuggggcaacggcugcgggcuauucggaaaggggucacugcuaacgugcgccaaauucaagugcgucaccaagcucgagggcaagaucguucaguacgagaacuugaaguacuccgugaucgugacgguccacaccggcgaucagcaccagguggggaaugaaacaaccgagcacggaaccaucgcgaccaucacgccccaagcgccuacgagcgagauucaacucacugacuacggcgcucugacucuggacugcagcccccgcaccggccucgacuucaacgagauggucuuacugacaaugaaggagaaauccuggcucguccacaagcagugguuccuggaccugccgcuccccuggaccuccggggccagcacgagccaggagacguggaaccggcaggaucuuuuaguaacguuuaaaaccgcacacgccaagaagcaggaggucguggugcucgguucucaggagggcgcgaugcacaccgcccuaacuggagccacggagauccagaccuccggcacuaccacgaucuuugccgggcacuuaaagugccgcuuaaagauggacaagcugacccugaaggggaugucauaugucaugugcacagggagcuucaagcuggagaaggagguugcggagacccagcaugguacggucuuaguccaagugaaauacgagggcaccgacgccccgugcaaaauccccuucgccacccaggaugaaaagggggugacucaaaauggcaggcugauaacagcuaauccgaucgugaccgacaaggagaagcccgugaacaucgaaaccgaaccgcccuucggggaguccuauaucgugguaggcgcgggcgagaaggcccugaaguuaagcugguucaaaaagggguccaguaucggcaagauguuugaagccaccgcccgaggggccaggagaauggcgauccugggggauacggcgugggacuucggguccaucggcgggguguucaccaguguggggaaacucguccaccagguguuuggaaccgcuuauggggucuuguucagcggcgucucauggaccaugaagaucgguaucggcaucuugcugacguggcugggccugaacucgcgaucaaccucgcugagcaugacuugcauagccguggggauggugacccucuaccugggggucaugguccaagccgacagcggcugcgugaucaacuggaagggacgggagcugaagugcgggagcggcaucuucgucacgaacgagguacacaccuggaccgagcaguacaaauuccaggcggacuccccaaaacgcuugagcgccgcgauugguaaggccugggaagagggggucugcggaauccgaagugccacccgccuggagaacaucauguggaagcagaucaguaacgagcugaaccacauccuccuggaaaacgacaugaaguucaccgucguggugggggacgcgaacggcauucuggcccaggguaaaaagaugauucggccccagccuauggagcauaaguacagcuggaagucauggggaaaggcuaagaucaucggcgccgacauccagaauacgaccuucaucauagacgguccggacaccccggaguguccagacgggcagcgggcguggaacauaugggaaguagaagacuauggguucggcauauucacaacaaacauaugguuaaagcugcgggacaguuacacccagaugugcgaccaccgcuuaaugagugccgcuaucaaggauucuaaggccguccacgccgacaugggauacuggaucgagagugaaaagaacgagaccuggaaacucgcgcgcgcuagcuuuauugaggugaagacuugcacguggcccaaaucucacacccuguggagcaauggaguccuggaguccgagaugaucauccccaagaucuacggcgguccgauuagccagcacaacuaccggcccggcuacuucacacaaaccgccgggcccuggcaccucggcaagcucgagcuggacuuugaucucugcgagggcacgacagugguggucgacgagcacugcgggaaucgugguccgagucuccgcacuaccacggugacagggaagaucauccaugaguggugcugccggagcugcacucugccuccgcugcgauuccguggcgaagacgggugcugguacggaauggagauacgcccaguaaaggagaaggaggaaaaccugguccgaucgaugguaagcgcaggguccggggagguggacagcuucagccugggcauccucugcgucuccaucaugaucgaggagguaaugcgcucgcgguggucccgcaagaugcugaugaccgggacucuggcgguguuccuacuguuaaucaugggccagcuuacauggaaugaccugauacgccugugcaucauggucggggcgaacgccagcgaccgcaugggcaugggcaccaccuaccucgcccugauggccacguucaagaugcgcccaauguucgcugugggacuccuguuccggcgacugaccucccgggagguucugcucuuaaccaucggccugagcuuagucgcguccguggaacugccgaacagccuggaagagcuuggggacggcuuagcuauggggauaaugaugcugaagcucuugaccgaguuucaaccccaccaacuguggacgacccuccugucccugaccuucgucaagaccacgcucucccuggacuacgccuggaaaaccaccgccaugguguuguccaucgucagccucuuuccccugugcuugucaaccacgagccagaagaccaccuggcucccggucuugcugggguccuucggcuguaagccgcucaccauguuccugaucacggaaaacaagauuuggggacgcaagagcuggccucuaaacgagggcaucauggcgaucggaauuguuuccauccucuugucaucccugcucaagaacgaugugccucuggccggcccgcugaucgccggcggaaugcucaucgccugcuauguaaucagcggcagcuccgccgaucugagccuggagaaagcggccgaggugucgugggagcaagaagccgagcacuccggagccucccacaacauucucguggagguccaggacgacgggacgaugaagauuaaggaugaagagcgggacgacacacugaccauccugcucaaggcgacccuguuagcggugagugggguguaccccauguccaucccagccaccuuguucgucugguacuucuggcaaaagaagaagcagcgcagcggcgugcugugggacacacccuccccgcccgagguagagcgggccgucuuggacgacgguaucuaccggauccugcagcgcggacucuuagggagaagccaaguaggggugggcgucuuccaagacggugucuuccacacuauguggcacguuacccgaggagccgugcugauguaccagggcaagcgucucgaacccagcugggcaagcgugaagaaggaccugaucuccuacggggggggguggcgcuuccaaggcagcuggaauacgggggaagaggugcaggucaucgcuguggaacccggcaagaacccgaaaaacgugcagacaacccccggcacuuucaaaacgcccgagggcgaagucggggccaucgcccuggacuucaagcccgggacguccggcagcccaaucgugaacagggagggaaagaucgucggucucuacggcaacgggguuguuacaaccucuggcaccuacgugagcgccaucgcccaggcgaaggcgagccaggagggcccccugcccgagauagaggaugaggucuucaagaagagaaaccugaccauaauggaccuccauccaggaagcggaaagacgcgcagauaccuaccggcuaucgugcgcgaggccaucaagagaaaacugcgcacccucauccucgcgccgacgcguguuguugccagcgagauggccgaggcacugaaggggaugcccauccgguaccaaaccacggccgugaagucagagcacacaggccgcgagaucguggacuuaaugugccacgcaaccuucacaaugcgcuuacugagcccgguccgcgugccaaauuacaacaugaucaucauggacgaggcccacuucacggauccggccuccaucgcagcucggggcuacaucagcacgcgcgugggcaugggggaggcugcugccauauucaugacggccacuccgccgggcagcgucgaggcguucccccagagcaacgcggugauacaggacgaggagagagacauccccgagcgcucuuggaacagcggcuacgacuggaucaccgauuuccccgggaagacagugugguuuguccccaguaucaaguccgggaacgacaucgccaacugccuccggaagaacgggaagagagugauccagcuuuccaggaagacguucgauaccgaguaccaaaagaccaagaacaacgacugggacuacgugguaaccaccgacaucagcgagaugggcgccaacuuccgcgcagaucggguaaucgacccccgccggugccugaaacccgugauucucaaggaugggccggagcgcgugauccuagcuggccccaugcccgucacuguagcguccgccgcccagcggcgcggacgaauuggccgcaaccaaaacaaggagggcgaccaguacguguacaugggccaaccccugaacaaugacgaagaccaugcgcauuggaccgaggcgaaaaugcuccuggacaacauaaacacucccgagggcaucaucccggcacuauucgagcccgagcgagaaaaguccgccgccaucgacggcgaguaccgacuccgcggcgaggcccggaaaacauucguggaacugaugcgccggggcgaccugcccgucuggcucuccuacaaaguggcgagcgagggguuccaguacucagaucgccggugguguuucgacggcgagcgcaauaaucaggugcucgaggagaacauggaugucgaaauauggacaaaggagggcgagcgcaagaagcugcgcccccgguggcucgacgcgaggaccuacucugacccacuggcacuucgugaguucaaggaauucgccgccggccgccguucagugagcggggaccugauccuggagauuggcaaguugccccagcaccuuacccugcgcgcgcagaaugcccuggauaaccucgugauguuacauaacagcgagcagggcgggaaagcguaccggcacgccauggaagagcugccggacaccauugagacacucauguugcucgcgcucaucgcuguccugaccggaggggucacccuauuuuuucucuccggcaagggacugggcaagaccagcaucggucuacuaugcgugacugcauccagcgcucuccuguggauggccucgguagagccccacuggaucgccgccucuaucauauuggaauucuuccugauggugcuguuaauaccggaacccgaccgccagcggacaccccaggacaaccagcuggccuacguggucauaggguuacuguuuaugauuuugaccgucgccgccaacgagaugggacugcucgagacgacgaaaaaggaccucggaaucggcuacguggcggccgaaaaccaucagcacgcuaccaugcuggauguugaucuccgcccugccuccgccuggacccuauacgcgguggccacuacggucaucacccccaugaugcgacacacgauugagaacacaacugccaacauuagccugaccgcgauugccaaccaggcggcgauccucaugggcuuagacaagggguggcccauaucaaaaauggacauuggcguacccuuguuagcccuggguugcuacucccaggugaacccgcugacccucaccgcagcgguacugaugcuggucgcucacuacgccaucauugguccgggucuucaagcgaaggccacacgcgaggcgcagaaacgcacagccgcgggcaucaugaaaaaccccacgguugacgggauaguggccauagauuuagaccccgucguguacgacgccaaguucgagaagcagcuggggcagauaaugcuccugauccugugcaccucccagauucuccugaugagaacgaccugggcguugugugagucaauaacccuugccaccgggccgcugacgacacugugggagggcagccccggcaaguucuggaacacgaccaucgcgguaagcauggccaacaucuuucgcggcaguuaccucgccggggcgggacucgccuucagccugaugaagucccucggggggggucgucgcgguacgggcgcccaaggcgagacccugggagaaaaguggaaacggcagcugaaucaacucucuaaguccgaguucaacaccuacaaacggucggggauaauggagguggaccggagcgaggccaaagaggggcugaagcgcggagagacgacgaagcaugcgguaucccgggggaccgcuaagcuucgcugguucguggagagaaacuuggucaagccugaaggcaaggugaucgaccucggcuguggccgcgggggguggucauacuacugugccgggcuaaagaaggugaccgaaguuaagggcuacaccaaaggugggccaggccacgaggagcccauucccauggccaccuauggauggaaccugguaaagcuccacagugguaaagacguguucuucaugccgcccgagaaaugcgauacgcuguuaugcgauaucggggaguccuccccgaaccccaccaucgaggaggggcggacccucagggucuugaaaaugguggagccguggcuccggggcaaucaguuuugcauuaagauccucaauccauacaugccgagcguuguagagacucuggaacagaugcagcggaagcacggcggcaugcuggugagaaauccccucucccgcaauagcacgcacgagauguauugggugucaugugggaccggcaauaucgucagcgcugugaacaugaccucccggaugcuucugaacagguucacaauggcgcaccgcaaacccacguacgagcgggauguggacuuaggcgccgggacgcgccauguggcuguggagcccgaggaggccaaccuggacauuaucggccaacgaaucgagaauaucaagaacgagcacaaguccaccuggcauuacgacgaagacaaccccuacaagacaugggccuaccacggauccuacgaggugaagcccucaggcucagcaucuuccauggucaacggggucguccgccugcucacaaagcccugggacguaauucccauggugacacagaucgccaugaccgacaccacgccguuuggccagcagcgggucuucaaggagaagguggacacccguacgccccgggcgaaacggggcacuacacagaucauggagguaaccgccaaguggcugugggguuuccugagccggaacaaaaagccccgcaucugcacccgggaggaguucacccgcaagguccgguccaacgcagcaauuggcgccguguucguugacgagaaccaauggaauucagcuaaggaagccgucgaggacgagagauucugggaccuugugcaccgggagcgcgaguuacacaagcagggaaagugcgcgacgugugucuauaacaugaugggcaaacgggagaaaaagcugggggaguucggaaaggccaaaggaucacgcgcgaucugguacauguggcucggagcccgguuccuggaguuugaggcacucggguuuaugaacgaggaccacugguuuucccgcgagaacagcuuaucgggggucgaaggcgagggccuccacaaacugggcuauauccuucgggacaucucaaagaucccaggcgggaacauguacgccgacgacaccgccggaugggauacacgcauuacugaggacgaucugcagaaugaggcuaagaucacggacaucauggaacccgagcacgcccugcucgcgaccuccaucuucaagcucaccuaccaaaacaagguggugcggguccaaagacccgcgaagaauggcaccgucauggacgugaucucgcgcagggaccagcgcggcagcggccaagugggcacguacggccugaacacuuucacgaacauggagguacaguugauccgccagauggagagcgaggggaucuuccugccaucggagcuggagaccccuaacuuggcugagcgcguacuggacuggcuggagaaacacggcgcggagcggcucaagcgcauggccauaucaggggacgacugcguugugaagcccaucgacgaccgguucgccaccgcgcugacugcccugaacgacaugggcaaggugcgcaaggacaucccccagugggagccgagcaagggcuggaacgacuggcagcaggucccguucugcagccaccauuuccaccagcucaucaugaaggacgggcgggagaucguggugccaugccgcaaccaggacgaguuagucgggcgggcccgagugucccagggggccggauggagccugcgggagaccgcaugccuagggaagucuuaugcgcagauguggcagcuaauguauuuccaccgccgggaucugcggcucgccgccaacgccaucuguagcgcggugcccgucgacugggucccaacgucccggaccacgugguccauccacgcgcaccaccaguggaugacaaccgaagauaugcugaguguguggaaucgcgucuggaucgaggaaaacccguggauggaagauaaaacacacgucuccagcugggaggaggugccauaccuugguaagcgcgaggaccaauggugcggcucccucaucgggcugacagccagagccacgugggccaccaacauccaagucgcgaucaaccaggugcgccggcuaaucgggaacgagaacuaccucgauuacaugaccagcaugaaacgcuucaagaaugaauccgaucccgagggggcacugugguga

SEQ ID NO: 24039 - RNA, 9879 nt, Artificial Sequence
  derived and/or modified CDS sequence (opt11) from DENV-1__FJ639741__SS-prME
agcgugaccauccuucucaugcugcugccaaccgcccuugccuuucaccugaccacacgcgggggagaaccccacaugaucguuagcaaacaggagaggggaaagagccuacuguuuaagaccagcgccggggugaacauguguacccugauagccauggaccuaggcgaacuuugcgaggacacuaugaccuacaagugcccccgcaucaccgaggccgagcccgaugacgucgacugcuggugcaacgccaccgacacaugggucaccuacgggaccugcagccagaccggggagcaccggagggacaagcggaguguggccuuggcgccccacgugggauuaggccucgagacgcgcaccgagacuuggauguccucggagggcgccuggaagcaaauccagcguguugagacgugggcucugcgccaccccggguucacagugaucgcccucuuucucgcacacgccaucggcaccagcaucacacagaaggggaucaucuucauucugcugaugcucgugaccccgucuauggccaugcggugcgucggcaucggcaaccgcgacuucguggagggguuaagcggcgccacguggguggacgucguccuggagcacggguccugcgucaccaccauggccaagaauaagcccaccuuggacaucgagcugcugaagacggaggucacuaaccccgcgguccuccgcaagcugugcauagaggccaagaucagcaacaccaccacggacagccgcugcccuacgcagggcgaggccacccugguggaggaacaggacgcaaacuuugucugccggcggacguucguugaucggggcugggggaacggcugcggccucuucggcaaggggucuuuguugacgugcgccaaguucaagugcgugaccaagcucgaaggaaaaauuguccaguacgagaaucugaaguacucagugaucgugacgguccauaccggagaccagcaccaaguggggaacgagacgaccgagcacggcaccaucgcgaccaucacuccccaggcccccaccagcgaaauacaacugaccgacuauggggccuuaacccuggacuguagcccaaggaccggccuagauuuuaacgagaugguccuccugacgaugaaggagaaguccuggcuagugcacaagcagugguuccucgaccuaccucuccccuggacguccgggaccagcaccucccaggagacguggaaccggcaggaucuccuggugacauucaagacggcgcacgccaagaagcaggaaguggugguguuaggcucccaggagggcgcgaugcauaccgcgcuuacuggggcaaccgagauacagacuagcggcaccacgaccaucuuugccgggcaccugaagugccgccugaagauggauaaacugacucugaagggcaccuccuauguaaugugcacggggagcuucaagcuggagaaagagguggccgagacccagcacggcacgguguuagugcaggucaaguacgagggcaccgacgcgcccugcaagauccccuucuccacacaggacgagaagggggugacccagaacgggagauugaucaccgcuaacccgaucguaaccgacaaggagaagccugugaacaucgagacggagccucccuucggggaaaguuacaucguggucggcgccggugagaaggcacugaaacuguccugguucaagaaggguagcucaaucggcaagauguuugaggcaaccgcccgcggugcucggcgcauggccaucuuaggggacacugcuugggacuucggguccaucggcggcguguucaccaguguggggaaguugguccaccagguguucgguacggcguacggcgugcuuuucagcggcgucucauggacaaugaagauaggcaucggcauccuucugaccuggcugggccuaaacagucgcuccacgagccuguccaugaccuguaucgccguggggaugguuacccuuuaccucggcguaauggugcaggcagauagugguugcguuauuaacuggaagggccgggagcugaagugcggguccggcaucuuugucacgaacgaggugcacaccuggacagagcaauacaaguuccaagccgacagcccuaaacgacuguccgccgcaaucggcaaagccugggaggagggggugugcgggauccgguccgcgacgcgccucgaaaacaucauguggaaacagaucagcaacgagcugaaccacauacugcuagaaaacgacaugaaguucaccgucgugguuggugacgcuaacggcaucuuggcccagggaaagaagaugauccguccacagcccauggagcacaaauacucuuggaaguccugggguaaggcgaagaucauuggcgccgacauucaaaacacgaccuucaucauugauggacccgacacaccggagugccccgaugaccagcgggccuggaacaucugggaagucgaggacuacggcuucgggauuuucaccaccaacauauggcugaagcuccgggacuccuacacccagaugugcgaccaccgccugaugucugcugcaaucaaggacucgaaagccgugcacgccgacaugggauacuggaucgaaucugaaaagaacgagacguggaaacuggccaaggccuccuucaucgaggugaagacaugcaucuggcccaagucucacaccuuguggucuaauggcguccuggagagcgagaugauuaucccaaagaucuacgggggccccaucucccagcacaacuaucggccaggguauuuuacccagacggccggccccuggcaccuggggaagcuagagcucgauuucgacuuaugcgaaggcacuaccguggugguugaugagcacugcggcaaccgagggccgagccucagaaccacgaccguuaccggcaagaucauacacgaguggugcugccgcuccugcaccuugccgccccugagguuucgcggggaggacggaugcugguaugggauggagauccggcccgucaaggaaaaggaggaaaaucucguccgcagcauggucuccgcuggcagcggagaggucgacucguucucauuagggauccuuugcgucagcaucaugaucgaggaggugaugcggucccgcuggagccggaagaugcucaugacggggacccuagcaguguuucugcuccugauaauggggcagcugacguggaacgaccucauccgccucugcauuauggucggcgcgaacgccuccgacaggaugggaaugggcaccacguaucuggcgcucauggccaccuucaagaugcggccgauguucgccgugggcuugcuguuccgccggcucaccagccgugaggugcuauuauugacaauaggacugagcuuggucgccagcguggagcucccgaacucccuggaggaacugggcgacggacucgccaugggcaucaugaugcugaagcugcucaccgaguuccagccccaccaacuauggaccacccugcuaagccugaccuucaucaagacaacccugucccucgacuaugcguggaaaacuaccgccaugguccugagcauugugucccuguucccguugugccugagcacgaccucccagaaaaccaccuggcugccggugcuccugggcagcuucgggugcaagccucugacuauguuccugaucacggagaauaagaucuggggccggaaguccuggccccugaacgaagggaucauggccaucggaaucgucagcauccugcucagcagccuguuaaagaaugacgugccccucgccgggccgcugaucgcgggcggaaugcucauugccuguuacgugauuagcggaucuagcgccgaucugucccucgaaaaggcggccgagguuagcugggagcaagaggcggagcacuccggcaccucacacaacaucuugguugaaguccaagacgacgggaccaugaagauaaaggacgaagaacgagacgacacauuaaccauccugcuuaaggccacccuccuggccguguccgguguguacccaaugagcauucccgcaacucuuuucgugugguacuucuggcagaagaagaagcagcguucuggcguccugugggauacccccucuccgcccgagguggaacgcgccgugcuggaugauggcaucuaccgcauccugcagcgcggacuacuagggcggagucaggucggcgugggaguguuccaggacggcguguuccacacgauguggcacgugacccguggggcggugcugauguaccagggcaagcgguuggagcccagcugggcuucagucaagaaggaccucaucagcuacggcgggggcuggcguuuccagggguccuggaacaccggggaggagguccaggugaucgccguugagcccggcaagaacccgaagaacgugcagacuacacccggcacuuucaagacccccgaaggcgagguaggcgcaaucgcccuggacuucaagcccggcaccagcggguccccgaucgucaaccgggagggcaagaucguuggccuguacgggaaugguguggucacgacaucgggaaccuacgugagugcaaucgcccaggccaaggccagccaggaaggaccccucccagagaucgaagacgaaguauuuaagaagagaaaccugacuaucauggaccugcacccggggaguggcaagacgcgacgcuaccucccagccaucguccgcgaagcgauuaagaggaagcugcggacccugauucucgccccaacucgcgugguugcaagugaaauggcagaggcgcuaaagggcaugcccauacgcuaccagaccacggccguaaagagcgagcacaccgggcgagagaucguggaccucaugugccacgccaccuucaccaugcgauuacuguccccggugcgaguccccaacuacaacaugauuaucauggaugaagcccacuuuaccgaucccgccagcauagcggcccgcggguacauuuccacgaggguggggaugggugaagccgcugccaucuucaugaccgcgacgccucccgggagcguggaggccuucccccaguccaacgccgugauccaagacgaggaaagagacaucccagagcggagcuggaacuccggcuacgacuggaucacagacuuccccggcaaaaccgugugguucguaccuagcaucaaauccgguaacgacaucgcgaacugccugagaaagaacggcaagcggguuauucagcucagccggaaaacguucgacaccgaguaccagaagacgaagaauaaugauugggacuacgucgugaccaccgacaucuccgagaugggggcuaacuuccgagcggaccgcguuaucgacccccggcgcugcuuaaagcccgugauacugaaggacggucccgagagggugauccucgcugggccgaugcccgucaccguggccagcgcagcgcagcgacggggccgcaucggccggaaucagaauaaggaaggggaucaguacgucuacaugggccagccucugaacaacgaugaggaccaugcacauuggacggaggccaaaaugcuacucgacaauauuaacacccccgaagggaucaucccggcccuguucgagcccgagcgugagaaguccgcagcgaucgacggcgaguaccgccugcgcggggaggcucgcaagaccuucgucgagcugaugcggcgcggcgaccugcccguguggcugaguuacaaggucgccuccgagggcuuccaguacagcgaucgccgcuggugcuucgacggcgaacgaaauaaccaggugcucgaggagaacauggauguggagaucuggaccaaggagggcgagcgcaagaaacugcggccccgcuggcuggaugcccggacguacuccgauccccucgcccuucgugaguucaaggaguucgcggccgggcggcgcagcgucagcggcgauuuaauccucgagauaggcaaacugccccagcaucugacgcuccgggcccagaacgcccuggacaacuuggugaugcugcacaacuccgagcaggguggcaaggcauaccgccaugcgauggaagaacuaccggauaccaucgagacccugaugcuccuggcccugaucgcugugcucaccggaggcgucacguuguucuucuuaucugggaagggccucgggaagaccuccaucggguuacugugcguaaccgccagcuccgcacugcuguggauggccucgguggagccccacuggauagcggccuccaucauccuggaguucuuucucaugguacuucugaucccggagcccgaccggcagcggacaccgcaagacaaucagcucgcguacguggugaucgggcugcuguucaugaucuuaacggucgcggccaacgagauggggcugcucgagacgaccaagaaggaccucggcaucgggcacguggccgccgagaaccaccaacaugccaccaugcuugacgucgacuugcggccggccagcgccuggacucucuacgccgucgccaccaccgugaucacaccgaugaugcgccacacgauugagaacacgaccgccaacaucucccugaccgcgaucgcgaaucaggccgccauccuaaugggguuagacaaaggauggcccauuagcaagauggacaucgggguuccccugcuggcccucggcuguuauucccaagucaacccgcugacgcugaccgccgcuguucuaaugcuaguggcccacuacgccaucaucgggcccggccugcaggcgaaggcuacccgggaggcccagaagcgcaccgccgcgggaaucaugaagaaucccacagucgacggcaucguugcgaucgaccucgaccccguggucuacgacgccaaauuugagaagcagcuaggccagaucaugcuccucauauugugcaccagccaaauccugcucaugcgcacaaccugggcccuuugugagucaaucacguuagccaccgggccccucaccacacugugggaagguucacccgggaaguucuggaacacgaccauagccguguccauggcgaacaucuuccgaggcagcuaccuugccggcgccggacucgccuucagccugaugaagucccugggcggaggccgccgggggaccggugcccaaggcgagacccucggggagaaguggaagcgccagcugaaccaguugucuaagagugaguucaacacguauaaacgaucuggcaucauggaaguggaccgcucagaggcgaaggagggauuaaagcggggcgaaacuacgaagcaugccgucagccgcggcaccgccaagcugcggugguuuguggagcgcaaccugguaaagcccgaggggaaggucaucgaccuaggaugcggucgcggggguuggucguacuacugcgccggccucaagaaggugaccgagguuaaaggguacacgaagggcgggcuugggcacgaggagccuauaccgauggcgacguacggcuggaaccuggucaaguuacauagcgggaaagacgucuucuucaugccucccgagaagugcgacacccuacugugcgacaucggcgaguccagcccuaacccgaccaucgaggaggggcgcacgcugcgggugcugaagauggucgagccauggcugaggggcaaccaauucugcaucaagauacucaaccccuacaugcccucugucguggagacacuggagcagaugcaacggaagcacggcggaaugcucguccgcaacccgcuaucuagaaauucgacgcacgagauguacugggugagcugcggaaccggcaacaucguguccgccgucaacaugacgucaaggaugcuuuuaaauagauucacgauggcccaccgcaaacccaccuacgagcgcgacguggaccucggcgccggcacccggcauguggccgucgagcccgaggucgcuaacuuggacauaaucgggcagcggauugagaauaucaagaacgagcacaaguccacuuggcacuacgacgaggacaaccccuacaagacuugggcuuaccacggcagcuacgaggugaagccguccgggagcgccuccuccauggucaauggagucgucaaacugcucaccaagcccugggacguuauccccauggugacucagaucgccaugacggauaccacaccuuucggucagcagcgggucuucaaagagaaggucgacacccgaacuccccgggccaagcgcgguaccacccaaauaauggaggugaccgcgaaguggcuguggggguuccuaucccggaauaaaaagccccgcaucugcacgagggaggaguucacccgcaaaguccggagcaacgccgcgauuggggccguguucguggaugaaaaccaguggaacagcgcgaaggaggcggucgaggaugagcguuucuggaaccucguccaccgggaacgcgaguuacacaagcagggcaagugcgcgaccugcguguauaacaugauggggaaacgggagaagaagcugggcgaguuugguaaggccaagggcucacgcgcgaucugguacauguggcucggugcgcgguuccuggaguucgaagcucugggcuuuaugaacgaggaccacugguuuagccgggagaauagccucagcggcguugagggggagggccugcacaagcugggguacauacuccgggacauuuccaagauacccggcggcaacauguacgcggacgacaccgcagggugggacacgcgcaucacugaagaugaucugcagaacgaggcgaagaucaccgacauaauggagccugagcaugcccuucucgccacaagcaucuucaagcugaccuaucagaacaaggugguccggguacagcgccccgcgaaaaacggcaccgugauggacgugaucuccagacgggaccagagggggagcggccaggucggcaccuacggguuaaacaccuucacgaacauggaagugcagcucauccgccagauggaguccgagggcaucuuucugcccucugagcuggagacacccaacuuagccgagcgcguacuggacuggcuugagaagcacggggccgagcgguugaagcgcauggcgaucucgggcgacgacugcgucguaaagccgaucgaugaccgguucgcuaccgcccugacugcacugaacgacauggggaaagugcguaaggacaucccccagugggagccuucuaagggcuggaacgacuggcagcagguccccuucugcucccaucacuuucaucaauuaauuaugaaagacggccgcgagaucguggugccgugcagaaaccaggaugagcuggucgggagggcaaggguuagccaaggagcgggguggucccugcgcgagaccgccugccugggcaaguccuacgcccagauguggcagcugauguauuuccaccggagggaccugcgcuuagccgccaacgcgaucugcuccgccgugcccgucgacugggugcccacgagccgaaccaccuggagcauccacgcccaccaccaguggaugaccacugaagacauguuguccgucuggaaccgcgucuggauagaggagaaccccuggauggaagauaagacccacgugagcucuugggaagaagugccguacuuagggaagcgugaggaccaguggugcggcagcuugaucgggcugaccgcccgcgcuaccugggcgacaaacauccagguugcuauuaaucagguccgacggcugauugggaacgagaacuaccuggauuacaugaccuccaugaagcgguucaagaacgagucggaucccgaaggagcccugugguga

SEQ ID NO: 24040 - RNA, 9879 nt, Artificial Sequence
  derived and/or modified CDS sequence (opt11) from DENV-1__FJ639743__SS-prME
agcgugacuaugcugcugaugcugcugccuaccgcccucgcguuccaccugacuacgaggggcggggagccccacaugaucgugagcaaacaggagcggggcaagagccugcuguucaagaccagcgcgggggugaacauguguacccuaauugccauggaccugggcgagcucugcgaggacacuaugaccuacaagugccccaggaucaccgaagccgagccagacgacgucgacugcuggugcaacgccaccgauaccuggguuacuuauggcacuugcagccagaccggcgaacaccggcgcgacaaacgguccguggcucuggccccccacgucggccuggggcucgaaacucgcaccgagacauggaugucguccgagggagcuuggaagcaaauacaaagaguagaaaccugggcccugcggcaccccggguucacggugauggcccuguuccuggcucacgcuauagggaccagcaucacgcagaaggggaucaucuucauccugcugaugcucgugacccccuccauggcgaugcgcugcgugggcaucggcaacagagauuucguugagggccugucgggcgccacguggguggacguugugcuggagcacgggucaugcgugacuaccauggccaagaauaaaccaacacucgacaucgagcugcugaagacugaggucaccaaucccgcgguguugcggaaauugugcaucgaggcgaagaucucaaacaccaccacggacucccgcugccccacccagggugaagccacccucguggaggagcaggacgccaacuucgucugucggcgcaccuucguggaucgcggcugggggaacggcugcggucuguucggcaaggggucccugcugacgugcgccaaguucaaaugcgugaccaagcucgagggcaagaucguacaauacgaaaaucucaaauauuccgugauagucacgguacacacaggugaucagcaccaggugggcaacgagacgaccgagcacggcaccauugcgaccaucacgccccaagcccccacuagcgaaauccagcugaccgacuacggggcacucacucuugacuguuccccgcggaccggccuggacuucaacgagaugguccuccugacgaugaaggagaaguccuggcuggugcacaagcaaugguuccucgaccugccguugcccuggaccuccggugccagcaccagccaggagaccuggaaccggcaggaccuccucguaacuuucaagaccgcacaugcgaagaagcaggaggucguggugcuggguucccaagagggagcgaugcacaccgcccucaccggggccacggagauacagaccucaggcaccaccacgaucuucgccgggcaucugaaaugccgccugaaaauggacaagcucacccugaagggcauguccuacgucauguguaccgggagcuucaagcuggagaaagaaguggcggagacccagcacggcacggugcugguccagguucgauacgagggcaccgacgcccccugcaagauccccuucucaacccaggacgagaaaggaguaacgcagaacggccgccucaucacggccaacccgauagucacagacaaggagaaacccgugaauauugagaccgagccgccguuuggagagagcuacauuguggucggcgccggagagaaggcgcugaagcuguccugguucaagaaagggagcuccaucgguaagauguucgaggccaccgcccgcggggcccgccgcauggcaauccucggagauacggccugggauuucgguagcaucggcggcguguuuaccuccguggggaagcugguccaccagguguucggcaccgcuuacggggugcuauuuucuggcguaucauggacgaugaagauugggaucggaauccuccuuacuuggcugggccucaacagccgguccaccagccuuucaaugacuugcaucgccguggggaugguaacucuguaccugggcgucaugguccaggcugacuccgggugcguaaucaacuggaagggccgcgaacugaagugcggguccggcaucuucgucacgaaugaagugcauaccuggaccgaacaguacaaguuccaggcggauaguccgaagcgucuuagcgccgccaucggcaaggccugggaagaggggguaugcggcauccgcagcgccacucggcucgaaaacauaauguggaaacagauuagcaacgagcucaaccacauccuccucgagaacgacaugaaauucaccgucguggucggggaugccaacggcauccuggcgcaagggaagaagaugauccguccccagcccauggagcacaaguacagcuggaaaucuuggggcaaagcgaaggucaucggcgcagacauccaaaacaccaccuuuaucaucgacgggccugacacuccagagugucccgacggccagcgggccuggaacaucugggaaguggaggauuacggguucggcauuuucaccacuaacaucuggcugaaacuccgcgauuccuacacucagaugugcgaccaccggcuuaugagcgcggcuauaaaggacuccaaggccguucaugcggacaugggcuacuggaucgagagcgagaagaacgagaccuggaaguuagccagagcgucuuuuaucgaggucaagacuuguacuuggcccaagucccacacccucugguccaacgggguacuggagucugagaugaucauccccaagaucuacggcgggccuaucagccagcacaacuaucgaccaggcuacuucacccagaccgcugggccuuggcaccugggcaagcucgagcucgacuucgacuuaugugaagggacgacaguaguuguggacgagcacugcgggaaucgcggaccuagccuucggaccacgacggugaccgggaagauaauccacgaguggugcugccgcuccugcacucugccgccccugcgguuccgcggcgaagacgggugcugguauggcauggagauccggcccgucaaggagaaggaggagaaccuagugcggagcaugguuucugcugggagcggggaggucgacagcuucuccuuagguauccuuugcgugagcaucaugaucgaggaggugaugcggucccgcuggagccguaagaugcucaugacuggcacgcuggccgucuuccugcuccuggucaugggccaacugaccuggaaugauuugaucagauuaugcaucauggugggggcaaacgcauccgaccgcauggguaugggaacgacguaccuggcccuaauggccacauucaaaaugcggccgauguucgcagucggucugcuauuccgccgguuaaccagccgcgagguuuuacugcucacuaucggccugagccuggucgcaagcguggagcuccccaacagucuugaggagcugggggauggccuggcgaugggcauuaugaugcucaagcuacucaccgaguuccagccccaccagcuguggacgacgcugcucagccucaccuucgugaagaccacgcuuucccucgacuacgcuuggaagacuacugccaugguccugagcaucgugucccuguucccccuuugccucucaaccacgucccagaagaccaccuggcugccagugcuccuggggagcuucgggugcaagccccuuaccauguuccucauuaccgagaauaagaucugggggcggaaauccuggccccucaacgagggcaucauggcgauugguaucgucucgauccuguuauccagccuccucaagaacgacgugccccuggccggaccgcugaucgcuggcggcaugcuuauugccugcuacgugaucagcggcucgucggccgaccucucccuggaaaaggccgcggaggucucgugggagcaggaggccgagcacuccggggcaagccauaacauacugguggaggugcaggacgaugguacaaugaagaucaaggacgaggagcgcgacgacacccucacaauacuguugaaagcgaccuugcuagccguuagcgggguguaccccaugagcauucccgcaacucuguucgugugguacuuuuggcagaagaagaaacaacgguccggcgugcucugggauacccccuccccgccugagguggaacgcgccgugcuggacgacggcaucuaucggauccugcagcgcgggcuguuaggucggucccaggucggggucgguguguuccaagacgguguauuccacacaauguggcacgugacccgaggcgcggugcugauguaccagggcaagcgacuggaacccucaugggcaagugugaagaaggaucucaucagcuacgggggcggguggcgcuuccagggcucauggaacacgggggaagagguccagguuauugccguugaacccggcaaaaacccgaagaauguacaaacgacccccggcacguucaagacgagcgagggggaggugggcgcaaucgcccuggauuucaagcccgggacguccggcagccccaucgucaauagagagggcaagauugugggucuguacggcaacgggguggucacaacauccggcacuuacguaagcgcaaucgcgcaggccaaggcaucucaagaagggccuuuaccagagaucgaggaugaaguauucaagaagcgcaaccugaccaucauggaccuccaccccggcucgggaaaaacucggcgcuaucucccagccauuguccgggaggcaaucaagcgcaagcuccgaacccucauccucgcccccacgcggguggucgcgagcgagauggccgaggcacugaaggggaugcccauucgcuaccaaaccaccgcggucaaguccgaacacaccggccgggagaucguugaucucaugugucacgccacguuuacuaugcgucucuugagccccgugcgggucccgaacuacaacaugaucaucauggaugaggcgcacuucacugacccugccuccaucgccgcccggggguacaucucuacuagggugggaaugggggaagccgcagcaauuuucaugacggcgacgccuccgggguccguggaagccuuuccgcagucuaacgccgucauccaagacgaggaacgcgauauccccgagaggaguuggaacagcggcuacgacuggaucacugacuuucccggucguaccguuugguucgugcccuccaucaagucugguaaugacaucgcuaacugucugaggaagaacgggaaacgcgugauacagcucucucgcaagacuuucgauacagaguaucaaaaaaccaaaaacaacgauugggacuacguugugaccacggacaucagcgagaugggggccaacuuccgcgccgaucgagucaucgacccgcgucggugccugaagcccgugauucuaaaggacggaccggagcgcgucaucuuagccggccccaugccggugacuguggcaucugcagcccagcgccgcggccgcauagggcggaaccagaacaaggaaggcgaccaguacgucuacaugggucagccccuaaacaacgacgaggaccacgcccacuggaccgaagccaagauguuacucgacaacaucaacacccccgaggguaucauccccgcgcuguucgagcccgagagggagaaguccgccgccaucgacggggaguaucggcugcgcggcgaggcccggaagacguucguggagcucaugcgcagaggcgaccugcccguguggcuguccuacaaggucgccagcgagggguuccaauacuccgacaggcgcugguguuucgacggcgagaggaacaaccagguguuagaggagaacauggacguagagaucuggaccaaggagggggagcggaagaagcuaagaccccgguggcuggaugcgcgcacauacagcgauccccucgccuuacgggaguucaaggaguucgccgcgggccgcaggagcgucuccggggaccuuauccucgaaauagggaaacugccgcaacaccugacccuccgcgcucagaaugcucuggauaaccuggugaugcuccacaacagugaacaaggcggaaaggccuaccgacacgccauggaggagcugcccgacaccauugagacgcugaugcucuuggcccugaucgcuguacuuaccggcgggguaacccuguucuuccuguccgggaagggccucggaaagaccagcaucggcuugcugugcguuacggccuccagcgcccuccuguggauggcuucuguggaaccccacuggaucgccgcgucuaucauccuggaguuuuuccucaugguccugcuuauccccgagccggaccgccagaggacgccgcaggacaaccagcuagccuacguagugaucgggcugcuauucaugauacucaccgucgcugccaacgagaugggccuguuagagaccacgaagaaggaccucgggaucggcuacguggcggcggagaaccaucagcacgccaccaugcuggacguggacuugcgccccgccagcgcuuggacacuuuacgccgucgcgaccaccgucaucaccccgaugaugaggcacaccaucgagaacaccacggccaacaucagccugaccgcgauagccaaccaagccgcaauccugaugggucucgacaaaggguggccgaucuccaaaauggauaucggagugccguuacuagcccucgggugcuacagccaggucaacccucugacuuuaaccgccgcaguccucaugcucguggcacacuaugccaucaucggcccugggcugcaggccaaggccaccagggaagcccagaagcgcacggccgccggcaucaugaagaaccccaccgucgacggcaucguggccaucgacuuagaucccguggucuacgacgccaaauuugagaagcaacuggggcaaauaaugcuacucauccugugcacgucccagauccugcucaugcggacgaccugggccuugugcgaaucuaucacccuggcgacuggcccccucacuaccuugugggaggggaguccgggcaaguuuuggaauacuaccauagcugugagcauggcuaacaucuuucgcggauccuacuuagccggggcuggccuagcguucagccugaugaaaucacuuggcggcgggcggcgcgggacgggcgcgcagggggagacccucggcgagaaguggaagcggcagcugaaccagcugagcaagagcgaguucaacaccuacaaacgcucugguauaauggagguggaccggagcgaggcgaaggagggccucaagcgcggugagacgaccaagcacgccgucagucggggcaccgcgaagcugcgcugguuuguggagcgaaaccuggugaagcccgagggcaagguaaucgaccucgggugcggacgcgggggcuggagcuacuacugcgccgggcugaagaaggugaccgaggugaagggcuacaccaagggcgggccuggccacgaggagccuaucccgauggcaaccuacggguggaaccuggucaaacugcacuccggcaaggacguguucuuuaugagccccgagaagugcgacacacuccucugcgacaucggggagucgagcccgaaccccaccaucgaggaggggcgaacccugcgagugcuuaaaauggucgagccguggcugcgcggcaaccaguucuguaucaaaauacugaaccccuauaugccuuccgugguggaaacccuggagcagaugcagcgcaagcacgggggcaugcugguccguaacccccugucacguaauuccacgcacgagauguacugggugagcugcggcaccggaaauauagucuccgccgugaacaugaccagccgcaugcuccugaaccgauucaccauggcccaccggaaaccgaccuacgagcgggacguagaucugggugcggggacccgccacguugccgucgagcccgaggaggccaaucucgauaucaucggccagcggaucgagaacauucguaacgaacacaagucuaccuggcacuacgacgaggacaacccuuacaagaccugggcuuaccacgggagcuacgaggugaagccuuccggcuccgccucuagcauggucaacgggguggugcggcugcugacgaagccgugggacgucauccccauggugacccagauagcuaugaccgacaccacaccguucggccagcagcgcgucuucaaagagaaaguggacacacggacgccccgcgcuaagcgggggaccacgcagaucauggagguuaccgccaaguggcucuggggguuucugagccgaaauaagaagccccggaucugcacccgcgaggaguucacccggaaagugcgcuccaacgccgccaucggcgccgucuucguggacgaaaaccaguggaacagcgcuaaggaagccguggaggacgagcgguucugggaucugguccaccgcgaacgagagcuccacaagcagggcaaaugugccacaugcguguacaacaugaugggcaaacgcgagaagaagcucggugaauucgggaaggcgaaaggcucccgagccaucugguacauguggcugggagcccguuuccuugaguuugaggcccucggcuucaugaacgaggaccacugguucagcagggaaaauucccugagcgggguggagggcgaaggguuacacaagcugggcuacauccugcgggacaucuccaaaaucccgggcggcaacauguacgccgacgacacggcgggaugggacacucgcauuaccgaggacgacuugcagaacgaggccaagaucacggacauaauggagccugagcaugcccugcuggccacaagcaucuucaaguuaacauaucagaacaagguagugaggguucagcggccggccaagaacgggacuguuauggacgugaucagucgucgggaccagcggggcagcggccagguggggacguacggccugaacaccuucaccaacauggaaguccagcugauucgacagauggaguccgaggggauuuuccuccccagugagcuggagacccccaaucuggcggagcgagugcucgauuggcuggagaaacauggcgcugaacgccugaagagaauggccaucucgggggacgacugcguagucaaaccgaucgaugaccgguucgccacggcccucaccgcucugaacgauaugggcaagguucggaaggacaucccgcagugggagccuucaaaaggauggaacgacuggcagcaagugcccuucugcucccaccauuuccaccaauugaucaugaaggacggucgcgagaucgucguaccaugccggaaucaagacgagcucgucggucgcgcccgggucucccagggggccggcuggucccuccgagagacggcuugccuggguaaaagcuacgcgcagauguggcaguugauguacuuccaccggcgcgaccugcgccuggcagccaacgccaucugcagcgccgugccaguugauuggguaccgaccucccggacaacauggagcauccaugcgcaccaccaguggaugaccaccgaggacaugcuguccguguggaaucgcguguggaucgaggagaauccguggauggaggacaaaacacacgucucguccugggaggaggugcccuaucugggcaagcgggaggaccaguggugcggcagccugaucggccucacugcccgcgcuaccugggcuaccaacauccagguagccaucaaccagguccggagauuaaucggaaacgagaacuaccuagacuacaugaccuccaugaaacgguucaagaaugagagcgauccggagggggcgcucugguga

SEQ ID NO: 24041 - RNA, 9879 nt, Artificial Sequence
  derived and/or modified CDS sequence (opt11) from DENV-1__FJ639794__SS-prME
ucagugaccaugcuacucaugcugcugccuaccgcccucgccuuucaccugacuacccgcgggggggagccacacaugaucgugagcaagcaagagcggggcaagucacuccuguuuaagaccagcgcgggggugaacauguguacccuaaucgcuauggaccuaggcgaacucugcgaggacaccaugaccuauaaaugcccuaggauaaccgaggccgagcccgacgacguggacugcuggugcaacgcuaccgacaccugggucaccuacggcaccugcucucagaccggcgagcaccggcgcgacaagcggucaguggccuuagcgccccacgugggacugggacucgagacccguaccgagacuuggaugagcagugagggugccuggaaacagauccagcgggucgagaccugggcccuccgacaccccggguucacggugauagcccuguucuuggcgcacgccaucggcaccagcaucacacagaaggggaucaucuucauccuucuuaugcucgugacccccuccauggccaugcggugcgucggcaucggcaaccgagacuucguggaggggcugucaggcgccacguggguggacgucgugcuggagcauggaucuugcgugaccaccauggccaagaauaagcccacacucgauaucgagcugcugaaaacggaggucaccaacccagcggugcuccggaagcugugcaucgaagccaagaucagcaacacgaccacggacucccgcugcccgacccagggcgaggccacccuugucgaggagcaggacgccaacuucgucugccggcgcacuuucguggaccggggaugggggaacggcugcggccuuuucggcaaagggagccugcugacgugcgccaaauucaagugcgugacgaagcucgaagguaagaucguccaguacgagaaucugaaguacuccgugaucgugacgguccacaccggcgaccagcaccagguggggaacgagacgaccgagcauggcaccaucgcuaccaucacgccccaggccccaacgagcgagauccaguuaaccgauuacggggcccucacccuugauugcagcccccgcaccggccuggacuucaacgagaugguccuucugacuaugaaggagaaguccuggcugguccacaagcagugguuucucgaccugccgcugcccuggaccucuggggccagcacgagccaggaaaccuggaaccgucaggacuuacuggugacauucaagaccgcccacgcaaagaaacaggaggucguggugcugggcucucaggagggugccaugcacaccgccuugaccggggccacggagauacagaccagcggcaccaccacgaucuuugccgggcaccugaagugccgccugaaaauggauaagcucacccugaaaggcauguccuacgucaugugcaccgggagcuuuaagcuggaaaaggagguggcggagacgcagcacgguacaguccuuguccaaguaaaguacgaggggacagacgccccuuguaaaauccccuucaguacucaggacgagaagggggugacccagaacggcaggcucauaacggccaacccgaucgucacugacaaggagaagcccguuaacaucgagaccgagccgcccuuuggcgagagcuacaucguggucggcgccggcgagaaggcgcuaaagcuguccugguucaaaaagggcuccuccaucggcaagauguucgaagccaccgcacgcggugcccgaagaauggccauccucggcgacacggcgugggacuuugggagcaucggcgguguguucaccuccguagggaagcugguccaccagguauucgguaccgccuacggggugcuauucagcggcgucuccuggacgaugaagauugguaucggaauacucuuaacgugguugggccucaacagcagguccacgagccuguccaugaccugcaucgugguggggauggucacccuguaucucggcgugauggugcaggcagacagcgggugcgucaucaacuggaagggccgggagcugaaaugcggguccggcaucuucguaacgaacgaagugcacaccuggaccgagcaguauaaguuucaggccgacaguccgaagcgccugagcgccgcgaucggaaaggcuugggaggagggggucugcggcauccggucggccacacgccucgagaacaucauguggaaacagauaagcaacgagcugaaccacauccugcucgagaacgacaugaaguucaccgugguggucggggacgcaaacgguauucuggcccagggaaaaaagaugauccgcccccaacccauggagcacaaguacuccuggaaguccuggggcaaggccaagauaauaggcgcagacauccagaacaccaccuucaucaucgacggcccugacaccccggagugccccgauggccagagggccuggaacaucugggaaguggaggacuacggguucgggaucuucaccacgaauaucuggcugaagcuccgggacucauauacccagaugugcgaccaccgccuuaugagcgccgccauuaaagacuccaaggccgugcacgccgacaugggcuacuggauugagagcgagaagaacgagacguggaaacuggcucgggcauccuuuaucgaggucaagaccugcacauggcccaagucgcacacccucuggaguaacggggugcuggagagcgagaugaucaucccaaagaucuacggugggccgaucucccagcacaacuaccgccccggcuacuuuacccagaccgcggggcccuggcaccugggcaagcuggagcuggacuucgaccugugcgagggcacgacuguggugguagacgagcacugcgggaaucggggccccagccuccgcaccaccacggugaccggcaagaucauccacgaguggugcugccgguccugcacgcugccaccacugagguuccggggcgaggacgggugcugguacggcauggagauccgccccgucaaggagaaggaggagaaccucgugcggagcaugguguccgccggcagcggggaagucgacagcuucucccuggggauccugugcgugucuauaaugaucgaggaggugaugcgcucccgguggagccgcaagaugcugaugaccgggacccuggccgucuuccugcuccugaucaugggucaacugaccuggaacgaucucaucaggcuuugcaucauggugggagccaacgccuccgaccggaugggcaugggcacaaccuaucucgcgcucauggcgacauucaagaugcgcccgauguucgcagugggccugcuguucaggcgcuuaacaagccgggagguacuacuccucaccauugggcuguccuuagucgccagcguggagcuccccaacucccuggaggagcugggagacggccucgcuaugggcaucaugaugcugaagcuguugacugaguuccaaccccaccagcuguggaccacccuuuugagccucaccuucgugaaaaccacucugagccucgacuacgcguggaagacuaccgccauggugcuuagcaucguuucgcuguucccacucugccugagcacgacgucacagaaaaccaccuggcuacccguucuccuggggagcuuuggcugcaagccacuuaccauguuucucauaaccgagaacaagaucugggggcgcaaguccuggccccugaacgaggguaucauggccaucgggauugugaguauccuucuuuccagccuguugaagaaugacgucccccuugcgggcccgcugaucgcgggcgggaugcugaucgccugcuacguuauuagcggcuccagcgcggaccucucccuggagaaggccgccgaggugagcugggagcaggaggcggagcacuccggggccagccacaacauacuggucgaggugcaggacgacggcacaaugaagaucaaggacgaggagcgcgacgacacccucaccauccuccugaaggcgacccuccuagccguauccgguguuuaccccaugagcauccccgccacgcuguuugugugguacuucuggcaaaagaagaagcagcgcuccggcgugcuaugggacacccccagcccgcccgaggucgagcgggcggugcuggaugacggcaucuaccgcaucuugcaacggggguugcucggccgcucgcaggugggggucgguguauuccaggaugggguguuccacacgauguggcacgucacccgaggcgccgugcucauguaccaggggaagagacuggagcccagcugggccuccgucaagaaggaccucauuagcuaugggggcggcuggcgguuccaaggcuccuggaacacaggggaggaggugcaggugaucgccguggagcccggcaagaauccgaagaauguccagacuacccccgggaccuucaagacaccggagggugaagugggcgccaucgcgcuggacuucaagcccgggaccagcgguucuccgauagugaaccgcgagggcaagaucguagggcuguacggcaaugggguggugacuacgagcggaacguacgucuccgcuaucgcccaggccaaggccucucaggaggggccccucccugaaauagaggacgaggucuucaagaagcggaaccugaccaucauggaccugcacccggggagcggaaagacccgccgauaucuccccgcgaucguccgcgaggccaucaagcggaagcuucggacauugauccucgcccccacgcgcgucguagccucggagauggcagaggcgcugaaagggaugcccauacguuaccaaaccaccgccgucaagagcgagcacaccggccgcgagaucgucgaucuaaugugccaugccacuuuuaccaugcgguugcuauccccggugagaguaccgaacuacaacaugaucaucauggacgaggcucacuucaccgacccugcgagcaucgccgcccggggcuacaucuccaccagagucggaaugggggaggccgccgcgaucuucaugacggcuacgccacccggaucgguggaggccuucccccaauccaacgccgugauccaggacgaggagcgggacauccccgagcgcagcuggaaccugggcuacgacuggaucaccgacuuccccggcaaaaccgucugguuugugcccucaaucaagagcgggaacgacauugccaacugcuugcggaagaacgggaaacgcgucauccaacugucccggaagacguucgacaccgaguaccagaagaccaagaacaacgacugggacuaugucgugacgacggacaucuccgagaugggcgcaaauuuccgagccgaccgggugaucgauccccgccggugccugaagccggucaucuuaaaggacggacccgagcgugugauccuugcgggcccgaugccaguuaccguggccucggcagcccagagacgcgggagaauaggccgcaaccagaacaaggaaggcgaccaguacguguacauggggcagcccuugaauaacgacgaggaccacgcacacuggaccgaagccaagaugcuccuagacaacaucaacacccccgaggguaucauuccggccuuguuugagcccgaacgcgagaaguccgcggccauugacggggaguaccggcuccgcggcgaggcccggaagacguucgucgagcugaugcgccggggcgaccugccgguguggcucucguacaaggucgccagcgagggauuccaguacuccgaccgacgguggugcuucgauggcgagcgcaauaaccagguccuggaggagaacauggacguggagaucuggaccaaggagggcgagcggaaaaagcugcgcccacgcuggcuagacgccaggacauacagcgacccccuggcucugcgggaguuuaaggaguucgcagcaggccgccgguccguguccggcgaccucauccuggagaucgggaagcugccacaacacuugacccugcgcgcccagaaugcguuggacaaccucguaaugcugcacaacucugagcagggcgggaaagcguaccggcacgccauggaagagcugcccgacaccauagagacacucaugcugcuagcccucaucgccgugcucaccggggggguuacccuguucuuccucucaggcaaaggccuggggaagacgagcaucggccugcucugcguaaccgccuccagcgcccugcuguggauggccuccguggagccccacuggaucgccgccagcaucauucuagaguucuuccugauggugcuacucaucccggaacccgacaggcagcggacgccccaggacaaucagcuggcguacguugugauuggacuccucuuuaugauacugaccguagccgcgaacgagaugggccugcuagagaccacuaagaaggaccuggguaucggguacgucgccgccgaaaaccaccagcacgcgacgaugcuagacguggaccuccgcccggccuccgcuuggacuuuauacgccguggccaccacgguuaucacccccaugaugcggcacaccaucgagaacacaacggcgaacaucagcuugaccgccaucgccaaccaggccgcaauacucaugggccuggacaagggguggcccaucaguaagauggacaucgguguuccucuccucgcgcuggggugcuacagccagguuaacccgcugacgcucaccgcugccguucugaugcugguggcccacuacgcuauuaucggcccaggccuccaagcuaaggcuacgcgggaggcccagaagcggaccgccgcgggaaucaugaagaaccccacuguggauggcauuguagccaucgaccuggaccccguggucuacgacgcaaaguucgagaagcagcuggggcagaucaugcugcugauccugugcaccucccaaaucuuacugaugcggacgaccugggcccucugcgaaucaaucacccucgccaccggcccgcugacgacacugugggaggggucccccggcaaguucuggaauacaaccauagcggucagcauggccaacaucuuucgcggcucuuaccucgcaggagccggucuggcauucagccugaugaagucucucgggggaggucggcgcggcacgggcgcgcagggggagacacugggugagaaguggaagcggcagcugaaccaguugaguaaguccgaauucaacacuuacaagcgcagcgggaucauggagguggaccggagcgaggccaaggagggccugaagcgcggggagaccaccaaacacgccgugucgcggggcaccgcgaaacugcgcugguucgucgagcggaaccuggugaagcccgagggcaaggugaucgaccucgggugcggccgcggaggcuggaguuacuacugcgcggggcugaagaagguaaccgaggugaagggcuacaccaagggcgggcccggucacgaggaaccgauccccauggccaccuacgguuggaaccuagucaagcuccacuccggcaaggacgucuucuucaugccgcccgaaaagugcgacacgcugcucugcgauaucggggagagcucucccaaccccaccaucgaagaaggucggacccucaggguucugaagaugguggagcccuggcugaagggcaaucaguucuguaucaagaucuuaaaccccuacaugccaagcgugguggagaccuuggagcagaugcagcguaagcacgggggcaugcuagugcgcaacccccucucccggaacucaacgcacgagauguacugggucuccugcgggaccggcaacauugugagcgccgugaacaugaccucccggaugcugcugaaccgguucacgaugguccaccgcaagcccacguacgagcgagaugucgaccucggcgccgggacucgacacguugccgucgagcccgaaguggccaaucuggacauuaucggccaacgcauugagaacaucaagaacgaacacaaaagcaccuggcacuaugacgaggacaacccguacaaaacgugggccuaccacgguuccuacgaagugaagccaagcggcuccgccagcucuauggugaauggaguugugcggcuacucacgaagcccugggacgugaucccuauggugacccagaucgccaugacugacaccacgccguucggccagcagcgcgucuucaaggagaagguggacacacggacgccccgcgccaagcggggcaccacacagaucauggagguuacggcgaaguggcuauggggguuccugucucgcaacaagaagccgcggaucugcacccgggaggaguucacgcgaaagguccgcuccaacgccgccaucggcgccguguucguggacgagaaccaguggaacagugccaaggaggcgguugaggaugagcgguucugggaccucgugcaucgcgagcgggagcuacacaagcaggggaagugcgcgacgugcguuuauaauaugauggguaagagagagaagaaacugggggaguucggcaaggccaagggcagccgggccaucugguacauguggcugggggcccgguuccuggaguuugaagcccuuggguucaugaacgaggaccacugguucucccgagaaaauagccucagcggggucgagggcgagggacugcacaagcugggcuacauccuccgcgacauuucgaagaucccgggcgguaacauguacgccgacgacaccgcaggcugggauaccagaaucaccgaggacgaccuccagaacgaggcuaagaucacggacauaauggagccggaacacgcuuuacucgccaccuccaucuucaaguugacuuaccaaaacaaggugguccgcguucagcgccccgccaaaaacgggaccgugauggacgucauuucacggcgugaccagcggggcucgggccaggucgggacguacggccugaacaccuucaccaacauggaggugcaacucauccgccagauggagagcgaggggaucuuccugccgucagagcuggagaccccgaaucucgccgagcgggugcuggacuggcuggaaaagcacggcgccgagcgccucaaacgcauggcgaucucaggggacgacugcgucgugaaacccaucgacgaccguuucgcaacggcccugacagcccugaacgacauggggaaggugagaaaggacaucccccaaugggagcccuccaagggcuggaacgacuggcagcaagucccguucugcagccaucacuuccaccaauuagugaugaaagacgggagagagauugugguccccugccggaaccaggacgagcuggugggccgcgcccgggugucccagggggcgggcuggagccugcgcgagaccgccugccucggaaaguccuacgcccagauguggcagcugauguacuuucacaggagggaccugcggcuagccgccaacgcgaucugcagcgccguccccguagacuggguuccgacaucgcgcaccaccuggagcauccacgcccaccaccaguggaugaccaccgaggacaugcuguccgucuggaaccgggucuggaucgaggaaaacccguggauggaggacaagacccacgugaguagcugggaggagguccccuaucugggcaagcgcgaggaccaguggugcggcucccucaucgggcugacggcccgcgcgacuugggccaccaacauccaaguggccauuaaccagguacggcgccugauugggaacgagaauuaccucgauuacaugaccagcaugaagcgguucaaaaacgaguccgaccccgagggggcccugugguga

SEQ ID NO: 24042 - RNA, 9879 nt, Artificial Sequence
  derived and/or modified CDS sequence (opt11) from DENV-1__FJ639796__SS-prME
agcguaacgaugcuucugaugcuccuaccaacagcccucgcauuccaccuuacgacccggggaggagaaccacacaugaucguaagcaaacaagaaaggggaaaaucccuacucuuuaaaaccuccgcgggaguaaauaugugcacacuaauagcgauggacuuaggagaacugugcgaagacacaaugaccuacaaguguccaaggauaacagaagcggaaccugacgacgucgacugcuggugcaaugccaccgacacuuggguaaccuacggaacaugcucccaaacgggcgaacauaggagagacaaacgaagcguagcccuagccccgcacguaggacuaggccucgaaacgaggaccgaaaccuggaugaguagcgaaggagcuuggaagcaaauccaacgugucgaaacaugggcccucagacaucccggauucaccgucauugcacuauuccuagcacacgcaauaggcacgagcaucacucaaaaagggauuauuuucauacuacucauguuagugaccccgucgauggcaaugcggugcguuggaaucggcaauagagacuucguggaaggauugucaggugccacuuggguggacgugguuuuagaacacggguccugcgucaccacgauggccaaaaacaaaccgacacuggacaucgagcuacucaaaacggaagucacgaacccagcaguccugcggaagcuguguauagaggccaaaaucucaaacacuacaacagauagcagauguccaacgcaaggcgaggcgacucuaguagaagaacaggaugcaaauuucguaugccgacgcaccuucguagaccguggcuggggcaauggaugcgggcuauucggaaaagggagccuguugacaugcgccaaauucaaaugcguuacaaaauuggaggggaagauaguacaauaugagaaccuaaaauauucggugauaguuacgguccacacaggagaccaacaccaggucggaaacgaaacgaccgagcacggcacgauagccacgauaacaccccaagcucccacgagugaaauccagcucaccgacuacggcgcacugacuuuggacugcucuccccguacagggcuagauuuuaacgagaugguauugcucacgaugaaggagaaaucaugguuaguacauaagcaaugguuccuagaccugccacucccguggacgagcggggcgagcacgucccaggaaacguggaaccggcaagaccuuuuaguaacuuucaagacagcacacgccaaaaagcaggaaguaguggugcuugguagucaggagggggcaaugcacacggcacugaccggcgcuacagaaauacaaaccuccggcacaacgacaaucuucgcaggacaccugaagugucgccuaaagauggacaaacucaccuugaaagggaugucauaugugaugugcaccggcagcuucaagcuggagaaagagguagcggagacgcaacauggaacgguccuaguacaggugaaguacgaaggaaccgacgcccccugcaaaauacccuuuuccacccaggacgaaaaaggcgucacacagaauggcagguugauaacagcuaacccgauagugacagacaaagaaaagcccguaaauaucgagacagaacccccauucggagaaaguuacauaguagucggggccggcgaaaaggcacuaaagcucagcugguucaagaaaggcucuagcauuggaaagauguucgaggcgacggcgcgcggagcacgccggauggccauacucggugacaccgcuugggauuucgggucaaucggaggaguguuuacauccguaggaaaguuaguccaccaggucuuugggaccgcguacggaguccucuucucaggggugagcuggaccaugaaaauaggcaucggaauccuacugacauggcuagguuuaaacucacggaguaccagccuaucaaugacgugcauagcggugggcaugguuacucuguaccucgguguaaugguucaagccgauagcgguugcgucaucaacuggaaagggagagagcuaaaaugcggaaguggaauauucguaacuaacgaggugcacaccuggacugagcaauacaaauuucaggccgacucccccaaacgacucuccgcugccauagguaaagcaugggaggaaggcguaugcggcaucagaagugcaacccgccuugagaacauaauguggaaacaaauuaguaacgaacugaaccauauucuccucgaaaacgacaugaaguucaccgucgugguaggggacgccaacgggauucucgcacaagggaagaaaaugauccgaccccaacccauggagcacaaauacucauggaaaucauggggcaaagccaaaauaaucggagcggacauucagaacacgacauucaucaucgacggaccagacacgccagaaugcccggacgggcagagggcguggaauauuugggaggucgaagacuauggauucggcauuuucacuaccaacauauggcugaaacuacgcgacagcuauacgcaaaugugcgaccacagacucaugucagcugcuauaaaagauucgaaggcgguacaugcggauaugggcuacuggauugaaagcgagaaaaaugaaacauggaagcuggcgcgcgcaucuuuuaucgaaguaaaaacgugcacguggcccaaaucacacacucuguggucaaauggcguucuugaaucggaaaugaucauuccgaagauauacggcggcccgauaucgcaacauaacuaccgcccaggguacuucacccagacugccggccccuggcaccuaggaaaacuugaacucgauuucgaccugugcgagggcacaacagucgugguagacgaacacuguggaaaccgcggacccucucuaaggaccacuacagugaccggaaagaucauccaugagugguguugccguaguugcacccugccgccccuaagauucaggggugaagacggcugcugguauggcauggaaauaaggccaguuaaagaaaaagaagaaaaucuagugcgaucgaugguaagcgccggcaguggcgaagucgacucauucucauugggcauucucugcguaucaaucaugauugaggaaguaaugaggucgcgguggagccgaaagaugcuaaugaccgguacccuggcuguuuuucugcuccuaauaaugggucaauugaccuggaacgaccuaauaagacucuguaucaugguaggagcaaacgcauccgacagaauggggaugggcaccaccuaccucgcauugauggcgacguuuaagaugaggccaauguucgcagucggacuacuauuccgcagacucaccucucgcgaaguacuccugcuaacaauagguuuaagccuaguggccucaguggagcuuccgaacagccuagaagaacuaggcgacggacuggcgaugggcauaaugaugcuuaaacuccuaaccgaguuccaaccacaccaacucuggaccacucucuuaucgcucaccuucgugaaaaccacacucucacuagacuacgcauggaaaacuaccgcgaugguccuaucgaucgucucccuguuuccucuaugccuaucaacgaccagccaaaagacaacaugguuacccguacugcuggguucauucgggugcaagccgcucacaauguuccucauaaccgagaauaagauauggggccggaaaagcuggccccucaaugagggaaucauggcaaucgguauaguguccauccuccuuucaagccuacuuaagaacgacguaccgcuggccggcccccucaucgccggcggaaugcuaaucgccugcuacguaauauccggauccagugccgaccucagccuggaaaaagcggccgagguaagcugggagcaggaggccgagcauagcggcgcgagccacaacauauuaguggaaguccaagaugaugggacaaugaagauaaaggaugaagaaagggacgacacacugacuauucuucugaaggcaacguugcuagcggucaguggcgucuacccgaugucuauaccagcaacauuguucgugugguauuucuggcagaagaagaaacaacgaucgggaguacugugggacaccccaucgccucccgaaguagaacgugcaguauuagacgaugggauauaucgaauacugcagcgaggacugcucggccgcucacaagugggagugggaguuuuccaagacgggguguuccauacuauguggcacguuacccgaggggccguacucauguaccaaggaaaaagacucgaacccuccugggccucagucaaaaaggaucucaucuccuacggcggagguuggcgguuccaaggaaguuggaacacaggggaagaaguacagguaauagcaguggaaccggggaagaaccccaaaaacguacaaacaaccccaggaacuuucaaaacaccagaaggggaaguaggagcgaucgcccuagacuuuaagccagguacaagcgguucgccgauagugaauagagaaggaaagaucguuggucuauacggaaacggagucguuaccacgucugguacguacgucagugccaucgcucaagcgaaagcuagccaagaaggaccucuuccugagaucgaagacgaaguguucaagaagcgcaacuuaacgauaauggaucuccacccaggcagugggaagacccguagguacuuaccagccaucgugcgagaagccaucaaaaggaaacugagaacgcuaauccuugcaccgacgcgagucgucgccagcgagauggccgaagcacuaaagggcaugccuauccgcuaccagacaacggcagucaaaucugaacacacagggcgagagauuguggaccucaugugccacgccacguucaccaugagacuccuuagcccgguacgcguccccaauuacaacaugaucauaauggacgaagcccacuucaccgacccugcgucuaucgcggcaagaggguauauauccacacgcgucggaaugggagaagcagccgcaaucuuuaugaccgcaacaccgccuggcagcgucgaggcauucccacaaucuaacgccgugauccaggacgaggaacgcgacauucccgagaggagcuggaacuccggcuacgacuggauaacagacuuuccgggaaaaaccgucugguucgucccaucaaucaaaucagggaaugacauugcaaauuguuuacguaaaaauggcaaaagggucauacaacucucucgaaaaacguucgacacagaguaccagaagacgaaaaacaacgauugggacuauguagucacaacggacauaagcgaaaugggagccaacuucagagcggacagagucauagacccacggcgcugccugaaaccgguuauccuuaaggacgggccggagagggucauacuagcagggcccaugcccguuaccguagcgagcgccgcacaacgccgaggcaggaucgggagaaaccaaaacaaagaaggagaccaauauguauacaugggccaaccacuaaauaacgaugaggaccacgcccacuggacagaagcaaagaugcucuuggacaacauaaacacucccgaagggauuauacccgcuuuguucgagccugaacgagagaaaucagcagccauugacggagaguaccgccugcguggcgaagcccgaaaaacauucgucgagcugaugcgacgaggagacuugcccguauggcucaguuacaaggucgcauccgaaggguuccaauauuccgacaggagauggugcuuugacggagaacgaaacaaccaaguacucgaggagaacauggacguagaaaucuggacaaaggagggagaaagaaagaaacugcgcccgagauggcuggacgcccggacauacucagauccacuugcccuacgcgaguucaaggaauuugccgcuggacggcgaagcgucucaggagaccuuauacucgaaaucggcaaacucccacaacaccucacacuacgagcccaaaacgcgcucgacaaccuagugaugcuccauaacucugaacagggcggcaaggcguacaggcacgcaauggaggaacuucccgacacaauagaaacguugauguuauuggcacucauagcgguccucacaggcggaguaacguuauucuuccucagugggaaaggucuaggcaaaacgucaaucggacuacuguguguaacagccagcucagcacuccuauggauggcaucaguagagccacacuggauugcggcaagcauaauacucgaguucuucuugauggugcuacuuauacccgagccagacaggcagaggaccccgcaagacaaccagcuagccuacguggugauaggccuacuguucaugauccugacgguggcagcaaacgaaaugggccuccuagagacgacuaagaaagaccuagggaucggcuacguagccgccgaaaaucaccaacacgcaacaaugcuagacguagaccuccgcccugcaucagcguggacucucuacgcgguggcuacuacaguuauaaccccaaugaugcggcacaccaucgaaaacacuacagcgaacauuuccuugaccgcaauagcgaaucaagccgcaauacucaugggacuggauaaaggauggcccaucucgaaaauggacauuggggucccuuugcuggcccuaggaugcuauucacaagugaauccgcuaacccugacggcggcagugcugaugcucguagcgcacuacgccauuaucgggccaggccuccaagcuaaagcgaccagggaagcacaaaaacggacagcggcaggcaucaugaaaaacccuacaguggacggaaucguagccaucgaccuugacccgguaguauacgacgccaaauuugagaaacagcugggacagaucaugcuacucauccugugcacuucacaaauccuccucaugcgaaccacgugggcucucugugagagcauaacgcuggcaacaggcccucuaacaacacuaugggaaggcucacccgggaaguucuggaacaccaccauagcaguaucaauggcaaauaucuuccgaggcagcuaucucgcuggcgcuggacucgcauuuagccuuaugaaaagccuagggggcggacgcagaggaaccggcgcucaaggggaaacacuuggugagaaauggaaacgucaauuaaaccaacucaguaaaagugaguucaacaccuacaagcgcucaggaauaauggaaguagaccgcagugaagccaaagaaggacuaaaaagaggagagacuacaaaacacgcggugagucggggcacugcgaaacuucgaugguucgucgaacgcaaucuagucaagccggaaggaaaagugauagaccucggaugcggcagaggcggaugguccuacuauugcgcuggucucaaaaagguaacagaagucaagggauacacuaagggaggcccggggcaugaagaaccgauacccauggcaacauacggguggaaucugguaaaguugcacuccggcaaagacguguucuucaugccucccgagaaaugcgacacccuacuaugcgacauuggcgagaguaguccaaacccaacgauagaagagggccguacacuccgcgucuugaagaugguagagccauggcucaagggaaaccaauucugcauaaagauccuaaacccguauaugccgagcguaguagaaacacucgaacagaugcaaagaaaacacggcggcaugcuuguaagaaacccgcugucccgcaacucgacccacgagauguauugggucucuugcggcacaggcaacauagugagcgccguaaacaugaccuccagaaugcugcucaaccgcuuuacaauggcccacagaaaacccacauacgagagagaugucgauuuaggugcagguacacggcauguggccguagaacccgaaguugcaaaccucgauauaauaggacagcgcauugagaacaucaagaaugaacacaagagcacauggcauuaugacgaggacaaccccuacaagaccugggcuuaucacggaucauacgaaguuaagccaaguggaagugcauccucgauggucaauggggucgugcgccugcugacaaaaccuugggacgugauccccauggugacccaaaucgcgaugacugauacaaccccauuuggacaacaacgaguauuuaaagaaaaaguagacacaagaacgccgagagcgaaacggggcaccacgcagauaauggaaguaacagccaaaugguuauggggauucuuaagucggaauaaaaagccccgcauaugcacacgagaagaguucacgagaaaaguacggucaaaugcagcuaucggcgcuguauuuguggacgaaaaucaauggaauagcgcuaaagaggcgguagaagacgaacgguucugggaucucgugcauagagagcgcgagcugcauaagcaagguaaaugcgcaaccugugucuacaacaugaugggaaaaagggaaaagaaacuuggagaguucgggaaagccaaaggcagcagagccauuugguauauguggcuaggcgcucgcuuccucgaguucgaagcgcucggauucaugaacgaggaccauugguuuagccgagaaaauucgcuuaguggcguagagggcgaaggccuccacaaauugggcuauauccugcgcgauauaaguaaaaucccugggggaaauauguacgcggaugacacagcagggugggacacccgaauuacagaagacgacuugcagaaugaagcaaaaauuacugacaucauggagccggaacacgcgcuccucgcgacguccauauucaaacugaccuaccaaaacaagguagugaggguccaacgacccgccaagaauggaacggugauggacgugaucuccagaagagaucaacgggguagcggccaagugggaaccuacgggcuaaauaccuucaccaacauggaagugcaacuaauaagacaaauggaauccgaaggcaucuucuugccaagugagcuagaaacgccgaaccucgcagagaggguacucgacuggcuugaaaaacacggcgcagaaaggcugaaacgaauggcaauaucaggggacgacugugucguuaaacccaucgacgaucgguucgcgacggcgcugacggcccucaaugauaugggcaagguccguaaagacauaccacaaugggagccaagcaaaggguggaacgacuggcaacaagucccguucugcagucaccacuuccaccagcuuauaaugaaagauggccgcgaaauugucgucccaugucgaaaccaagacgaacucguggggagagcacgcguaucacaaggcgccggauggucgcuacgagaaacagcaugccuagggaaaagcuacgcgcaaauguggcaacuaauguauuuccacaggcgggacuuaagacuugcagcaaacgcuaucugcucagccgugcccguggacugggucccgacaaguaggacaaccuggucgauacacgcgcaucaccaguggaugacuacggaagacaugcuuagcguuuggaacagggucuggaucgaagagaaccccuggauggaggauaagacacacgugagcagcugggaagaagugccguauuuggggaaacgggaagaccaauggugcggaucauugauagggcugacagcccgggcgaccugggccacuaacauacagguggccauaaaccaaguccgaagacucauaggcaacgaaaauuaccuugauuauaugaccucgaugaaaagauucaaaaacgaaagugacccagaaggggcccuaugguga

SEQ ID NO: 24043 - RNA, 9879 nt, Artificial Sequence
  derived and/or modified CDS sequence (opt11) from DENV-1__FJ639797__SS-prME
agcguuaccaugcugcucaugcugcugccgaccgcccuugccuuccaccugaccacuaggggcggggaaccacacaugauagugagcaaacaggaaaggggcaagucacuacucuucaagaccagcgccggggugaauaugugcaccuuaauugcuauggacuuaggugagcuuugcgaggauaccaugacguacaaauguccucggaucacagaagcugaacccgacgauguugacugcugguguaacgccacagacacgugggugacauacgggaccugcagccaaaccggcgaacaccggcgggacaagcgguccguagcucuggcgccacacguaggccuugggcucgagacgcgcaccgagaccuggaugucguccgagggcgccuggaagcagauacagcggguagagaccugggcccugcgucaccccggguucacugugauugcccuguuccucgcgcaugcaaucgguacgagcaucacccagaaggggaucaucuucauccugcuuaugcucgugacccccuccauggccaugcgaugcgucggcaucggcaaccgcgauuuuguggaagggcucagcggcgccacguggguggacgucguucuugagcacggauccugcgugacgaccauggccaagaacaaacccacgcuggauaucgagcuguugaagaccgagguuacuaacccugcggugcuccggaagcugugcauagaggccaagaucagcaacacaaccacagacucccgcugcccuacucagggcgaggcaacccugguggaggagcaggacgccaacuucgucugccggcgcacauucguggaccggggcugggggaacggcugcggacucuucgggaaagggagccugcugacgugugccaaguucaaaugcguaaccaagcucgagggcaagaucguacaguacgagaaccugaaguacucggugauugugacgguccauaccggugaucagcaccaaguagggaacgagacgaccgagcacggcaccaucgccaccauuacgccccaggcccccaccucggaaauacagcugacggacuacggggcucucacccuggacugcagcccucggaccggacuggacuucaacgaaaugguucuucugacgaugaaagagaaguccuggcuagugcacaagcagugguuccucgacuugccgcugcccuggacauccggugccagcaccagccaggagaccuggaaccggcaggaccuccuggugacuuucaagacagcccacgcuaagaaacaggaagucguagugcuaggcucccaggagggugccaugcacacagcucucacgggcgccaccgagauccagaccagcggcacgaccacaaucuucgccgggcacuugaagugccgccugaagauggacaagcucacacugaaaggcaugucguaugucaugugcacugggagcuucaagcuggagaaagagguagcggagacccagcacggaacaguccuggugcagguaaaguaugaggguacagacgcuccaugcaaaauccccuucaguacccaggacgaaaagggggugacucagaacggccggcucaucacagcgaacccuaucgucacugacaaggagaaaccugugaacaucgaaaccgagccgccauuuggggagagcuacaucguuguaggcgccggugaaaaagcguuaaagcugagcugguucaagaaggguuccucgauuggcaagauguucgaggcaaccgcuagaggggcaagacgcauggcgauccucggagacacggcgugggauuucggaaguaucggaggcguguucacaagugugggaaagcugguccaccagguguuuggcaccgccuacggggugcuguucuccgguguguccuggacaaugaagauagggaucggcauacuacugacguggcugggccucaacucaagguccaccagccucuccaugaccuguauugccgucggaaugguaacccucuaccucggggucauggugcaggcagauucggggugcguuaucaauuggaaaggccgggagcugaagugcggaagcggcaucuucgucacgaacgaggugcacaccuggacugagcaguacaaguuccaagcagacaguccuaagcgccugucagcggcuaucggccgagccugggaagaaggggugugcggcaucaggagugccaccagacuagaaaacaucauguggaagcagaucagcaacgagcuaaaccacauccugcucgagaacgauaugaaguucaccgucguugugggggacgccaauggcauccuggcgcagggcaagaagaugauccgcccacagccuauggaacacaaguacuccuggaaguccugggguaaagccaagaucaucggcgccgacauccagaacacgacuuucauuaucgacgggcccgauaccccggagugccccgacggccagcgggccuggaacaucugggagguggaggacuacgguuucgguaucuucacaacgaauaucuggcuaaagcucagagacuccuacacucagaugugcgaccaccggcugaugucugcggccaucaaggacuccaaggccgugcacgccgacaugggcuacuggauagagagcgagaagaacgagaccuggaagcuggccagggcguccuucaucgaggugaaaaccugcaucuggcccaaaagccauacccucugguccaaugggguccuggagagcgagaugaucauccccaagaucuacggugggcccaucucccagcauaacuaucggcccggauacuuuacccagaccgccggccccuggcaccugggcaaacucgagcucgacuucgacuuaugcgagggcaccacgguggugguugacgagcauugugggaaccgagggccgucucuucgcaccacaaccgugacugguaagauaauccacgaguggugcugucgcuccugcacccuuccgccgcuaagauuuagaggcgaggauggcugcugguacggcauggagauccggcccguaaaagagaaggaggagaaccucguccgcucgauggugagcgccggcagcggggagguggacucuuucucucugggcauccugugcgucagcaucaugaucgaggaggugaugcggucccgcuggagcaggaaaauguugaugaccgggacgcuggcuguguuucuguugcuuaucaugggccagcugacuuggaacgaccucauccggcugugcaucauggugggggcgaaugccagcgaccgcaugggcaugggcacaaccuaucuggcccuuauggccacuuucaagaugcguccgauguuugcaguggggcugcuguuuaggcgccucaccagucgcgaggugcuucugcucaccaucggauugucccuuguggccagcguagagcuccccaauucccuggaagaacucggggacggccucgcgaugggcaucaugauguugaagcugcucaccgaguuccagccccaccaauuauggaccacgcugcugagccugacauucgucaagaccaccuugucccucgauuacgccuggaagacgaccgccauggugcuuagcaucgugucucucuucccccucugccucuccaccaccucacagaagacgaccuggcugccuguccuccuagggagcuucggcugcaagccccuuacaauguuucucaucacagagaauaagaucugggggcgaaaguccuggccauuaaaugagggcaucauggccaucgggauugugaguauccugcuauccucccucuuaaagaacgacgugccgcuagcggggccgcugauagcuggcgggaugcugaucgccugcuacguaaucaguggcuccagcgccgaccugagccucgagaaggcagcggaaguuagcugggaacaagaggccgaacacagcggggccagucacaacauucugguggaaguccaagacgacggcaccaugaagauaaaggacgaggaacgcgacgacacccucaccauccugcugaaggccacgcuccuggccguguccggcguguaccccaugagcaucccugcaacccucuucgucugguacuuuuggcagaagaagaagcagagauccggcgugcucugggauacgcccagcccgcccgaaguugagagggccguccuggaugacgguauauacaggauccuucaacgcgggcugcucgggcgaucacaaguggguguaggcguguuccaggaugggguguuccacaccauguggcacgugacacgcggugccguccucauguaucaagguaagcggcuagagcccagcugggccuccguuaagaaagaccucaucagcuacggcggcggauggagauuccaggguuccuggaauaccggggaggaagugcaagucauugcugucgagcccggcaagaacccgaagaacguccaaacgacccccggcaccuucaagacacccgagggggaagucggggcaaucgcccuggacuucaagcccgggacgucggggucccccauugugaaccgggagggaaagaucguggggcuauacgguaacggugucgucaccaccagcgguaccuacguguccgccaucgcgcaggccaaggcgucgcaggaggguccacucccggaaaucgaagaugagguguucaagaagaggaacuuaaccaucauggaccugcaccccggcucuggcaagacccggagguaucugcccgcgaucgugagagaggccauaaagcgcaaacuucgcacccuuauccucgccccgacucggguggucgcguccgagauggcugaggcccugaaagggaugccuauccgauaccagacuaccgccgucaagagcgaacacaccggcagggaaaucguggacuuaaugugccacgccaccuucacgaugcgccuucugaguccgguccgggugcccaacuacaauaugaucaucauggacgaagcgcacuucaccgaccccgccaguaucgccgcacgaggguauaucucuacgcggguuggcaugggagaggcugcggccaucuucaugaccgccacgccgccuggcuccguagaggccuucccucaaaguaacgccgucauacaggacgaggagagggacauccccgagcguagcuggaacuccggcuaugauuggaucaccgacuuccccggaaagaccguuugguucgucccgucaaucaaguccggcaacgauaucgcgaacugccugcgcaaaaacgggaagcgcgugauccagcuaucacgcaagaccuuugacacggaauaccagaagaccaagaacaacgacugggacuacguggucaccaccgacaucuccgaaaugggagccaauuuucgggcagaccgcgugaucgauccaagacggugucuaaaacccgugauacugaaggacggcccugagcgcgucauacucgccgggcccaugcccgugacagucgcgagcgcggcccagcgacggggccgcauugggcgaaaucagaacaaggagggcgaucaauacguguacauggggcagcccuuaaacaacgacgaggaccacgcccacuggacggaggcuaaaaugcuucuagacaacauuaacacccccgagggcaucaucccggcgcuguuugagccugaacgggaaaaguccgccgccaucgacggcgaguaucgauuacguggcgaggcgcgcaaaaccuucguagagcucaugcggagaggggacuugccggucuggcugagcuauaaaguggccuccgagggguuccaguauagcgacaggcgcuggugcuucgacggugagcggaauaaccaggugcuggaggagaacauggacgucgagaucuggaccaaggagggggagcgcaaaaagcugcggccacgauggcuggacgcgcggacguacuccgacccguuggcccugcgugaguucaaggaguucgccgccggccggaggucugugucuggcgacuuaaucuuggagauagguaaacugccucagcaccugacccugagagcccagaaugcgcuggauaaccuugugaugcuccauaauucugagcagggcgggaaggccuaccgccacgcuauggaagaacugcccgacacaaucgagacccugaugcuccuggcccugaucgcgguacucacaggcggggugacccuuuucuuccugagcgguaaggguuuggggaagaccuccaucgggcugcugugcgugaccgcuucauccgcccuccucuggauggccagcgucgagccacacuggaucgccgccuccauaauccuagaauuuuuccucauggugcugcucaucccagagccugaccggcagcgcacgccacaagacaaccagcucgccuacguaguuauaggguuacuguucaugauccugaccguagccgcgaaugagaugggccugcuagagacuaccaagaaagaccucgggaucggcuacguggccgcggagaaccaccagcacgccacgaugcuggacgucgaucugcggccggccagcgccuggacccucuacgcagucgccaccaccguuaucacgcccaugaugcgccacaccaucgaaaauaccacugccaacaucucccugacggcgaucgcuaaccaggccgcaauccugaugggucuagacaaaggguggcccaucagcaagauggacauaggcguccccuugcuugcccucgggugcuacagucaggugaacccgcugacucugacagcggcgguauugaugcuggucgcucacuaugcgaucaucgggcccgggcugcaggcgaaggccacccgcgaagcccagaagagaaccgcggcgggcaucaugaagaaccccaccguggauggcaucguggccauugaccucgaccccguuguguacgacgcaaaguucgaaaagcagcugggacagaucaugcugcucauccugugcaccagccagauacuucucaugcguaccacaugggcccugugcgaguccaucaccuuagcgaccggaccgcucaccacgcugugggaggggagccccggaaaguucuggaacacuaccaucgccgucuccauggccaauaucuucagggguagcuaucucgcgggggccggccucgcguucuccuuaaugaagucccuagggggcggucgccguggcaccggcgcccagggugagacucucggagagaaguggaagcgccaacugaaccaacuguccaaaagcgaguucaacaccuacaaacggagcggcaucauggaggucgaccgcuccgaggccaaggagggccucaagcgcggcgagacuaccaagcaugcuguaagccgugggacggcgaaacuuagaugguucgucgaaaggaaccuggucaagccugaaggaaaggucaucgaccugggcugcggucgcggcggcuggagcuacuacugcgcuggguugaagaagguaaccgaagucaagggguacacgaagggagggcccggccacgaggaacccauccccauggccacuuacggguggaaccuggugaagcugcacagcggcaaggacguguucuuuaugccgcccgagaagugcgacacccuccuuugcgauaucggggagaguagcccgaaccccacgauagaagaggggcguacccugcgaguccucaagaugguggaacccugguuaaaggggaaccaguuuugcauuaagauuuugaacccuuauaugccguccguggucgagacccucgagcagaugcagcgcaagcacgggggcaugcuaguacggaaccccuuaagccgcaacuccacgcacgagauguacugggugagcugugguacaggcaauauugucuccgccgugaauaugaccagccggauguuacucaaucgcuucaccauggcccaccguaagcccacguacgagcgggauguggaccucggcgcaggaacgcggcacgucgccgucgagcccgagguagccaacuuagacauuaucggccagagaaucgagaacaucaagaacgagcacaaguccaccuggcauuacgaugaggauaacccguacaagaccugggcguaccacggaagcuacgaggucaagccaucaggcagcgccucgagcaugguaaauggugucguccgccugcugaccaaaccuugggacgugauucccauggucacgcagaucgcgaugaccgacacuaccccguucggccaacaacgaguguucaaggagaagguggauacgcgcacgccucgggcgaagcgcggcaccacccagauaauggagguuacggcaaaguggcucuggggguuccuaucccggaacaagaaaccccgcauuugcacccgggaggaguucaccaggaaagugcggagcaacgcagccaucggugcgguguucgucgacgagaaccaguggaacucagccaaggaggccguugaggaugagcgauucugggaucucgugcaccgggagcgcgagcuccauaaacaggggaagugcgcgaccugcgucuacaauaugauggggaagagggagaagaaacucggggaguucggcaaggcgaagggcagucgcgccaucugguauauguggcugggcgcgcgguuccucgaguucgaggcccuggguuucaugaaugaggaccacugguucagccgcgagaacucccugucugggguggagggcgaggggcuccacaaacugggcuacauccuacgggacaucucuaagaucccaggugggaacauguacgccgaugacacggcugguugggauacgcguaucaccgaagacgacuuacagaacgaagccaagauaacugacaucauggagccggagcacgcccuccucgccacgucuaucuuuaaacugacguaucagaauaagguggugagagugcagaggccggccaagaacgggaccgugauggacgugaucucccggagggaucagcgaggcucgggccaaguggggaccuacggccugaacacauucaccaacauggagguacagcugauacggcagauggaauccgagggaauuuuccuccccagugagcuggaaaccccgaaucuugcagagcguguccucgacuggcuugagaagcacggggccgagcggcucaagaggauggcaaucuccggggacgauugcgugguuaagccuaucgaugaccgguuugccaccgcacucacggcucugaacgacaugggcaaaguacgcaaggacauuccacagugggagccaucgaaaggcuggaaugacuggcaacaggugccguucugcucccaccauuuucaucagcuaaucaugaaagacgggcgugagaucgugguccccugcagaaaccaagacgagcuugugggccgcgcccgcgugagccagggcgcuggguggucccugcgggagacugccugccugggcaagucguacgcgcaaauguggcaguugauguacuuccaccgccgggaccugcgccuggcagccaaugccaucugcucagccguccccguugacugggugcccaccagucggacuaccuggagcauccacgcgcaccaccaguggaugaccacagaggauaugcuguccguuuggaaccgcguuuggaucgaggagaauccguggauggaggacaagacacacguuagcuccugggaggaggugcccuaccuuggcaaacgcgaggaccaguggugcggcagcuuaauugggcucacagcccgugccacgugggcuacaaacauccagguggccaucaaccaggucaggagacugaucgggaacgagaacuaccuggacuacaugacuagcaugaagcgcuucaaaaaugagagugaccccgaaggggcgcucugguaa

SEQ ID NO: 24044 - RNA, 9879 nt, Artificial Sequence
  derived and/or modified CDS sequence (opt11) from DENV-1__FJ639802__SS-prME
ucugugaccaugcucuuaaugcugcugcccaccgccuuggccuuucaccucaccacccgcggcggggagccgcacaugaucgugagcaagcaagagcggggcaagagccuucuguucaagacuagcgccggugugaacaugugcacccugaucgcaauggaccugggcgagcucugcgaggacaccaugaccuacaagugcccccggaucacugaggccgagcccgacgacguggacugcuggugcaacgccaccgauacuugggugaccuauggcaccugcucgcagaccggcgaacaccgucgagacaagcgcucgguggcccuggcgccacaugugggccuggggcucgagacgcguaccgagaccuggaugagcucugagggcgccuggaaacagauccaacgcgucgagaccugggcccugagacaccccggguucacggugaucgccuuguuccucgcgcacgcuaucggaacaucaaucacccagaaagggaucaucuucauucugcugaugcucgucacccccagcauggccaugcggugcgucggcaucggcaaccgcgacuucguagaggggcugagcggugccaccuggguggaugucgugcuggaacacggcuccugcgugaccacaauggccaaaaacaaacccacccucgacaucgaacugcucaagacggagguaaccaaccccgcgguguuaagaaagcugugcaucgaggcaaagaucucgaacaccaccacagacucccgcugccccacccagggcgaggcgacgcuaguggaggaacaggacgcuaacuucgucugccgucgcaccuuuguggaccggggcugggggaacggcugcggccucuucggcaaggggucguugcucacgugcgccaaguucaagugcgugaccaagcucgaaggcaagauaguccaauacgagaaccugaaguacucuguaaucgugacagugcacaccggcgaccagcaccaagugggcaacgagacgaccgaacacggcaccauugcgacaaucacgccccaggccccgacgucagagauccagcugaccgacuacggggccuuaacccuggauugcagcccccggacuggcuuggauuucaacgagaugguccuccugacaaugaaggagaaguccugguugguacacaagcagugguuccucgaucugccgcugccguggacaucaggggccagcaccagccaggagaccuggaacaggcaggaccuccuggugaccuucaagaccgcacacgcgaaaaaacaggaagucguggugcugggcucacaggagggcgccaugcacaccgcccucacuggugcuacggagauccagaccagcggcaccaccaccaucuucgccggccaccugaagugccgccucaagauggacaaguuaacacugaagggcauguccuacguuaugugcaccgggagcuucaagcuggagaaggaggucgcggagacccagcacggcacuguguuaguccaggugaaguacgagggcaccgacgcuccgugcaagauccccuucuccacgcaagacgagaagggggugacucagaacggcagguuaaucacggcaaacccuaucgucacugacaaggagaagcccgugaauaucgagaccgagccgcccuucggggagucauacaucguggucggcgcgggcgagaaggcuuugaagcuguccugguucaagaaaggcagcuccauagggaagauguucgaggccaccgcccgcggggcccggcgcauggcaauccucggcgauacugcgugggacuucggguccaucggcggcguguucacauccguggggaagcuggugcaccaaguguucggcaccgccuacgguguccuguucaguggggucuccuggaccaugaagaucggcaucggcauccuccugacguggcugggucucaacagccgcuccaccagccugucaaugaccugcaucgccguggggauggugacacuguaucucggcgucaugguccaggccgacagcgggugcgugauaaacuggaagggccgggagcucaagugcgggucuggcaucuucgucacgaacgaggugcacaccuggacugagcaguaccgcuuccaggcugacagccccaagcggcucagcgcggccaucggaaaggcuugggaggaaggggugugcggcauccgcuccgccaccagacucgagaacaucauguggaagcaaaucagcaacgagcugaaccacauccugcuugaaaacgacaugaaguucaccgucgucgugggggacgccaacggcauacuugcucaggggaaaaagaugauccggccucagcccauggagcacaaguacuccuggaaguccuggggaaaagccaagaucaucggcgccgacauccagaacacaaccuucaucaucgacgggcccgauaccccggagugcccagacggccagcgggcuuggaacauaugggaggucgaggacuacggguucggcaucuuuaccacgaacaucuggcugaagcuccgcgacucuuacacccagaugugcgaucaccggcugaugagcgcugccaucaaagacuccaaggccguacaugccgacaugggauacuggauagagagcgagaagaacgagacguggaagcuggcucgcgcguccuucaucgaggugaaaacgugcaucuggcccaaaagccacacgcucugguccaacgggguccuggagagcgagaugaucauccccaaaauuuacggcgggccgauaucacagcacaacuaccggcccggcuacuucacccagacagccgggcccuggcaccugggcaagcucgagcuggauuucgaccugugcgaaggaacgacuguggugguggacgagcacugcgggaacaggggcccgagccugcggacaaccacagugacggguaagaucauccacgaauggugcugccgcucuugcacccugccgcccuuacgguuccgcggcgaggacgggugcugguacggcauggagauccggccagucaaggagaaggaggagaaccucgucagaagcaugguguccgcgggcagcggugaggucgauagcuucucccugggcauccugugcgucagcaucaugaucgaggaggugaugcggucccgauggagccggaagaugcucaugaccgguacccuggcgguguuccugcuccugaucaugggccagcugacguggaacgaccuaauucggcugugcaucaugguuggagccaaugcgucagaccgcaugggcaugggcaccaccuaccuggcccucauggcgaccuuuaaaaugcggccgauguucgccguggggcugcuguuccgccggcucacgagcagagaggugcugcugcugaccaucggccugucccuggucgcgaguguggagcuccccaacucccuggaggaguugggggacggccucgcuaugggcauaaugaugcugaagcugcucaccgaauuucagccccaccagcuguggaccacgcugcucagccugacauucgucaagaccacccugucccuagacuacgccuggaaaacgaccgcaauggugcugagcaucgugucccuguucccccuuugucugucaaccacgucacagaagacgaccuggcugccgguccuccuugggagcuucggcugcaagccgcuuacuauguuccucaucacagagaacaagauauggggacggaaguccuggccccugaacgagggcaucauggcuaucggcaucguaaguauccuccucucuagccugcugaagaacgacgugccucucgcgggcccgcugaucgcaggagggauguuaauagcaugcuacgucaucagcggcuccucagccgacuugucccuggagaaggccgcggaggugagcugggagcaggaggccgagcauuccggggcaagccacaacaucuuaguggagguccaggacgacgggacaaugaagaucaaggacgaggagcgcgacgacacgcucacaauccugcugaaggcaacacucuuagcugucuccgggguguaccccaugagcauccccgcuacccuguucgucugguacuucuggcagaagaagaagcagcgcuccggcgugcucugggacacucccagcccgcccgaaguggagcgcgccguccuggacgacggcaucuacaggaucuuacagcgcgggcugcucggcagaucccaggugggcgugggcgucuuccaggacgggguguuccacaccauguggcacgugacccgcggcgccguccuaauguaccaaggcaagcggcuggaacccagcugggccuccgugaagaaggaccugauuuccuacgguggcggcuggcgcuuccaaggcuccuggaacaccggggaggagguacaggucaucgccguagagccaggcaaaaacccgaagaacgugcagaccacccccggcaccuucaagacccccgagggggaggucggcgcgaucgcacuagacuucaaacccggcacgagcggcuccccgaucguaaaucgggagggcaagauagucggguuguacggcaacgggguagugaccacgagcggcaccuacguguccgccaucgcucaggccaaggcgagccaggaggggcccuuacccgagaucgaggacgaggucuucaaaaagcgcaacuuaacgauaauggaucuucacccaggcucgggcaagacccgucgcuaccuccccgccaucgugcgggaggccaucaagcggaagcugcgcacccuaauucucgcccccacccggguggucgcguccgagauggccgaggcgcugaaggggaugcccaucagguaccaaacgaccgccgucaagagcgagcacacgggcagagagaucguggaccugaugugccacgccaccuucacaaugagacucuugagcccgguccgggugccgaauuacaacaugauuaucauggacgaggcgcauuucaccgaccccgccagcauugcugcucgcggguacauauccacccgggugggcaugggcgaggccgcggccaucuucaugaccgccacgccccccggcagcgucgaggccuuuccucaauccaacgcugugauacaggacgaggagcgcgacauccccgagcggagcuggaauuccggcuacgacuggaucaccgacuuccccgggaagacggugugguucgucccgucaaucaagaguggcaaugacaucgccaacugccuccggaagaacgggaagcgggugauccaguuaagccgcaaaaccuucgacacggaguaccagaagaccaaaaacaacgacugggacuacgugguuaccaccgacaucuccgaaaugggcgccaauuuccgggccgaccgaguaauugaccccaggcggugccugaagcccgugauacugaaggacgggcccgaaagggucauccucgccggcccgaugcccgugacggucgcgagugcagcccagagacgggggcgcauuggccgcaaccagaacaaagagggcgaccaguacguguauauggggcagcccuugaacaacgacgaggaccacgcucacuggaccgaggccaagaugcugcucgacaacauaaacacccccgagggcauaauacccgcguuguucgaaccugagcgggagaagucugccgccaucgacggggaguaucgccuucggggcgaggcccgaaaaaccuuuguggaacuaaugcgccgcggggaccugccggucuggcugucuuacaagguggccuccgagggguuccaguacagcgaccggcgcuggugcuucgacggcgaacggaacaaccaagugcucgaggagaacauggacgucgaaaucuggacgaaggagggggaacgcaagaagcugcggccccgcuggcuggacgcgcggaccuacuccgacccgcuagcccugcgcgaguucaaggaauucgccgccggucggcggagcgugagcggcgaccugaucuuagaaauagggaagcugccucaacaccugacccuccgggcccagaacgcgcuggacaaccuuguaaugcuccacaauuccgaacagggagggaaggccuaccgccacgccauggaagagcuucccgacacaaucgagacccugaugcuccuggcuuuaaucgcgguccucacuggcggugugacguuauucuucuuaagcggcaagggacucgggaaaacuuccaucggccugcugugcgugaccgccucuuccgccuugcuuuggauggccagcguggagccccauuggaucgccgcgaguaucauccuggaguucuuccucauggugcugcuuaucccggagccugaccggcagcgcacgccccaggacaaccaacucgccuacguggucaucgggcugcuauucaugauccucaccgucgccgccaacgagaugggccugcuggagaccaccaagaaggaccucgggaucggcuauguggccgcagagaaccaccagcacgccacgaugcuggacgucgaccugcggccggccucggccuggacgcucuacgccguggcuaccacagugaucacgccuaugaugcggcacaccaucgagaacaccaccgccaacaucucccugacggccauugccaaccaggcagcgauccugaugggccucgacaagggguggcccauaagcaaaauggacaucggcguaccccugcuggcccucgggugcuacucccaggugaacccguugacccugaccgccgccguguuaaugcuggucgcucacuacgcaaucaucggaccgggguuacaggccaaggccacgagagaggcucagaagcgaacggcggccggcaucaugaagaaccccaccguggaugguauaguggcaauagaccucgaccccgucguguacgacgccaaguucgaaaagcagcuggggcagauuauguuacuuauccugugcaccagccaaauccuccucaugcgcaccacgugggcucugugcgagucuauuacccuggcgaccggcccacucacuacgcucugggaagggucgcccggcaaguuuuggaacaccaccaucgccguguccauggccaacauuuuccggggcagcuaccuggccggggccggccucgcguucucucugaugaaaucccucgggggugggcgucgggggaccggugcgcagggggagacgcucggcgagaaauggaagcggcagcugaaccagcuguccaagagugaauucaacaccuacaaacggagcggaaucauggaggucgaccgcuccgaggccaaggagggccucaagcgaggugagaccaccaagcacgcaguuagccgcggcaccgcgaagcugcgcugguucgucgagcgcaaucucgucaaacccgagggcaaggucaucgaccuggggugcgggcgcggcgggugguccuacuauugugccggccucaagaaagugaccgaggucaagggguacaccaaggggggcccuggacaugaggagccgaucccaauggccaccuacggguggaaccuggugaagcuucacucaggcaaggauguguucuucaugccaccugagaagugcgacacccuccugugugacauaggggaguccagucccaaccccacgauagaggagggcagaacgcugcgggucuugaagaugguugagccuuggcugaagggcaaccaguucugcaucaagauccugaaccccuacaugccguccgugguagagacacucgagcaaaugcaacgcaagcaugggggaaugcugguccggaaucccuuaagccgcaacuccacccacgagauguacugggugagcugcgggacgggcaacaucguuagugccgugaacaugaccagccgaaugcucuuaaaccgcuuuaccauggcccaccguaagccuacuuacgagcgggacguggaccugggcgcggguacgcgccacgucgcuguggagcccgagguugccaaccucgacaucaucggccagcggaucgagaacaucaaaaacgagcacaagagcaccuggcacuaugacgaggacaacccguauaagaccugggccuaccacgggagcuacgaggucaagcccuccggcagcgccucaagcauggugaacggggucgugcgccugcugacuaagcccugggacgugauccccauggucacgcagaucgcgaugaccgacacaaccccguucgggcagcagcggguguuuaaggagaagguggacacgcgcacgccccgggcaaagcgcggcaccacccagaucauggaagucacggccaaguggcucuggggguuccugucccggaacaagaagccccgcaucuguacccgggaggaguucacucgcaaggugcggagcaacgccgcuauuggagcaguguucgucgaugagaaccaguggaauagcgccaaggaggccguggaggacgagagauucugggaccuggugcaccgcgaacgcgagcuccacaaacaagguaagugcgcgaccugcguguacaacaugaugggcaagcgagagaagaagcugggggaguuuggcaaggcgaagggcagccgggccaucugguauauguggcugggggcccgguuccucgaguucgaggcacugggcuucaugaacgaagaccacugguucagccgugagaacucccugagugggguagagggugaggggcuccauaagcuaggguacauccugcgggacauuuccaagauaccgggcgggaacauguacgccgacgacacggcgggcugggauacuaggaucaccgaggacgaccuccagaaugaagccaagaucaccgacaucauggagcccgagcacgcccugcuggccacgagcaucuuuaagcucaccuaccaaaacaaggucguccgcgugcagcggcccgccaagaacgggacaguaauggacgucauaucccgucgugaccagcgcggcagcggucagguggggaccuauggccucaacacguuuaccaacauggaggugcagcugauccggcagauggaguccgaggggaucuuccuccccagugagcuggagacgccgaaccuggcggagcgcguccucgacuggcuggagaagcacggcgccgagagguuaaagcgaauggccaucuccggagacgauugcguggugaaacccaucgacgaccgguucgccaccgcccucacggcgcugaacgacaugggcaagguccgcaaggacauaccccagugggagcccagcaaaggcuggaacgacuggcagcaggucccguucuguucccaccacuuccaucagcugaucaugaaggacgggcgggaaaucguagucccuugccgcaaccaggacgagcucgugggccgggcccgcgugagucagggggcgggcuggagccugcgggaaaccgccugccuggguaagaguuacgcccagauguggcagcucauguacuuccaccgccgagaccugcgcuuagcggccaacgccaucugcuccgccguccccguggacugggugcccaccagccggaccacauggaguauccacgcgcaccaccaguggaugacaacggaagacaugcucuccgucuggaaccgcguauggaucgaggaaaacccguggauggaggacaaaacccacgugagcaguugggaggaaguacccuaccugggcaagcgugaggaccaauggugcgggagcuugaucggguugaccgcccgggccacuugggccacgaacauccagguggcaaucaaccaggugcgccgacugaucggcaacgagaacuaccuggacuauaugaccuccaugaagcgcuucaagaacgaguccgaccccgagggcgcgcucugguga

SEQ ID NO: 24045 - RNA, 9879 nt, Artificial Sequence
  derived and/or modified CDS sequence (opt11) from DENV-1__JN819410__SS-prME
uccgugaccaugcucuugaugcugcucccuaccgcccucgcauuccaccuuacaacgcgcggcggggaaccacauaugauaguguccaaacaagaacgggggaaaucauuacuauucaaaaccucagccggagugaacauguguacgcugaucgcuauggacuuaggagaauuaugcgaagauacaaugacauacaaauguccaagaauuacugaagcggaaccagaugacguagacuguugguguaacgcaaccgauaccugggucacuuacgggacgugcucacaaaccggagaacacagaagagaaaaacgcagugucgcacuggcgccucauguggggcucggauuagaaaccaggacugaaacauggaugucaagcgagggcgcauggaaacaaauacaaagaguggagacuugggcacugagacaccccgguuuuaccgucauagcauucuuucuagcacacgccauuggaaccucaaucacgcaaaaaggaaucauauucauacuguuaauguuggucacgccgucaauggcaaugagguguguuggaauaggaaaucgggacuucguagagggucugagcggagcuaccugggucgaugucguccuggagcacggcucauguguuacaacaauggccaaaaacaaacccacgcucgacauagagcuacuaaaaacggaagucacuaacccagcaguauuaagaaaacuguguauagaggcgaaaauaaguaacacuaccaccgacucgcgaugucccacacaaggagaggcgacccucguagaggagcaagacgcaaacuuuguaugucggagaacucuaguagaucggggcuggggcaauggaugcggacucuucgggaaagguaaccucuuaacgugugcaaaauucaaaugcgugacaaaacuggaagggaagaucguucaauaugaaaacuuaaaguacagcgugauagucacaguccacacaggcgaccaacaccaagucgggaacgaaaccacugaacauggcacaauagcgaccauaaccccgcaagcucccacuagcgaaauucaacuuacagacuacggcgcgcuuacacucgacugcucaccacguacgggccucgacuucaacgaaauggugcuguugacaaugaaagaaaaauccuggcuggugcauaaacagugguuccuagaccucccccuaccguggacaucaggagccagcacaucucaagaaaccuggaacagacaggaccucuuaguaacauucaaaacggcacaugccaagaaacaagagguagucguucucggcagccaagaaggagccaugcauacagcucuaaccggcgcaacugagauacagaccuccggaacaacaacaauauucgcaggccacuuaaaaugccggcuaaaaauggacaaacuaacccugaaaggaauguccuacgugaugugcacagguagcuucaaacucgaaaaagaaguggccgagacccagcacggaacaguucugguccaagucaaauacgagggcacagacgcgccuugcaaaauccccuucucgacccaagaugaaaaaggcgucacucaaaacggaaggcuaaucacggcgaaccccauuguaaccgacaaggaaaaaccugugaauaucgagaccgagccacccuucggagaguccuacauaguggucggcgcaggcgaaaaggcacucaaacuaucgugguuuaaacguggcaguuccauaggaaaaauguuugaagcaacggccagaggcgcaagacguauggccauacuuggggacaccgcaugggauuucggauccauaggaggggucuuuacauccgucgggaaauuagugcaccagguguucggcacugcauacggcguacuauucuccgguguguccuggacaaugaaaauuggaauaggcaucuugcucacguggcugggccugaacucacgaucaaccucccucuccaugacgugcauagcggucggcaugguaacgcuguaucucggugucaugguccaagcagacucgggcugcgugaucaauuggaagggcagggaacuuaaauguggcuccggaauuuucguaaccaacgagguccacacauggacggagcaguacaaguuccaagcagacagcccaaaaaggcuuagcgcagcaaucggaaaggcaugggaagaaggaguuugugggauucggucggccacacggcucgaaaacauaauguggaagcaaauaagcaacgagcuuaaccacauacuucuagagaacgacaugaaguucaccgucguagugggugaugcgaauggaauacuagcacaggggaagaaaaugauaagaccccagccuauggaacacaaguacucguggaaauccugggggaaagcaaagauaauaggagcagacauccaaaauacgacauucauuauugacggccccgauacgccggagugccccgauggacaacgugcauggaacaucugggaaguugaagacuacggcuucggcgucuucacgacgaacaucuggcuaaaacuacgugauucuuacacacagaugugcgaccacagacuaaugagugcagccaucaaggacuccaaggccguacaugcagauaugggauauuggaucgaaucggagaaaaacgaaaccuggaagcuggcgcgcgccagcuucaucgaaguaaagacaugcaccuggcccaagagccauacccuguggagcaacgggguucuggagagcgagaugaucauuccaaaaaucuacggagggccgaucucccaacauaauuaccgaccgggauauuucacacagacggccggaccguggcaccuaggcaaacuggagcuggacuucgaccugugcgagggaacgacggucguuguagacgaacauugcggcaaucgcgguccaagccuccggacaacaaccgugacgggaaagauaauccacgaauggugcugccgauccugcacguuaccuccucuccgauucagaggggaagacggcugcugguacggaauggaaauccggccggucaaagaaaaagaagagaaccugguaaggaguauggucucagcagggagcggggaggucgauaguuucagucugggaauacucugcguaucgauaaugauagaagaaguaaugagaagucgguggagucgcaaaaugcuuaugaccggaacgcuagcagucuucuuacuccugaucaugggccagcuaacauggaacgauuugauccgucucugcaucaugguaggggcgaacgcaucggaucgaaugggaauggggacaaccuaccuagcguuaauggcuaccuucaaaaugaggccaauguucgcagucggccucuuauuucgccgccugacguccagagaggucuuacuacugaccauaggucuaucucuaguugcaagcgucgaacuucccaacucgcuagaggaguuaggcgacggguuagcaaugggaaucaugauguuaaaacuacugacggaguuccaaccacaccagcucuggaccacccuguuaucacuaacauuuaucaagacaacacugagccuugacuaugccuggaaaaccacggcgaugguucuuagcauagucucccuguucccguuaugccucuccacaacaagccagaaaacaacuuggcuacccguccuacugggcucguucgggugcaaaccacuaacaauguuucuaauaaccgagaacaaaaucuggggccgaaaaagcuggcccuuaaaugaaggaauaauggcaaucggcauagugagcauacuucuaucgucucuucucaaaaacgacgucccucucgccgguccauuaaucgccgggggaaugcucauagcaugcuacguaauuucaggcagcagugcggaccucagccuagagaaagccgcagaggugagcugggaacaggaagccgaacacucuggagccagccacaauauauugguagagguacaagaugaugggaccaugaagaucaaagaugaagaacgagacgacacucuaacaauucuccugaaagcuaccuuacuggcgguaucuggggucuauccaaugucgauuccagcaacacuauucgucugguauuucuggcagaagaagaaacaacgaagcggcguauugugggacacaccuucaccacccgaaguggaaagagccguacuggaugacgggauauacagaauacuucagcggggucuacuaggucgcucccagguagggguggguguuuuucaagauggagucuuucacacaauguggcacguaacuagaggagcgguccucauguaccagggcaaacgccuggagcccucgugggcauccguaaagaaggacuugauauccuacggagggggauggcgauuccaaggcagcuggaacaccggcgaggagguacaggugauagcagucgaaccgggcaagaacccgaaaaacguucaaacaacacccggcaccuuuaaaaccccagaaggcgaggucggagccauagcgcucgauuuuaaaccugguacgucuggcagucccauuguuaacagggagggaaagauaguaggacucuacgggaacgguguagucacaacuucaggaacuuacgucagcgcaaucgcccaggcuaaagccagccaagaagggccacuaccggaaaucgaggaugaagucuucaagaaaaggaaccuaacgaucauggaccuucacccggggagcgggaaaacgcggcgauaccugcccgcaauaguaagagaggcaauuaaacggaaacuacgaacccucauauuagccccuacccgcgucgucgcaucggaaauggcagaagcgcucaaggggaugccgauaagguaucaaaccacagcaguaaaaucggaacacacugguagagaaauagucgaccuaaugugccaugccacuuucacgaugcgacuacuaucccccgugaggguuccaaauuauaacaugauuauaauggacgaagcccacuuuaccgacccagccagcaucgccgcacgaggcuacauuagcacacggguaggcaugggggaggcugcugcgauauucaugacagcgacgcccccuggcagcguagaggcauucccccaaaguaaugcuguaauccaggacgaagaacgcgauauaccagaacguaguuggaacuccggguacgacuggauaaccgacuucccuggaaagacaguaugguuuguccccagcauuaagucaggcaacgacauagcaaacugccuaaggaagaauggcaagagaguaauacagcucucccgcaaaacauucgacacagaauaccagaaaaccaaaaacaacgacugggacuacgugguaaccaccgacauauccgagaugggggcaaauuuucgugcagauaggguaauagaccccagaaggugccuaaagcccguaauacucaaagauggaccagagaggguaauacuagcgggcccaaugccagucacaguggcaucugccgcacaaagaagaggaaggaucggaagaaaucaaaacaaggaaggagaccaauacguauacaugggucagccgcuaaauaacgacgaagaccaugcccacuggacagaggccaagaugcuucucgacaacauuaacaccccagagggcaucaucccugcucucuucgaaccugaaagggagaaauccgcagcaauagacggggaauaccgccuccgcggagaagcgaggaaaacguuuguggaacugaugcgccgcggagaccuucccguauggcucagcuauaaaguagccucagaaggcuuccaauacuccgaccggagauggugcuucgauggcgaacgcaacaaccaagugcucgaagaaaacauggaugucgaaaucuggacgaaagagggcgaaaggaagaaacuaaggccacguuggcuagaugcgcgcacauacagugacccccuggcccuccgagaguucaaggaguucgcagcgggacggcgaagugucagcggcgaucucauauuggaaaucggcaagcuaccgcaacaucugacgcuucgugcccagaacgcacuugacaaucucguaauguuacacaacucagaacaggguggcaaggccuacaggcacgccauggaagaacucccggacaccaucgaaacacuaauguuauuagcccuuauagcaguacuaacgggcggagucacacucuucuuucugucggggaagggauuggggaaaacaucgauugggcugcuaugcgucaccgcaagcagcgcacuacuuuggauggcuagcgucgagccacacuggauagcagcgagcauaauacuugaguucuuccugauggugcuccuuauuccagaaccggaccgccaacgcacaccacaggacaaccagcuagccuauguggucaucggccuauuauucaugauacucacgguugcugccaacgaaaugggguugcucgagacaaccaagaaggaccucgguaucggcuacguugcggcggaaaaucaccaacaugcaacuaugcuggauguagaucugcacccagccucagccuggacacuguacgccguagcaacgacaguaaucaccccaaugaugcggcacacaauagaaaacacuacugcgaacauuagucuaacagcgaucgcgaaccaagccgcgauacuuaugggcuuagacaaaggcuggcccaucucaaaaauggacauaggcgucccacuacuagcccucggcugcuacagucaagugaauccccugacccuaacggccgcgguacucaugcuagucgcacacuaugcgauaauaggucccggguuacaggcgaaagcuacaagagaggcgcaaaaacgcacagccgcaggaauaaugaaaaacccgacugucgauggcauugucgcuauugaucuagauccaguaguguacgacgcaaaguuugagaagcaacugggccaaauaaugcuacuaauacuaugcaccucgcagauccugcugaugcgaaccacgugggcccuaugcgaaaguaucacucuagcgacgggccccuugaccacccucugggaagggagccccgggaaauuuuggaacacgacaaucgcagugagcauggccaacauauuucgcggaagcuaccucgcaggagccgggcuugcguucagccucaugaaaagucuaggggguggccgucgcggaacgggagcccaaggagagacacugggggaaaaauggaagcgccaacuaaaccagcucucaaaaucagaguuuaacacguacaagcggucgggcaucauggaaguugaccggucagaagcuaaggaaggacugaagcggggugagacuacaaaacacgccgugucucgaggcaccgccaaacuccgcugguucgucgaaagaaacuugguuaaaccggaaggcaaagugauagacuuaggcugcggccgcggaggauggucguauuacugcgcugguuugaaaaagguaacggaggugaaaggcuacaccaagggcgggccaggccaugaggagccuauuccgauggcaaccuacgguuggaaccuggugaaacuacacuccggaaaggacgucuucuuuaugcccccagagaaaugugauacacuccuaugcgacauuggggaaagcucgccuaauccaacgaucgaagaaggacggaccuuacggguauuaaagaugguagaaccguggcugcgggggaaucaauucugcaucaaaauccugaacccuuacaugccaucagucgucgagaccuuagagcaaaugcaacguaagcauggagggaugcuagugcggaacccccucagcaggaacagcacgcaugaaauguacugggucucguguggaacgggaaacauagucucagccgugaacaugaccucacggaugcuccugaaccgguucaccauggcgcauagaaagccaaccuacgaaagagauguggaccucggcgccggcacgcgacacguugcaguggaaccggaggucgcaaaccuagauauuaucgggcagcguaucgagaauauaaagaaugaacacaagagcaccuggcauuacgacgaagacaacccguacaaaaccugggccuaucacggaucauaugaagucaaaccaucgggcagugcaagcaguauggugaacggcguaguacgccuacuaacaaagccaugggacgucauacccauggugacacaaauagcaaugacagacaccaccccguuuggacaacagcgagucuucaaagaaaaggucgacacccggacaccccgagcuaaaaggggcaccacccaaauuauggaagugaccgccaaguggcucugggguuuccugucgagaaacaagaaaccgcguauuugcacaagggaagaguucacccgcaagguacgcucaaacgccgcaaucggagcugucuucguggacgaaaaccaguggaacucagcaaaagaagcaguagaggacgagcgguucugggaccugguccaccgugaacgagagcuccacaaacaggggaagugcgcaaccugcguauacaauaugaugggcaaacgagagaagaaacugggcgaguucggcaaggcaaaaggcagccgagcgauaugguacauguggcucggggcacgcuuccuagaauuugaggcacuggguuuuaugaacgaagaccacugguuuagccgggaaaauucccuaagcggagucgaaggagaagggcuccauaaacuaggauauauccuccgcgauauuuccaaaauaccaggcgggaacauguacgcggacgacacggcaggaugggauacgcgaaucacggaggacgaucuacagaaugaagccaaaaucacagauauuauggagccugagcacgcacugcucgcaacgaguauauucaagcugacauaccaaaacaaggucguccgcguccagcggccagccaaaaacggcacaguaauggacgugaucagucgucgcgaccaacggggcucgggccaaguuggcacauauggauugaauacguucaccaacauggaaguacaacucauaagacaaauggagucugaaggcaucuucuuaccauccgagcuagaaacaccaaaccuggcagaacgagcgcuggacugguuggagaaacauggcgcagagcgucucaaacggauggcaauaagcggagacgauugcguggugaaaccgaucgacgaucgauucgccacggcccuaacagcguuaaaugacaugggcaagguacguaaggacaucccccaaugggaaccuaguaaggguuggaaugacuggcaacaggucccguuuugcucgcaccacuuccaccagcugauaaugaaagacgggagagagaucgugguaccgugcaggaaucaagacgaacucguuggaagggcgcgcgugucccaaggagcuggcuggagucuaagagaaaccgcgugccuggguaaaagcuacgcccaaauguggcagcuaauguacuuccauagaagagauuuacgucucgccgcaaacgcuauaugcagcgccguacccgucgauugggucccgaccucaagaacuacuuggagcauacacgcgcaccaccaguggaugaccaccgaagacaugcuaagcguuuggaaccggguguggaucgaagaaaacccauggauggaagauaagacccacgucagcagcugggaggaaguaccguaucuaggcaagagagaagaccaguggugcggcucucucauagggcuaaccgcgagggcgacaugggcaaccaacauacagguagcuauaaaccagguccgacguuugauuggcaaugaaaacuaccucgacuacaugacaucuaugaagagguuuaaaaaugagagcgaucccgaaggugcccugugguaa

SEQ ID NO: 24046 - RNA, 9879 nt, Artificial Sequence
  derived and/or modified CDS sequence (opt11) from DENV-1__FJ639806__SS-prME
agcguuaccaugcugcucaugcuuuugccuaccgcccucgccuuucaucugaccacacgcgggggggaaccccacaugauugugucgaagcaagaaaggggcaaaagccuguuguuuaagaccuccgccgggguaaacaugugcacccugaucgccauggaccugggcgaguuaugcgaagauaccaugaccuacaagugcccccgaaucaccgaagcagagcccgacgauguggacugcuggugcaacgccacugacacuugggugaccuacgguacgugcagccagacuggcgagcaccggcgcgacaagcgauccguggcccucgcgccccacguuggcuuaggccuggagacgcgcaccgagaccuggaugagcuccgagggagcguggaagcaaauccagagaguagagaccugggcucugaggcacccgggcuucacgguaaucgcucuuuuccuagcgcacgccaucggcacgucgauuacccagaaggguaucauuuucauccugcuuaugcucgugacuccgucgauggccaugcggugcgucggcauagggaaucgcgauuucguggagggacugucuggcgcuacguggguggacguuguacuggaacacggaucgugcguaaccaccauggccaagaauaagcccaccuuggacaucgaauuacugaagacugaggucaccaaccccgcggucuuacggaagcuguguaucgaggccaagaucagcaacacgaccacggauucccgcugucccacccagggcgaagccacccugguagaggagcaggacgcuaauuucgucugccgucgcacuuucguggaccggggcugggggaacggcugcggccuuuuuggaaaggggucucuccuaaccugcgccaaauucaagugcgugaccaagcucgagggaaagauuguccaguacgagaaccugaaguacucaguuauugugacuguccauacaggagaucaacaccagguagggaacgagacgaccgagcauggcaccaucgcgaccaucacuccccaggcacccacgagcgagauccaguugaccgacuacggagcccuuacccuugacugcucgccccggacuggccuggacuuuaacgagaugguacuccugacgaugaaggagaaauccuggcugguccauaagcagugguuccucgaccuuccucugcccuggaccuccggggccagcaccucgcaggagacuuggaaucggcaggaccuacuggugacguucaaaaccgcgcaugcuaagaagcaggagguggugguucugggcucccaggagggcgccaugcauaccgcacuuaccggcgcuacugagauccaaaccucaggaaccacgacgaucuucgccgggcaccugaagugucgcuugaagauggacaaacugacccucaaaggcauguccuacgucaugugcacgggcagcuucaagcuagaaaaggagguugcggagacccagcacgggacuguguugguccagguaaaguacgagggaaccgaugccccaugcaaaaucccguucucuacccaggacgagaaaggcgugacccaaaacggcaggcuaaucacggcaaauccgaucguaaccgacaaggaaaagcccgugaacaucgaaaccgagccgcccuucggcgagagcuauaucgugguaggcgcuggcgagaaagcgcugaagcuauccugguucaagaaggggagcuccaucggcaaaauguucgaagccacugcacgcggcgcccgccgcauggcaauccuuggcgacacggcgugggauuuugguagcaucggcggcgucuuuaccuccgugggcaagcugguucaucaaguguucggcaccgccuacggggugcuguucagcggugucaguuggaccaugaagaucgggaucggcauucuccugacguggcugggccucaauagcaggagcaccagccugaguaugaccugcauugccguggggauggugacgcuguaccucggcgucaugguucaggccgauagcgggugugugaucaauuggaagggccgggaauuaaaaugcggguccggcaucuucgucaccaaugaagugcacaccuggaccgaacaguacaaguuccaggccgacucgccgaaacgccuguccgccgcuaucggccgggccugggaggaaggaguaugcggaauccgcuccgccacccggcucgagaacaucauguggaaacagauaagcaacgaguugaaccacauccuccuugagaacgauaugaaauucaccgucguggugggggacgccaacggaaucuuggcgcaggggaagaagaugauccgcccacaacccauggagcacaaguauuccuggaaauccuggggcaaggccaaaaucaucggcgccgauauucagaacacaacauucaucaucgacgggccggacacuccggagugcccugauggacagcgggccuggaacaucugggaggucgaagacuacggauucggcaucuucacgacgaacauauggcugaagcucagagacuccuacacccagaugugcgaccaucggcuaauguccgcggccaucaaggacucaaaagcugugcacgccgacaugggcuacuggaucgaguccgagaagaacgagacauggaagcuggcccgcgcgagcuucauugaggucaaaaccugcaucuggcccaagucgcacacgcucuggucuaaugggguccucgagucagagaugaucaucccuaaaauauauggcgggccaaucucacagcauaacuaucggcccggcuacuucacacagacggcugggcccuggcaccugggcaaacucgaacuagacuucgauuugugcgaggguacaaccguggugguagacgagcacugcgggaaccgcggcccgagccuccggaccaccacuguuacggguaagaucauucacgaguggugcugucgcagcugcacccugccaccccugagguuucgcggcgaggaugggugcugguacggcauggagauccggccagucaaggagaaggaggagaaccucguucgcucaaugguaucggccggcagcggagaggucgacagcuucucccuggggauccuuugugucaguaucaugaucgaggaagugaugcggucccgcuggagccgcaagaugcucaugaccggaacucuggccguguuucuacuccugaucauggggcagcugaccuggaaugaccuuauucggcuuugcaucauggucggagccaaugcgagcgaucgcaugggcaugggcaccaccuacuuggcccucauggccacuuucaagaugcggccgauguucgccgugggccugcuguuucgucgccucacgagccgcgaggugcucuugcucaccaucggccugucacugguagccagcguggaacuccccaacucacuggaggagcugggggacggccucgcgaugggcaucaugaugcugaagcuguugacagaauuccagccccaucagcuguggaccacguuacucucucugaccuucguuaagaccacccugucgcucgacuacgcuuggaagacgaccgcgaugguccugucuaucgugucccuguucccucucugccugagcaccacaucucagaagacaaccuggcuaccgguccuucuugguaguuucggcugcaagcccuuaaccauguuccuuauuacagagaacaagaucugggggcguaaaagcuggccgcugaacgagggcaucauggccauagggauagugagcauccugcuuagcagccugcucaagaacgacguuccucucgcagggccguugaucgccggcgggaugcugaucgccugcuacgucaucagcggcucaagcgcagaccucucccuugaaaaggccgcggaagugagcugggagcaagaagccgagcacagcggggccagccacaauauccucguggaggugcaggaugauggcaccaugaaaaucaaggacgaggaacgcgacgacacgcugacaauccugcucaaggccacgcucuuagccguguccgggguguaccccaugucgauccccgcgaccuuauuugucugguacuucuggcagaagaagaaacagcgguccggcgugcucugggacacgcccagcccgcccgagguugagcgcgccguccuggacgauggcaucuaccggauacugcagcgcgggcugcucggccguucacaggugggagugggcgucuuccaggauggaguguuccacaccauguggcacgugacccgcggggccguacugauguaucaggggaagcggcuggagccauccugggcuuccgucaagaaagaccucaucagcuacgggggcgguuggcgcuuccaaggcuccuggaacaccggggaggagguacagguaaucgccguagaacccgguaagaacccgaagaacguucagacgacccccgguaccuucaagaccccggaaggggaaguaggcgcgaucgcucuggacuucaagccggggacgagcgguuccccgauugucaaccgcgaaggcaagaucgucgggcuguacgguaauggggucguaaccaccucuggaacguauguguccgcuauugcccaggccaaagcaucccaggaaggccccuuacccgagaucgaggacgaggucuucaagaaacgcaaccugacgaucauggaccuacacccgggcucgggcaaaacacggcguuaucuccccgccaucgugcgggaggcgaucaagcgcaagcugcgaacccucauccucgcgccgacucggguggucgccagcgagauggcggaggcccuuaagggaaugccgauccguuaccaaacuacugccgucaagagcgagcacaccggcagagaaaucguggacuugaugugccacgccaccuucaccaugcgccuccuguccccgguacggguccccaacuauaacaugaucaucauggacgaggcgcacuuuacagaccccgcgagcaucgccgcacgcggauacaucaguacgcgggugggcaugggggaggcggcagccaucuucaugaccgcgacuccgccgggaagcgucgaggccuucccucaauccaaugccguaauacaggacgaggagcgcgacaucccugaacggagcuggaacuccggguaugauuggaucaccgacuuccccgggaagaccgugugguucgucccgucuauaaaguccggcaacgacaucgcgaacugccugcgcaaaaacgggaaacgggugauccaacucagccgcaagaccuuugacacggaguaucagaagaccaagaauaaugauugggauuauguggugacuaccgacaucagugagaugggcgccaauuucagagccgaucgagugaucgauccccgacgcugccuuaagcccgugauccugaaggacgggcccgagcgggucauucucgccggcccgaugccggugacggucgcgagcgcggcccagcgcagggguaggaucgggcgcaaccaaaacaaggagggcgaucaguacguguacauggggcagccccugaauaacgacgaggaucaugcccacuggaccgaggccaagauguuacucgacaauauuaacacucccgagggcaucaucccagcgcuguuugagcccgagcgggagaaguccgcggccauugauggagaguaccgccugcguggcgaggcccguaaaacuuucguggaauugaugcggcgaggugaucugccuguuuggcugagcuacaagguggccuccgagggauuccaguauagcgaccggcgcuggugcuucgacggcgagcggaauaaccaggugcucgaagaaaacauggaugucgagauauggacaaaagaaggugagcggaagaagcugcggccaagguggcuggacgcuaggaccuauuccgacccgcucgcacucagggaauucaaggaguucgccgccgggaggcgcagcgugagcggagaccuuauccuagagaucggaaaacuuccccagcaccugacgcuccgggcccaaaacgcgcuggacaaccugguaauguugcacaauucggagcagggagggaaggccuaucgccacgcaauggaagagcuccccgacacuauagagaccuuaaugcuucuggcccuaaucgcggucuugacuggcggcgugacacucuuuuuccuguccggcaaaggccucgggaagaccuccaucggucuacuaugugucaccgccagcucugcccuuuuauggauggccagcgucgagccucacuggaucgccgcaaguaucauccuggaauucuuccugauggugcuguugauaccggaacccgaccgucaacgaacgccccaggacaaucagcucgccuacguggucaucgguuugcuguucaugauucuaaccguggccgccaaugaaaugggucugcucgagaccacuaagaaggaucugggaauuggcuacguugcugcggaaaaccaccagcacgccacuaugcuggacgucgaccugcggccggccucugcguggacuuuguaugcugucgcuaccaccgugaucacgccaaugaugcgccacaccaucgagaauaccacagccaauauaagccugacugcgaucgcgaaucaagccgcgauccucaugggacucgacaaaggauggcccaucagcaagauggacauuggcgugcccuugcuggcuuuggguugcuacagccagguaaacccacugacccugaccgcggccgugcuuaugcugguagcgcauuacgccaucaucggccccggguuacaagccaaagccacccgcgaggcgcagaaaagaacggcagccgggaucaugaagaaucccaccguggacggcaucguggccaucgaccuggaccccgucguguacgaugccaaguucgagaaacagcuggggcagaucaugcugcuaauccugugcaccagccagaucuuauuaaugcgcaccacaugggcgcugugugagaguaucacccuggccaccggcccucuuacgacucugugggaggggagccccggcaaauuuuggaauacaaccauagccguguccauggccaacaucuuccggggcaguuaccuggcaggggcuggacucgcguucagucuaaugaagucccucgggggcggucggcgggguaccggagcccagggcgagacacuuggcgagaaguggaagcgccagcugaaucaacugucuaagagcgaguucaacaccuacaagcgaagcgggaucauggaggucgaucguucggaagcaaaggagggccucaagcgcggggagaccaccaagcacgccguuucacgaggcacugcgaaacugcguugguucguggagaggaaccuggucaaacccgaggguaagguuaucgaccugggcugcggccgcggcggguggaguuauuacugcgcagggcucaagaaggugaccgaagucaagggguauacaaaaggcgggccgggccacgaggagccgauucccauggccaccuacggguggaaccuugugaagcugcauuccggcaaggacguauuuuucaugccucccgagaagugcgauacgcugcugugcgacaucggcgaguccagcccgaauccgacgauagaggaaggccggacacuaaggguucucaagauggucgagcccuggcugaagggcaaucaguuuugcaucaagauccugaaccccuacaugccgucagugguugagacccucgagcagaugcaaagaaaacacggaggcaugcuggugcggaacccucugagccguaauuccacacacgagauguacugggugagcugcgggacgggcaacauagucucggccguuaacaugaccagccggaugcucuuaaaccgcuucaccauggcccaccgcaagccuaccuaugaacgggacgucgaccugggcgcggggacgagacacgucgccguggagccggagguggcuaaccucgauauaaucggccaacggaucgagaacaucaagaacgagcauaagucuacguggcauuacgacgaggacaacccguacaagaccugggccuaucauggcagcuacgaggucaagccuuccgggagugccaguagcauggugaacggggucgugcgacuguugacuaagcccugggaugugauuccuauggucacccagauagcgaugacggacaccaccccguucggacagcagcggguguucaaggaaaagguggacacgagaacgccucgugcuaagcgagggacgacccagaucauggaggucacggccaaauggcucuggggauuccucucccggaacaagaagccgcgcaucugcacccgggaggaguucacccgcaagguccggagcaacgccgcaaucggcgcgguauuugucgaugaaaaucaguggaacucugccaaggaagccguggaggaugagcguuucugggaccuggugcaccgcgagcgcgagcuccauaaacaggggaagugugcuacauguguauauaacaugaugggcaagcgcgagaagaagcugggggaguuuggcaaggcgaaggguucucgggcaaucugguacauguggcugggggccagguuccuagaguuugaggcccuaggcuuuaugaacgaagaccacugguucagccgugagaacucccugagcgggguugaaggugaggguuugcauaagcugggcuacaucuugcgagacaucagcaagaucccaggcgggaacauguaugccgacgacacggcaggcugggacacccggaucaccgaggacgauuugcagaacgaggccaagaucaccgacaucauggagcccgaacacgcccuguuagccacgagcaucuucaaacucaccuaccagaacaagguugucagaguccagcggcccgcaaagaacgggaccgugauggacgucaucucacgccgggaccaacgcggcucuggccagguggggaccuauggccugaacacguucacaaacauggaggugcagcugauccggcagauggagucggaggggauuuuucuccccucugagcuggagacccccaaucuagcagagaggguccucgacuggcugaagaagcacggcgcggagcgacugaaacgcauggccauaucuggcgaugauugcgucgugaagccgaucgacgacagauuugccacagcccucacggcucuaaacgacauggguaaaguccgcaaggacaucccccagugggagcccagcaagggcuggaacgacuggcagcaaguacccuucugcagucaccacuuccaccaacugauaaugaaagacggacgggagaucgugguccccugccggaaccaggacgaguuggugggccgggccagggugagccagggugcaggcuggucccugagagagaccgcguguuuaggcaagucuuacgcgcagauguggcagcucauguacuuccauaggcgggacuuacgccuggcggccaaugcuaucuguagugccguucccguggacuggguuccuacgucacggaccacauggagcauucaugcgcaccaccaguggaugacaacagaggauaugcuuuccgucuggaaucgcguguggaucgaggaaaacccauggauggaggacaagacccacgugagcuccugggaggaaguccccuacuuagguaagagggaggaccaauggugcggcagccugaucgggcucaccgccagagccacaugggcuacuaacauacaggucgccaucaaccaggugcgccggcuuaucgggaacgagaacuaccucgacuacaugacguccaugaagcgguucaaaaacgagagcgaccccgagggggcguuaugguaa

SEQ ID NO: 24047 - RNA, 9879 nt, Artificial Sequence
  derived and/or modified CDS sequence (opt11) from DENV-1__JN819411__SS-prME
agugucaccaugcuucucaugcugcugcccaccgcccucgccuuccaccugaccacgcgcggaggggaaccacacaugaucgugagcaagcaggagcgggguaagagccugcuguucaagaccagcgcgggggugaacauguguaccuuaaucgccauggaccugggcgagcucugcgaagacaccaugaccuacaagugcccccgaaucaccgaagccgagccggacgacguggacugcugguguaacgcuacggacaccugggugaccuacgggaccugcagccaaacuggcgagcaccggcgcgacaagcgguccguggcccuggcgccccacguggggcugggccucgagacccguaccgagacauggaugagcuccgaaggcgcguggaagcagauccagcgggucgagaccugggcccuccgucauccaggguucacugugaucgcgcuguuccucgcgcacgccauuggcaccagcaucacccaaaaggggauaauauuuauccugcucaugcucgugacccccaguauggccaugcggugcgucggcauagguaaccgcgacuucguugaggggcugagcggcgccacguggguggacguuguacuggaacacgggagcugcgugacuaccauggcuaagaacaagcccacccucgacaucgaacugcugaagacggaagucaccaacccugcggugcuccggaaguuaugcaucgaggcgaagaucaguaacaccaccacggacucccgcugcccgacccagggcgaggcgacccugguggaggaacaagacgccaacuucgucugccggcggaccuucguugacaggggcugggguaacggcuguggccuauucggcaaggggagccugcugacgugugccaaguuuaagugcgugaccaagcuggaggguaagaucguucaauacgagaaccugaaauacuccgugaucguuaccguccauaccggugaccagcaucaaguggggaaugagacgaccgagcacggaaccauagcgacuaucacgccccaggcacccaccagcgagauccagcuaaccgacuacggggcccucacccucgacugcagcccccgaaccggccuggacuucaacgagaugguccuccugacgaugaaagagaaguccuggcuaguucacaaacagugguuccucgaccugccgcuuccauggaccuccggugccagcaccagucaagagaccuggaaccggcaggaccuccucgugacguucaagaccgcccaugcuaagaagcaggaggucguggugcugggaucccaagaaggcgcaaugcacaccgcccucaccggugccacggagauccagaccagcggcaccaccacgauuuucgccgggcaccuuaagugccgucugaagauggacaagcucacucugaaggggauguccuacgucaugugcaccgggagcuuuaagcucgagaaagagguggcggagacccagcacggcacggugcugguccaggugaaguacgaggggacugacgccccaugcaagaucccauucuccacccaggacgaaaaggggguuacccagaauggccggcucaucacggccaacccaaucgucaccgauaaggagaagcccgugaacaucgagaccgaaccgcccuucggggagagcuacaucgugguaggcgcaggcgaaaaggcgcugaagcugagcugguucaagaaggggagcuccaucgggaagauguucgaggccacagcccgcggggcccggcgcauggccauacucggcgauaccgcaugggacuuugggagcaucggcggcguguucaccuccguggggaaguuaguccaucagguguucggcaccgccuacggggugcucuuuagcggcgucuccuggaccaugaaaaucgggaucggcauccuuuugacguggcugggccuuaacucccgcuccaccucccuauccaugacuugcaucgccguggggauggucacgcuguaccucggcgucauggugcaggccgacucugggugcgugaucaauuggaagggccgggaacugaagugcggguccggcauauucgucacgaacgaggugcacaccuggaccgagcaguacaaguuccaggccgacaguccuaagcgccugagcgcggccauuggcaaggcgugggaggaaggggugugcggcauccggucugcaacccgccucgaaaacaucauguggaagcagaucagcaacgagcugaaccacauccugcucgaaaacgacaugaaguuuaccgucgugguuggggacgccaacggcauccuggcgcaggggaagaagaugauccggccccagcccauggagcacaaguauucuuggaaguccuggggcaaggccaagauuaucggcgccgauauccagaauacgacauucaucaucgacgggcccgacaccccggaaugccccgacggccagcgcgccuggaauaucugggaggucgaggacuacggguucggcaucuucacuacgaacaucuggcugaagcuccgggacuccuauacccaaaugugcgaccaucgccugaugagcgcggcaaucaaggacucgaaagcagugcacgccgauaugggcuacuggaucgaaucagagaagaacgagaccuggaagcuggcgcgggcguccuucaucgaggugaagacaugcacauggccuaagucgcacaccuugugguccaacgggguccuggagagugagaugauuauuccgaagaucuacggcgggccgaucucccagcacaacuaccgccccggauacuucacccagaccgccgggccuuggcaccuuggcaagcucgagcuggacuuugacuuaugcgagggcacgaccgugguggucgacgaacauugcgggaaccggggcccgagccuccggaccaccacggucacagggaagaucauccacgaguggugcugucgguccugcacccugccaccccugcgcuuccggggugaggaugggugcugguacggcauggagauucgccccgugaaggagaaagaagagaacuuagugcggagcauggugucugcgggcucuggggagguagacuccuucucccugggcauccuaugcgucuccaucaugaucgaagagguaaugcgcucccgguggagucgcaagaugcuaaugaccgggacgcuggccguguuucugcuacugaucgucggucagcugaccuggaacgaccuaauccgccugugcaucauggugggugcaaacgccuccgaccggaugggcaugggcaccacguaccuggcacucauggcaacguuuaagaugcgcccuauguucgccguggggcugcuguucagaagacugacaagccgggaaguacugcugcucaccaucggguugucccuuguggcgagcgucgagcucccgaacucccuggaggagcugggggacggccucgcuaugggcaucaugauguuaaagcugcucaccgaguuccagccgcaccaacuguggacgacccugcucagccucaccuucgugaagaccacgcugagucucgacuacgccuggaagacgaccgcgauggugcugucaaucguuucccuguucccacucugccugagcaccacgagccagaaaaccaccuggcucccggugcucuuggggagcuuuggcuguaagccccuaaccauguucuugaucaccgagaacaaaauaugggggcgcaaaucguggcccuugaacgagggcaucauggccaucgggaucguguccauccugcuauccucacugcugaagaacgacgucccccucgccggcccgcugaucgccggcgggaugcuaaucgccuguuaugugaucagcggcaguagcgcagaccucucacuggagaaggccgcggaagugagcugggaacaggaggccgagcacuccggagcuucacacaacauccuggucgaagugcaggacgacggcacuaugaagauuaaggaugaggagcgggacgauacccucaccauccugcugaaggccacccuucuugccgugaguggggucuaccccaugagcauccccgcgacgcuguucgucugguacuucuggcagaaaaagaaacagcgcucaggcguccucugggacacccccucaccgcccgaggucgagcgggccgugcuggacgacggcaucuaccgcauacugcagagagggcugcucggcagaucccagguaggggucggaguguuccaggacgggguguuccacacaauguggcaugucacgcggggcgccgugcugauguaccagggcaaacgucuggagcccagcugggcgagcgucaaaaaggaccucaucagcuacgggggcggguggcgguuccagggaaguuggaacacuggggaggaaguccaggugaucgccguggagccuggcaagaacccgaaaaacguccagaccacccccgggaccuucaagacaccagagggggaagugggugcgauagcgcuggacuucaagcccgggaccagcggcuccccgaucgugaaccgcgagggcaagaucgucggucuguacggcaacggggugguuacuacaagcgguacauacgucuccgcaaucgcccaggccaaggcgagccaggaggggccacucccggagaucgaggacgagguauucaagaaaaggaaccugaccaucauggaccugcacccggggagcggcaagaccaggcguuaccuccccgccaucguacgcgaggcgaucaagcggaagcugcggacccucauucucgcccccacgcgcgucguagcguccgagauggccgaggcucugaagggcaugccgauucgguaccagaccaccgccguuaagagcgagcacaccggccgcgagaucguugaccugaugugccaugccacguuuaccaugcgacuccugucgccggugcgcgugcccaacuauaacaugaucaucauggacgaagcucacuucacugaccccgccagcaucgccgcucggggcuacaucucuacccgcgugggcaugggggaagccgccgccauauucaugacggccacgccgcccggcagcguagaggcauucccccaguccaaugcagugauccaggacgaggagcgggacauacccgagcgcagcuggaacuccggguacgacuggaucaccgacuuccccgggaagaccgucugguucgugcccucaaucaaguccggcaacgacauugcgaacugucugagaaagaacggcaagcgggugauccaguugagccgcaagacguuugauaccgaguaccagaagaccaagaacaaugacugggacuacgucguaacuacggauaucuccgagaugggcgcgaacuuucgagcagaucgggugaucgacccccggcgguguuugaaacccgugauccugaaggacgggccugagcgcgucauccucgccggcccgaugcccgugaccguggcgagcgccgcccagcggcgcgggaggaucgggcgcaaccagaacaaagaaggcgaccaguacguguacauggggcagccccugaacaacgacgaggaccacgcccacuggacugaagccaagaugcuucucgacaacaucaacacccccgaggggaucaucccggcgcuguucgagcccgagcgcgagaaaucugcagccauugacggggaguaccggcugcgaggcgaggccaggaagacguucgucgaacucaugcgccggggcgaccugcccguguggcugagcuacaagguggcuuccgaaggguuucaguacucagacagacgcuggugcuucgauggggaacgaaacaaccagguccucgaagaaaacauggauguggagaucuggacuaaggagggugagcgcaagaaacuuagaccucgcuggcuggacgcgcgaacguacuccgauccgcucgcccugcgugaguucaaggaguucgccgccggccgccggagcgucagcggcgaccugaucuuggagaucgggaaacugccccagcaucugacccuccgcgcgcagaacgcgcuggacaaccuggucaugcuccacaacuccgagcagggcgggaaggccuacagacacgccauggaggagcuucccgacaccaucgagaccuuaaugcucuuagcucugaucgcggugcucaccgggggagugacgcuguucuuccugagcggcaagggacuaggcaagaccuccaucggccuguugugcgucacggccagcucggcguuacuguggauggccagcguggaaccccauuggaucgccgcguccaucauccuggaguucuuccucauggugcucuugaucccggagcccgaccgccagcgaacgccgcaagacaaccagcucgcguacgucgugaucggguuacuguucaugauccucaccguggccgccaaugagaugggccucuuagaaaccacgaagaaggaccucgggaucggcuacgucgccgcagagaaccaccagcaugccaccaugcuggauguggaccugcgcccggccagugccuggacucucuacgccgucgccaccacggucaucacacccaugaugcggcacaccaucgagaacaccacggccaauauuucccuaaccgcaaucgcgaaccaggccgcgauccuaauggggcucgacaaaggguggccgauuucgaagauggauaucggagugccccuacuggcacucgguugcuacucccaggugaacccccugacccucaccgccgcuguccucauguugguggcgcacuacgcaaucauuggcccagggcuacaggccaaggcgacacgcgaggcccagaagcgcaccgccgccggcauaaugaaaaacccuacuguggacggcaucguugccaucgaccuagacccugugguguacgacgccaaauucgaaaagcagcuggggcagaucaugcugcucauccuguguaccagccaaauccuguugaugcggacgaccugggcccuuugcgaguccaucaccuuagcgacaggaccacucacaacccuaugggagggcagcccggguaaguuuuggaacacuaccaucgccgucuccauggccaacaucuuccgcggcagcuaccuggccggggccggccucgcguucucccugaugaaaagccucgggggugggcggcgcggaacgggcgcccaaggggagacccucggcgagaaguggaagcggcaacugaaccagcugaguaaaagcgaguucaauacguacaagagaagcggcaucauggagguggaccgguccgaagccaaggagggacucaagagaggggagaccacgaagcacgccgugucgcggggcaccgcgaagcugcgcugguuuguugagcggaaccuggugaagcccgagggcaaagucauagaccugggguguggucgcgggggcugguccuacuacugcgccgggcucaagaaggucaccgaggugaagggcuacacuaagggcgggcccggucacgaggagccggugcccauggccaccuacggguggaaccuggucaagcugcacagcgguaaggacguguucuucaugcccccagaaaagugcgacacgcuccugugcgacaucggggaaaguucuccgaaccccaccaucgaggaaggccggacccuccgcgugcugaagauggucgagcccuggcugaaggggaaccaguucugcaucaaaauucugaaccccuauaugccguccgugguugaaacgcucgagcagaugcagcggaagcacgguggcaugcugguccgcaaccccuugagccggaacuccacgcacgagauguacugggucaguugcgggaccggcaacaucgugagugccgucaacaugaccucacgcaugcuccugaaucgguucacuauggcccaccgcaaacccacguaugagcgcgacguggaccugggcgcggggacccggcacguugccguugagcccgagguagcaaaccucgacaucaucggccaacgcauagaaaacauaaagaacgagcacaagcugaccuggcacuaugacgaggauaacccguacaaaaccugggcauaccacggguccuacgaggucaagcccagcggcuccgccucauccauggucaacggggugguccggcugcucacgaagccuugggacgugauccccauggugacccagaucgcgaugaccgacaccacgcccuucggccagcagcgcguguucaaggagaagguggacacccggacgccccgcgccaagcggggcaccacgcagaucauggaggugacagccaagugguuguggggguuccugagucgcaacaagaagccgcggaucugcacccgcgaagaguucacccggaagguccgcucuaacgccgccaucggcgcgguguucguggacgagaaccaguggaacagcgccaaggaagccgucgaggacgagcgguuuugggaccucgugcaccgcgagagagagcugcauaagcaggguaagugcgcaacgugcguguacaacaugaugggcaagcgugaaaagaagcugggggaguucggcaaggccaagggcagccgggccauaugguacauguggcucggagcccgcuuccuggaguucgaggccuuaggguucaugaacgaggaucacugguucucucgcgagaacagcuuauccgggguugagggcgaaggacugcacaaacugggcuacauucuccgagacaucuccaagaucccgggugggaacauguaugccgaugacacagcaggcugggacacccggauaaccgaggacgaccuucaaaacgaagccaagaucacagacaucauggagcccgagcacgcucuacucgccaccagcaucuucaagcugaccuaccagaacaagguggugcgcguccagcgaccugcuaagaacgggaccgugauggaugugaucagccggcgcgaccaacggggcuccggccaagucgggaccuacggccugaauaccuucaccaacauggaggugcagcucauccgccagauggagucggagggcaucuuuucccccagcgagcuggaaacuccgaacuuagcugagcgcgugcucgacugguuagaaaagcauggcgccgagcgccugaaacggauggccaucaguggggaugauugcgucgugaagcccaucgacgaccgcuucgcuacagcucucaccgcgcugaacgacaugggcaaggugcggaaggacaucccccaaugggagcccagcaagggcuggaacgacuggcagcaggucccguucuguucccaucacuuccaccagcugaucaugaaagacggucgcgagaucgugguuccaugccguaaccaggacgaacucguuggccgcgcccgggugagccagggggccggauggucccugagggagaccgcgugccugggcaagagcuacgcgcagauguggcagcucauguacuuccaccggcgcgaccugaggcuggcggccaacgccaucuguuccgccgugcccgucgacugggugccuaccagccgcaccacguggagcauccacgcgcaccaccaguggaugaccaccgaagauaugcucuccgucuggaaccgggucuggauagaggagaacccguggauggaggacaagacccacgugagcucuugggaggaggugcccuaccuaggcaaacgcgaggaccaauggugcggaagccugauagggcucacggcucgcgccaccugggccaccaacauccaaguagccaucaaccaaguucggagacugaucggcaacgagaacuaccuggacuacaugaccuccaugaaacgguucaagaaugaaagcgaccccgagggggcgcucugguga

SEQ ID NO: 24048 - RNA, 9879 nt, Artificial Sequence
  derived and/or modified CDS sequence (opt11) from DENV-1__FJ639812__SS-prME
agcgugaccaugcugcugaugcugcugcccacagcccucgcuuuccaccugaccaccaggggcggcgaaccgcacaugaucguguccaagcaggagcggggcaagagccucuuguuuaaaacuagcgcgggggugaacaugugcaccuugaucgccauggaccuaggcgagcucugcgaagauaccaugaccuauaagugccccagaaucaccgaggcagaacccgacgacguggacuguugguguaacgccaccgacaccugggucaccuacggaaccugcagccagaccggcgagcaccggcgagacaagcgguccguggcccuggcgccccacgugggcuugggguuggaaacgcgcacggagacauggaugagcuccgaaggcgccuggaagcagauccagcgggucgagaccugggcccugcgccaccccggguucacggugauagccuuguuccucgcucacgccauuggcacuagcauuacccagaaagggaucauauucauauuacugaugcucgugaccccaucaauggcgaugcggugcgucggcaucggcaaccgcgauuucguugagggguugucaggcgccacguggguggacgucgugcucgaacacggguccugcgucaccaccauggcaaagaacaagccgacacucgauauugaacugcuaaagaccgaggugacuaaucccgccguauugcgaaaguuaugcaucgaagccaaaaucagcaacacgacaacagauucccgauguccgacccagggcgaagccaccuuggucgaagagcaggaugccaacuucgucugucggcgcacuuuuguggaccguggcugggguaacggcuguggccuguucggaaaggggagccugcugacuugcgccaaauucaaaugugugacgaagcucgagggcaaaaucguccaguacgaaaauuuaaaguacagugugaucgugaccguccacacgggcgaccagcaccaaguggguaacgagacgaccgagcacggaacgaucgcgaccaucacgccccaggccccuacgucggagauucagcuuaccgacuauggggcccucacccuggacugcagcccccgcaccggccuggacuucaacgagaugaugcuacugacgaugaaggagaaaagcuggcugguccacaagcaaugguuucucgauuuaccgcuacccuggaccuccggggccagcacgagccaggaaaccuggaacagacaggacuugcuagucacguucaagaccgcccacgcgaaaaagcaggagguagucgugcugggcucccaggagggggccaugcacaccgcccucaccggugccacggagauccagacgagcgggaccaccaccaucuucgccggccaccuuaagugccgacugaagauggacaagcucacgcugaagggcaugagcuaugugaugugcaccgggagcuucaagcuagagaaggaagucgcggagacccaacacgggacgguccuggugcaggucaaguacgagggcaccgaugcaccuugcaagaucccguucagcacacaggacgaaaagggggugacccagaacgggaggcucaucacagccaacccaauagugaccgacaaggaaaagccugucaacaucgagaccgagccgccuuucggggagagcuauaucguggugggcgccggcgagaaggcgcugaagcuguccugguucaagaaaggcagcucaaucggcaagauguucgaggcuaccgcccgcggggcccgucgcauggcaauccucggcgauacugccugggacuucggcagcauuggaggcgucuucaccaguguggggaagcugguccaccaggucuucgguaccgccuauggcguccuguuuagcggcguaaguuggaccaugaagauagggaucggcauacuccugacauggcuaggccuuaauagccgguccacaagccuguccaugacgugcaucgcagucgggauggugacccuguacuuaggcguaaugguccaagccgacagcgggugugugaucaacuggaagggacgagaacugaaaugcggguccggcaucuucgugacaaacgagguccacaccuggaccgagcaguacaaguuccaggcugacucgccgaagcgacugagcgcggccaucggcaaagccugggaggagggggugugcggcauacggucugcgacccggcuagagaauauaauguggaagcaaauuagcaacgagcugaaccacauccugcucgagaaugacaugaaauuuacgguggucgugggggacgccaacggcauucuggcgcaggguaaaaagaugauccggccacagcccauggaacacaaguacuccuggaaauccuggggcaaagccaagaucauaggcgccgacauccagaacacgaccuucauuauugacgggcccgacaccccggaaugccccgacggucaacgagccuggaacaucugggagguggaagauuacggguucggaaucuucaccaccaacaucuggcugaagcuccgcgacagcuauacccaaaugugcgaccaucgucugaugagcgcggccaucaaggauuccaaagcuguccacgccgacaugggcuacuggaucgaaagcgagaagaaugagacauggaaacuugcacgugcguccuucaucgaagucaaaacgugcacguggcccaagucccauaccuuaugguccaacgggguucuggaaucggaaaugauaauccccaagaucuacggcggccccauaucccagcauaauuaccgccccggauacuuuacccagaccgcggggccauggcaccuuggcaaacucgagcuggauuucgaccugugcgagggaacgacugucgucguggacgaacacugcgggaaccggggcccuagccuccgcaccaccacggucaccgggaaaaucauacacgaaugguguugccgguccuguacccugccgccucuacguuuccggggcgaggacgggugcugguacggcauggagauaaggcccgugaaagagaaggaggagaaccucguacggucaauggucuccgccggcagcggcgaaguggacagcuucagccugggcauccuuugugugucaauuaugaucgaggaggugaugcgcucccgguggagucggaagaugcucaugacagggacgcuagcgguguuucugcuccugauuaugggccaacugaccuggaacgaccucauccgcuuauguauaauggugggggccaacgcguccgaccggaugggaauggggaccaccuaccuggcucucauggccacguucaaaaugcgcccuauguuugcugucggguugcuguucaggcgccucaccucucgggagguacugcugcucaccaucgggcucucccucguggccucugucgagcuccccaacuccuuggaggaacugggggacggacucgcgaugggcaucaugaugcucaagcugcucaccgaguuucaaccccaccagcuguggacaacccugcucucacugacauucgucaagaccacucugucccucgacuacgccuggaagaccacagccaugguccugagcaucguuaguuuauuuccccucugucucucgacaacgucccagaagaccaccuggcuaccuguacuccuggggucauuuggcugcaagccacugaccauguucuugaucacugagaacaagauuugggggcgcaagucauggccccugaacgaggggaucauggcaaucgggaucgucagcauccucuuauccagccugcugaagaaugacgucccccuagccgguccgcugauugccggggggaugcugaucgccugcuaugugauuucaggguccagcgccgaucuucugcuggaaaaggccgcggaggucuccugggagcaagaagccgaacacagcggugccucccacaacauauugguggaaguucaggacgacgguacgaugaagaucaaggacgaggagagggaugacacccucacgauccugcucaaggccacccugcuggccgugagcgggguuuacccuauguccauccccgccacccucuucguuugguacuucuggcagaaaaagaagcagcgcaguggcguccugugggacacccccuccccgccggaaguggagcgggccgugcuggacgacggcauauaccgcauucugcagcgggggcuccugggccgcucgcaggugggagugggcguguuccaggacggggucuuccacaccauguggcacgugacccggggcgcagugcugauguaccaggguaagcguuuggagcccagcugggcaagcgucaagaaagauuuaauaagcuacgggggaggguggcgguuccagggcagcuggaacacgggggaagaaguccaggugaucgccgucgaacccggaaagaacccgaagaaugugcaaacuacacccgguaccuucaaaacgcccgagggugaggugggcgcgaucgcccuggacuuuaagccagggaccuccgggagcccuauagucaacagagagggcaagaucguggggcucuaugguaauggggucguuaccaccaguggcacguaugugagcgccauugcccaggcaaaggcuucccaggaggggccccuccccgagaucgaggacgagguguucaagaagcgaaaucucaccaucauggaccuccaccccgggucuggcaagacccgcagauaccugcccgccaucguccgcgaggcaauaaaacggaaauuaagaacgcucauucuggcucccacgcgcgugguagcuagcgagauggccgaggcgcugaaagggaugccgauucgguaccaaaccacagccgucaaguccgagcauaccggccgugaaaucguagaccucaugugccacgccacguucacuaugcggcugcugagcccgguccgcguccccaacuacaacaugaucaucauggacgaggcgcacuucaccgacccggcguccaucgccgcccggggguacauaaguacucgcgugggcaugggggaggccgcggccaucuucaugacggcgaccccgccuggguccguggaggccuucccccagagcaaugccgugauucaagaugaggaacgggacaucccugagagauccuggaauuccgguuacgacuggaucaccgacuucccaggcaagaccguaugguuugugcccuccaucaagagcggcaacgacaucgcgaacugccuccguaagaacgggaagcgcguaauccagcugucccgcaagacuuucgauacugaguaccagaagaccaagaauaaugacugggacuacguggugacaacagacaucagcgaaaugggcgccaacuuucgcgcugaccgggucauagaccccagacggugccuuaagcccguuauacucaaggacgggccugagcgcgugauccuggccggcccgaugcccguuaccguggcguccgcggcccagaggcgcggaaggaucgggcguaaccagaacaaggaaggcgaccaguacguguacaugggccagccacucaauaaugacgaggaccacgcccacuggaccgaggcuaagaugcuacuggacaacaucaacacccccgagggcauaaucccugcgcuguucgagccggagagagagaaguccgccgccaucgacggagaguaccgacuccgaggcgaggcccggaagacguucguggagcucaugcggcgaggcgaccugcccguguggcuuuccuacaaggucgcgagcgagggguuccaguacucagaccgccggugguguuucgacggagaacgcaacaaccaagugcuggaggagaauauggacguggaaaucuggacuaaagagggggagcggaagaagcugcgcccccgguggcucgaugcccgcacguacagcgacccgcuagcgcugcgggaguucaaggaguucgccgcaggccgaagauccgucucgggcgaccucauacuggagauagggaagcuuccccagcaccucacccugcgugcccagaaugcuuuggacaaccucgugaugcugcacaacagcgagcaaggcgggaaagccuaccggcacgcgauggaggagcugccggacaccauagagacgcugauguugcuggccuuaauagcggugcugacuggagggguuacccuuuucuuccucuccggaaagggacuggggaaaaccucgaucggauuacucugcgugacugcauccucugcacugcuguggauggccuccguggagccccauuggaucgccgccagcaucauccucgaguucuuccugaugguccugcucaucccggagcccgaccgucagcggacgccccaggacaaccaguuagccuacgucguaaucgggcuccucuuuaugauccugaccguugccgcuaacgagauggggcugcuggagacgacgaagaaggaccugggcaucggcuacguagccgccgaaaaucaccagcacgcuaccaugcuggacguggaucuccgcccggccuccgcuuggacccuguacgcuguagcaaccacggucaucacccccaugaugcggcauaccaucgagaacaccaccgccaacaucagccugacugccaucgccaaccaagccgcuauccucaugggccuggacaaaggguggccaauuucuaaaauggacauaggagugccccuucucgcacuugggugcuauucacaggucaacccccugacccuaaccgcggcugugcugaugcuggucgcgcacuaugcuaucauagguccuggguuacaggccaaggcgaccagggaggcccagaagagaaccgcggcagguaucaugaaaaaccccaccgucgacggcaucguggccaucgacuuagaccccgugguuuaugaugcgaaguucgaaaagcaauuggggcaaauaaugcucuugauuuugugcaccucacagauccuccuuaugcggacgaccugggcccugugugaaagcaucacacucgcgacaggcccacugacgacccugugggaggguucucccggaaaguucuggaacaccacuauugccgugagcauggccaauaucuuucggggguccuacuuagcgggggcaggucuggcguuuagccugaugaaaucccucggcggcgggcggcgcggaacgggcgcccagggggagacccugggggagaaguggaagcggcagcugaaccagcucagcaaguccgaguuuaacaccuacaagcgaagcggcaucauggaaguggaucgaucggaggcaaaggagggccuuaaaagaggggagaccacaaagcaugcaguaucccggggcacugcgaagcugcgcugguucgucgagcggaaccuggugaaacccgagggcaagguuaucgaccuuggguguggccggggugguuggucuuacuacugcgccgguuuaaagaaggugacggaggucaagggauacaccaaaggcgggccuggccacgaggaaccgaucccuauggccaccuacggguggaaccuggucaagcuccacaguggcaaggacguguucuucaugccgccagagaagugcgacacucugcugugugacaucggggagagcuccccgaacccaacuauugaggagggccggacccuccgcgugcugaagauggucgagccauggcucaagggcaaccaguucugcaucaagauccucaaccccuacaugccaagcgugguggaaacccucgagcagaugcaacggaagcaugggggcaugcugguccgcaaucccuugagucggaacucaacgcacgagauguacugggugaguugcggaacuggcaauaucgucagcgccgugaacaugacaagccgcauguuacugaacagauucaccauggcgcaccguaagccgacguacgagagagaugucgaccugggagcugggacccggcacguggcgguagagcccgagguggccaaccucgacaucaucggucagaggaucgagaacauuaagaacgagcacaagucuaccuggcauuacgacgaggacaauccguauaagaccugggccuaccaugggucauacgaagucaagccgagcggauccgccagcuccauggucaacgggguaguccggcucuugacuaaaccuugggacgugauccccaugguuacgcagaucgcgaugaccgacaccacaccauucggccagcaacgcgucuucaaggagaagguggacacccggacgccacgcgccaagcggggcaccacucagauaauggaaguuaccgccaaguggcuguggggguuccugagccgaaacaagaagccucggaucugcacccgcgaggaguucacucggaagguccgcuccaacgccgcgaucggcgcgguguucguggacgagaaccaguggaacuccgccaaggaggccguugaggacgagcgguucugggaccugguucaucgcgagcgagaacugcacaaacaggggaagugcgcgacgugcguguacaacaugauggguaagagagaaaagaaauuaggugaguucggcaaggcgaagggcucccgugcuaucugguacauguggcucggagcccgcuuuuuggaguuugaagccuugggguucaugaacgaggaccacugguucucccgggagaacagccucuccgguguugaaggugaggggcugcacaagcugggcuauauccuccgcgacaucucgaagaucccgggcgggaacauguacgccgaugacaccgccggcugggauacccggaucaccgaagaugaccugcaaaacgaagccaagaucacggacaucauggagcccgaacacgcccuacuagccacauccaucuucaagcuaacuuaccagaacaagguagugagggugcagcgccccgccaagaacgggacagugauggacgucaucuccagacgcgaccagcggggcucgggacaggucggaaccuacggccugaacacguuuaccaacauggagguucaguugauccgucagauggagagcgaggggaucuuucugccaagugagcuggagaccccgaacuuagcagaaagagugcuugacuggcuggagaagcacggcgccgagcgccucaagcggauggcaauaaguggggaugauugcgucguuaagccuauugacgaccgcuucgccaccgcccucaccgcgcugaacgacaugggcaaggugcguaaagacauuccccagugggagcccuccaagggauggaacgauuggcaacaagucccguucugcagccaucauuuccaccagcucaucaugaaagacgggcgcgaaaucgucguaccauguaggaaccaagacgaauuggucggccgggcccggguaucacagggggccggauggagccugagagagaccgccugccuggggaaguccuacgcccagauguggcagcucauguacuuccaccgucgcgaccugagacuggcggccaacgccaucuguagcgccguucccgucgauugggugccuaccucgcgcaccacuuggagcauccacgcgcaccaccaauggaugaccacggaggauauguugucggucuggaaccgggucuggaucgaggaaaacccguggauggaagacaagacccacgugucaagcugggaggagguccccuacuuaggcaagcgggaagaccaguggugcggcuccuugauugggcugacggcccgcgccaccugggccaccaauauacagguagccaucaaucagguucggaggcugaucggcaacgagaacuaucucgacuacaugacuagcaugaagcgguucaagaaugaaagugaccccgagggugcgcugugguga

SEQ ID NO: 24049 - RNA, 9879 nt, Artificial Sequence
  derived and/or modified CDS sequence (opt11) from DENV-1__FJ639813__SS-prME
ucagugaccaugcugcucaugcugcuccccaccgcccucgcguuccaccugaccaccaggggcggggagccccauaugaucguuagcaagcaggagcggggcaagucccuccuguucaagaccagcgcgggugucaacauguguacucuaaucgcgauggaucugggcgaguugugcgaggacaccaugaccuacaagugcccccgcaucaccgaagccgaacccgacgacguggacugcuggugcaacgccaccgacacgugggugaccuacgggaccugcucccagaccggggagcauagacgcgacaagcggagcgucgcgcuggcaccccacguggggcuggggcucgagacuaggacugagacguggaugaguuccgaaggagccuggaagcagauacagagggucgagaccugggcccuucgacaccccggguucacggucaucgcccucuuucuagcgcacgccaucggcacuucgauuacccagaaggggaucaucuucauccugcugaugcucgugaccccaagcauggcaaugcguugcguuggcauugggaacagggacuucguggaggggcugucgggcgccacguggguagacguagugcuagaacacggguccugugugaccaccauggcuaagaauaagccuacgcuugacaucgaacugcugaagacagagguaaugaaccccgcgguguuaaggaaacugugcauagaggcgaagauaagcaacacaaccaccgacucccgcugucccacucagggcgaggcgacacuuguggaggaacaagacgccaacuucgugugccggaggacguucguggaccggggcugggguaauggcugcggacucuuugggaaagggucgcugcugacuugcgccaaguuuaagugcgucacgaagcuagaggggaagaucguccaguaugaaaaccucaaguacuccguaaucgucacuguccacaccggcgaccagcaccagguggggaacgagacuacggagcacgggaccaucgcgacuaucacgccccaagcccccacaucugagauccaguugacagacuacggugcccucacccuggauugcucgccgcgaaccggauuagacuuuaacgagaugguccuccugacuaugaaggaaaagucguggcucgugcacaagcagugguucuuagaccugccccugccguggacuuccggggccagcacuucacaggagacauggaaccggcaggaucuacuggugacauucaagaccgcccaugccaagaagcaagagguuguaguguuaggcucccaggagggcgcaaugcacacugcccuuacgggggccaccgagauucaaacuagcggcaccaccacaaucuuugccggucaccugaagugccgccucaagauggacaagcucaccuugaaggguaugucauaugucauguguaccgguucauucaagcuggagaaggaaguggcggaaacccaacacggcacugugcugguccaggugaaguacgaggggacagaugcccccugcaagauccccuucuccacucaagacgaaaagggcguaacucagaacggccggcucauuacagcgaacccgaucgucaccgauaaggagaagccugugaacauagagaccgagccgcccuucggggaauccuauaucguggugggcgccggagagaaggcgcucaagcugucgugguucaagaaggguagcuccaucggcaagauguucgaagccaccgccagaggugcccggcgaauggccauccucggcgacaccgcaugggacuuuggaagcaucggaggcguguucacauccgucgggaagcuaguccaccaagucuucggaaccgcauacggggugcucuuuucuggcgucuccuggacaaugaagaucggcaucggcauccuccugacauggcugggccucaacucgcguuccacgagcuuuucaaugaccugcaucgcugucgggauggucacccuauaccugggcguaauggugcaggccgacuccgguugcguaaucaacuggaagggucgggagcucaagugcggguccggaauuuuugucaccaacgagguucauacguggaccgaacaguacaaguuccaggcugacucgccgaagagguuaagcgcggccaucggcaaggcuugggaggagggggucugcggcauuagaagcgccacccggcuagaaaacaucauguggaagcagaucucuaacgagcucaaccacauccugcucgagaacgacaugaaguucaccgucguggugggugaugccaacggcauccuggcgcaggggaagaagaugauccggccccagcccauggagcacaaguacuccuggaagucguggggcaaagccaagauuaucggagcagacauccagaacacaacguucaucauugacgggccagacacuccggagugucccgauggccagcgcgcguggaacauaugggaggucgaggacuacggcuucggcaucuucaccacgaauaucuggcugaagcugcgagacuccuacacgcagaugugcgaccaccgcuuaaugucagcugccauuaaggacucuaaggccgugcacgccgauaugggauauuggauugagagcgagaagaacgagaccuggaagcuagcaagagcguccuuuaucgaggugaaaaccugcacguggcccaagagccauaccuuguggagcaacggaguacucgaaucggaaaugaucauccccaagaucuacggugggccgaucucacagcauaacuaccgcccuggauacuucacccagacugccgguccauggcaccuggguaaacuggaacucgacuucgaccuaugugagggcaccacggugguugucgacgagcauuguggcaacagagggccgagccuccgcaccacgaccgucacggggaagaucauccaugagugguguugucgcuccugcacacugccgccacugcgcuuccggggugaagacggguguugguacgggauggagauccgaccgguaaaggagaaagaggaaaacuuggugcgcagcaugguuucugccggcagcggcgagguugacagcuucucccucggaauccugugugucuccaucaugauugaggaagugaugcgcagucgguggagccgcaagaugcuaaugaccgggacucuugccguguuccugcuucucaucaugggccagcugaccuggaacgaucugauacgccucugcaucauggucggagccaacgcuagcgaucggaugggcauggggaccacuuacuuggccuugauggccacuuucaagaugcggccgauguucgccguggggcuccucuuccgucgccucacgucucgggagguauuacugcugacgaucggccucuccuugguagccagcguagaacuccccaauucccucgaggagcugggugauggacucgcgaugggcauaaugaugcucaaacuucugaccgaguuccagccacaccagcuauggaccaccuugcugagcuuaaccuucguaaaaaccaccuuguccuuggacuacgcuuggaagacgaccgccaugguguugagcauagugucccuguucccucugugccucucgaccacaucccagaagacgaccugguuaccgguccuguuagggucguucggcuguaaaccacugacuauguuccucauuacagagaacaaaaucuggggucgcaaauccuggccccugaacgaagggauuauggcuaucgggaucguuagcauccugcucuccagucuccugaagaacgacgugccccucgcgggcccgcucaucgccggcgggaugcugaucgccuguuacgucaucuccggcuccagcgccgaccuguccuuggagaaggccgcugaggugagcugggaacaggaggccgagcacucuggggccagccauaacauucugguggaggugcaggacgacgggaccaugaagaucaaggacgaggaacgugaugauacguugacgauccuauuaaaggccacccugcuggccgucuccgggguguaccccaugagcaucccggcaacucuguuugucugguacuucuggcagaagaagaagcagcgcucuggcguacucugggacacacccucgccgcccgagguggaaagagcagucuuagaugauggcaucuaccgaauccugcagcgggggcugcugggcaggucccagguuggggugggcguauuccaggacgggguguuccacaccauguggcacgugacucggggcgccgugcucauguaccaggggaaacgcuuggagcccagcugggccuccgugaaaaaggaucugaucagcuacgggggagguuggcgguuccaggggucguggaacaccggugaggaggugcaagucaucgccguggagcccggcaagaacccgaaaaacguucagacgacgccugguaccuucaaaaccccugagggggaggucggggcuaucgcucucgacuucaaacccgggacguccggcuccccgaucguuaaccgcgagggcaaaauaguugggcuguacggcaacggcgucgugaccaccagcggcacguacgugucugcgaucgcgcaggccaaggcgagccaagaggguccgcugccugagaucgaggacgagguuuucaagaagcggaaccucacuauuauggaccugcacccgggcucuggcaagacccgccgguaccugcccgcuaucgugcgagaggcgaucaaacggaagcuccgcacucucauuuuggcacccacccgaguuguagcgucugagauggccgaggcauugaaggggaugccuauccgguaccaaacgaccgcaguaaagagcgaacacacgggccgcgagauaguggaucugaugugccacgccaccuuuacaaugcggcugcucucccccguccgcguaccgaacuacaauaugaucaucauggaugaggcgcacuuuaccgaccccgcgagcaucgccgcgcggggguacauuucaaccaggguaggcaugggggaggccgcugcuaucuucaugaccgccacgcccccuggcagcguggaagccuucccacagaguaaugccgugauccaggacgaggaacgggacaucccagaacguaguuggaacucuggcuacgacuggaucaccgacuuccccgggaagaccgugugguucguuccgagcaucaaauccggcaacgacaucgcgaauugucuaaggaaaaaugggaagcgcgugauucagcucucccguaaaaccuuugacacggaguaucagaaaaccaaaaacaacgauugggacuaugugguaaccacagacaucuccgagaugggugcaaacuucagagcagaccgggugauugaucccagaagguguuugaaacccguuauucugaaggacggcccagagcgugucauucuggcggguccgaugccuguaacugucgcgagugccgcacagagacgcggccggaucgguagaaaccagaacaaggagggagaccaguacguguauauggggcaaccccugaauaacgacgaggaccacgcccacuggaccgaagccaagaugcuauuggacaacauaaacaccccugagggcauaaucccugcccucuucgagcccgagcgcgagaaguccgccgccauugacggggaguaccgacugcgaggcgaggccaggaaaaccuucguggagcugaugcgucguggcgacuuacccgucuggcugagcuacaagguagcuuccgaaggguuccaguacagcgaccgcagauggugcuucgacggggagcggaauaaucaggugcuggaggagaauauggacgucgagauauggacgaaggagggcgagcggaagaaauuacgcccccgauggcuagacgcacggaccuacuccgacccgcucgcccuccgggaauuuaaggaguucgccgcuggccgccggucaguuagcggcgaucugauacuggaaauagggaaguuaccccaacaucugacacuucgcgcccaaaaugcgcucgauaaccuggugaugcugcacaacucggagcagggcggaaaggccuacaggcacgcaauggaagaguugcccgacaccauagagacucugaugcugcucgcccugaucgcgguccugacuggcggggucacccucuucuuuuuaucuggcaagggccuggguaagaccucuauaggccuacuaugcgucacugccagcuccgcacugcuguggauggccagcguggaaccccauuggaucgccgcguccaucauccuggaguuuuucuuaaugguacucuugaucccggaacccgaccgccagcggacgccacaggacaaccagcuggccuaugugguuaucggguuacuguucaugauccucaccguggccgccaaugagaugggccuccuggaaaccaccaaaaaggacuuagguaucggauacguggccgcggaaaaccaccagcacgcuacgaugcuagacguagaccugcgcccggccagcgcuuggacccuguacgcuguggcgaccaccgugaucacgcccaugaugcggcauacaaucgaaaauacuaccgcgaauaucaguuugaccgcaaucgccaaccaggccgcgaucuugaugggacuggacaagggguggcccaucagcaagauggauaucggcgucccccuucuggcacuggguugcuauagccaaguaaauccccucaccuugaccgccgccguacugaugcuagucgcccacuacgccaucauuggccccgggcugcaggccaaggcaacccgggaggcccagaagcgcacggccgccggcaucaugaagaaccccaccguggacgggauaguggccauugacuuggaccccguagucuacgaugccaaauuugagaagcaguuagggcaaaucaugcugcugauccucugcacaagccagauccuguuaaugcggacaacgugggcccucugcgagucaaucacccuugcgaccgggccucuaacgacucucugggaggggucgcccgggaaguucuggaauaccacgaucgcagugaguauggccaacaucuuccgcggcagcuaccuggccggggcaggccuggcguucucccucaugaaaucacuagggggcgggcgacgcgguaccggagcccagggugaaacgcugggugagaaauggaagcggcagcucaaccagcuguccaagagcgaguuuaacacguacaagcgcagcgguaucauggaggucgaucguucagaggcgaaggagggucugaagcgcggggaaaccaccaagcacgcugugagccgagguacggcgaaacuccgcugguucguggaacguaaccuaguaaagcccgagggcaaagugauugaucuggggugcggccgcgggggcugguccuacuacugcgccggccugaagaaagucaccgagguuaagggguacacuaagggagguccaggccacgaagaaccaaugcccauggccaccuacggguggaaccuggugaagcugcacagcgguaaggacguauucuucaugccgcccgaaaagugcgacacccuacucugcgauaucggugaguccagcccgaacccaacgaucgaagaggguagaacccugcgcguccugaaaaugguagaaccuuggcucaaggggaaucaguuuugcaucaaaauccugaaccccuacaugccgagcgugguagagacccuggagcagaugcagcggaagcacggagguaugcuaguacgcaacccccugagcagaaacuccacucaugagauguauugggugagcugcgggaccggcaacaucgucagcgcagugaacaugaccucucgcaugcuacucaaucgguuuaccauggcgcaccgcaagccuacuuacgagcgagacguggacuugggagcggggacgcggcacguugccguggaacccgagguugccaaucuggacauuaucgggcagcgcaucgaaaauaucaagaacgagcacaagucgaccuggcacuacgaugaagacaacccauacaagaccugggccuaccacgggucguacgaggucaagccgucgggcucggcuucgagcauggugaacggggucguucggcuccugaccaagcccugggauguaauccccaugguaacgcagaucgcaaugaccgacaccaccccguucggacagcagcgcguguucaaggaaaaggucgacacccggacgccccgcgcaaaacggggcaccacgcaaaucauggaggugacggccaagugguuauggggguuccucucccgcaacaagaagcccaggaucugcacucgagaggaguuuaccaggaaggugcgcagcaacagcgccaucggcgcgguguucguugacgagaaccaauggaacagugcgaaggaggcggucgaggacgagcgguuuugggaccuggugcaccgcgagcgggagcuacacaaacaagguaaaugugcaaccugcguuuacaacaugaugggcaagcgcgagaagaaacuuggggaguucgguaaagcuaaggguagccgcgcgaucugguacauguggcuuggagcacgcuuccuggaguucgaggcccuaggcuuuaugaacgaagaucacugguucucccgcgagaacucacugucggggguggaaggggaggggcuucauaaacucggcuacaucuugcgugacaucucuaagaucccaggagggaacauguacgccgacgacacggccggcugggacacccggaucaccgaagacgaccugcaaaacgaggcgaagauaacggacaucauggaaccggagcacgcccuccuggcuacuucaaucuucaagcugaccuaccagaacaaggugguccgcgugcagcgccccgccaagaacggaacaguaauggacgucaucagccggcgcgaccagcggggcucgggccagguaggaacguauggccuaaacacguuuaccaacauggagguacagcugauccgccagauggagagcgaagguaucuucucccccagcgaacuggagaccccgaaccuugccgaacggguucuugauuggcuagagaagcacggugcggaacgacucaagcggauggcuauaagcggagacgacugcgucguaaagccgaucgacgaccgcuuugccacugcauugacugcgcuaaaugauauggggaagguacggaaggacauaccucagugggagccaagcaagggcuggaacgacuggcagcaggucccauuuuguucccaccauuuccaccagcucaucaugaaggacgggcgcgagaucgugguuccgugccggaaccaggacgagcuggugggcagagcacgcgugagccagggggccggguggaguuuacgcgaaacagccugccucgguaagagcuacgcgcagauguggcagcucauguacuuccaucggcgcgaccugagacucgccgcgaaugcuaucuguagcgccguccccguggacugggugcccacaucccguacaaccugguccauucacgcacaccaccaguggaugacgaccgaggacaugcugucuguguggaaucggguguggaucgaggaaaaccccuggauggaggacaagacccacgugagcucuugggaggaaguacccuaccugggcaagcgcgaggaccaauggugcggaagccucaucggcuuaaccgcccgggcgacgugggccaccaacauacagguggccaucaaccaggugcggcgccuaaucggcaacgagaacuaucucgacuacaugacaaguaugaagcgauucaaaaacgagucagaccccgagggcgcccugugguag

SEQ ID NO: 24050 - RNA, 9879 nt, Artificial Sequence
  derived and/or modified CDS sequence (opt11) from DENV-1__JN819412__SS-prME
agcgugaccaugcugcucaugcugcugccaaccgcccuugcuuuccaccugaccacccgcggcggggagccacacaugaucgugucuaaacaagagcggggcaagagucuccuguucaagaccucggcggguguaaacaugugcacccugauagccauggaccugggcgaauugugcgaggacaccaugaccuacaaaugcccccgcaucacagaagccgagcccgaugacgucgacugcugguguaacgcaaccgacacuuggguuacguacggcaccugcagccagaccggcgagcaccggcgcgacaagcgguccguggcccuggcgccacacguaggccuggguuuggagacgcgcaccgaaacguggaugagcuccgagggggccuggaagcagauccagcgggucgagaccugggcccugcgccaccccggcuucacggugaucgcccuguuccucgcacaugccaucggcaccagcaucacccaaaaggggaucaucuuuauccugcugaugcucgugacucccuccauggcgaugcguugcguaggcauuggcaaccgcgacuucguagaggggcugucgggcgccacguggguugacguagugcuggagcacggguccugcgugacaacaauggccaaaaauaaacccacgcucgauaucgagcugcugaagacggaagucaccaaccccgcugugcuccguaagcuaugcaucgaagcuaagaucagcaacacgaccacggacucccgcugcccgacucagggcgaggccacccuggucgaggagcaggacgcgaacuucgucugccggcgaaccuucguggaucggggaugggggaacggcugcgggcuuuucggcaaggguagccugcugacgugcgccaaguucaagugcgugaccaaguuagagggcaagaucguccaguacgagaaccugaaauacuccgugaucgugaccguccacaccggcgaccagcaccaaguugguaacgagacgaccgagcacggcacuaucgcgacuaucacgccccaagcccccacguccgagauacagcugaccgacuacggagcccucaccuuagacugcaguccccgcaccggccucgauuucaacgaaaugguccugcugacgaugaaagagaaauccuggcuggugcacaaacagugguuccucgaccugccgcugcccuggaccuccggggccagcaccagccaggagaccuggaaucggcaggaccuuuugguaacguucaagaccgcccaugcgaagaagcaggaggucguggugcucggcucacaagagggcgccaugcacaccgcccucacgggggccacggagauccagaccagcggcaccacuacgaucuucgccggacaucucaaaugccgcuugaaaauggacaagcucacgcugaaggggauguccuacgucaugugcaccgggagcuucaagcuggagaaggagguugcggagacccagcacggcacggugcugguccaggucaaguacgaggguacggacgccccuuguaagauccccuucuccacccaggacgagaaggggguuacccagaacggccguuugaucaccgcgaacccuaucguuaccgacaaggagaagcccguuaauaucgaaaccgagccgcccuucggugaguccuacauuguggucggcgcuggagagaaggcgcugaagcugucaugguuuaagaaggggagcuccaucggcaagauguucgaggccaccgcccgcggggcuagacgcauggccauacucggcgacacggcgugggacuucggcucaauuggcggcguguucaccucgguggggaagcugguccaccagguguuuggcaccgcauacgggguguuguucagcggagucuccuggaccaugaagaucgggaucgguauccuacugacguggcuuggccucaacucacgcuccacaucucuguccaugacuugcaucgccguggggauggugacccuguaccucggcgucauggugcaggccgacagcgggugcgugaucaacuggaaaggccgggaacugaaauguggguccggcaucuuuguaacgaacgaggugcauaccuggaccgagcaguacaaguuccaggccgacagcccgaaacgccugucagcggcuaucgggaaggcgugggaggagggggugugcggcauccgguccgccacacgccucgagaacaucauguggaagcagauuucaaacgaguugaaccacauccugcucgagaacgacaugaaguuuacagucgucgugggggacgcaaacggcauccuggcgcaggggaagaaaaugauccggccccagccgauggagcacaaguauuccuggaaguccuggggcaaggcaaagauaaucggcgccgacauccagaacacgaccuucaucaucgacgggcccgacaccccggaaugcccggacggucagcgggccuggaacaucugggaagucgaagacuacggguuugggaucuucacaacgaacaucuggcuuaaacuccgggacuccuacacccagaugugcgaccacaggcuuaugagcgcggccaucaaggacuccaaggcagugcacgcugacaugggcuacuggauagagagugagaagaaugagaccuggaaguuagcccgggcguccuucaucgagguuaagacgugcacauggcccaagagccacacccucugguccaacgggguccuggagagcgagaugaucauccccaagaucuacggcgguccgauaagucagcauaauuaucggccagguuacuucacccagaccgccgggcccuggcaccugggcaagcucgaacuggacuucgaccugugcgaggggacgaccgugguggucgacgagcacugcgggaacagaggcccgagccuccgcacgacuacggugacugggaagauaauccacgaguggugcugccgguccuguacccugccgccccugagguuccggggugaggaugggugcugguacggaauggaaauacgacccgugaaggagaaggaggagaaccucguccgaucgauggugucugcgggcagcggggaaguggacucauucucccugggcauccugugcgucagcaucaugauagaagaggugaugagaucccgguggagccggaaaaugcucaugaccgggacacuggccgucuuuuuacuccugaucaugggacagcugacguggaacgaccucauccggcuuugcaucauggugggggccaacgcgagcgaccggaugggcauggggaccaccuaccuggcccucauggccaccuucaagaugcgcccaauguucgcaguggggcuccuguuucggagacuaaccagccgggaaguucuguuauuaaccaucgggcugucucuggucgccagcguggagcucccuaacucccuggaggagcugggggacggccucgcgaugggcaucaugauguuaaagcugcucaccgaguuccagccgcaccagcuguggacuacccuacucagccugaccuucgucaagaccacgcuaucccuagacuacgccuggaagaccaccgccauggugcuuagcaucguuuccuuauucccccucugucuaagcacgacgucccagaagaccacauggcuuccaguccuccuggggagcuucggcugcaagccacugaccauguucuugaucaccgagaacaagauuugggggcgcaaguccuggccccugaacgaaggcaucauggcuaucgguaucgugagcauccugcuuuccagccucuugaagaacgacgugccccuugcagguccgcuuauugccggcgggaugcuuaucgccugcuacgucaucagcggcuccagcgccgaucuccugcuggagaaagccgcggagguguccugggagcaggaggccgagcacagcggggcaagccacaacauccucguagagguccaggacgacgggacgaugaagaucaaggacgaggaacgggaugacaccuugaccauccugcuaaaggcgacccugcuggccgucuccgggguguaucccauguccauccccgcgacguuguuugugugguacuucuggcagaagaagaagcaacgcagcggcgugcugugggauacccccuccccgcccgagguggagagagccguucuggacgauggcaucuaccgcauacugcaacgggggcuccuggggcgcagccaaguaggggucggcguauuccaggacggggucuuucacaccauguggcacguaacccggggcgccguccugauguaccagggcaagcgccucgagccauccugggccagcgugaagaaagaccugaucuccuacgggggcggguggcgguuccagggcagcuggaacacgggggaggaggugcaggugaucgccguggagcccggcaaaaacccgaagaacgugcagaccacgcccggcaccuuuaagacgcccgagggggaggucggugcgaucgccuuggacuucaagcccgggaccuccggcagcccgaucgugaaccgcgaagguaagaucguggggcucuacggcaacggggucgugaccaccuccgguacguacgugagcgcgaucgcccaggccaaggcaagucaggaggggccccugccagaaaucgaggacgaggucuucaagaagcggaaccugacgaucauggaccuccauccgggaagcggcaagacccgccgcuaucugcccgccauagugcgcgaggcuaucaagcggaagcugcgcacacucauccuggcccccacgcgcguggucgcuagcgagauggcugaggcacugaaggggaugcccauccgguaccagacuaccgccgugaaguccgaacacacuggccgugagauaguagaccucaugugccaugcaacguucaccaugcggcugcucagccccguccgcgugccgaacuacaacaugaucauaauggacgaggcgcacuucaccgaccccgccuccauugccgcucggggcuacaucagcaccagaguuggcaugggggaggcugcggccaucuucaugacggcuacgccgcccggauccgucgaggccuucccgcagagcaacgcggugauccaggacgaggagcgggacauccccgaacgcuccuggaauagcggcuacgacuggaucaccgauuuccccgggaagaccgugugguucgugccuuccaucaagucuggcaacgacaucgcuaacugccuccggaaaaacgggaagcgugugauccagcugucccggaagacguucgacaccgaguaccagaagaccaagaacaaugacugggacuacguggucaccacggacaucagcgagaugggcgccaacuuccgcgccgaccggguaauugacccccgccggugccugaagccagugauccucaaggacgggccagagcgugugauccuugccggcccgaugccagugacaguugcguccgccgcccagcggagaggccggauagggcgcaaccagaacaaggagggcgaccaguauguauacauggggcagccccugaacaacgaugaggaccacgcucacuggaccgaggcgaagaugcuccuggacaauaucaacacuccagaggggaucaucccggcgcuguucgagcccgagcgagagaaguccgcggccaucgacggggaguaccggcuccgcggugaggccagaaagacguucguagagcucaugcggcggggcgaccugcccgucuggcucuccuacaagguggccagcgagggguuccaguacuccgaccgccgguggugcuucgacggcgagcgcaauaaccaggugcuggaggagaacauggacgucgagauuuggaccaaggagggggagcguaagaagcuccgcccgcggugguuggacgcaaggaccuacuccgacccgcuggcuuugagagaguucaaggaguucgccgccggccgccgguccgugagcggagaccucauccuggagaucgggaaacugccccagcaucucacccuacgcgcgcagaaugcgcucgacaaucucguuaugcugcauaacagcgagcagggcgggaaggccuaccggcacgccauggaagagcugcccgacaccauugagacucugaugcuucuugcccucaucgcgguccugaccggcgggguuacucuguucuuccucuccggcaagggcuuagggaaaaccagcaucgguuugcucugcguaacggcauccucggcccugcuguggauggccuccgucgagccccacuggauagccgcgagcaucauacucgaguuuuuccugauggugcuauuaaucccggaacccgaucgccagcggacgccccaggacaaccaauuagccuacgucgucaucggccucuuguucaugauccugacaguggcggcaaacgagaugggccuacucgagaccacgaagaaggaccuagggaucggcuacguugccgcggagaaccaucagcacgccaccaugcuggacgucgaccuccgcccggccuccgccuggacccuguaugccguggcgacaacggugaucacccccaugaugcggcacaccauugagaacacgaccgccaacaucagccucacagccaucgccaaccaggccgcgauccucaugggccuggacaagggguggcccaucuccaagauggacaucggcgugccccugcucgcccuuggcuguuauucgcaagugaacccgcugacacucaccgccgccgugcugaugcucgucgcgcacuacgccaucaucggccccgggcuccaggcaaaagccacgcgcgaggcccaaaagcgcacagcugccggcaucaugaagaaucccaccguggacgggauugucgccauagaccuggaccccgugguguacgaugccaaguuugagaaacagcuggggcagaucaugcuccugauccucugcaccucccagauccugcugaugcggacgaccugggccuuaugcgagagcaucacccucgcgaccggcccccugacgaccuuaugggaagguucccccggaaaguucuggaacacgaccaucgccguauccauggcuaacaucuuccgcgggucuuaccucgccggugcuggccuggcguucagccugaugaaaagucucgggggagggcgccgcgggacgggcgcccaaggggaaacgcucggcgagaaguggaagcgacaacucaaccagcucagcaaguccgaguucaacaccuacaaacgcagugggaucauggagguggaccggagcgaggcuaaggagggccugaagcggggggaaaccacgaaacacgccgugagccgcggcaccgcaaagcugcgcugguucguggagaggaaccuggucaagccggaaggcaaggugauugaucucgggugcggccgcgggggguggagcuacuacugugccggccugaagaaagugacagaggucaagggcuacacuaagggcgggcccggccacgaagaaccgauccccauggccacguacggguggaaccuggucaaacuccacuccggcaaggacguauucuucaugccgcccgagaagugcgacacgcuccugugcgacaucggggagagcuccccgaaccccacaaucgaggagggccggacccuccgcguccugaagaugguggaacccuggcuaaaggggaaccaguucugcaucaagauccucaaccccuacaugccuagcguggucgagacccuggagcagaugcagcgaaagcacgggggcaugcuggugcgcaacccccucucccggaacagcacgcacgagauguacuggguuuccugcgggaccggcaacaucgucagcgccgugaacaugaccucccguaugcuguuaaaccgguucaccauggcccaucgcaagcccaccuacgagcgcgacguggaccucggcgcagguacccggcacgucgccguggagcccgagguggccaacuuagacaucaucggccagcgcaucgagaauaucaagaacgagcauaaaagcaccuggcauuacgacgaggacaacccguauaaaaccugggccuaccacggguccuacgaggucaagcccucuggcucugcgagcuccauggugaacggggucgugcggcugcucacgaagcccugggacgugauccccauggucacccagaucgcgaugaccgacaccacgccguucggccaacaacgcguguucaaggagaaaguggacacaagaacgccacgagccaagcgggggaccacucagauuauggagguaaccgccaaguggcuguggggcuuccuuagccgcaacaagaagcccaggaucuguacccgcgaggaguuuacccggaaggugcgcuccaacgccgccauaggcgcgguguucguggacgagaaccaauggaauagcgccaaagaggccguggaggacgagcgguucugggauuuagugcaucgcgagcgggagcugcacaagcaggggaagugcgccacgugugucuacaauaugaugggcaagcgcgagaagaagcuaggggaguucggcaaggcgaagggcucucgggcgaucugguacauguggcucggggcccgcuuccucgaauuugaggcccugggcuucaugaaugaggaccacugguucucgcgggagaacucucuauccggggucgagggcgaggggcugcacaaacugggcuacauccuccgcgacauaagcaagaucccgggcgggaacauguacgcugacgacaccgcgggcugggacacacggaucaccgaggacgaccuacagaacgaggcaaagaucacggauaucauggagcccgagcaugcacugcucgccaccagcauuuucaagcuaaccuaucagaacaaaguuguccgcgugcagcgccccgccaagaacgggacggugauggaugucaucagccggcgcgaccagcggggcuccggccagguggggacguacggccugaacaccuucaccaacauggaagugcaguuaauccgccagauggagagcgaggggauauuccugcccuccgagcuggagacuccgaaccucgcggaacggguccuggacuggcuggaaaagcacggcgccgagcgcuuaaagcggauggcgaucagcggggacgacuguguagugaagcccaucgacgaccgauucgcuacggcccuuacggcgcugaacgacaugggcaaagugcggaaggacaucccccagugggagcccaguaagggcuggaacgacuggcagcaggucccguucugcagccaccacuuccaucaacucaucaugaaggacggacgcgagauugugguaccauguaggaaucaggacgagcuaguuggccgcgcccgggugucacagggggccggcuggagccugagggagaccgccugcuuggggaagucauacgcccagauguggcagcugauguacuuccaucggcgcgaccuacggcucgcugccaacgccaucugcuccgccguccccgucgacuggguacccaccucacgcaccacguggagcauccacgcgcaccaccaauggaugacaaccgaggauaugcugagcguguggaaccggguguggaucgaggagaacccauggauggaggacaagacacacguguccucaugggaggaggucccuuaccugggcaagcgcgaggaccaguggugcggcuccuuaaucggacugacggcccgcgccaccugggcuaccaacauccagguagcgaucaaccaggugcgacgccugaucggcaacgagaacuaucucgacuacaugaccagcaugaaacgguucaaaaacgagagcgacccagagggagcgcugugguaa

SEQ ID NO: 24051 - RNA, 9879 nt, Artificial Sequence
  derived and/or modified CDS sequence (opt11) from DENV-1__FJ810415__SS-prME
aguguuacuaugcuucucauguuauuacccaccgccuuagcuuuccaccugacuacucguggcggggagccucacaugauuguaagcaagcaagagcggggcaagagccuccuauuuaagaccuccgcaggggugaacaugugcacccugauugccauggaccuaggggagcucugcgaggacaccaugaccuacaagugccccaggaucacagaggccgagcccgacgaugucgacugcugguguaacgccaccgacaccugggugaccuacgggacaugcucgcaaacgggugagcaccgucgagaaaagcgguccguugcccuggcgccucacgugggccugggacuagagacucgcaccgagaccuggaugagcucugagggcgcuuggaagcagauccagcgggucgagaccugggcucugcgccauccagguuuuacgguuauagccuucuuucuggcucacgccaucggcaccagcaucacccaaaagggggucaucuuuauccuccugaugcugguuacaccguccauggccaugcggugcguuggcaucggcaaucgcgacuuuguggaggggcuuagcggcgccacgugggucgacguugugcuggagcacggguccugcgugacuacuauggccaagaacaagcccacccuggauaucgagcuccugaaaacggaagugacuaaccccgcggugcugcggaaacuauguauagaagccaaaauuuccaauaccacuaccgacucccgcugcccgacccagggcgaggcgaccuuggucgaggaacaagacgccaacuucgugugccggcgcaccuucguggaccgcggcugggggaacggcugcgggcuguucgguaagggaagccucuuaacgugcgcaaaguucaagugcgucaccaaguuggaaggaaagauagugcaguacgagaaccucaaauauuccgugaucgucaccguucacaccggcgaccagcaccaggucgggaacgagacgaccgaacacggcacgaucgcgaccaucacgccccaagcccccacgagcgagauccagcuaacggauuauggggcucuaacccucgacugcagcccccggacgggccuggacuucaacgagaugguguugcuuacgaugaaagaaaaguccuggcuggugcacaagcagugguuuuuggaccuaccgcugcccuggacuucaggggccucuaccagccaagaaaccuggaacagacaggacuugcuugucaccuucaaaacggcccaugcgaagaagcaggagguaguggucuuggguucccaggagggagcgaugcacaccgcacugacuggggcuacggagauccagaccucgggcaccaccaccauauuugccgggcaccuaaagugucgccugaaaauggacaagcugacccucaaaggcauguccuacgugaugugcaccgggucauucaaacuggagaaggaaguggcggagacucagcauggaacuguccugguacaggugaaauaugagggcaccgaugcccccugcaagauuccuuucuccacccaagacgagaagggcgucacccagaacgggcggcuuaucacugccaacccaaucgugaccgacaaggagaagcccgugaauaucgagaccgagccgcccuucggggagagcuacaucguaguuggugccggcgagaaggcgcucaaacugaacugguucaagcgaggguccagcaucggcaagauguucgaagccacugcccgcggagcgcgccgcauggccauccugggagacacggcgugggacuucggguccaucggcgguguguucaccucagucgggaaacuugugcaucaggucuucgguaccgccuacggggugcuauucuccggcgugucuuggaccaugaagaucgguaucggcauccugcucacguggcugggccugaacagucggucgaccucacucagcaugaccugcauagcuguggggauggucacccucuacuugggcguuaugguccaggccgacuccgggugcgucaucaacuggaagggccgcgagcuaaagugcgggagcggcaucuucgugacgaacgaggugcacaccuggaccgagcaguacaaguuccaggccgacaguccgaaaagacugagcgcggccauugguaaggccugggaggaaggggucugcggaauaaggagugccacccggcuggagaauaucauguggaagcagauaagcaacgaguuaaaccacauccugcuggagaacgacaugaaauucacggugguggucggugaugccaacgguauccucgcgcagggcaagaagaugauccgaccccaacccauggagcauaaguacuccuggaaguccuggggcaaggcaaagauuaucggggccgacauccagaacacgaccuucaucaucgacgggcccgacacacccgagugcccagacggccagcgggccuggaacauuugggagguggaggacuacggguucggcguguucacgacuaacaucuggcugaagcugcgcgacagcuauacacaaaugugcgaccaccggcucauguccgcggcgaucaaggacagcaaggccguccacgcggacaugggguauuggaucgaguccgagaagaacgaaacauggaagcucgcccgcgcgagcuucaucgaggugaagacgugcacuuggcccaaaucccacacccuauggagcaacggggugcucgaauccgagaugaucaucccuaagaucuacggagggccgaucagccagcacaacuacagaccgggcuacuuuacccagaccgccgggcccuggcacuuagggaagcuggagcucgauuucgaccucugugagggcacuaccgucgugguggacgagcacugcgggaaccgcggaccgucccugaggacuacaacugugaccgggaagaucauccacgaaugguguugccgcagcugcacccuaccaccccugcgguuccgcggagaggacgggugcugguacggaauggagauucggccugugaaggagaaggaggagaaccuggugcgcuccauggucagugccggcucaggggagguggacuccuucagcuuaggcauccuuugcguguccaucaugauugaggaaguuaugcgcagccgcugguccagaaaaaugcugaugacggggacgcucgcggucuucuuacuacucaucauggggcaguugaccuggaacgaccugaucagacucugcaucauggucggggccaacgcgagcgaccgcaugggcaugggcacgacuuaccuggcucugauggcuacguucaagaugcguccgauguucgccgucgggcuccuuuuccgccggcuaaccuccagggaggugcuucugcugaccauaggcuugagccucgucgcuucuguggaguugcccaacagucuugaggaacugggggauggccuggcgaugggaaucaugaugcucaaauuacuaaccgaguuccagccgcaccagcuauggacgacuuuguuaucgcucaccuuugugaaaacuacgcugagccuggacuacgccuggaagaccaccgcgaugguccucuccaucgugagccuguucccucugugccucuccaccacgagccagaaaaccacguggcugcccgugcugcucggguccuucgguugcaagccccugaccauguuccugauaaccgagaacaaaauaugggggcgcaaguccuggccccugaaugagggcauaauggccaucgggaucguuuccaucuuguuaagcucccuccucaagaacgacgucccguuagccgggccguugaucgccggcgggaugcuaaucgcgugcuauguuaucuccggcucguccgcugaccuuucacucgagaaggccgcagaggucuccugggagcaggaagccgaacacagcggggcaucccacaacauccugguggaggugcaggacgacgggaccaugaaaaucaaagacgaggagcgcgacgacacucugaccauucuccuaaaggccacccugcucgcggucagcgguguguaccccauguccaucccagcgacgcuguucgugugguacuucuggcagaaaaagaagcagcggagcggcguccugugggacacuccguccccacccgaaguggaaagggcagugcucgacgauggaaucuaccguaucuuacagcgagggcugcugggacggagccaagucgggguggggguguuucaggacggggucuuccacaccauguggcacgugacccgaggcgccgugcucauguaccaggggaagcggcuggagccguccugggcaagcgucaagaaggaccugauuuccuacgggggcggguggcgauuccagggcucauggaacacuggggaagagguccaggugauagccgucgaacccggcaagaacccgaagaacgugcagaccacccccggcaccuucaaaacgcccgagggggaggugggcgcaauugcucucgacuucaagccagggaccuccggcagcccgauagucaaccgggagggcaagaucgugggguuauacggcaacggugucguuaccaccuccggcacuuacgugagcgccaucgcccaggccaaggcgucccaagaggguccgcugcccgagaucgaggacgagguuuuuaagaagcgaaaccuuaccauaauggaucugcacccgggcuccggcaagacccggcgcuaccugcccgcgauuguccgggaggccauaaagcgcaaacuacgcacccugauacuggcgccgacucgggugguugcgagcgagauggcagaggcgcucaaggggaugccaauccgcuaccagaccaccgccgucaaguccgagcacaccggccgggagaucguggaccugaugugccaugccacguuuacuaugcgacugcucaguccggugcggguccccaacuacaacaugaucauuauggaugaagcgcacuucaccgaccccgcaaguaucgcagcccgaggguacauuagcacccgggugggcaugggggaggccgcagccaucuuuaugacagccacgccgcccggcucugucgaagcauucccccaaucgaacgccgucauacaggaugaggagcgcgauauucccgagcgguccuggaauaguggcuacgacuggaucacggacuuccccgguaagacgguaugguucguucccuccaucaagaguggcaacgacauugcgaauugcuuacgcaagaacggcaagcgggucauccagcugucucgcaagacguucgacacggaguaccagaagaccaagaacaacgacugggacuauguggugaccacggauaucucugagaugggcgccaacuuccgggccgacagggucauugauccccggcgcugccucaagcccguuauccugaaggacgggcccgagcgggucauacuggccggcccgaugccggucaccguggcguccgccgcccagcgcaggggccgcaucgggcgcaaccagaacaaggagggugaccaguacgucuauaugggccagccccucaacaaugacgaggaccacgcccacuggaccgaggccaagaugcugcuggacaacauuaacacucccgagggcaucaucccagcccucuuugagcccgagcgggaaaaguccgccgcaaucgacggggaguaccgacugcggggcgaggcccgcaagacguucguggagcugaugcggcgcggcgaccuccccguguggcugucguauaaggucgccagcgaaggauuccaguacucagaccggcgauggugcuucgacggcgagcggaacaaccaggugcuggaggagaauauggacguagagaucuggaccaaggagggggagcgcaaaaagcucaggccgagguggcucgacgcgagaaccuacuccgacccccuggccuuacgcgaguucaaagaguucgcagcuggccggcgcucagucagcggcgaccugaucuuggaaauuggaaagcucccacagcaccugacccuacgggcccaaaaugcgcucgauaaccuugucauguugcacaacagcgagcagggcgggaaagcguaucgccacgcaauggaggaauuacccgacaccaucgagacgcugaugcuccucgccuuaaucgcgguucugaccggaggggucacccucuucuuucuguccggcaagggccuggguaagacgucuauuggccuucugugugugaccgcaagcagcgcccugcucuggauggcuuccguugaaccccacuggaucgccgcaagcauuauccuggaguucuuccugauggugcuacugaucccggagcccgaucggcaacgcaccccucaggacaaccagcuggccuacgugguuaucgggcuccuguucaugauacugaccgucgccgccaacgagaugggccuccuggagaccacgaagaaggaucuggggaucggcuacguggccgcggagaaccaccagcacgcaaccaugcuagacguggaccugcacccagcguccgccuggacccuguacgccgucgcgacuacggugauaacccccaugaugcggcacaccaucgagaacaccacggccaauaucagccugacggccaucgccaaccaggccgcgauccugaugggccuggacaaaggguggcccaucuccaaaauggacaucggagugccccucuuggcccuggggugcuacagucaaguaaacccgcucacccugacugccgcuguccugaugcucguggcgcacuaugccaucaucggccccgggcugcaggccaaggcaacgcgcgaggcccagaagcgcaccgcggcuggcaucaugaagaaccccacggucgauggcaucguggccaucgaccuagauccuguggucuaugacgccaaguucgagaagcaacuugggcagaucaugcugcucauccucugcacuucccagauacugcucaugcggacgacgugggcacugugcgagagcaucacacuggcgacaggcccgcuaacgacgcucugggagggcuccccugguaaguucuggaacaccaccauagccguaagcauggcaaacaucuuccgcggcuccuaucuggcaggggccggacuggcuuuuagccuuaugaagucccucgggggcgggcggcgcggcacgggcgcacagggggagacccugggagagaaauggaagcggcagcucaaccagcuaagcaaguccgaguucaauaccuacaaacgcagcggcaucauggagguggaccggucagaggcuaaggagggccugaagcguggggaaaccaccaagcacgccgucuccaggggcaccgcgaaacuucgcugguucgucgaacggaaccuggugaagcccgaaggcaaggucaucgaccuggggugcggccgagggggcuggagcuacuacugugccgggcugaagaagguaaccgaggugaagggcuacaccaagggcgggcccggccacgaagaaccgauccccauggcgaccuacgguuggaaucucguaaagcugcacuccggcaaggacguguucuucaugccuccugaaaagugugacacgcuguugugcgacaucggggagaguuccccaaaucccaccaucgaagagggccggacucuccgcgugcugaagauggucgagcccuggcuucgggggaaccaguucugcauaaagauccuaaaccccuacaugccgagcgugguggagacccuggagcaaaugcagcgcaagcacgggggcaugcucguccggaacccccucucccgcaacagcacgcacgagauguacugggugucaugcgggaccggcaauaucgugagcgcugugaacaugaccucgcggaugcuacucaaucgcuucaccauggcccaccgcaagccuacguacgagcgggacguggaccucggggcggggacacgccacguagcugucgaacccgagguggccaaucuggacaucauuggccagcggaucgaaaacaucaagaaugagcacaagaguaccuggcauuacgacgaagauaauccguacaagaccugggccuaccacgguucuuacgaggucaagcccucuggcuccgcaucaucuaugguaaacgggguggucagacuccugacaaagccaugggaugugauccccauggucacccagaucgcaaugaccgacaccacaccguucggacagcagcgcguuuucaaagagaagguggacacccgcacgccccgagcuaagcgcggaaccacgcagaucauggaggugaccgccaaguggcucuggggguuccuuagccgcaauaaaaagccccgcaucugcacgcgggaggaguucacccgcaaggucaggucgaaugccgccaucggugcgguguucguggacgaaaaccaguggaacagcgccaaggaggccgucgaggaugaaagguucugggaccuggugcaccgggagcgugagcugcauaagcaggggaaaugcgcgacguguguguacaacaugaugggcaaacgugagaagaagcucggggaguuuggcaaggcgaaaggcucaagggccaucugguacauguggcugggggcccgguuccuggaguucgaagcccugggcuucaugaaugaggaucacugguucucccgcgagaacagucuguccggggucgagggcgaagggcugcauaagcugggcuacauucugcgggacaucagcaagaucccaggagggaacauguaugccgacgacaccgcgggcugggacacccggaucaccgaggacgaccuccagaaugaggccaaaaucacggauaucauggagcccgagcacgccuuacuggccacuuccauuuuuaagcugacuuaccagaacaaaguggugaggguccaaaggcccgccaagaaugguacugugauggacgucaucagccgcagagaccagcgcggcuccggccaggucggcacguauggacucaauaccuucaccaacauggaggugcaacugauacggcagauggagagugaggggaucuuccuucccuccgagcuggaaaccccgaaccuggcggagcgcgcccuggacuggcuggagaaacacggggccgagcgacugaagcgcauggcaauaagcggugaugauugcguagucaagcccauugacgacagauuugccacggcgcuuaccgcccucaacgacauggggaaggugcgcaaagacaucccacaaugggagcccuccaagggcuggaaugacuggcaacaggucccguucugcagccaccauuuccaccagcuuauuaugaaggacggcagggagaucgucguacccugccgcaaccaggacgaguuggugggacgggcccgcgucagccaaggggccgguuggagccuccgggagaccgcgugcuuaggcaaguccuacgcgcagauguggcagcuaauguacuuccaccgccgggacuugcgccuggcagccaacgccaucuguagcgcgguccccguugacuggguccccacuagccguaccacguggagcauacacgcccaccaccaguggaugaccaccgaagauaugcugucgguauggaaucgcgucuggauagaagagaacccguggauggaggauaaaacccacgucuccagcugggaggaggugcccuaccucgguaaacgugaggaccagugguguggcagucugauuggccugacggcccgggccaccugggccaccaacauccagguggcgauaaaucaggugcgccggcucaucggcaaugagaacuaccuggauuacaugacuuccaugaaacgcuucaaaaacgagucggaccccgagggggcccugugguga

SEQ ID NO: 24052 - RNA, 9879 nt, Artificial Sequence
  derived and/or modified CDS sequence (opt11) from DENV-1__FJ639814__SS-prME
agcgugacgaugcugcucauguugcugcccaccgcccucgccuuccaccucaccacaaggggcggggagccccauaugauugugagcaaacaggagagagguaagagcuugcuguucaagacaucagcgggggugaauaugugcacccucaucgccauggaucugggcgagcucugcgaggacacgaugacguauaagugcccccgcaucacugaagccgaaccagacgacguggauuguuggugcaacgcuaccgacacgugggugacuuaugguacgugcagccagaccggugagcaccguagggagaaaagguccguggcccuggcaccccacgugggccuggggcucgagacccgcaccgagaccuggaugagcuccgagggcgccuggaagcaaauucagagaguggagacgugggcccugcgccaucccggguucacggugaucgccuucuuccuggcacacgccaucggcaccagcaucacccagaaggggauaaucuucauccuccugaugcuggucacccccuccauggcuaugcggugcgucgggaucgggaaccgcgacuucguugagggguugagcggugccacauggguggaugucgugcucgaacacggguccugcguaacgaccauggcuaagaacaagcccacccuggacaucgaguuacuaaagacggaagugacaaaccccgcggugcugcggaagcuaugcaucgaagcuaagauaucuaacacuaccacugauucccgcuguccgacccagggggaagccacccugguagaggagcaagacgccaacuucgucugcagacgaaccuucguggaccggggcuggggaaaugguugcgggcuguucgguaaagggagucuccugaccugugcuaaguucaagugcgucaccaagcucgaggggaagauuguacaguacgagaaccucaaguacagcgucaucgugacaguacauacuggcgaccaacaccagguagguaacgagaccaccgagcacggcaccaucgcaaccaucacaccccaggcgcccacguccgagauccagcucaccgacuacggagcccugacacucgacugcagcccccggaccggccuggacuuuaacgagauggucuuguugacaaugaaggagaaguccugguuggugcauaagcagugguucuuggaccucccgcugccguggaccuccggggccucuacaucucaggagacauggaaccggcaagaccugcucgugacuuuuaagaccgcccacgccaagaaacaggaggucguuguccugggcucccaggagggcgccaugcacaccgcccugaccggggccacggaaauacagaccagcggcaccaccacgaucuucgccgggcaccucaaaugucgcuugaaaauggacaagcugacgcucaaagggauguccuauguaauguguaccggcagcuuuaagcuggagaaagaaguagcugagacccaacacggcaccgugcugguacaggugaaguacgaggguacugacgcaccgugcaaaauccccuucaguacccaggaugagaagggggugacccaaaauggucgccugaucacagccaacccgaucguaacggacaaggagaagcccguuaacaucgaaacugagccacccuucggggagagcuacauuguggucggcgccggagagaaggcacucaaguuguccugguucaaaagggggagcuccauuggcaagauguuugaggccaccgcucgcggggcaagacgcauggcaauccugggcgacacagcgugggauuucgggagcauuggcggcgucuucacuuccgugggcaagcucguccaccaagucuucgggacugccuacgggguacucuucagcggcgucuccuggaccaugaagaucggcaucggcauccuccugacguggcucggcuugaauagccgguccaccucgcucagcaugacuugcaucgccguggggaugguuacacuguaccugggcgucaugguacaagccgacagcggcugcgugauaaauuggaagggccgcgaacucaagugcgggucaggcaucuuuguuacuaacgaagugcacacauggaccgagcaguacaaguuucaggccgacagcccgaagcggcugagcgccgccaucggcaaggccugggaggagggcgucugcggaauccgcuccgccacccggcuggagaacauuauguggaaacaaauuucgaaugagcuaaaucacauccuucuagaaaacgacaugaaguucaccgucgugguuggggacgccaacggcauccuggcacaggggaagaagaugauccgcccccagccaauggagcacaaguacucuuggaaguccuggggaaaggccaagauuaucggcgccgacauucagaauaccaccuucaucaucgacgggccggacacgcccgagugccccgauggccagcgggcuuggaacauaugggaagucgaggacuacggguuugguguguucacgacgaacaucuggcugaaacugcgcgacagcuacacccaaaugugcgaucaccggcuaaugucagcggcgauaaaggacucaaaggccgugcacgccgacaugggcuacuggaucgagagcgagaagaacgagacuuggaagcuggcccgcgccuccuucaucgaggucaagaccugcacguggcccaagagccacacccugugguccaacggggugcuugagagcgagaugaucauaccgaagaucuacggcggaccgaucucccagcacaacuaccggcccgguuacuucacccagaccgcugggcccuggcaucugggcaagcuggaacuagacuucaaccugugcgagggcacuaccguugucguagacgaacauugcgggaaucgcggcccuagccuacguaccacgacggugaccgggaagauaauccaugaguggugcugucgcucuugcacgcugccgccacugcgguuccgcggcgaggacgggugcugguacggcauggagauccgacccgucaaggagaaagaagagaaccuggugagaagcaugguguccgccggcucaggggaggucgacaguuucagccuuggcauucucugcgugagcaucaugauagaggaagucaugcggucgagguggagccgcaaaauguugaugaccgggacgcucgccguauuucugcugcucaucaugggccaguuaacguggaacgaccugauccggcucugcaucauggugggggccaacgccagcgaucgcaugggcaugggaacgaccuaucuggcccugauggccacguucaagaugcgaccgauguucgcgguggggcuccuguuccggaggcucaccagccgagaggugcuccugcugacaaucggcuugucccugguugccucaguugaacugcccaacucccucgaagaacugggagacggcuuagcgauggguaucaugaugcucaaacuucugacagaguuccaaccgcaccagcucuggacgacgcuacuuucacucaccuucgugaagaccacgcugucccuggacuacgccuggaagaccacggccauggugcucagcaucgucucccuguuccccuugugccucucuacgacgucccagaagaccaccuggcugccagugcugcucgggagcuuugguuguaagccccuuaccauguuucugaucaccgagaacaagauuuggggcagaaagucuuggccccugaacgagggcauuauggccaucggcaucguuagcauacuccuguccucgcuccugaagaacgacgucccccuggcuggaccgcucaucgccggcgggauguuaaucgcgugcuaugugaucagcgguaguagcgcugaccuguccuuggagaaggccgcggaggugagcugggaacaggaagccgagcacuccggggccagucauaacauucuggucgagguccaggacgacgguacgaugaagaucaaagacgaggagcgcgacgacacccugaccauucucuuaaaggccacuuugcucgccguguccggggucuaccccaugagcauccccgcgacccuguucgugugguacuucuggcagaagaaaaagcagcgauccggcguacucugggacacccccaguccucccgaagucgagagagcagugcucgacgacggcaucuaucggauccugcagcgcgggcuguuaggccguucccagguuggggucggcguauuucaggacgggguguuccacaccauguggcacguuacccgcggcgcgguguugauguaccagggcaagagacuggagcccucaugggccucagugaagaaagaccugauuucguacgggggagguuggcgguuucagggcuccuggaacacgggggaggaaguccaaguaaucgccguggaacccggcaagaacccgaagaacguccagacaacacccgguacguucaagacgcccgagggggaaguuggcgcuauugcccucgacuuuaaaccagggaccucuggcucaccgaucgugaaccgggagggcaaaaucgucgggcuguacggcaacgggguaguaacuacaucaggcacguaugucuccgccauagcccaagccaaggcgagccaggaggggccucugcccgagaucgaggacgagguguucaagaagcggaaccuuaccaucauggauuuacauccgggaagcggcaagacccggcguuaccuacccgccauugugcgagaagccauaaagcgcaaacuccgcacccugauacuggcccccacgcgcgucguggcguccgagauggccgaagcccucaagggaaugcccauccgcuaucaaaccaccgccgucaagucggaacauaccggccgugagaucgucgaccugaugugccacgccacguuuacgaugcgucugcucuccccggugcgugugccgaacuacaacaugaucaucauggacgaggcgcauuuuaccgacccugccaguaucgccgcccgcggcuacauauccacccgggucgggaugggagaggccgcugccauauucaugacggccacgccgcccggaagcguggaagcauuuccucaguccaacgccgugauccaggaugaggagcgcgacauccccgagcguagcuggaacuccggauacgacuggauaacggacuuccccgggaagaccgucugguuugucccuagcaucaagucuggcaaugacaucgcgaacugucugcgcaagaacgggaagagggugauucagcugucgcgcaagacguucgacaccgaguaucagaagaccaagaacaacgacugggacuaugucgucaccacggacauuucugagaugggggccaauuuccgggcugauagagugauagacccgcggcggugccucaagcccguuauccugaaggacgggcccgaacgugugauucuggcaggcccgaugcccgugacggucgcuucagccgcgcagcgcagaggccggaucggucgaaaccagaacaaggagggagaccaguauguguacaugggccaaccccucaacaacgacgaggaccacgcucacuggaccgaggcuaagaugcugcuggacaacaucaacacucccgagggcauuaucccggccuuauucgagcccgagcgggaaaaguccgcagccauagacggggaauacagacugaggggcgaagccaggaagacguucgucgaacugaugcggcgcggcgaccuucccguaugguuauccuacaagguggccuccgaaggguuccaguacagcgaccggagauggugcuucgacggcgagcggaacaaccagguccuggaggagaacauggacguggagaucuggacgaaggagggggaacguaagaagcuccgaccccgcuggcuggacgcgcggaccuauagcgacccucuggcacuccgcgaguucaaggaguucgccgccgggcgucgaagcgugucaggggaccugauucuggagauugggaagcucccccagcacuugacccugcgggcccagaacgcgcucgacaaccuugucauguuacauaacucggagcagggcggcaaggccuaccggcacgccauggaggaguuacccgacacaaucgagacgcugauguuguuagcccugaucgcggugcugacaggaggggugacacucuucuuccucucgggcaagggccucgggaagaccucaauuggccuacugugcgucacggcgagcuccgcccugcucuggauggcgagcguggaaccccacuggaucgccgcguccaucauccuggaguuuuuccuuauggugcuucuuaucccggaacccgacaggcaacgcacgccccaggacaaucagcuggccuaugucguuauugggcucuuguucaugauacugaccguggccgccaacgagaugggacuccuggagaccacgaagaaggaccuggguaucggguaugucgccgcugagaaucaccagcaugcaaccaugcuugacguagaucugcaccccgcauccgcauggacccucuacgcaguagcgacaacagucaucacucccaugaugaggcauaccaucgagaauaccacggcgaacaucucucucaccgccauagccaaccaggccgcgauccugaugggccuagacaagggguggcccaucagcaagauggauauaggcgugccacuccuggcucuggguugcuacucccagguuaacccgcugacccugaccgccgccguccugaugcucguggcucacuacgccaucaucggccccggacuucaggccaaggccacgcgugaggcccagaaacgaaccgcggccggcauaaugaaaaacccaaccguggacggcauugucgcgauagaccuggacccagucguguacgacgccaaguuugaaaagcaguuagggcagauaaugcuccuuauccucugcaccagccagauucugcugaugcggacuaccugggcccucugcgaauccaucacccuugcuaccggcccgcuuacgacucucugggaggggagccccggcaaauucuggaacaccaccaucgcugucucaauggccaauaucuuccgcggcaguuaccuugccggggcugggcuggcauuuucgcucaugaagucccuagggggagggcggcgcgggacgggugcccaaggcgagacccugggcgagaaguggaaacggcagcucaaccagcugagcaagagcgaguuuaacacguacaaaaggagcgggauaauggagguugaccggucugaggccaaggaagguuugaagcgcggggagacaacuaagcacgcaguaagcagaggcaccgcaaagcuccgaugguuugucgagcgaaaccuagucaagcccgagggcaaggugauugaccuggggugcgggcgcgggggcugguccuacuacugcgccgggcugaaaaagguaaccgaggugaagggguacaccaaagguggacccggccacgaggaaccuauccccauggccaccuacggguggaaccucgugaaacuucacagugguaaggacgucuucuuuaugccgccggaaaaaugcgacacgcuccucugcgacauaggggaguccucgccgaacccgacaaucgaggaggggcggacccugagaguacugaagaugguggaacccuggcuacggggaaaccaguucugcauaaagaucuuaaaccccuauaugccguccgucguggagacccuggagcagaugcagagaaagcacgggggcaugcucguaagaaacccccucucacgcaauuccacacaugagauguacuggguaagcugugggacuggcaauaucguguccgccgugaacaugaccagccggaugcuacucaaucgcuucaccauggcccaccgcaagcccacguacgaacgggacgucgaccuaggcgccgggacccgccauguggcugucgagccagaggucgccaaucuagauauuaucggccaacguauagagaauaucaagaacgagcacaagucuaccuggcacuaugacgaggacaaccccuauaaaaccugggccuaccacgggagcuacgaagucaagcccuccgggucugcaaguucuauggucaacgggguggugagauuacugacgaaacccugggauguuauccccauggugacccagaucgccaugaccgacaccaccccguucggacagcaacggguguucaaggagaaagucgacaccaggacuccccgggccaagcgcgggaccacgcagaucauggaggugacagccaaauggcuguggggguuccucucccggaauaagaaaccacgcauuugcacccgggaggaguuuacccggaagguacggagcaacgcugccauaggugcggucuucguggaugaaaaccaauggaacucagccaaggaggccguugaggacgagcgcuucugggaccugguccacagagagcgugagcuucacaaacaagggaagugcgccacaugcguguacaacaugaugggcaagcgggagaagaagcucggggaguucggcaaggcgaagggcucccgugccaucugguacauguggcugggugcccgguuuuuggaauuugaagcguugggcuucaugaacgaggaccacugguuuagccgagaaaacucccucagcgggguggagggggagggguugcacaaauugggguacauacugcgggacaucuccaagauaccgggugggaacauguacgcugacgacaccgcgggaugggauaccagaaucacugaggacgaccugcaaaaugaggcaaagaucacggacaucauggagcccgagcaugcucugcuggcaaccagcaucuucaagcugaccuaccagaacaagguugugcgggugcagcguccugcaaagaacgggaccgucauggacgugaucagcaggcgggaccagcgcgguaguggacagguggggacguauggccucaacaccuucaccaacauggagguccagcucauccggcagauggaguccgaggggaucuuccugcccagcgaacucgagaccccgaaccuggcggagcgcgcccuugauugguuagagaagcacggcgccgagcggcugaagagaauggcuaucuccggugaugacugcguugucaaaccuauagacgaucgguucgcgacagcgcugacggcucuaaacgacauggggaagguccgcaaggauaucccccagugggagcccagcaagggcuggaacgauuggcaacaggugccguuuugcucccaucacuuccaccagcugaucaugaaagacgggcgggagaucgucguccccugccgcaaccaagacgagcugguggggcgcgcacgcguaucgcaaggggccggcuggucccuccgggagacugccugccuggguaaguccuacgcccaaauguggcagcugauguauuuccaccgcagggaccuccgccuggccgcuaacgccaucugcuccgcggugcccguggacugggugcccaccucccggaccacguggagcauccacgcucaucaccaguggaugacgaccgaggacaugcuguccgucuggaaucgcguauggaucgaggagaauccguggauggaagacaagacccacgucagcuccugggaggagguucccuaccuaggcaagcgcgaggaucaguggugcggcagccuuauagggcuaacggcgcgggcaacuugggcgacuaacauccagguggcgaucaaccaggugcgccguuuaaucggcaacgagaacuaccuggacuacaugacauccaugaagcgcuucaagaacgagagcgaccccgagggcgcccucugguga

SEQ ID NO: 24053 - RNA, 9879 nt, Artificial Sequence
  derived and/or modified CDS sequence (opt11) from DENV-1__FJ639815__SS-prME
agcgugaccaugcugcucauguugcuccccaccgcccuggccuuccaucugacaacccgcggcggagagccccacaugaucgucagcaagcaggaacggggcaagagcuuacuguucaagacgagcgcgggggugaauaugugcacccucauagccauggacuugggagagcucugcgaggauaccaugaccuauaagugccccagaauuaccgaggccgaacccgaugauguggacugcugguguaacgccacggacacuugggucaccuacgggaccugcucucagaccggcgaacaccggcgcgagaagcgauccguagcucuggcuccucaugugggguuggggcucgaaacccgcaccgagacauggaugagcuccgagggugcuuggaagcagauccagcgggucgaaaccugggcccugcgccacccggguuuuacggugaucgccuucuuucuggcgcacgccaucggaaccagcaucacccagaaagguauaaucuucauucugcugaugcuggugacgcccuccauggccaugcggugcgugggcaucggcaaccgcgacuucguggaggggcucagcggcgccacguggguggacgucgugcuagaacauggguccugugucacgaccauggcgaaaaauaagcccacccuggacaucgaacuccugaaaacagaggucaccaaccccgcaguucugcggaagcucuguaucgaagcuaagaucagcaauaccaccacggacucccgcugcccgacccagggggaagccacccugguggaggagcaagaugccaacuuugugugucgacgcaccuucguggaccggggcugggggaacgggugcgggcuauucggaaaggggagccucuuaacaugugcuaaguucaagugcguuaccaagcuagaggggaaaaucguucaguacgagaaucucaaguacagcgugauagugaccguacacaccggcgaccaacaucagguggggaacgagacaaccgagcacgguaccaucgcgaccaucacgccccaggcccccacaucugagauccaacuuaccgauuacggggcccugacccucgacugcucgccccggaccggccuggauuucaacgagaugguccugcucacgaugaaggagaagucguggcuggugcacaagcagugguucuuggaccugccguuacccuggaccuccggggccucgaccagccaggagaccuggaacagacaagaccugcuugugacguucaaaaccgcccacgcgaagaaacaagaggugguggugcugggcucgcaggagggcgcuaugcacaccgcgcuaaccggggcgacggagauccagacgagcgggaccacuacgaucuucgccggacaccucaaaugccgccuaaaaauggacaagcugacucucaaggggauguccuacgucaugugcaccgggagcuucaagcuggagaaggaaguggcggaaacccagcacggcacagugcugguucagguuaaguacgaaggcaccgacgccccgugcaaaauacccuucuccacccaagacgagaagggggugacccaaaacggcagacugaucacggccaacccgauugucaccgacaaggagaagcccgugaacaucgagaccgagccucccuucggggaaucguacaucguggucggcgccggggagaaggcucucaaacuguccugguucaagcgcgggucauccaucgguaagauguuugaggccacugcacgcggggcccgccgcauggccaucuuaggcgacacggcgugggauuucgguagcauuggcgguguguucaccuccgucgguaagcucguacaucaggucuucggcaccgccuaugggguguuguucucuggcgucuccuggacuaugaaaaucgggaucggcauacuguuaacuuggcuggguuugaacucacgguccaccagccucuccaugaccugcaucgccgugggcaugguaacucuguaucugggcgucaugguccaggccgacagcgggugcguuaucaacuggaagggccgcgaacucaagugcggauccgguaucuucgugacgaacgaggugcacaccuggaccgagcaguacaaguuccaggccgacucgcccaagcggcucagcgcggcuauaggcaaggccugggaggaggguguuugcggcauccgcuccgccacccggcuggagaacaucauguggaagcagaucagcaaugaacucaaccacauccuucuggagaacgacaugaaguucaccgugguugugggagacgcuaacggaauccucgcccaagggaagaagaugauccgcccccagccgauggagcacaaguacuccuggaaguccuggggaaaggcuaagauuauuggcgccgacauacagaacaccaccuucauuaucgacggucccgacacaccagagugccccgacggccagcgggcauggaacaucugggaggucgaggacuacggguucgguguguucaccacgaacaucuggcugaagcugcgcgacuccuacacccagaugugcgaccaccgccucaugagugcggccauuaaggauucaaaggccguucacgcagacaugggcuacuggaucgaaagcgagaaaaacgagaccuggaagcuggcccgagcuuccuucaucgaggucaagacauguacguggcccaaaagccacacccugugguccaacggggugcucgaaagcgagaugaucauccccaagaucuacggcgggcccaucucccagcacaacuaccggcccggcuacuucacccagaccgcagggcccuggcacuuaggcaaacuggagcucgacuuugaccugugugagggaacaaccguugucguugacgaacacugugguaaccgugggccgucccugcggaccaccacggugaccgggaagaucauccacgaguggugcugccgcuccuguacacugccgccccuccgguuucgcggcgaggacgggugcugguacggcauggaaauccgacccgucaaagagaaggaggagaaccugguucgcucuaugguuuccgcaggcuccggggaggucgauaguuucucucucgggauccugugcgugagcaucaugaucgaagaggugaugcggagccgcuggagccgcaagaugcugaugacugggacguuagccgucuuccugcuucucaucaugggacaguuaaccuggaacgaccugauccggcucugcaucauggugggggcaaacgcuuccgaccgcaugggcauggggaccaccuaccuggcccugauggccacguucaagaugcggcccauguucgccguggggcuccuguuccgccgacuaaccagcagagagguccuccucuugaccauuggccucucccugguggccuccgucgagcuccccaacucucucgaggagcugggugacggacuggcaauggguaucaugaugcuuaaacugcugaccgaguuccaaccacaccagcucuggacaacccugcugagcuuaaccuucguuaagaccacgcuuucccuggauuacgcuuggaaaaccaccgccaugcuccucucaaucgugucacuguuuccacucugccugagcaccacaucccagaagacgacuuggcugccuguccuccugggcucuuucggcugcaagccccugacgauguuccucaucaccgagaacaagauuugggggcguaagaguuggccacugaaugagggaaucauggccauagggaucgugucgauccugcuuuccucucuacugaagaacgacgugccccucgccgggccgcugaucgccggagggauguugaucgcuugcuacguuaucagcggcagcagcgccgaccucucccuggaaaaggcugcggaggugucaugggagcaggaggcagagcacuccggggcgagccacaacaucuuaguugagguccaagacgacggcacgaugaaaaucaaggacgaagagcgggacgacacccucaccauccuucugaaggccacccuccuggccguguccgggguguauccuaugagcaucccagcgacgcuguucgugugguacuucuggcagaaaaagaagcagagauccggcguacuuugggauacgccuagcccgcccgagguggagcgcgccgucuuagacgacggcaucuaccggauccugcagcgcgggcuccuaggccgcucacaagugggggugggcgucuuccaggacgggguguuccacacgauguggcaugugacccggggugcuguuuugauguaccagggcaagaggcuggagccaucaugggcguccgugaagaaggaccucaucagcuacgggggcggguggcgcuuccagggcuccuggaacacgggugaggaggugcaggucauugccguggagccuggcaagaacccgaagaacgugcagacgacuccaggcaccuucaagacgcccgagggagaggucggcgcgaucgcccuggacuucaagcccggcaccagcggcucaccgaucgugaaccgggagggcaagaucguggggcuguacggcaacggggucgugacaaccuccggcacguacguguccgcaaucgcccaggcgaaggcgagccaagaggggccucuccccgagauugaggaugaggucuucaagaagcguaaccugaccaucauggaccuucaccccggcagcgguaagacccggagauaccuccccgccauuguuagagaagcuaucaagaggaagcugcgaacccugauccucgccccuacacgggugguagcuuccgagauggccgaagcgcugaagggaaugcccauaagguaccaaaccaccgccgucaagagcgagcacaccggccgggagaucguggaccugaugugccacgccacuuucacgaugcgccucuugucaccgguccgugugcccaacuacaacaugaucaucauggaugaagcgcacuuuacggaccccgcaagcaucgccgcccgcggguacaucuccacccggguggguaugggggaagccgcggcgaucuucaugacggccacgccgcccggcagcgucgaggccuucccccaguccaaugccgugauccaggacgaggagcgcgacauccccgaacggaguuggaacuccggcuacgacuggaucaccgacuuccccgggaagaccguuugguucgugcccuccaucaaguccgguaacgauaucgcgaauugccuacgcaagaacgggaagagggugauucaguugagccgcaagacguucgacacugaguaccagaagaccaagaacaaugacugggacuacguggucacuacggacauuuccgagaugggcgccaacuuccgggccgaccgcgugauugaccccagacgcugccugaagccugucauccugaaggacgggcccgaacgggucauauuagccggcccuaugcccguuaccguagcgagcgccgcgcaacgacggggacgcaucggacgcaaccagaacaaagagggcgaccaguacguguacauggggcagccuuuaaacaacgaugaggaccacgcccacuggaccgaggcuaagaugcugcucgacaacaucaauacccccgagggcaucaucccggcucuguucgagcccgagcgagagaaguccgccgccauugacggugaguaccgccugcggggcgaggcgcgcaagacuuucguggagcucaugcggcgcggugaccugcccgucugguuaagcuacaagguggccuccgagggguuccaguauagcgaccgccgcuggugcuucgauggcgagcggaacaaccaggugcucgaagagaacauggacgucgagaucuggaccaaggagggggagcgcaaaaaguugcggccccgcuggcuggacgcgcggaccuacuccgacccucucgcacuuagagaguucaaggaguucgcggccggccggcgcagcgugagcggcgaucugauccuagagauagggaaacugccacagcaccugacccuucgagcccagaaugcgcuagacaaccuggugaugcuccacaauucugaacaaggcgggaaagccuaccgccacgcaauggaggagcugcccgacaccaucgaaacgcuuaugcuucuggcauugaucgcgguccuuacaggcggggugacuuuauucuuccugucggguaaaggccucgggaagaccagcauaggccuucuaugcgugaccgccagcuccgcccuccuguggauggccuccguggagccgcauuggauugccgcgagcaucauccuggaguuuuuccucaugguccuacugaucccggagcccgaccggcagcgcacgccccaagacaaccagcucgccuauguaguuaucgggcugcuguucaugauuuuaaccguggccgccaaugagaugggccugcuugaaacgacgaagaaagaccucgggaucggcuauguggccgcggagaaucaccagcacgccaccaugcuggacgucgaccugcaccccgccagcgccuggacccucuacgcgguagcgaccacgguaaucacucccaugaugagacacacgauugagaacacgacagccaacauuucccugacagccaucgccaaucaggccgcgauccugaugggauuagacaagggguggcccaucucuaagauggacaucggagucccccugcuggcucucgggugcuacucgcagguuaauccgcucacccugaccgccgccguacucaugcuggucgcccacuacgccaucaucggccccgggcugcaggccaaggcgacgcgggaggcucaaaagcgcacagcggccggcaucaugaagaaccccaccguggacggcaucguggccaucgaccucgacccuguuguguacgacgcuaaguucgagaagcagcugggccagauaauguuacucauccuguguacaagccagauucuccucaugcggacaacuugggcccugugcgaguccaucacccuggcgaccggcccgcucacgacccugugggaggggagccccggcaaguucuggaauaccaccaucgccgucucaauggccaacaucuuccgcggcagcuaccuggccggggccgggcucgccuucucccuuaugaagagccucgggggcgggcgacgcgggacuggggcccagggggagacccucggcgagaaauggaagcggcagcugaaccagcuaaguaagucagaguucaacacuuacaagcgcagcgggaucauggaggucgaccgguccgaggcuaaggagggccucaagcgcggggagacgaccaagcacgccgugucacgggggacagcuaaguuacgcugguucguggagagaaaccugguaaagcccgagggcaagguaauugaccuggggugcggccgggggggcugguccuacuacugcgccgggcuuaagaagguaaccgaagucaaaggcuacaccaagggaggccccggacacgaggaaccgauccccauggccaccuacggcuggaaccuggugaagcuucauagcggcaaggacguguuuuucaugccgcccgagaagugcgacacgcuccugugugauaucggggaguccagcccgaauccgacuaucgaagaaggcagaacucugcgcguccucaaaaugguggagcccuggcugcggggaaaccaauucugcaucaaaauccugaaucccuacaugccgucgguggucgagacccuggagcagaugcaacgcaagcacggaggcaugcuagugcggaacccccugagccgcaacaguacgcacgagauguauuggguuagcuguggcaccggcaacaucguauccgcagugaacaugaccucgagaaugcuccuuaaucgcuucaccauggcccaccgcaaaccaacauaugagcgggacgucgaccugggcgcggggacucgccauguugcggucgagccugagguggccaaucucgacauuaucggccagcguaucgagaacauuaagaacgagcacaaguccaccuggcauuacgaugaagauaaccccuacaagaccugggccuaucauggcuccuaugaaguuaaacccucgggauccgccuccagcauggugaacgggguugugcgccugcugacgaagcccugggacgugaucccaauggucacccagaucgcgaugaccgacaccacaccguucgggcagcaacgcguuuucaaggaaaagguagacacccgcacgccgcgggcaaagaggggaacgacacaaaucauggaggugacugcuaaguggcuauggggguuccugucccggaacaagaaaccccgcauaugcacgcgggaggaguucacccgaaaggugcggagcaacgccgccaucggcgcuguuuucguagacgagaaccaguggaacagcgcuaaagaagccguugaggacgagcgcuucugggaccuggugcaccgggagcgcgaacuucacaagcaggggaaaugcgccacguguguuuacaacaugaugggcaaacgggagaagaagcugggcgaguucggaaaggcgaaggguucgcgcgccaucugguacauguggcugggggcccgguuccucgaauucgaggcccugggcuuuaugaaugaagaccacugguucagccgagagaacucccugucugggguggaaggugaagggcuccacaaauuaggauacauucugcgggacaucagcaagaucccuggcggaaacauguaugccgaugacacugcgggcugggacacgcguauaaccgaggacgaccugcagaaugaggccaagauaacggacaucauggagcccgaacacgcccuccuagccaccagcaucuucaagcucacguaccaaaacaaagugguccgcgugcagcggccugcgaagaacgguaccgugauggaugucaucagccgcagggaccagcggggaagcgggcaagucgggacguacgggcugaauaccuuuaccaacauggaaguacagcuaauuagacagauggagucagaggggauuuuccugcccucggaacuggagaccccuaaucucgcggagcgcgcccuagacuggcuggagaagcauggcgccgagcggcugaagcgcauggccauuuccggcgacgacugcguugugaagccaaucgacgaucgguuugccacagcccucaccgcccugaacgacaugggcaaggugcgcaaagauauuccccagugggagcccagcaagggcuggaacgacuggcagcaggucccguucugcucucaccacuuucaccagcugaucaugaaggauggucgggagaucguggugcccugccgcaaccaggacgagcucguaggccgggcgagggugucccagggggccggcuggucacuacgggagacggccugccucggcaagagcuacgcgcagauguggcaguuaauguacuuccacagacgcgaccugcgccuggccgccaacgccaucugcucggcggugcccguugacugggugcccacaagccggaccacguggagcauccacgcccaucaccaauggaugaccacugaagacaugcuuucaguguggaaccgcgucuggaucgaggaaaacccguggauggaggacaaaacccaugugagcagcugggaggagguacccuaccugggaaagagagaggaccaguggugcgggagccugaucgggcuaaccgcacgggccaccugggccaccaacauacaggucgcuaucaaccaagugcgccggcugaucggcaacgagaacuacuuggacuacaugaccuccaugaagcgcuucaagaaugagagcgaccccgagggugcccucugguga

SEQ ID NO: 24054 - RNA, 9879 nt, Artificial Sequence
  derived and/or modified CDS sequence (opt11) from DENV-1__FJ639818__SS-prME
agcgugacgauguugcucaugcugcugccaaccgccuuggccuuucaccugaccacucgcgguggggagccccacaugauagucucaaaacaggagaggggcaagagccugcuguuuaagaccucagcugggguuaacaugugcacacugauagccauggaccugggcgaacucugcgaggacaccaugaccuacaagugucccaggaucacugaggcugagccggacgacguggacugcuggugcaacaccaccgacaccuggguuaccuaugguaccugcucacagacgggcgaacaccgccgagacaaacggucuguggcccuggcgccccacgugggccuagggcucgagacccggaccgagaccuggaugagcucagagggcgcauggaagcagauucaacggguugagacgugggcccugcgccaccccggguucaccguaaucgcuuuguuccuggcccaugcgaucggcaccagcauuacacaaaaaggaaucaucuuuauacuccuuaugcucgugacgcccuccauggccaugcggugcguggggaucggcaaccgcgacuucguggaggggcugucgggagcaaccuggguggacguugugcuggagcacggguccugcgugacgaccauggccaaaaacaagcccacucuugacauagaacuguuaaagacggaggucaccaaccccgccgugcuccggaaguuguguaucgaggcgaagaucucaaacaccacgacagacucccgcugcccaacccaaggggaggccacccugguggaggagcaggaugccaacuucgucugccggcgcacguuuguggaccgggguugggggaacggcugcgguuuauucggcaaagggagccugcuaacgugugccaaguucaagugugugacuaagcucgagggcaagaucguccaguacgagaaccugaaguacuccgucaucguuaccguccauacgggcgaucaacaccagguggggaacgagaccaccgagcauggcaccauagcgaccaucacgccgcaggcucccacguccgagauccagcugacugacuacggggcacucaccuuagacugcucaccccggacggggcuggauuucaacgaaaugguccucuuaacuaugaaagaaaagucguggcuggugcacaagcaaugguuccucgaccugccgcugcccuggacaagcggggccagcacaagccaggagacuuggaaccgacaggaucuccugguuaccuucaagaccgcccaugcuaagaagcaggaggucguggugcuggguucccaggagggcgcgaugcacaccgccuugacgggcgccacggagauccagaccagcgggaccacaacuaucuucgcuggucaccuuaagugccgccugaagauggagaagcucacccucaaggguaugucauacgugauguguaccggaagcuucaagcuggaaaaggagguggccgaaacacagcacggcaccguucuggugcaggugaaauacgagggcaccgaugcgccuuguaaaauccccuucuccacacaggacgagaagggggugacgcagaacggccggcucaucacugccaaccccaucgucaccgauaaggagaagcccgugaacauagagaccgaaccgcccuucggggagagcuauaucguggucggggccggugagaaggcucuuaagcuguccugguucaagaaggggagcuccauuggcaagauguuugaggcgacagccagaggcgcucggcggauggccauccucggcgauacagccugggacuucgggagcauugguggcguguucaccuccguggggaagcugguccaccagguguuugguaccgcguacggcgugcuguuuagcggcgucuccuggacgaugaagaucgggaucggcauucucuuaaccugguuaggccuuaacagcaggucgacuagccugagcaugaccugcaucgccguggggauggugacguuauaccuuggcguuauggugcaggccgacagcggaugcgugaucaacuggaagggacgggaacugaagugcggcuccggcaucuucgucacuaacgagguucacaccuggaccgagcaguacaaguuucaggcagauagcccgaagcgccugagcgccgcgaucggaaaggcgugggaggagggggugugcggaauucgguccgcuacccgccucgaaaacaucauguggaaacaaauuucaaacgaauuaaaucacaucuuacucgagaacgacaugaaauucacggucgugguuggggacgccaauggaaucuuggcccaggggaagaaaaugauccggccccagcccauggagcauaaguacuccuggaaauccuggggcaaggcgaaaauaaucggcgccgacauccagaacaccacguucaucaucgacgggcccgacaccccggagugccccgacggccaacgcgccuggaacaucugggaggucgaggauuacggguuuggcauauucacgaccaauaucuggcuaaaacuccgggacuccuauacccaaaugugcgaccaccgcuugaugagcgccgcaaucaaggacucgaaggccgugcacgccgacauggguuacuggauagagucagagaagaacgagaccuggaagcuggcccgggccuccuucaucgaagugaagacgugcaccuggcccaagagccacacguuauggagcaauggaguccucgagagcgagaugaucauccccaaaaucuacggcgggccgaucucucagcacaauuacagacccggcuacuuuacccagacggcagggccguggcaccugggcaaacucgaacuggauuucgaccugugcgaaggcaccacggugguugucgacgagcacugugggaaccgaggcccgucucuccgcaccaccacugugaccgggaaaaucauccacgagugguguugucgguccugcacacucccuccccugcgcuuccggggcgaggacgggugcugguacggcauggagauccgccccgugaaagagaaggaggagaaccucguccggucgaugguuuccgccggcagcggggaaguggacagcuucucccugggcauucugugcguuagcaucaugaucgaggaggugaugcgcucccgguggagcaggaagaugcugaugacggggacucuggcgguguuccugcuucugaucaugggucagcugaccuggaacgaccugauucgucugugcauuaugguaggggcuaacgcuuccgaucggaugggcaugggcacuacacaccuugcauuaauggcgaccuucaagaugcgucccauguucgcuguggggcugcuguuucggcgccugacuagcagagaagugcuguugcucaccauugggcugagcuuagucgccucagucgaacuccccaacucccuagaagagcugggggacggucucgccaugggcaucaugaugcugaaacugcucacggaauuucagccccaccagcuguggaccacauuacucuccuuaaccuucgucaagacgacccugucgcucgacuaugccuggaaaaccaccgcgaugguguuaagcauagugucccuguucccccucugccugagcaccacgucccagaagacgaccuggcugccaguccuacuagggagcuucggcugcaaaccccugaccauguuccugaucacggagaacaagaucugggggagaaaguccuggccccuuaacgagggcaucauggcuauugggaucgucagcauacuguuguccagccuacugaagaacgacgucccccuggccggcccgcugaucgcgggcgguaugcugauagccuguuacgucaucagcggcuccagcgccgacuugucgcuggaaaaagcagcagaggugagcugggagcaggaagcggagcacuccggggcgagccacaacauccuuguggagguccaggacgauggcaccaugaagaucaaggacgaagaacgggacgacacacucaccauucugcugaaggccacgcuccuagccguguccgggguguauccaaugaguauuccggcaacccucuucgucugguauuucuggcagaagaaaaaacaacgcuccggcgugcucugggacacaccuagcccgcccgagguggagcgggccguacuggacgauggcaucuaccgcauccugcaacggggguugcucggacgcucacagguggguguaggcgucuuccaggacgggguguuucacacaauguggcacgugacgcggggcgcuguccuuauguaccagggcaaacgccuagaacccagcugggccagcgugaagaaggaucucaucagcuacgggggcggauggcgcuuucaaggcuccuggaacaccggggaggaggugcaggucauagccguggaaccuggcaagaacccgaagaacguucagaccacccccggcacguucaagacccccgaaggggaggucggcgccauagcguuagacuuuaagccgggaaccucuggcucucccaucgugaaccgagaggguaagauagucggccuauacggcaacggggucguaaccacgagcgggaccuacguguccgcaauagcccaggccaaagcuagccaagaagggccucuccccgagauugaggacgaagucuucaaaaagcggaaucugaccaucauggaccugcacccgggcucgggcaagacgcgccgguacuugcccgcgaucguacgugaagccaucaagcggaagcuuaggacucugauccuggcccccacacgcguagucgccuccgaaauggcggaggcacuaaaggguaugccuaucagguaccaaaccaccgccgucaagagcgaacauacgggccgcgaaaucguggaucugaugugccacgccacuuucaccaugcgauuacuuuccccgguacgcgugcccaacuauaacaugaucauuauggacgaggcccacuucacugaccccgcgagcaucgcggcccgaggguacauuuccacacgcgugggaaugggcgaggccgcugcgauauucaugaccgcuacgccgcccgguagcgucgaggccuuuccucaguccaaugccgugauccaggacgaggagcgagauauccccgagcgcagcuggaacucuggcuacgacuggaucaccgacuuccccgguaagacagucugguuuguaccgucgauuaagucuggcaacgacaucgccaauugccucagaaaaaacgguaagcgcguaauccagcucagccggaagacauucgacacagaguaccagaagacuaagaacaacgacugggauuauguggugaccaccgacauuuccgagaugggcgcuaauuuccgcgccgaccgggugaucgacccccgccggugccugaagcccgugauccuuaaagacgggcccgagcgcgucauucucgccgguccaaugcccgugaccguggccagcgcggcccagcggcgcggccggaucgggcgcaaucaaaacaaagaaggugaucaguacguguacauggggcagccgcugaacaacgacgaggaccacgcccacuggaccgaggccaaaauguugcucgacaacaucaauacgcccgaaggcaucaucccugcgcuguucgaaccggagcgggagaaguccgcggccaucgacggagaauaccgccuccgcggagaagcccggaaaaccuucguggagcugaugcgccggggcgaccugccagucuggcugucuuacaaaguggccucagaagguuuccaguacuccgaccgccgcuggugcuucgauggcgagcgcaacaaucaagugcuggaggagaauauggacguggagauuuggaccaaagagggggagcggaagaagcugcguccccgguggcuggaugccagaacguacucugacccccucgcguugcgggaauucaaggaguuugccgccggccgucguagcgugucaggcgaccugauacucgagaucgggaagcucccgcaacaccugacccuccgggcccagaacgcccuggauaacuuaguaauguugcacaacucagagcagggcgggaaggcguaccggcacgccauggaggagcugcccgacacgaucgagaccuuaaugcuccuggcucugauagcggugcucacaggcggugugacccucuucuuucuguccgggaaaggccuggggaagacauccaucggacugcuguguguaaccgccagcuccgccuugcuguggauggccagcgucgagccccauuggaucgcagccuccaucauccuggaguucuuucuuauggugcugcugaucccggaaccagaccgccagcggacgccucaggacaaucagcuagcguacgucgucauugggcuuuuauucaugauucucaccgucgcagccaacgagaugggcuugcucgagaccacaaagaaggaccucgggauaggcuacguggcugccgaaaaccaucagcacgcgaccaugcuggacgucgaucugcgcccugccagcgccuggacacucuacgccguggccacgacagucaucacccccaugaugcgucacaccaucgagaauacgacagcgaacaucagucugaccgccaucgcuaaccaggccgccauacuaaugggccucgacaagggguggcccaucagcaagauggacauuggugucccccugcuggcucucgggugcuacagucaggugaacccgcucacccugacggccgccguucucaugcugguugcccacuacgcgaucaucgggcccgggcugcaggccaaagcuacccgagaggcccaaaagcgcacagcugcgggcauaaugaagaaucccacaguggacggcauuguggccaucgaucucgaccccguuguguacgacgcaaaguucgagaaacagcuggggcagauuaugcuucucauacuaugcacgucacagauauuguuaaugagaaccaccugggcgcuuugcgaaucgaucacauuagccaccgggccccucaccacccugugggaaggcagccccggcaaauucuggaacaccacgaucgcggugaguauggcaaauaucuuccgcggcucauacuuagcgggagccggccuagcauucucccugaugaagucacucgggggcgggcggcgcggaaccggugcacagggggagacccuuggcgaaaaguggaagcggcagcugaaccagcucuccaagucagaguuuaacacguacaagcgaagcgggaucauggagguugaccgguccgaggccaaagaaggguugaagcgcggggagacgaccaagcacgccgugagcagggggaccgcgaagcugagaugguuuguggagcggaaccuggucaagccugagggaaaaguuaucgaccuggggugcggacggggaggcuggaguuacuacugcgcgggacuaaagaaagugacugaaguaaagggcuacaccaagggcggaccgggccacgaagagcccauccccauggccaccuacggguggaaccuggugaagcugcacagcgggaaggacguguucuuuaugccgcccgagaagugcgacacgcuguuaugcgacauaggggagucaucgcccaaccccaccaucgaggaaggacggacgcucagaguccugaagauggucgagccgugguugaagggcaaccaguuuugcaucaagauccuuaaucccuacaugccguccguugucgagacauuagagcagaugcagcgcaaacacgggggcaugcucguacgcaacccccugagccggaacuccacgcaugagauguacugggucuccugcggcacuggcaacaucguauccgccguaaacaugaccagccgcaugcuccugaaucgguucacgauggcccaccgcaaacccaccuacgaaagagacguggaccuuggcgccgggacacggcauguggcgguggagcccgaaguggccaaccucgacauaaucggccagcgaaucgagaauaucaagaacgagcauaaauccaccuggcacuaugacgaagacaauccguacaagacuugggcauaccacgggagcuacgaggucaagccguccggcucugccagcuccauggugaauggggucguacggcuguuaaccaagcccugggaugugauccccauggucacccagaucgccaugaccgacacgaccccuuuuggccaacaacgcguguucaaggagaaggucgacacccguacuccacgggcgaagcggggcacgacccagaucauggaagugaccgccaaauggcugugggguuuucucucccggaacaaaaagccccggaucugcacccgcgaagaguucacgcgcaaggugcggucaaacgccgcgaucggugcgguuuucgucgacgaaaaccaguggaacagcgcgaaggaggccguggaggaugagcgguucugggaccuggugcaccgggagcgggagcuccacaagcaaggaaagugugccaccugcgucuacaauaugaugggcaagcgcgaaaagaagcugggggaauucgggaaggcgaagggcucucgggcgaucugguauaugugguuaggcgcccgauucuuagaguucgaggcucugggcuucaugaacgaggaccacugguucagcagggagaauucccugagcgggguagagggagaagggcugcacaagcugggcuauauccugcgagacauaucaaagaucccgggcggaaacauguacgcggacgacaccgcaggcugggacacucggauaacggaagacgaccuccagaacgaagcgaaaaucaccgauaucauggagcccgaacacgcccugcuggccaccucaaucuuuaagcucaccuaccaaaacaaagugguacgcgugcagcgcccugccaagaauggcacggugauggaugucaucucacgucgcgaccagcggggaagcggccagguggguaccuaugggcugaacaccuucaccaacauggagguucagcugauacgccagauggagucagaggggaucuuucucccuagcgagcuggagacaccgaaccuggccgagcggguccucgacuggcuggagaagcacggcgcggagcgcuugaagagaauggccaucucgggggacgauugcgugguaaagccaaucgacgaccgcuucgccaccgcuuugacggccuuaaaugacaugggcaaagugcggaaggacaucccccagugggagcccagcaagggcuggaacgauuggcagcaaguccccuucugcucccaccacuuccaccaguugauuaugaaggacggccgagagaucgugguuccgugccggaaucaggaugaacuagucggccgggcccgggugagccagggggcaggauggucccugagggagaccgcaugucugggcaagagcuacgcacagauguggcagcugauguacuuccaucggcgcgaccuucgacucgcagcgaacgccaucugcucagcuguccccgucgacuggguucccacaagccgcaccaccuggagcauccacgcccaccaucaauggaugaccaccgaggauaugcuuuccgucuggaaccggguauggauugaggagaacccguggauggaggacaagacgcaugucagcagcugggaggaggucccuuaccugggaaagcgugaggaccaauggugcgggagccugaucggccuuacggccagggccacaugggccaccaacauccagguagccaucaaccaggugcgucgccuuaucggcaacgagaacuaccuagauuacaugacguccaugaagcgguucaagaacgaaagcgaccccgaaggcgcucucugguga

SEQ ID NO: 24055 - RNA, 9879 nt, Artificial Sequence
  derived and/or modified CDS sequence (opt11) from DENV-1__FJ639819__SS-prME
agcgugacaaugcugcuaauguuacugcccacugcccucgccuuccaccugaccacccggggcggugagccccacaugaucgugagcaaacaggagcgggggaagucccuccuguucaaaacuucugcgggggugaacaugugcacccugauugccauggaccuuggcgagcucugcgaggacaccaugacuuauaagugcccccgcauuaccgaggcggagccggaugacguggacugcuggugcaacgcgaccgacacuugggugaccuacgggaccugcagccagaccggcgaacaccggcgcgagaagcgguccguggccuuggcgccccauguuggccuggggcucgagacccgaacggagaccuggaugagcuccgagggcgccuggaagcagauccagcgggucgagacaugggcccugcgccaccccggguucacagugaucgcuuucuuccuggcgcacgccaucggcaccagcaucacacagaaggggaucaucuucauccuguuaaugcuagugacccccuccauggccaugcggugcgucggcaucgggaaccgagacuucguggaggggcuaucuggcgcuacuuggguggacguagugcuggagcacgguuccugcgucaccaccauggccaaaaacaagcccacucuggacaucgagcuccugaagacggaggucaccaaucccgcggugcugcggaagcucuguaucgaggccaagaucagcaacaccacaacugacucacgaugcccaacccaaggcgaggccacucugguggaggagcaggacgccaacuucgucugucggcgcaccuucguggaccggggcuggggcaauggcugcgggcuguucggcaaggggagccuccugacgugcgccaaauucaagugcgugaccaagcuggaaggcaagaucguccaguacgagaauuugaaauacuccgucauagugacgguccacaccggcgaccagcaccagguggggaacgagacgaccgaacauggcacuaucgcgaccaucacgccgcaggccccaacgucggagauccagcugaccgacuauggggcccuaacccuagauugcagcccccgcaccggccuggacuuuaacgagaugguccuucucacgaugaaggagaagucuuggcugguccacaagcagugguuccuggaccucccgcuuccguggacguccggggccagcacaucacaggagaccuggaaccggcaggaucugcucgugacauucaagaccgcccacgcgaagaagcaagaagucguggugcugggcucacaggagggcgcgaugcacacagcacucaccggggccacagaaauacagaccagcggcaccaccacgaucuuugccgggcaccucaaaugccgccugaaaauggauaagcugacccucaaaggcauguccuacgucauguguaccgggagcuucaaacuggagaaggagguggcggaaacacagcacgguacggugcuuguccaggugaaguacgagggcacggaugcccccugcaagauaccuuucaguacgcaggacgagaagggcgugacccagaacggcaggcuuaucacggcgaaucccaucgucacagacaaggagaagcccgugaauaucgagaccgagccccccuucggggagagcuacaucguggucggcgccggcgagaaagcgcuuaaacugucaugguucaaacgcggaagcagcaucggaaagauguucgaagcuaccgcccgcggggcccgcagaauggcgauccugggcgacacugcgugggacuucggguccaucggcggcguguucaccucaguaggcaaacucguccaccaaguauucggcacagccuacggaguucuguucagcggcgucuccuggaccaugaagaucgggaucggcauccugcucacauggcugggccuaaacuccagguccaccagcuuguccaugacaugcaucgccgucggcauggugacccuguaccugggcgucaugguccaggccgacagcgggugcguuaucaacuggaagggccgcgagcucaagugcgggagcggcaucuuugugacaaacgagguacacacguggaccgagcaguauaaguuccaggccgacagcccaaagcggcugagcgcggccaucggcaaggccugggaggagggggugugcggcaucagguccgccacccggcuggagaacaucauguggaagcagaucagcaaugagcucaaccacauccuuuuggagaaugacaugaaguucaccgucguggugggggacgccaacggaauccuggcacaggggaagaagaugauccgcccccagccuauggagcacaaguacuccuggaagaguuggggcaaggccaagauuaucggagccgacauccaaaacacuacguuuaucauagaugggcccgacaccccggagugccccgacggccagcgcgccuggaacaucugggaagucgaggacuauggguucggcaucuucaccacgaauauuuggcugaagcugcgcgacuccuacacgcagaugugcgaucaccgacucaugucugcggccaucaaggacuccaaggcagugcaugccgauaugggcuacuggaucgagucggagaagaacgagaccuggaaacuugcccgcgcguccuucauagaggugaagaccugcacguggcccaagagccauacccugugguccaaugggguccuagagagcgagaugaucaucccgaagaucuacggagggccgaucucccagcacaauuaccgacccggcuauuucacccaaaccgcugggccguggcaccugggcaagcuggaacuagauuucgaccugugcgagggcacgacagucguugucgacgagcacugcgggaaccgcggcccgagccugcgaaccaccacagugaccgggaagauuauccacgaguggugcugccgcucuugcaccuuaccgccccugcgguuccgcggcgaggaugggugcugguaugguauggagauccggcccgugaaggagaaggaggagaaccugguccgcagcaugguguccgccggcucaggggagguugacaacuucagucucggcauccugugcguguccauuaugaucgaggagguaaugcggagcagguggucccgcaagauguuaaugaccgggacacucgcaguguuccugcugcuaaucaugggccagcugacuuggaaugaccugauccggcugugcaucauggucggggccaacgcguccgaccguaugggcaugggcaccaccuaccuggcccugauggccacguucaagaugcggccgauguucgccguuggguuacuguuccgccggcugaccucccgcgaggugcuccugcugaccauaggccuuagccuagucgcuuccguggagcugcccaacagucucgaggaauuaggggacggccucgcgaugggaaucaugaugcugaagcugcugaccgaguuccagccccaccagcucuggaccacccuguuguccuugaccuucgucaagaccacgcugagccuagacuacgcauggaagaccacagccauggugcuuuccaucgugagccuguucccccugugccucuccaccacgucccagaagaccaccuggcugccgguccugcucggguccuucggcugcaagccucugacuauguuccuaaucaccgagaacaagaucugggggcgcaaaucauggccacucaacgagggcaucauggccaucgggauaguguccauccuauugucuucccuccugaaaaacgaugugccccuagccggcccgcucauugccggcgggaugcucaucgcaugcuacgucaucagcggaagcuccgccgaccugucacuggagaaggcugcggagguguccugggagcaagaggccgaacacagcggagcuucacacaacauacugguggagguacaggacgauggcacgaugaagauaaaagacgaagagcgcgacgacacccugaccauucucuuaaaagccacccugcucgccgugagcggcguguaccccauguccauucccgcgacgcuguucguaugguacuucuggcagaagaagaagcagcgguccggcgugcugugggacacccccuccccgcccgagguagaacgcgcaguccuggacgacggcauauaccggaucuugcagcgcggcuuauugggccggagccaggugggugugggcgucuuccaggacggaguauuccacaccauguggcaugugacgcgcggcgcuguccucauguaccagggcaagcggcuggagcccuccugggccugcgugaagaaggaccugaucuccuacgggggcggguggcgauuccagggccucuggaauacgggggaggaggugcagguuaucgccguggaaccagggaagaacccuaagaaugugcagaccacucccggcaccuucaaaacucccgagggggaggugggcgcgaucgcgcuggacuucaaacccgggaccuccggcagcccgauugugaaucgggagggcaagaucgucggccuguacggaaacggggucgugaccaccuccggcacuuacguuagcgcgaucgcucaggcaaaggcgagucaggaagggccccuacccgagaucgaggacgagguauucaagaagcgcaaccugaccaucauggacuugcauccggguagcgguaagaccaggcgcuaccucccggccaucguccgagaggccauaaagcgcaaacugcgcacccugauacucgcucccacccggguggucgcguccgaaauggccgaagcccugaaggggaugcccauacgcuaccagaccaccgccgucaagagcgagcauaccggccgggaaaucguggaccuaaugugccaugccacguucaccaugcgccuccuaagccccguccggguacccaacuacaauaugauuaucauggacgaggcgcacuucaccgaucccgccuccaucgccgcacgcggguacauuagcacccguguaggcaugggggaggcagcagcaaucuucaugacggccacuccgcccgguucugucgaggccuuuccccagucgaacgccgugauccaggacgaggagcgggacauccccgagcggucauggaauagcggcuaugacuggaucaccgacuuccccgggaaaaccgugugguucguccccuccaucaaaagcggcaacgacaucgccaacugccuccgcaagaacgggaagcggguaauucagcucucgaggaaaacguucgauaccgaguaccaaaaaaccaagaacaacgacugggacuacguggucaccacagauaucagcgagaugggcgcaaacuuccgggccgaccgggugauugacccccggcgcugccugaagcccgugauccucaaagacggcccagagcgggugauccuggccggaccgaugcccguuaccgucgcguccgccgcccagagacggggccgcauagggcgcaaccagaauaaggagggcgaccaauacguuuacauggggcagccccugaacaacgacgaggaccacgcccacuggaccgaagcaaagaugcuccucgacaacaucaacacucccgagggcaucauaccggcgcuguucgagcccgaacgggagaaguccgcagccaucgacggcgaguaccgguuacggggagaagcccgcaaaaccuucguggaacucaugcggcgcggcgaccugcccgucuggcuguccuacaagguggccagcgagggguuccaguacuccgaccggcgcuggugcuucgacggcgagcggaauaaccagguguuagaggagaacauggacguugaaaucuggaccaaggaaggagagcgcaagaaguuacggccccgcuggcuggacgcgcggacguacagcgacccgcucgcccuucgcgaguucaaggaguucgccgccggccggcgcucaguuagcggcgaccugauacucgagauugggaagcuaccgcagcaccuaacucuccgugcgcaaaacgcucuggauaaccuggugaugcuccacaacuccgagcaaggcgggaaggccuaccggcacgccauggaggagcugcccgacacaaucgagacguuaaugcuacuugcccugaucgcaguccucaccggcggagugacucuguuuuuccucagcggcaagggcuuggggaagaccucaauuggccugcugugugugacggccuccagcgcuuuacucuggauggccuccguugaaccccacuggaucgcggcguccaucauccuugaguucuuccuaauggugcugcugauaccggagcccgaccggcagcgcacgccccaggacaaucagcucgccuacguagucauagggcugcuguucaugauccucaccguggccgccaaugagaugggccugcuggaaacuacaaaaaaagaccuuggcauaggcuacgucgccgcggagaaccaccagcacgccaccaugcuggaugucgaccugcacccggccuccgccuggacccucuacgcuguggcgaccacggugaucacccccaugaugcggcacaccaucgaaaacacaacugccaacauuucgcugaccgcgaucgccaaccaggcagcgauuuugaugggacuggacaagggguggcccaucuccaagauggacaucggugucccccugcuggcccucgggugcuacagccaggugaacccgcugacccugaccgccgccgucuuaaugcuggucgcacacuaugccauaaucggccccggccugcaggccaaggcgacccgcgaggcccagaagcgcaccgcagcaggcaucaugaagaaccccacuguugacgggaucguugccauagaccucgaccccgugguauacgacgcgaaguucgagaagcagcuggggcagaucaugcugcucauccugugcaccucccagauccugcucaugcggacgaccugggcacugugcgagagcaucacccuggcgaccggcccacuuacgaccuugugggaggguuccccgggcaaguucuggaacaccaccaucgccgugucuauggcaaacaucuuucgcggcaguuaccuggccggggccggccucgcguucagccugaugaagagucucgggggcgggcgucgcggcacgggcgcccagggggagacgcucggcgagaaguggaagcgccagcugaaucagcugucaaaguccgaguuuaacaccuacaagcgcagcggcauaauggagguggaccgguccgaggcgaaggagggucucaaacgcggggagacaacgaagcacgccguaagcaggggcaccgcgaaacugcgcugguucgucgagcggaaccuggucaagcccgagggcaaaguuaucgaccugggguguggccgcgggggauggagcuacuacugugccggguugaagaaggugaccgaggucaaaggcuacacuaagggagggccgggccacgaggagcccauccccauggccaccuauggguggaaccuggugaagcugcacucugguaaggacguguucuucaugccgcccgaaaagugcgacacgcuccucugcgacaucggggaguccucaccgaaccccacaaucgaggagggccggacccugcgcgugcucaaaaugguggagcccuggcuacggggcaaucaauuuugcaucaagauccugaaccccuacaugccgagcguggucgagacccucgagcagaugcagcgcaagcacggcggcauguuggugcgcaacccccugucccgcaacagcacgcacgaaauguacuggguguccugcgggacuggcaacaucgucucugcaguuaauaugaccuccagaaugcuccugaaccgcuucacgauggcccaccggaagcccacguacgagcgggacguggaccugggcgcggggacccgucacguagccguggagccagagguggccaaccucgauaucaucggccagcgcauagagaacaucaagaaugagcacaagagcacauggcacuacgacgaggacaacccguacaagaccugggccuaccacggguccuacgaagucaagccaagcggcuccgccagcucaauggugaacggggucgugcgccugcuaacgaagcccugggacgugauccccauggucacccagaucgcgaugacagauacaacuccguucggccagcagcggguauucaaagagaagguagacacccgcacgccucgggccaagcgcggcaccacgcagauaauggaagucaccgccaaguggcucuggggguuccugagccgaaauaagaagccacgcaucuguacccgagaggaguucacacgcaagguacgguccaacgccgccaucggcgcgguauucguagacgaaaaccaguggaauagcgccaaggaggcaguggaggaugagcgcuucugggaccuggugcaccgggagcgcgagcuccacaagcaggggaagugcgcgacgugcguuuacaacaugaugggcaagcgggagaagaagcugggggaguucggcaaagcgaagggcucccgcgccaucugguacauguggcuaggggcccgguuccucgaauucgaggccuugggguucaugaaugaagaccacugguucucccgcgagaacagccuguccgggguggagggcgagggguugcacaagcugggcuauauccugcgagacaucagcaagaucccgggcgggaacauguacgccgacgacaccgcuggcugggacacucgcaucaccgaggacgacuugcagaacgaggccaagaucacggacaucauggagcccgagcacgcccugcuggccaccucaaucuucaaacucacauaccagaacaaggugguccgugugcagcgucccgccaagaacgggaccgugauggacgucaucagccgccgagaccagcgcggcuccggccagguggggacuuacggucugaacaccuucaccaacauggagguacagcugauccggcagauggagagcgagggcaucuuccugcccuccgagcuggagaccccgaaccuggcggaaagaguccuagacuggcuggagaagcacggcgccgagcggcugaagcgcauggccaucuccggggacgacugcguggugaagcccauagacgaucgguucgccacggcccucacggcgcugaacgacauggguaagguccgcaaagacaucccccaaugggagcccaguaagggcuggaacgacuggcaacaggugccguucugcagccaccacuuccaccagcugaucaugaaggacgggcgggagaucgugguccccugccgcaaccaggacgagcucgugggccgggcacgcgugucccaaggugccggcuggagccugcgggagacugccugcuuggggaaguccuacgcccaaauguggcagcucauguacuuccaccgcagggaccugcgccuggcugccaacgccaucugcagugcgguccccguggauugggugccuacaucccggaccacguggucgauccacgcgcaucaucaguggaugaccacagaggacauguuauccgucuggaaccgcguguggaucgaggagaauccguggauggaagacaagacccaugugucgagcugggaggagguccccuaccugggcaagcgcgaggaccaguggugcggcagccugaucgggcucacggcccgggcgaccugggccaccaacauucagguggccaucaaucaagugcgccguuugauaggcaacgagaacuaucucgauuacaugacuagcaugaagcgcuucaaaaacgaguccgaccccgagggggcgcucugguag

SEQ ID NO: 24056 - RNA, 9879 nt, Artificial Sequence
  derived and/or modified CDS sequence (opt11) from DENV-1__FJ639820__SS-prME
agcgugacgaugcuuuuaaugcugcugcccaccgcccucgccuuccaccugaccacucgcgguggggaaccccacaugauaguguccaagcaggaacggggcaaaaguuugcuguucaagacuagcgcgggggugaacauguguacacugauagccauggaccuuggcgaacucugcgaggacacgaugaccuacaagugcccccgcauaaccgaggccgagcccgacgacguggacugcuggugcaacgccaccgauaccugggucaccuauggaaccugcagccagacgggcgaacaccgacgcgacaagcggaguguggccuuggcuccucacgucggacuaggccuggagacccgcaccgagaccuggaugagcucugagggcgcauggaagcagauccaacggguugaaacaugggcacugagacaccccggguucacggugauagcacuauuccuggcgcaugccaucgguaccucaaucacacagaagggaaucauuuucaucuuacugaugcucgugaccccaaguauggcaaugcggugcgucggcaucgggaauagggacuucguggaaggguugagcggcgccacauggguagacgucgucuuagagcacggguccugugugaccaccauggcuaagaacaaacccacccucgauaucgaacuucugaagacggaggucaccaaccccgcggugcuucggaaacugugcauagaggccaagaucuccaacaccaccacugacucccgaugccccacgcagggcgaggccacccuuguugaagagcaggaugccaauuucguaugccgacgcacauucguugaccgggguugggggaacggcugcggccucuucgguaaggggucacugcugacuugcgccaaguucaaguguguaacgaaacucgaaggcaagaucguucaguacgagaacuuaaaguacuccgucaucgugacaguccacaccggcgaccagcaccagguggguaaugaaacaacagaacaugguaccaucgcaacgauaacuccccaagccccaacgagcgagauccaauuaaccgacuacggggcccugacccuggacugcagcccccgcaccggccuggacuucaacgaaaugguccuccuaacgaugaaggaaaaguccuggcuggugcacaagcaaugguucuuggaccugccccugcccuggaccucuggggccagcaccucucaagaaaccuggaaccgucaggaccuucuugugacguucaagaccgcccacgcgaagaaacaggaggugguaguucuaggcucccaagagggggccaugcacaccgcccucaccggggcuacggaaauucagaccagcggcaccaccacaauauucgcugggcacuuaaagugcaggcugaagauggacaagcucacccucaagggcauguccuacgugauguguaccggaucguucaagcuggagaaggagguagcggagacccagcacggcacagugcuaguacagguaaaguaugagggaacagaugcucccugcaagauccccuucucaacccaagacgagaagggggugacccagaacggcagacucauuacggccaacccuaucguuaccgacaaagaaaaaccaguaaacaucgagacugaaccgcccuucggcgagagcuacaucguggucggagccggcgagaaggcgcugaagcuguccugguucaaaaaggggagcuccaucgguaaaauguucgaggccacagcucgcggggcccggcgcauggccaucuuaggugacacagcgugggacuucggaucaauugggggcguguuuaccuccguggggaagcuggugcaccagguguuugguaccgcuuacggggugcuauuuucgggcgucaguuggaccaugaagaucgggauugggauccuccugacguggcugggccucaacagccgcuccacgagccuguccaugaccuguaucgccgucgggauggugacucucuaccuuggaguuauggugcaggccgacagcgggugugugaucaacuggaaaggucgggaacugaagugcggauccgguaucuucgucaccaacgagguacacacauggaccgagcaauacaaguuccaggcagacagcccuaagcgacugagcgcagccauaggcaaagccugggaggagggagugugcggcauccguuccgcaacccgccucgagaacaucauguggaagcagaucucgaacgaauuaaaccacauccuacuagagaacgacaugaaguucaccguugugguaggagaugccaacgguauccuagcucaagggaagaagaugauccggccccagcccauggaacacaaguacagcuggaaguccuggggcaaggcaaagaucaucggcgccgacauccagaacaccacguuuaucaucgauggacccgacaccccggaaugcccggauggccagagagccuggaauauuugggaaguggaggacuacggguuugguaucuuuacgaccaauauauggcugaagcugcgggauucauacacccagaugugcgaccaccgacugaugucugcggcgaucaaggacuccaaggccgugcacgcugacaugggcuacuggaucgagagcgagaagaacgaaacuuggaaacucgcccgagcauccuuuauugaggucaagacauguaccuggcccaagagccauacccucugguccaauggggugcuugagagcgagaugaucauccccaaaaucuauggcgggccgauaagccagcacaacuaucgccccggcuacuuuacucagaccgccgggcccuggcauuugggcaagcuugagcuggacuucgaccugugugagggcacgaccgucguagucgacgagcacugcgggaaucgggguccgucgcuccguacgaccacgguaaccgguaaaaucauccaugaauggugcugccggucaugcacucugccgccccugcgcuuccggggcgaggacgggugcugguacggcauggagauccgccccgugaaagaaaaggaggaaaaccucguccguuccaugguguccgccggaagcggugaaguugauagcuucucgcugggcauccugugcgucagcaucaugaucgaggaggucaugcguucccgguggagccgaaagaugcucaugaccggcacacuggcgguguuccuguuacugauuaugggccagcuaaccuggaacgaucucauccgccugugcaucauggucggggccaacgcuucugauaggaugggcaugggcaccaccuaccuggcccucauggcgacauucaagaugcgcccgauguucgccguggggcugcuguuccggcgucuaaccagccgggaaguacuguuauuaaccauugggcugucccuagucgccagcguggagcuccccaacucccuagaggagcuuggggacggccucgcgaugggcaucaugaugcugaagcuccucaccgaguuccagccccaucagcuguggacgacccugcucagccugacauucgucaaaaccacgcucucccucgacuacgcguggaagaccaccgccaugguacuaagcaucgugucacucuuuccccucugccugucaaccacgucccaaaagaccacguggcugccgguccuccuggguagcuucggcuguaagccucugaccauguuccucauuaccgaaaauaagauaugggggcguaaguccuggccacugaacgagggcauuauggcuaucgggaucgugagcauccugcucucuucgcugcugaaaaaugaugugccucucgcaggcccgcucauagccggaggcaugcuaaucgccugcuacgucauuagcggauccagcgccgaccucucccuggagaaggccgcggaggugucgugggagcaggaggccgagcacaguggggccagccacaacauccucguggaggugcaggacgacggcacgaugaagaucaaggacgaggagcgugaugauacccuaacgauccugcugaaggccacccuucuggccguuucagggguguaccccaugagcaucccugcgacgcuguucgucugguacuuuuggcaaaagaaaaagcaacgcuccggcgugcucugggacacacccagcccgcccgagguggagagagccgugcucgacgauggaaucuaccgcauacugcagcgggggcuccucggccgcucccaggugggggucggcgucuuccaggaugggguguuucauacaauguggcacgugacccgaggcgcggugcugauguaccagggcaaacgccuggagccaagcugggcuucugugaagaaggaccuaaucucguacgggggcggguggcgguuucagggcuccuggaacacgggagaggaaguucaagucauagccguggaaccgggaaaaaacccuaagaacgugcaaaccacccccggcaccuuuaaaacgcccgagggggaagucggagcuaucgcccucgauuucaaaccugggacaagcggcuccccgaucgugaacagagagggcaaaauugucggguuguacggcaacggaguggucaccaccaguggaacguacgugagcgcgaucgcccaagcaaaggcaagccaggaggggccccucccggagaucgaggaugaggucuucaagaagcggaaccugaccaucauggaccugcacccgggcucagguaagacccggcgguaucucccugcgauagugcgcgaggccaucaagagaaaauuacgcacucugauccucgcaccgacucgcguugucgcguccgagauggcugaggcucugaaggggaugccuauccgguaucagaccaccgcagucaagucugagcauaccggccgcgagaucguggaucugaugugccacgcaacguuuaccaugcggcuccuguccccaguccgcgugcccaacuacaacaugauaaucauggacgaggcgcacuucacugaccccgccuccaucgccgcccgggguuacaucuccacgcguguggguaugggugaggcugcagccaucuuuaugacugccacuccgccaggcagugucgaggcuuucccccaguccaaugccgugauccaggaugaggagcgggacaucccugagcgcucauggaacuccggcuaugacuggaucaccgacuuccccgggaagacugugugguucgugcccucuaucaagucagguaacgacaucgcgaacugcuuacgcaagaacgguaaacgcgugauccagcuaucucggaaaacuuucgacacugaauaccagaaaaccaagaauaaugacugggauuacguggugacaaccgacaucagcgagaugggcgccaauuuccgcgcugaccggguaaucgacccccgccggugccugaaaccaguaauacugaaagacgggcccgagcgagucauacucgcggggccgaugcccgugaccgucgcgagcgccgcccagcggagaggccggaucgggaggaaucagaacaaagaaggagaccaguacgucuauauggggcaaccccuaaauaaugacgaagaccacgcccacuggaccgaggccaagauguugcucgacaacaucaacacgccugagggcauuauaccugcguuguucgagcccgagcgugaaaagucggcugcaaucgacggggaauaccggcugcgcggcgaggcccggaagacguuuguggagcucaugcggaggggggaucugcccgucuggcugagcuacaaaguggccuccgaaggguuccaguauagcgaccgccggugguguuucgacggcgagcgcaacaaccagguccucgaggaaaacauggacgucgagauuuggaccaaggagggggagcgaaagaagcugcgccccagauggcuggaugcgcgcacauacuccgaccccuuagcgcugcgggaguucaaagaauucgcagccggccgccgcagcgugucuggcgaccugauacucgagauugggaagcucccucagcaccucacccugcgcgcccagaaugcgcuggauaaccuggccaugcuccacaacucagagcagggcgggaaggccuaccggcacgccauggaggagcugcccgacacgauagagacgcuuauguugcuggcucugaucgcggugcuuacgggcgggguaacacuauuuuuccugaguggcaagggccuagggaagacgucgaucggcuuacugugcgugacggccucauccgcccuccucuggauggcuucuguggagccgcauuggaucgccgcuagcauaauccuggaguucuuccucauggucuugcugauacccgagccagaccgucagcggacgccccaggacaaccaguuagccuauguggugaucgggcugcuguuuaugauccucaccgucgccgccaacgaaaugggccuucuggagaccacuaagaaggaccuugggaucggguacguugcggcagagaaucaccagcacgcuaccaugcuggaugucgaucugcgcccagcgagugccuggacacucuacgcugucgcaaccacggugauaaccccuaugaugcgucacacgaucgagaacaccacggccaacaucagccugacggccaucgccaaccaagcagccauccugauggggcucgacaagggguggccuaucagcaagauggacaucggcgugccauuacuggcccuagggugcuacucccaggucaauccacuaacccugaccgcggcgguacucaugcugguggcccacuacgcgaucaucggccccgggcugcaagcuaaggccacuagggaggcccagaagcggacugccgccggcauuaugaagaacccgaccgucgacggcaucguggccauagaucucgaccccguggucuacgacgcgaaguuugaaaagcagcuggggcagaucauguugcuuauccugugcaccucgcagauccugcucaugcggacaaccugggcguuaugcgaauccaucacacuggccaccggcccgcucaccacacucugggagggaagccccggcaaguucuggaacacuaccaucgccguauccauggccaauauauuccgaggcagcuacuuagccggggccggccucgccuuuucccugaugaagucccucggaggcgggcggcgcggcaccggcgcccagggggagacccugggcgaaaaguggaagcggcagcugaaccagcugaguaagagcgaauucaacaccuacaagaggagugguauaauggaaguugaucggagugaggccaaagagggucucaagcgcggggagaccacgaagcacgcggucucccggggcaccgccaagcugcgcugguucguggagcggaaccuggucaagccggagggcaaggugauagaccuggguugcggcagagggggcugguccuacuauugugccgggcucaagaaggugaccgaggugaagggcuauacgaagggggguccuggucacgaggagccgauuccuauggccacuuacggguggaaccuggucaaacugcacagcggaaaggacguguuuuucaugccgccggagaagugcgacacacuacucugcgacauuggggaguccagcccgaaccccaccaucgaagagggccggacccugcgcguccucaagauggucgagcccugguugaagggcaaccaguucugcaucaaaauccugaaccccuacaugccgucggucguggagacgcucgagcagaugcagcggaagcacgggggcauguugguucgcaauccccugagccggaauuccacgcacgaaauguacugggugagcugcgggaccggcaacaucguauccgcagugaacaugaccagccgaaugcucuugaaccgguucacaauggcucaccgcaagcccacguacgagcgcgacguagaccugggcgcgggaacccgucauguugcuguagaacccgagguggccaaccuagacaucauaggccagcgcaucgagaacaucaaaaacgagcacaaguccacauggcacuacgaugaggauaacccguacaagaccugggcuuaccaugggagcuacgaggugaagccauccgggucggcguccagcauggucaacggugugguccgacugcugacgaagccaugggacgugauccccauggugacacagauagccaugaccgacaccacgccguucggccagcagcgcgucuucaaggagaagguggacacccgaacgccucgcgccaagcggggaacuacgcagaucauggagguuacugccaaauggcucuggggguuccuaucccgcaacaagaagccccggauauguacccgcgaggaauucacgcggaagguccgcagcaacgcagcaauuggggcuguguucguugaugagaaccaguggaacucggccaaagaggccgucgaggacgagcgguucugggaccuggugcaucgcgagcgagaguugcacaagcaagguaagugcgcgacgugcgucuauaacaugauggguaagagggagaagaaacugggggaguucggaaaggccaaaggcucaagggccauaugguauauguggcugggggcccgcuuccuagaguucgaggcacugggcuuuaugaacgaagaccauugguucagccgugagaacucccuguccggugucgaaggagaggggcuccacaaacugggguacauccugcgggacaucuccaagaucccgggugggaauauguacgcggacgacaccgccggcugggauacccggaucacggaggacgauuugcagaaugaggccaagaucacggacauuauggagccagagcaugcccugcucgccaccucgauauucaaguugaccuaucagaacaaaguggugcgaguucagcgccccgcuaaaaacgguaccgugauggacgucauaucccgucgggaccagcgcggcuccggccaggucgggacguacggccuuaacacguucacgaacauggaagugcagcugauccggcagauggagagcgaggggauauuccucccuagcgagcuggagaccccgaaccuggccgagcgggugcucgacuggcuggagaagcacggcgccgagcgccucaagcgaauggcgaucucuggggacgacugcguagugaagccuaucgaugaccgcuucgcgacggcgcucaccgcgcuaaaugacaugggcaaggugcguaaggacauuccccaaugggaacccagcaagggcuggaaugauuggcagcaggugccuuuuugcucccaccacuuccaccagcugauaaugaaggaugggagagagaucguugugccgugucggaaccaggacgagcucgucggccgcgcucgggugagccaaggggcuggcuggucccuccgggagaccgccugccugggcaagagcuacgcccagauguggcagcucauguauuuucaucggcgugaucugcggcuggccgcgaaugccauuugcuccgcggugccgguggacugggugcccacaagccgcaccacguggaguauccacgcgcaucaccaguggaugacuaccgaagacauguuguccguguggaaccgggucuggauagaggagaacccguggauggaggauaagacucacgugucauccugggaggaggugcccuaucugggcaaacgcgaggaccaguggugcggcagccugaucgggcucacggcuagagcaaccugggccacgaauauacaagucgcuaucaaccaggugcgccguuuaaucgggaacgagaauuaccuggacuacaugaccuccaugaagcgcuucaagaacgaaagcgaucccgaaggggccuuaugguga

SEQ ID NO: 24057 - RNA, 9879 nt, Artificial Sequence
  derived and/or modified CDS sequence (opt11) from DENV-1__FJ639821__SS-prME
ucagccaccaugcugcuuaugcugcugcccacagcccuggccuuccaccuuacgacccgcgguggggaaccccacaugaucguguccaagcaggagcggggcaagagccuccuguucaaaaccagcgccggggugaauaugugcacccugaucgccauggaccugggcgagcucugugaggauaccaugacauacaaguguccccgcaucaccgaggcggagccggacgacguggacugcuggugcaacgccacugacaccugggugaccuacgggaccugcagccagaccggcgaacaccggcgcgaaaagcgguccguugcguuagcaccccaugucggccuggggcuugaaacccgaacagagacguggaugagcucggagggcgccuggaagcagauucagcggguugagaccugggcgcugcgacaccccggguuuacagugaucgcuuucuuccuugcgcacgccaucggcaccucuauuacccagaaggguaucauauucauccuccugaugcugguuacccccucgauggccaugcggugcguaggcaucggcaacagggacuuugucgaaggacucagcggugccacuuggguggacguggucuuagagcacggcucuugcgugaccaccauggcgaagaacaaacccacccuggacaucgagcuccugaagacggaggucaccaacccugcagugcugcggaagcucugcauugaggccaagaucagcaauaccaccacggacucccgcugccccacgcaaggcgaggccacccuggucgaagaacaagacgccaacuucgugugccggcgcacauucgucgaccgggguugggggaacggcugugggcuguucggcaaggggagccuccugacuugcgcgaaguucaagugugugaccaaacuggaaggcaaaaucgugcaguacgagaaccucaaguacuccgucaucgugacagugcacaccggcgaccagcaccaagucgggaaugagacgaccgagcacggaaccaucgcuacgaucacuccucaggcccccacgucggagauccaauugaccgacuacggggcacugacccuugacugcagcccccggaccggccuggacuucaaugagauggugcugcucacgaugaaggagaagucauggcugguucacaagcagugguuccuggaccucccgcuacccuggaccucaggggcgagcacuagccaggagaccuggaaucggcaagaccugcucgugacguucaagaccgcgcaugccaagaagcaggagguaguuguacugggcucccaggagggagccaugcacacagcccugaccggggccacggagauccagaccucgggaacgaccacgaucuucgcggggcacuuaaaguguagacuaaagauggacaaguugacucucaaggggauguccuacgucaugugcaccgggagcuucaagcuggagaaggaggucgccgagacccagcacggcacggugcuugugcagguacgguacgagggaacagaugccccaugcaagauacccuucaguacccaggacgagaaaggggugacccagaacggccgccugaucacggccaacccgaucgugaccgacaaggagaagcccgucaacaucgagacggagccgcccuucggcgagagcuacauagugguaggcgcgggcgaaaaggcacucaaacuguccugguuuaaacgggggaguuccaucggcaagauguucgaggccaccgcgaggggggcccgcagaauggcgauccugggcgacacggccugggacuucggcucgaucgggggcgucuucacauccguggggaagcucgugcaccaggucuuugguaccgcguacggggugcuguucagcggagucuccuggacgaugaagaucggcaucgggauccuguugaccuggcuuggacugaauucccgcuccaccagccucuccaugaccugcaucgcugucgggauggugacccucuacuuaggugugaugguccaagccgacagcgggugcgugaucaauuggaagggccgugagcucaaaugcggguccggaauauucgugacgaacgagguccacacguggaccgagcaguacaaguuccaagcggacaguccuaagcgccugucggccgccaucggcaaagccugggaggaggggguauguggcauacgguccgcgacccgccuggaaaauaucauguggaagcaaaucuccaaugagcucaaccacauccugcuggagaacgacaugaaauucacaguggucgugggggacgcgaacggcauccucgcccaggggaagaagaugauccguccccagccgauggagcacaaguacuccuggaaaaguuggggcaaggccaagaucauuggcgccgacauucagaacacgaccuucaucaucgaugggcccgauacaccggagugccccgacggccagcgagcguggaacaucugggagguugaggacuauggguuugggaucuucaccacgaacaucugguugaagcugagggacuccuacacccagaugugugaccaccgccucaugagcgccgccaucaaggacaguaaagccguccacgccgacaugggcuacuggaucgaaagcgagaagaacgagacuuggaaacuggcgcgggccuccuucaucgaggugaagacaugcacguggcccaagagccacaccuuaugguccaauggugugcucgagagcgagaugauaauaccuaagauauacggcgggccgauaucccagcauaacuaccgccccggguacuacacacaaacggcagggccauggcaccucgggaagcuggagcucgacuucgaucuaugcgagggcacuaccgucgucguggaugagcacugcgggaaccggggaccaagccugcgcaccaccacggucaccgggaagaucauccacgaguggugcuguagauccugcaccuuaccaccccuccgauuccggggcgaggacgggugcugguacggcauggagauccgccccgugaaggagaaggaagaaaaccuggugcggucgaugguauccgccggcagcggggagguggacaacuucucucuuggcauacucugcguguccauaaugaucgaagaggucaugcgaagccgguggucccgaaagaugcugaugaccgggacacuagccguguuucuguugcucaucaugggccaauuaaccuggaacgaccugauccgccucugcauuauggugggggcgaaugccagcgacgguaugggcauggggaccaccuaucuggcccugauggccaccuucaagaugcgaccgauguucgccgucggcuugcuguuucgccgguuaaccucgagggagguccuucugcucaccaucggacucagccugguggcauccgucgagcugccuaacagccuagaggagcugggggacggacuggccauggguaucaugaugcucaaguugcugaccgaguuccagccccaccaguuauggacaacccuacugucccucaccuuugucaagacuacacugucgcuggauuaugccuggaaaaccaccgccaugguccucuccaucgucagccuguucccccuuugccucuccaccacaagccaaaagaccacuuggcugccuguucuccuaggcucguuugguuguaagccccugaccauguuucucaucacagagaacaagaucuggggccgcaagucguggccacuaaacgaagggaucauggcgauaggcaucgucuccauucugcugagcucccugcugaagaaugacgugcccuuagccggcccgcucaucgcuggaggcauguugaucgcgugcuacgugaucagcgggagcucugccgaccugagccucgacaaagcggccgaggucagcugggagcaggaggccgagcacagcggcgccucgcacaacauuagcguggaaguccaagacgacgggacgaugaagaucaaggacgaggaacgcgacgauaccuugaccauccugcucaaagccacccugcuggcggucuccggcguguaccccaugagcauacccgccacccucuucgugugguacuucuggcagaagaagaagcagcgguccggcguccugugggauaccccaagcccgcccgaaguggaacgugccguccuggacgacgggaucuaccggauccuacagcgcggccugcucggucguucccaggucggcguggggguauuccaggacggugucuuucacacuauguggcauguuacccgcggcgccguacugauguaccaggggaaacggcucgaacccucgugggccugcgucaagaaggaccugaucuccuacggcgguggcuggagauuccaggggagcuggaacacgggcgaggagguccaggugaucgcaguugagcccggcaagaacccgaagaauguccagaccacccccgggaccuuuaaaacgcccgagggcgagguaggggccauagcacuggauuucaagcccggcacgagcgggagcccaaucgugaacagggaggggaagaucgugggccucuaugggaacggcguggucaccaccuccgggacauacgugucugcgauugcccaggcgaaggccagucaggaagguccccugccggagaucgaggacgagguguucaaaaagcgcaaucuaaccauaauggaccuacacccgggcagcgggaagacacggagauaccugccugccaucguccgggaggccaucaagcgcaagcuacgcacccucauccuggcccccacgcgggugguggccucugaaauggcggaggcccugaagggcaugcccaucagguaccagaccaccgcugucaaguccgagcacaccggacgcgagaucguggaccucaugugccacgcgaccuucaccaugagguugcuguccccggugcggguccccaauuacaauaugaucaucauggacgaagcccauuucaccgaccccgccuccaucgccgccaggggcuauauaagcacgcgcguggggaugggcgaggcggccgccaucuucaugacggcuacgccgcccgguuccguggaggccuucccccagagcaacgcugucauccaggaugaagagcgcgacauccccgagagguccuggaacagcggcuacgauuggauuaccgacuucccuggcaagaccgugugguucguuccuuccauuaagucagguaaugacauugcaaacugucuccgcaagaacgguaaacgggucauccaguugucccggaagacguuugacaccgaguaccaaaagacuaagaacaacgacugggacuacgugguaacuacugacauaagcgagaugggugcuaacuuccgggcagaccgcgucauugacccgcggcgcugccugaagcccgugauacucaaggacgggcccgagcgagugauccuggccggcccgaugcccgucacaguggccucggccgcucagcgccggggucgcaucggcagaaaccagaacaaagagggcgaccaauacgucuacaugggucagccccugaacaaugacgaggaccacgcucacuggacggaggcgaagaugcuccuggauaacauaaacaccccggagggaauaaucccggcccuguuugagccagagcgggagaagucugcggcuaucgacggagaguaccgccuccggggugaggcccgcaagacguucguggagcugaugcggcgcggggaccugcccgucuggcucuccuacaaggucgcaucggaaggauuccaguacagugaccgucgauggugcuuugacggggagagaaacaaucaaguucuggaggagaacauggacguggaaaucuggaccaaggagggcgaacgcaagaaacugcggccacgcugguuggacgcgaggaccuacuccgacccccuggcccugcgcgaguuuaaggaguucgcugcaggccggcgcagugucuccggggaccucauccuggagaucggcaagcugccccagcaccucacgcuccgggcccagaacgcauuagacaaccucguuaugcugcacaacagcgagcagggagggaaagccuaccgccacgccauggaggagcugccggauaccauugagacgcucaugcuguuagcccucauugccgugcugaccgggggcguuacucuuuucuucuuauccggcaaaggguuagggaaaaccuccaucggcuuacugugugugacggcaagcucugcccugcucuggauggccuccguggagccccacuggaucgcggccagcauaauccucgaguucuuccugauggucuuauugaucccggagcccgaccggcaacggacgccucaggacaaccaacucgccuacguaguuaucggccucuuauucaugauucugacaguagccgccaaugagaugggucugcucgagaccacuaaaaaagaccuagguauuggcuauguggcggccgagaaccaccagcacgccacuaugcuggacgucgacuuacacccggcguccgccuggacacuguaugcagucgccaccacagucaucaccccgaugaugcggcacacuaucgagaacacaacggcaaauaucucccugaccgcuaucgccaaccaggcagccauccucauggggcuggacaagggcuggcccaucuccaaaauggacauaggggugccccugcuugcccucggcuguuauagccaggucaacccgcucacccucaccgcugcggugcugaugcugguggcccacuacgcaaucaucgggcccggccuccaggcgaaggccacgcgcgaggcgcagaagcgcaccgccgccggcauuaugaagaaccccaccgucgacggaaucguggcgaucgaccuggaucccgugguuuacgaugugaaguuugagaaacagcugggccagaucaugcuucugauacuuuguacgucacagauucugcugaugcggacgaccugggcucucugcgaaagcaucacgcucgcgaccgggccgcugacgacucugugggagggcucccccggcaaauucuggaauaccaccaucgccgugagcauggcaaacaucuuccggggcucauacuuggccggcgccgggcuggcguuuagccugaugaagucccucggcgggggccgacguggcacgggggcccaaggcgagacucugggugagaaguggaagcggcaauuaaaccagcucaguaaauccgaguuuaacaccuacaagcgcucaggcaucauggaggucgaccggucugaggccaaggaagggcucaagcgcggggagaccacgaaccacgcugugagcagaggcaccgccaagcugcgcugguucguggagcgcaaccucgucaagcccgagggaaaggugauugacuuaggauguggucgcgggggguggagcuauuacugcgccggccucaagaagguaacggaggucaagggcuacacgaagggugggcccgggcacgaggagccgauccccauggcaaccuacggcuggaaccuagugaagcuccacuccgggaaagacguguucuucaugccgcccgagaagugcgacacacuacugugugacaucggugagucaagcccgaaccccaccaucgaggagggcaggacccuccgcguccucaagaugguagaacccuggcugcggggcaaccaguucugcaucaagauccugaaccccuacaugccgagcgucguagaaacccuggagcagaugcagcguaaacacggcgguaugcuggugcggaacccccucucccgcaacagcacgcacgagauguacuggguuucgugcggcacuggcaacaucgugagcgccgugaacaugaccucccgcaugcugcugaaccgcuucacuauggcccaucgcaagcccaccuacgagcgcgacguagaccucggggcgggcacucgccacgucaccguggagcccgagguggcuaaucuggacaucaucgggcagcgcaucgagaacauuaagaaugagcacaagucgaccuggcauuacgacgaggacaauccguacaagacgugggccuaccacggauccuaugaaguaaagccuagcggcucggccagcagcaugguaaacggcguagugaggcuacucaccaagcccugggacguuaucccaauggugacccagauagccaugaccgacacgaccccguucggccaacaaagaguguuuaaggagaagguggacacgcgcacgccccgggcaaagcgcggcacgacccagaucauggaggucaccgccaaguggcuguggggcuuccugagccggaacaagaagccccgcaucugcacccgggaggaguuuacacguaaggugagguccaacgccgccauuggugccguguuugucgacgagaaccaguggaacucagcgaaggaggccguggaggacgaaagauucugggaccucgugcaucgggaacgcgagcugcacaagcagggcaagugcgcgaccugcgucuacaacaugaugggcaagcgggaaaagaagcuuggcgaguucggcaaggcaaaggggagccgggcgaucugguacauguggcucggcgcccgguuccuggaguucgaagcccugggguucaugaacgaggaucauugguucucacgcgagaacagccucuccggaguggagggcgagggccugcacaaguuaggcuauauucuccgggauaucagcaagauuccuggagggaacauguacgccgacgauaccgcggggugggacacccggauuacggaggacgaccugcagaacgaggcuaagaucaccgauaucauggagccggagcaugcacugcucgccaccuccaucuuuaagcuaaccuaucaaaacaaggugguccgcgugcagcgaccagccaaaaacgguacggucauggaugucaucagccgccgggaccagcgcggcuccggccaggucggcaccuacggguuaaauacauucacaaacauggagguacaacuaauccggcagauggagagcgaggggaucuuucugccgucggagcuggagacgccgaaccuagccgagcgcguccuggauuggcuggaaaagcauggggcugaacggcucaaacgcauggcgaucucgggcgaugacugcgugguaaagcccaucgacgaccgguuugccacagcacugacugcccugaacgacauggggaaggucagaaaggacaucccccagugggagccauccaagggguggaacgacuggcaacaagucccguuuugcucgcaccacuuccaccagcucaucaugaaggacggccgggagaucguggucccgugccgcaaccaggaugagcugguggggcgggcgcgcgucucccagggggcugguuggaguuuacgggaaacugccugccuagguaagucauaugcccagauguggcagcucauguacuuccaccgccgagaccuacgccucgcagcgaacgccaucugcagcgccguccccguugauuggguucccaccucccgaacgaccuggagcauccacgcccaccaccaauggaugaccaccgaggacaugcugagcgucuggaacaggguguggaucgaggagaacccuuggauggaagauaagacgcacguguccagcugggaagagguccccuaccuggggaagagagaggaccaguggugcgggucccuuaucggccuuacggcgcgggccaccugggcuaccaacauccagguugcuaucaaccagguccgccgccugaucgggaacgagaauuaccucgacuacaugacgagcaugaagcguuucaagaacgagucggaucccgaaggcgcccugugguga

SEQ ID NO: 24058 - RNA, 9879 nt, Artificial Sequence
  derived and/or modified CDS sequence (opt11) from DENV-1__FJ639824__SS-prME
agcgugacuaugcugcucaugcugcugcccaccgcacuugccuuccaucuuaccacacgcggcggggagccucacaugaucgucagcaagcaggagcgggguaagucauuacuguucaagaccagugcgggggugaauaugugcacccugaucgccauggaucucggcgaguuaugugaggacaccaugaccuacaagugcccccgcauaacugaggcggagccagacgacguggacugcugguguaaugcgacagacacaugggugaccuacggaaccugcagccagaccggagagcaccggcgcgacaagcgaagcguggcccuugcgccgcacgugggccuaggacuagaaacccggaccgagaccuggaugucgucugaaggugccuggaaacagauacagagagucgaaaccugggcgcugaggcaccccggguucacggugauagcccuguucuuggcgcacgccaucgggaccagcaucacucagaagggcauuaucuuuauccugcucaugcucgugacgcccuccauggccaugagaugcguuggcaucgguaaccgcgacuucguggaggggcugagcggcgccacauggguggauguaguguuggagcacggguccugcgugaccacuauggccaagaacaaaccuacccucgacauugagcugcugaagacggaggucaccaaccccgcaguguuacggaagcugugcaucgaggcgaagaucagcaacacaacuacugacucacgcugccccacgcagggcgaggccacccugguagaggaacaggacgcuaacuuugugugccggcgcaccuucguggaccggggcugggggaauggcugcggacuauucgggaaggggucccuacugaccugcgccaaauuuaagugcgugaccaagcucgaggggaaaaucguacaauacgagaaucugaaauacuccgugauuguaaccguccacacgggugaccagcaccagguggggaacgagacgacggagcacgguaccaucgcgaccauaacgccucaggcacccacgagcgagauucagcucacugacuacggggcccucacccuggacugcucgcccaggaccggucuggacuucaaugagaugguccuccucacgaugaaggagaaguccuggcuggugcacaagcagugguuccucgacuugccacuacccuggaccaguggcgccagcacuagucaggagaccuggaacaggcaggaccuccuggugacguuuaagacugcacaugcgaagaagcaggaggucgugguguuaggcucccaagagggagccaugcacaccgccuuaaccggggccacagagauccagaccagcggcacgacgacgaucuuugccgggcaccugaagugcagacugaagauggacaaguuaacccucaagggcauguccuacgugaugugcaccggcagcuuuaagcuggagaaagagguggcagagacgcaacauggcacugugcugguccaggugaaguacgaggggacugacgcacccugcaaaauccccuucucaacccaggacgaaaagggggugacccaaaacggccgccucauuacggccaacccgaucgucaccgacaaggagaagcccguuaauaucgaaacugaaccgcccuucggggagucauacaucguggugggggccggcgagaaggcacugaagcuguccugguucaagaaggggaguuccauaggcaagauguucgaagccaccgcccgcggggcccggaggauggccauccugggcgacacggcaugggacuuugggucgaucggcggcguguucaccuccguggguaagcuuguccaccagguguuugggacggccuauggagugcuguuuucuggagucucuuggaccaugaagaucggaaucggcauacugcugacguggcuggggcucaacagccgcagcaccucccuguccaugacgugcaucgccguggggauggugacccuguacuugggcgucauggugcaggccgacagcgggugcgugaucaacuggaaaggccgggagcuuaagugcgggucggggaucuucguuacgaaugaggugcacaccuggacagagcaguacaaguuucaagcugauuccccgaagcgccuuucggcggccaucgggaaggccugggaggagggagucugcggaauacgguccgcuacccgacuugagaacaucauguggaagcagaucagcaacgagcugaaccacauccuucucgagaacgauaugaaguucacgguugucgugggggaugcgaacggcauccuggcgcaggggaagaaaaugauacggccgcagccaauggagcacaaguauagcuggaagucuuggggcaaagccaagaucauaggcgccgacauccaaaacacgacguucaucauagacgggccagacaccccggagugcccagacggccaacgcgcguggaacaucugggaggucgaggacuacggguucggcaucuucacuacaaacauuuggcucaagcuacgagacuccuacacccagaugugcgaccaccgccugaugagugcggccauuaaggacagcaaggccguacaugcggacaugggauacuggaucgaguccgaaaagaaugaaaccuggaagcuggcccgagcguccuucaucgaagugaagacuugcacguggccaaagucgcacacccuguggaguaacggaguccuggagagcgagaugaucauccccaagaucuacggcgguccgauaagucagcacaacuaccgccccggcuacuucacccagacagcaggccccuggcaccugggcaagcucgagcuggacuucgaucuaugcgagggcacgacaguagugguagacgagcacugugggaaccgugguccgagccuccgcaccaccacggugaccgguaagaucauccacgaguggugcugcagaaguugcacccugccacccuuacgcuuccggggagaagacgggugcugguauggcauggagauccgcccagugaaggagaaggaggagaaucuugucaggagcaugguauccgccgguagcggggaggucgauaguuucagucugggcauccugugcgucagcaucaugaucgaggaggucaugcgcucccguuggagcaggaaaaugcuuaugaccgggacgcuugcuguauuccugcucuuaaucaugggucagcugacguggaaugaccucauucgccuguguaucauggucggagcgaaugcgucggaucggaugggcauggggacgacuuaucuggcccucauggcaaccuucaagaugcgcccgauguuugccgugggguuacuuuuucggcgccucaccaguagagaagugcugcugcucacaaucgggcucucccugguugccucuguggaauuaccaaacuccuuggaggagcugggggacggccucgcgaugggcauuaugaugcuuaagcugcucaccgaguuccagccucaccaguuauggacaacccugcucagccugaccuuuguaaagaccacgcuguccuuagacuacgccuggaagacuaccgcgaugguucugagcaucguguccuuauucccccucuguuugagcaccacuucucagaagaccaccuggcucccgguccuccuggggucauucggcugcaagcccuuaaccauguucuugaucaccgagaacaagauaugggggcgcaaguccuggccccugaacgagggcaucauggcuaucggaauugugagcauucuucucagcucccuuuuaaagaacgacgugccccucgcgggcccuuuggucgcagggggaauguugaucgccugcuaugugauaucaggaagcagcgccgaccucagucuugagaaggccgcggaagugagcugggagcaggaggccgagcauuccggggcaagccacaacauccugguugagguccaggaugauggcacgaugaagaucaaagacgaggagcgagacgacacccucaccauccugcuuaaggccacucuacuggccgugucagggguuuaccccaugagcauccccgcuacgcuguucgugugguacuucuggcagaagaaaaagcagagguccggcgugcucugggauacucccucgccccccgaggucgagcgugcgguccuugacgacggcauuuaccguauccugcagcggggacuucucggccgcucccaagugggggucggcguauuccaggacgggguguuucacaccauguggcacguaacgcggggcgccgugcugauguaccaggggaagcgacuggaacccagcugggcguccgucaaaaaggaucucauaagcuacggaggcggguggagauuucagggcuccuggaacacuggcgaggaaguucagguuaucgccguggagcccggaaagaacccaaagaacguccaaaccacgcccggcaccuucaagacgcccgagggggaggugggcgcgauagcccuggacuucaagccagguaccucaggcucacccaucgugaaccgcgagggcaagauagucggucuguacggcaacgggguggugaccaccagcggaacguacgucuccgcgauugcccaggccaaagcgagucaggaggggccccugcccgagauagaggacgagguuuucaagaagaggaaccugaccaucauggaccugcacccggguucaggcaagaccagacgcuaccuucccgcuauaguacgcgaggccaucaagcguaagcugcgcacccugauacucgcccccacgagaguaguggcguccgagauggccgaggcccugaaggggaugccuauccgcuaccagacuacagccgucaagucugagcacacuggccgagagaucgucgacuuaaugugucacgcaacguuuaccaugcggcuccuguccccggugagggugcccaacuacaacaugaucauuauggacgaggcgcacuucacugaccccgccaguaucgccgcccggggguacaucuccacgcgcgucggaaugggggaggccgcagccaucuucaugacggccaccccaccaggcagcguggaggcguucccccagucuaaugcggugauccaagacgaggagagagacauccccgaaagaucguggaauagcggcuaugacuggauaaccgacuuccccgggaagaccgucugguucgugcccaguaucaaguccggcaacgacaucgccaauugccugcggaagaaugggaagcgcgucauccagcucagccggaagacguucgauaccgaguaccagaagacaaagaauaacgacugggacuaugucguuacaacggacaucuccgagaugggagcuaacuuccgugccgaccgggugauagacccccgccggugccugaagccuguuauccugaaggacggucccgagcgcgugauccucgcgggaccaaugcccgucaccguagccagcgccgcccaacggcgaggcaggaucggacgcaaccagaacaaggagggcgaccaguacguguacauggggcagcccuuaaacaacgacgaagaccacgcccacuggacggaggccaagaugcugcucgacaauaucaacaccccggagggcauuauccccgcgcuguucgagcccgagcgcgagaaguccgccgccaucgacggggaauaccggcugcgcggcgaggcccggaaaacguucgucgagcucaugcgccggggcgaucuaccuguguggcugagcuacaagguggccuccgaaggguuccaguacucggaccgcagauggugcuucgacggcgagaggaauaaucaagucuuggaagagaauauggacguggagaucuggaccaaggagggggagagaaaaaagcugcgcccucgguggcuggacgcgcgaaccuacuccgacccguuagccuugagagaguuuaaggaguucgccgcaggccgccggucagugagcggcgaccugauccucgagaucgggaagcugccccagcaucuuacccuccgcgcccagaacgcgcuugacaaccuagucaugcugcacaacuccgagcaaggcgggaaggccuaccgccaugccauggaggagcugcccgacaccauagagacucucaugcugcuggcccugaucgcgguguuaaccggaggggugacucuguucuuuuugagcggcaaaggccuggguaaaaccuccauaggacuguuaugcgucacggcaagcagugcccuccuauggauggcgagcguagaaccgcacuggauagccgcguccaucauccuggaauucuuccucauggugcugcugaucccggaacccgaccgccagcggacgccccaggacaaccaacucgccuacgucgucaucgggcuguuguucaugauucucaccguggccgccaacgaaaugggucuguuagagaccacgaagaaggaccucggcauuggcuacgucgccgcugagaaucaccagcacgccaccaugcuggauguagaucuuaggcccgccagcgccuggaccuuguacgcuguggcaaccacggucauuacccccaugaugcggcacaccauugagaacacaacugccaacaucagucugaccgcuaucgcaaaucaggccgcuauucucauggggcucgacaagggguggcccaucagcaaaauggacaucggcgugccccuguuggcccucggaugcuauucccaagugaacccuuuaacccugaccgccgcgguacucaugcuaguagcgcacuaugccaucaucggcccggggcugcaggccaaggccacgcgcgaggcccagaagcgcacugccgcgggaauaaugaagaaccccacuguggacggcaucgucgcuauugaccucgaccccgugguguacgacgcuaaauucgagaagcagcuagggcaaaucaugcuacuuauccugugcaccucccaaauccuguugaugaggacgaccugggccuugugcgaaagcaucacguuagcgaccgguccgcucaccaccuuaugggaggggucacccggcaaauucuggaacaccaccaucgccgugaguauggccaacauauuccgcgggagcuaccuagcaggggcaggccucgcguuuagucucaugaagucccucgggggcgggcgaagggguacgggcgcccagggggagacccucggcgagaaguggaagagacagcugaaccaacuuucuaagagcgaguucaacaccuacaaacgcucggggauaauggaggucgacagauccgaggccaaggagggccuaaaacgaggggagaccacgaaacacgccgugagcagaggcacggcgaagcugcgcugguucgucgaacggaaccuagugaaacccgagggcaaagugaucgacuuagggugcggccgggggggcugguccuauuacugcgcagggcuuaagaaggugacggaggugaaggguuacaccaagggcggacccggccacgaggaaccgauccccauggccacuuauggguggaaccugguaaagcuacauucgggcaaggacgucuucuucaugccgccggagaaaugcgauacacuucugugugauaucggagaguccagcccaaacccuacaaucgaagagggucggacccugcgggugcucaagaugguggagcccuggcugaagggcaaccaguucugcaucaaaauccugaaccccuacaugccguccgucguggagacccucgaacagaugcaacggaagcacggaggaaugcuugugcgcaaccccuugagccggaacaguacgcacgagauguacugggucagcugcgguaccggcaacauaguguccgccgugaacaugacuucucgcaugcuccugaauagauucacaauggcccaccgcaagcccacguacgaacgggacguugaucugggcgcggggaccagacacguggcgguggaacccgaggucgccaaccuagacauuauaggccagcguaucgagaacaucaaaaacgagcauaaguccacauggcacuacgacgaggacaauccuuacaagaccugggccuaccacgguucguaugaggucaaacccuccggcagcgcuaguagcaugguaaauggggugguuagacugcugacgaagcccugggaugucauccccaugguaacccagaucgcgaugaccgauacaacgccguucggccagcagcgaguauucaaggagaaagucgacacccggacgccccgcgccaagcggggcaccacucagauuauggaggugaccgcaaaguggcucugggguuuccugucgagaaacaagaagccccgaaucuguacucgcgaggaguuuacccggaagguccgcucgaacgcugccaucggcgcggucuucguggaugagaaccaguggaacuccgccaaggaggccgucgaggacgagcgcuucugggaccugguccaccgcgagcgggagcuccauaagcaggggaagugcgcaaccugcguuuauaauaugaugggcaagcgcgagaagaagcucggggaguucggaaaagcgaaggggucccgggccaucugguacauguggcugggagcucgguuccucgaguucgaggcccucggcuucaugaaugaggaccacugguucucucgggagaacucccugucgggggucgagggcgaaggucugcauaagcugggcuacauccugcgggauaucucuaagauuccagguggcaauauguacgccgacgacacagcgggcugggauacaagaauuacagaggacgaccuccagaacgaggcaaagaucacggacaucauggagcccgagcacgcccugcuggccaccuccauauucaagcucaccuaucagaacaaggucgugcgcgugcagcgccccgccaagaacgggacggugauggacgugauuucgcgccgcgaccagcggggcaguggucaggugggaacguauggccucaacacauucaccaacauggaaguccagcugauucgccagauggaguccgaggggaucuuccuccccagcgagcuggagaccccgaaccuggcggaaagagugcuggacuggcuggaaaagcacggcgccgagaggcugaagaggauggccaucuccggagacgacugcguagucaaaccuauagacgaccgcuuugccaccgcccucaccgcccugaacgacaugggcaaagugcgaaaagacauaccccagugggagcccagcaagggguggaacgacuggcaacaggucccguucuguucccaccacuuucaccaacugaucaugaaggacgggcgcgagaucgucguucccugccggaaccaggacgagcucgucggucgugcccgggucagccaaggggcuggcuggucucugcgcgagaccgccugccugggcaagagcuacgcccaaauguggcagcugauguacuuucaccgccgcgaucugcgccuggcugccaacgccaucugcucggccgucccuguggacugggucccgacgagccgcacuacuuggagcauccaugcgcaccaccaguggaugaccacagaggauaugcucaguguauggaaccgaguguggauagaggaaaaucccuggauggaggauaaaacacacgucaguuccugggaagagguccccuacuuaggcaaacgcgaggaccaguggugcgggucucugaucggguugacggcgcgcgccacgugggcgaccaauauccagguagcgaucaaccagguccgccgccuuaucggaaaugagaacuaccuagacuacaugaccuccaugaagcgguucaaaaacgagagcgaucccgaaggggcacucugguaa

SEQ ID NO: 24059 - RNA, 9879 nt, Artificial Sequence
  derived and/or modified CDS sequence (opt11) from DENV-1__JN819425__SS-prME
uccgugacuauguugcucaugcuacugccgacugcccucgcauuccaccucaccacccgaggcggggagccccacaugaucgugagcaagcaggagcgggguaagagccuccuguuuaagaccucggcgggggugaacaugugcacccugaucgccauggaccugggcgagcuaugcgaggacaccaugaccuacaagugcccccgcaucaccgaggccgaacccgacgacguggacugcugguguaacgccaccgacaccuggguuaccuacgguaccugcucucagaccggcgagcaucggagggagaagcgaucaguggcccuggcgccccauguaggcuugggucucgagacccgaacugaaacuuggaugucguccgagggggccuggaaacaaauccagcgcgucgaaaccugggcgcugcggcaccccgguuuuacggucauagccuucuuccuggcgcaugccauuggaaccagcaucacccagaagggcauuaucuucauccucuugaugcuggucacacccuccauggcgaugcggugcgucggcaucggcaaccgagacuucguggagggucucagcggcgccacguggguggauguagugcuagagcacggguccugcgugaccaccauggccaagaauaagccuacccuggacaucgaacuccugaagacugaaguaaccaaucccgcgguccugcggaaacugugcaucgaggccaaaauuagcaacaccaccacggauucgagaugcccgacccagggcgaggccacacugguggaggagcaggaugcuaacuuuguaugucggcgcaccuucguggaccggggcuggggaaauggcugcgggcuguucgggaaagggagccuccuaacgugugcgaaguuuaaaugcgugaccaagcucgaggggaagauuguccaguacgagaaucuaaaguacuccgugaucgugaccguccauaccggcgaccagcaccagguugguaacgagacgaccgagcacggcaccaucgccaccaucacaccccaggcccccacgagcgaaauacaauuaaccgacuacggagcccugacccucgauuguagcccccggacuggccucgauuucaacgagauggugcugcucacgaugaaggaaaagagcuggcuggugcacaagcagugguuuuuggaccucccguugccauggacguccggggcauccaccagccaggagaccuggaacaggcaagaccuucuuguaacguucaaaaccgcccacgcgaagaagcaagagguaguggugcugggcagccaagagggcgcuaugcacaccgcucugaccggggccacugagauccagacaagcggcaccaccacgaucuucgccggacaccucaagugccgccuuaagauggacaagcugaccuuaaaggguauguccuaugucauguguaccgggagcuucaagcuggagaaagagguagcagagacccagcacggcacggucuugguccaggugaaauacgagggcacagacgcgcccugcaaaaucccuuucuccacccaggacgaaaagggagugacccagaacggccgccuaauuacggccaauccgaucgucaccgacaaggagaagcccguuaacauagagacggaaccaccauucggcgagagcuacaucguggugggcgccggcgagaaggcguuaaagcuguccugguucaagcgcgggucuuccaucggcaagauguucgaggcaaccgcccgcggcgcccggcgcauggccauccuaggcgauacugcgugggauuucgguagcauugguggcguguucacaagugugggcaaacuuguacaccagguguucggcaccgccuacggggugcuguucagcggagugucguggaccaugaagauugggaucggcauccuguugacuugguuaggccugaacucccgcaguaccucucucucuaugacaugcauugccgucgggauggugacacuguaccugggcgucauggugcaagccgacagcggaugcgugaucaacuggaaggggcgcgagcucaaaugcggguccggcaucuuugucacgaaugagguacacacuuggacggagcaguauaaguuccaggcugacagcccgaagcggcuuuccgcggccaucggcaaggcgugggaagaggggguguguggcauccgauccgcgacccggcuggagaauauaauguggaaacaaaucagcaacgagcuuaaccacauccugcuggagaaugacaugaaguucaccgucgugguuggggaugcgaacgguauucuagcgcaggggaagaagaugauccguccccagccuauggagcacaaguacuccuggaaguccuggggcaaggccaaaauaaucggagccgacauccagaacacgaccuuuaucaucgaugggccugauaccccggagugcccagauggccaaagagccuggaacaucugggagguagaggauuauggcuuuggcguguucacuaccaacaucugguugaagcuccgcgacucuuacacccagaugugcgaccaccgucucaugagcgcggccauuaaggacuccaaggccgugcacgccgacaugggauacuggaucgaaucggagaagaacgagacuuggaaacuggcgcgcgcuaguuucaucgaggucaaaaccugcaccuggcccaaaucucacacguuaugguccaacggagugcucgagucagaaaugauaauccccaagaucuacggaggcccgaucucccaacacaacuacagaccggguuauuuuacgcagacagccgggcccuggcaccuggguaagcuggaacucgacuucgaccucugugaagguacgaccgugguuguggacgagcacugcgggaauagaggaccuagucugcggacgaccacggugacggggaagaucauccaugagugguguuguagguccuguacauugccgccucugagguuccgcggcgaggacggguguugguacggcauggagaucaggcccgugaaagaaaaggaagagaaccuaguucgcagcaugguguccgcgggcagcggcgagguggauagcuuuucccuggggauccuaugcgugucaaucaugauagaggaggugaugcggucccgcuggucgcgaaagaugcugaugaccggcacucuagccguauuucugcugcucaucaugggccagcuaaccuggaacgaccuaauccggcucugcaucauggugggcgccaacgcgucagaucggaugggcaugggcacaaccuaucuggcucugauggccacuuucaagaugcggcccauguucgcagugggccuccuguuccgccggcugaccagccgugagguccuccugcugaccauugggcucucccucguggcaagcgucgagcugcccaacucucucgaggaacugggggacggccuggcgaugggcauaaugaugcugaagcugcugaccgaguuccagccccaccaacucuggacgacccugcugucguugaccuuuguaaaaacgacgcuuucccuggacuaugcauggaagaccacggccauggugcucagcaucgucucccuguucccccugugcuuaaguaccacgucccaaaagacaacuuggcugccgguccugcucgggagcuucggcugcaagcccuugaccauguuccucauuaccgaaaacaagaucuggggccggaaguccuggccccugaacgagggcaucauggcgauagguauuguaucgauccugcuaucaagccugcugaaaaacgaugucccccuggcuggaccacucaucgccggagggauguuaauugccugcuacguaaucagcggcuccagcgccgaccugucccucgagaaggccgugaagauuucuugggagcaggaggcggagcauuccggcgccagccacaauauccuggucgaggugcaggacgacggcacaaugaaaaucaaggacgaagagagagacgacacccucacgauucuccuaaaagccacccugcuagccguguccggaguauaccccaugagcauaccagcgacacuguucgucugguauuucuggcaaaagaagaagcagcgcucuggcguucucugggacacccccagcccuccugaggucgaacgcgcggugcucgaugacgggaucuaccgcaucuuacagcgcggguuauuaggccggucccaggugggggucggaguuuuccaggacggaguuuuccacaccauguggcacguaacgcgcggugccgugcugauguaccagggcaaacggcuggagcccagcugggcgucggucaaaaaggaucugauuucauacgggggcggguggcgcuuccaaggcuccuggaacacaggcgaggaaguccagguuauagccguagagcccggcaagaacccgaagaacguccagaccacccccgggaccuuuaagacacccgagggggaagugggcgcaaucgcgcuagacuucaagcccgggaccucaggauccccgaucgugaaccgggaaggcaagaucgucgggcuguacgggaacggaguugugacgaccagcgguacauacgucagcgccauugcccaagccaaagcaucucaggaggguccccuaccggagaucgaggacgagguuuucaagaagcggaaccuuaccaucauggaccuacacccugguagcggcaagacccggcgcuaccuccccgcgauugugcgggaggccaucaagagaaaacuacgcacccugaucuuagccccaacucgaguaguggcuuccgagauggccgaggcuuuaaaggggaugcccauccgcuaccagaccaccgccgucaaaagugaacauaccgguagggaaaucgucgaccuaaugugccaugccaccuucaccaugaggcugcucuccccggugcgaguucccaacuacaauaugauuaucauggacgaggcccacuuuaccgaccccgcgagcaucgccgcccgcggguacaucuccacccgggucgguaugggggaggccgccgcuaucuucaugaccgccacaccacccggaucaguggaggcauuuccgcaaucaaacgcaguuauacaagaugaggagcgcgacaucccugagaggagcuggaacucugguuacgauuggauaacggacuuucccggaaagaccgucugguucgugcccuccaucaaaaguggaaacgacauagccaauugucugcgcaagaacgggaagcgcgugauucagcugagucgcaagacguucgauaccgaauaccagaagaccaagaacaaugacugggauuacgucguuaccacggacaucagcgagaugggggcgaacuuccgggccgaccgugugaucgauccccggcgaugccucaagcccguaauccugaaggacgggcccgagcgggugauccuggcuggucccaugcccguuacagucgccagcgcggcccagcgccgaggccgcauagggcgcaaccagaacaaggagggggaccaguacguguacauggggcagccucuaaauaaugacgaggaucacgcccacuggaccgaggcgaagaugcugcuagacaacauuaacacccccgagggcauaauaccugcccucuucgaacccgagcgggaaaagagcgcggccauugacggggaguacaggcugcggggagaggcuagaaagacguucgucgaauugaugcgucgcggcgaccucccggugugguuaagcuauaaaguggccuccgaaggguuccaguacagugaucggcgcuggugcuucgacggugagcguaacaaucaaguccucgaggaaaacauggauguggagauauggacgaaggagggggaacgcaaaaagcugcggccccgcuggcuggacgcccggacguacuccgauccgcuggcgcuccgcgaguucaaggaguucgcagccggccgccgcagcguaagcggggaccugauccuggagaucggcaagcucccgcagcaucugaccuuacgggcacagaacgcccucgacaaccucgucauguuacacaauuccgaacagggcggaaaggcguaccgacaugccauggaggagcuccccgacaccauugagacgcugaugcuguuagcccuaauugccguccugaccggagggguaacacuguucuuccugagcggcaagggcuuagggaagaccuccauaggucuacugugugucacugcuagcucagcccuguuauggauggcuagcguggagccccauuggauugccgcuagcauuauccuggaguucuuccugaugguccuacugaucccagagcccgaucggcagcgcacgccucaggacaaccagcuggcguacguugucaucggccuccucuucaugaucuuaaccguggccgccaacgaaaugggucucuuagagaccacaaagaaggauuuggggauaggcuacguugccgcagaaaaccaccagcacgcgaccaugcucgacguagaucuacacccggcuagcgccuggacccuguacgcuguggccaccaccgucaucacccccaugaugcgacacacaaucgagaacaccacggcgaauaucagucucaccgccaucgccaaccaggccgcuauacugaugggcuuagacaagggguggccuaucagcaagauggacaucggcguucccuuauuggcguuaggaugcuacucccaggugaacccgcucacccuuaccgcggcuguccucaugcucguggcccacuacgcgauaaucggcccaggucugcaggcuaaggcaacgcgagaggcccagaagagaacugccgcgggcaucaugaaaaaccccacuguggacggcaucguagccaucgaccuggaccccgucguguaugacgccaaguuugagaagcagcucgggcagaucauguuacugauccuaugcaccagccagauucugcugaugcguacgaccugggcacugugcgaguccaucacauuggccaccggaccgcuaacuacucuaugggaggggucgcccggcaaguucuggaacaccacuauagcggucaguauggccaacaucuuccgcggcucuuaccuggccggggccggccuggccuucucccucaugaagucccucgggggaggaaggcgcgguacgggcgcgcagggugagacccuaggcgaaaaguggaaacggcagcucaaccagcuuuccaagagcgaguuuaacaccuauaagcgcagcgggaucauggaaguggaucgaucugaggccaaggaaggccugaagcgcggcgagaccacuaaacacgccgugucccggggcacagcaaaacuccguugguucguggaacgcaacuuaguuaagcccgagggcaaagugaucgaucuggggugcggccgcggaggcugguccuacuacugcgcggggcucaagaaagucaccgaagugaagggcuacaccaaaggaggccccggucaugaggaaccgauuccgauggcuaccuacggguggaaccucgugaaacugcacuccggcaaggacgucuucuucaugccgcccgagaagugcgacacgcugcuuugcgauauuggggaguccagucccaaccccacgaucgaggaaggccggacccugcgcgugcugaaaaugguagaacccuggcuccggggcaaccaguucugcauaaagauccugaaccccuauaugccguccgucguggagacucuggagcaaaugcagcgcaagcacgggggaauguuagucagaaacccccugagccgcaauuccacgcaugagauguauugggucagcugcgggaccggcaacauagugucugccguaaauaugaccagcagaaugcugcucaauagauucaccauggcacaucgcaagcccacguaugaacgugacguggacuugggcgccggaacccgccauguggcgguggagccggaagucgcuaaccuggauaucaucggccaacggaucgagaacaucaagaaugagcacaaguccaccuggcacuacgacgaagacaauccguauaaaacuugggcguaccacgggucuuaugaggugaagcccuccggcagcgcuucgaguauggugaacggggugguucgccucuugaccaagccaugggacgucauuccuauggucacccaaauagccaugacagauaccacacccuucggccaacaacgaguauucaaagaaaaagucgacacccgcacuccccgugccaagcguggcaccacgcagaucauggaggugacggccaaguggcugugggguuuccucucccgaaacaagaagccccgcauuugcacccgcgaggaguucacccggaaggugcguuccaacgccgccaucggagccguauucguggacgagaaccaguggaacagcgcuaaggaggccguugaggaugagcguuuuugggaccugguccaucgggagagagaacuucacaagcaagggaagugugccacgugcguauacaacaugauggguaagcgggaaaagaagcucggagaguucggcaaggccaaggguuccagagcgaucugguacauguggcugggggcucgguuucuggaguucgaggcccucggauucaugaaugaagaccacugguucagccgcgagaacucacugagcgggguagagggcgaaggauuacauaagcucggcuacauccugcgugacaucucuaaaauuccgggcgggaacauguacgccgacgacaccgccggcugggacacaagaaucacugaggaugaccugcaaaacgaggccaagaucacagacauaauggaaccagagcacgcccuccuggcaaccucuauuuucaagcugaccuaccagaacaaggucgugcguguacagaggccggcuaagaacgggaccguaauggacgugaucuccagacgggaucagcgcggcagcggccagguugggacguacggucucaacaccuuuaccaauauggagguucaacugaucagacagauggaguccgaggggaucuuccugcccagcgagcucgagacccccaaucuggcagagcgcgcucuugacuggcuagagaagcacggcgccgagcgucugaagcgcauggccaucagcggugacgacugugucgucaagccaaucgacgacagauuugccaccgcccucaccgcgcucaaugauauggggaagguuagaaaggacauuccucaaugggagcccucuaagggcuggaacgacuggcagcaggucccuuuuuguucccaucauuuccaccagcugauaaugaaggacgggcgcgagaucgugguccccugccggaaucaggacgagcuggugggccgggcucgcguuagccagggcgccggcuggucccuccgggaaaccgccugccuggguaaaagcuaugcucagauguggcagcugauguauuuccaccggcgggaccuaaggcuggcggccaacgccaucugcuccgcgguccccguggauugggugccaaccagccgaacaacguggagcauccacgcgcaccaccaguggaugacaaccgaggacaugcugucagucuggaacaggguguggauugaggagaauccguggauggaggacaaaacccacgugagcuccugggaggaggucccuuacuuggggaagcgagaggaucaguggugcggcagccugauugggcugacagcccgggcgaccugggcuaccaacauccagguggccaucaaccaagugcgccggcucaucggcaaugaaaacuacuuagacuacaugaccuccaugaagcgcuuuaagaacgagagcgacccggaaggugcacugugguga

SEQ ID NO: 24060 - RNA, 9879 nt, Artificial Sequence
  derived and/or modified CDS sequence (opt11) from DENV-1__FJ850099__SS-prME
ucaguaacuaugcuacucaugcuccugccuacggccuuagcguuccaccugacuacacgagguggagaaccccacaugauagucuccaagcaagaacgcgggaaaagccuccuauucaaaacaucagcaggaguaaacauguguaccuuaauugccauggaccuaggugaacucugcgaagauacuaugacauacaaauguccuagaauaaccgaagccgaacccgaugacguagacugcugguguaaugccaccgacacuugggugacauacgggacaugcagucagacgggggaacaccgacgggacaaacgcucuguugcccucgcgccucaugucggacuaggguuggaaacgcgaacugaaacauggaugucaucugaaggugcauggaagcagauccaacgaguagaaacuugggcacugagacaccccggauuuacgguuauagcacuauuucucgcacacgccauuggcacgagcauuacgcagaaggggauaaucuucauacuucugaugcuugucacgccaucuauggccaugcgcugcguuggaauagguaauagagacuucgucgaagggcucucgggagccacuuggguagacgucguacucgaacacggaagcugcgugacuaccauggccaaaaacaagcccacucuagacaucgaacuccugaagacggaaguuacuaaccccgcaguccuccgcaaacuaugcaucgaagcgaagauaaguaacacaacgacggacagucgcuguccaacucagggagaagcaacccuuguggaagaacaagacgcuaacuucguaugcagacgaacauucgucgacaggggauggggaaacgggugcggauuauuugggaaaggaagccuccuaaccugugcgaaguucaaaugcgucaccaagcuagaaggaaaaaucguccaauacgaaaaccuaaaauauagcgucauagucaccguacacacaggcgaccaacaccaagucggcaacgaaaccaccgagcacgguaccauagcgaccauaacuccccaagcaccgaccagcgaaauacagcuuaccgacuacggcgcacugacccucgacugcucuccacgcaccggccucgacuucaacgaaaugguacuccugaccaugaaagagaaaagcuggcugguacacaaacaaugguuccuagaccuuccgcuacccuggacaagcggugccucgaccucacaggagacauggaaucgccaagaccuccuagugaccuuuaagacugcacacgccaaaaagcaggaagugguuguucuaggaagccaggagggagccaugcacaccgcucuaacgggcgcaaccgaaauccagacaaguggcacuacaacaauauucgcagggcacuuaaagugcagacucaaaauggacaaacucacccucaaaggaaugaguuacguuaugugcaccggauccuucaaacucgagaaggaagucgcggagacccaacacggcacagugcugguacagguaaaauacgaagguacggaugcucccuguaaaauacccuucucaacccaagacgaaaaaggggugacacaaaacgggcggcugaucaccgcaaaccccauaguaacggacaaagaaaaaccuguaaauauugagacggaaccacccuucggagaaaguuacauaguagugggugcgggggaaaaggcacuuaaguuaucgugguucaaaaaggggaguagcaucggaaaaauguucgaagccacggcacgaggggcgaggagaauggccauauuaggugauaccgcaugggacuuuggcucgaucgguggaguuuucacgagcgugggaaaacugguacaucaaguguucggcacagcauacgggguacuauucuccggggucagcuggacaaugaagaucggaauugguauacuacuaacaugguugggccucaauagccggagcacaagccucucaaugacgugcauagccguggggaugguaacacucuaccugggcguaauggugcaagcggacagcggaugugucaucaauuggaagggacgggagcucaaguguggaaguggcauauucgugaccaacgaaguacacacguggacagaacaguacaaauuccaagccgacucgccuaagcgauuaagugcagcgauaggcaaagcaugggaagaaggcguaugcggaauacggagcgcgacaagguuggaaaacauaauguggaagcagaucucaaaugagcucaaccacauccuacuugaaaaugacaugaaauucacgguagugguuggagaugcaaacggcauccucgcccaaggcaagaaaaugauccgaccucaaccaauggagcacaaauauucauggaaaaguuggggcaaagcgaagauaauaggagcagacauccaaaacacgacauucauuauagacgggccggauacuccggaaugcccggacgggcaacgcgcauggaacaucugggagguagaagacuacggcuuuggaaucuucaccaccaacaucuggcuuaaacugagggacucuuacacgcaaaugugcgaccacaggcuaaugucagccgcgauuaaggauagcaaagccguccacgccgauaugggauacuggaucgaauccgagaaaaaugaaacuuggaagcucgcaagagcgagcuucaucgagguaaagacuugcacguggccgaagucucacacccuauggucaaacggcguacucgaaagcgagaugauaauaccaaagauuuacgggggucccauaagccaacacaacuaccgaccgggguacuuuacacaaacggccggccccuggcaccucggaaaauuggagcucgacuucgacuuaugugaggggacaaccgugguaguagaugaacacugcgguaaucgugguccaagccugcggacaacaacaguaaccggcaaaaucauucacgaguggugcugcaggaguugcacguuaccgccccuccgcuuccgcggagaagaugggugcugguaugggauggagauacggccugucaaagaaaaagaagagaaccuaguccggagcaugguaucagcaggcagcggagaaguagacucauuuagcuuagggauucucugcgugagcauaaugaucgaagaaguuaugaggagccgguggagcagaaagauguugaugacagggacccuagccguguuccuacuucugauuaugggccaacucacauggaaugaccucauucgucucugcauaauggucggcgccaaugcaucggacaggaugggcauggggacaacauaucuggcccuaauggcgaccuucaagaugaggcccauguucgcaguaggauugcuguucaggagguuaaccagcagggaaguccuacuccuaacaaucggcuuauccuuaguagccaguguagaacugccuaacagccuagaggaacuaggagacggccuugcaaugggaauaaugaugcuaaaacuucucacagaguuccaaccccaucagcucuggacgacccuccuaagccuaaccuucgugaaaacaacucuaagucuagacuacgcguggaagacaacggcgaugguauuaagcauagucagccuauuucccuuaugccugucaacuaccagucagaaaaccaccuggcuucccguccuacuaggaucauucgggugcaagccccugacgauguuccucauaacagagaacaagauaugggggaggaagucuuggccucuuaacgaaggaaucauggccauaggcaucguaagcauacugcuguccagucuacugaaaaaugacguaccccucgccgguccccucauagcgggaggcaugcucaucgccugcuaugugauaagcgggagcagcgcggacuugucgcuagagaaggccgcugaagugagcugggagcaagaagcggagcauucaggagcgucucacaacauccucguagagguccaagacgacggaacuaugaaaauaaaagacgaagaacgggacgacacgcucaccauacuccugaaggccacacuacuggcuguaagcgguguauaccccaugagcauaccagcuacccuguuugugugguacuucuggcagaagaagaaacagcguagcggugucuugugggacacgcccagcccaccggaaguugaaagagccguccuagacgacggaaucuaccgcauccuccaacgaggccuacuagggagaagccaagucggaguaggcgucuuccaggacggcguauuccacaccauguggcacgucaccagaggggccguacugauguaccaagggaagcggcuagagccaucgugggccagcgucaagaaagaucugauaagcuauggcggcggcuggcgcuuucaggggucauggaacacaggagaggaagugcaaguaauagccgucgaacccggcaaaaaucccaaaaauguccagacaacaccggggaccuucaagacaccggaaggagaggucggagcaaucgcccuagacuuuaagccgggcaccucagggagccccauaguaaaccgagaagggaagauagucggccuuuacggcaacggaguuguaaccaccaguggaacguacgucagugccaucgcccaggcaaaagccucgcaggaagggccucugccugaaauugaggacgagguauucaaaaagaggaaccucacgauaauggaccugcacccaggauccggaaagacgcgccgcuaccuucccgcaauuguacgcgaagcuaucaagcggaaauuacgcacccucauacuugcgccaacacgggugguggcaagcgaaauggccgaagccuuaaagggaaugccaauacgauaccaaaccaccgcggucaaaucggaacacaccggacgggaaauuguugaucuaaugugucaugcaaccuucacaaugcgauuacuaucaccaguacgaguccccaacuauaacaugauuaucauggacgaagcgcauuuuacugaccccgcaucuauagccgcacggggauacauuucgacucggguugggaugggggaagcggcggccauauucaugacggcaacgccacccggcuccguggaagcauucccgcagagcaacgcgguaauccaggacgaggagagagacaucccagaaagauccuggaacucaggcuacgacuggauuacggacuucccagggaaaacgguaugguuugucccgucgauaaaaagcgggaacgacauugccaauugccucaggaaaaacgguaaacgaguaauacaacuaucccgaaagaccuucgacacggaauaccagaaaaccaaaaacaaugacugggacuacguugucacgaccgauaucucagaaaugggcgcaaacuucagagcagacagagucauagaccccagacggugcuugaaaccagugauauuaaaagacgggcccgagagaguaauccuugcaggaccaaugccugugacaguagcaagcgcggcccagagaagaggacggauuggaaggaaucaaaacaaagaaggcgaccaauacgucuauaugggacaaccgcuaaacaacgacgaggaucacgcacacuggacagaggcaaaaaugcugcuggacaacauaaacacccccgaagguaucauaccugcucuauucgaaccggaaagggagaaaagcgcugcgauagauggcgaguauagguuaaggggagaggcuagaaagacauucgucgaguugaugcgaaggggagacuuaccaguauggcuaucauacaagguggcaucagaagguuuucaauauagcgacaggagauggugcuucgacggggaacgcaacaaccaaguucucgaggagaacauggacguagagaucuggaccaaggagggagagagaaagaaacuccggccucgauggcuggacgccagaacguacucagacccacuagcccucagagaauuuaaggaguuugccgcggggcguagaagcgucucaggagaccucauacucgaaauaggcaagcugccccaacaccucacacucagggcacagaacgcgcuagacaaccuggucaugcugcacaacucggaacaaggagggaaggccuaccgacacgccauggaggaacucccggacacgauugaaacacugaugcugcuagcccuaaucgcagugcucacgggagguguaacacucuucuuuuuaagcgggaagggucuggggaaaacaucaauaggccuacuaugcgugacugcguccucagcccugcuguggauggcaucugucgagccucacuggaucgcugccucaauaauccucgaguucuuccugauggugcuguuaauaccggagccagaccggcaacgcaccccacaagauaaccagcuagcauacgucgucaucggauuacuauucaugauacucaccguagcagcaaacgaaauggggcuacuagaaaccacgaagaaagaccuagggauaggauauguagcggcggagaaccaucaacaugcaacgaugcucgacguggaccugcgcccggcaagugcguggacgcucuaugcaguggccacaacaguaaucaccccaaugaugcgacacaccaucgagaacacgaccgccaauauuagccucaccgcaauagcgaaucaagcggcaauacucaugggacucgauaaaggguggccgaucucaaaaauggacauuggcgugccucugcuagcccuuggguguuacucucaagugaauccacuaacccugacagccgccguccugaugcuagucgcacauuaugcgauuaucggaccuggucuucaagccaaagccacgcgggaggcgcagaagcggacagcugcaggaauaaugaaaaacccaacagucgacgggaucguugcgauagacuuggaccccguagucuaugaugcaaaauucgagaagcagcugggccaaaucaugcuccugaucuuauguacaucccagauacugcuuaugcgaacaacuugggcacugugugagagcaucacccucgcgacgggaccgcuaaccacacugugggaaggcuccccagguaaauuuuggaacacaacgaucgcagucagcauggccaacauauuccguggaaguuaccuugcgggcgccgggcucgcguucucacugaugaaaagccucgguggcggucgacguggcacuggggcacagggagaaacucucggcgagaaguggaaacgacagcuaaaucaacucagcaaaucggaguucaacacauauaagcgauccggcaucauggaaguagaucguuccgaagcaaaggaaggccugaagagaggggaaaccaccaagcacgcggucuccagaggaaccgcaaagcugaggugguucgucgaacgaaaccucgucaaacccgaggggaaagugauagaccugggaugcggacgcgguggguggagcuacuauugcgcgggccucaagaaaguuacugaggucaagggcuacacgaaaggcggcccaggucacgaggaaccgauuccaauggcaacguacgguuggaaccuugugaagcuccacagcggcaaagacguguucuuuaugccacccgagaaaugcgauacacuucuaugcgauauaggagagagcucccccaacccaaccauugaagaaggccgcacccuacgcgugcucaaaaugguagaaccguggcuuaagggaaaucaauucugcauaaagauacucaauccauacaugccgagcgucguugaaacccuagagcaaaugcagcgcaaacauggagggauguugguccgaaacccgcuaagccgaaacagcacccacgagauguauuggguauccugcggaacagguaacauaguguccgcagucaacaugacauccaggaugcucuugaaccgcuuuacgauggcccaccgcaaacccaccuaugagcgagacguagaucucggagccggcacccgccacgucgcaguggaacccgaaguagcaaaccuggacauuauagggcaacgaaucgaaaacaucaaaaacgaacacaaaaguaccuggcauuaugacgaggauaacccguacaaaacuugggcauaccauggaucauacgaaguaaagccgagcggaagcgcaucgucaaugguaaacggagugguccgccuacuaaccaagccgugggacgucauaccgauggugacccaaauagcaaugacagacacaacgccauuuggccaacagagaguguucaaagaaaaagucgauacccgcacaccgcgagccaagagaggcacgacacaaauaauggaaguaaccgcgaaauggcuauggggauuccuaucaaggaacaagaagccgcggauuugcacacgagaagaguucacacgaaaagugcgcuccaacgcagccauaggagcagucuucguagaugagaaccaauggaacucagcgaaagaggcaguugaagaugagcgguucugggaccugguacaccgcgagcgagagcugcauaaacagggcaaaugcgcaacgugcgucuacaacaugaugggcaaaagggaaaagaaguuaggagaguucggaaaagcgaaggggaguagagcaauaugguacauguggcucggcgcccgauuccuggaguucgaagcgcuaggauuuaugaaugaagaucauugguucagccgagaaaacucuuugagcggugucgagggugaaggacuccacaaauugggguauauauugcgagacauuaguaaaaucccgggagggaacauguacgcagacgacaccgcugggugggacacccggauaacagaagaugacuuacaaaacgaagccaagauaacggacauaauggagccugagcacgcguuacucgcgaccucuaucuucaaguugacuuaucaaaauaaaguaguaagagugcaacggccggccaaaaacggaacagucauggacguaauaagccgaagagaccagcgcggaucgggacagguaggaacguacggucuuaauaccuucacuaauauggaaguacaacuaauacgccagauggaaucggaggggaucuuccugagcagcgagcucgagaccccuaaccuggcagagcggguccuggauuggcuagagaagcacggcgcagaacggcucaagcggauggcgauaaguggggacgauugcgucguuaaaccgauagacgaccgauucgcgaccgcgcuaaccgcgcucaacgacaugggaaaaguccgcaaggacaucccacaaugggagccaagcaaaggauggaaugacuggcaacaggucccguucugcucacaccacuuccaccagcuaauaaugaaagacgggcgcgaaaucgucguaccuugcagaaaucaggacgagcuagucggucgcgcccgcguaagccagggugcaggguggucucugagagagacggcaugccuaggaaagagcuacgcacaaauguggcagcucauguauuuccaccgccgcgauuuacgccuggccgcgaacgccauaugcagugccguccccgucgauugggucccaacgagcagaacaaccuggagcauucacgcacaucaccaauggaugacaacagaagacaugcuuuccguuuggaaccgggucuggauugaggaaaacccuuggauggaagauaaaacgcauguaagcucgugggaagaaguuccuuaccuggggaagcgggaggaccaauggugcgggagccucauagggcucacagccagagcaacaugggcaacgaacauucaagucgccauaaaccaagugagaagacugauaggaaacgaaaacuaccuggacuacaugaccucaaugaaaagguucaaaaacgagucggaccccgagggggcuuuaugguga

SEQ ID NO: 24061 - RNA, 9879 nt, Artificial Sequence
  derived and/or modified CDS sequence (opt11) from DENV-1__FJ850100__SS-prME
agcgugacaaugcugcugaugcuacuucccacugcgcucgccuuccaccugacaacccgcggcggugagccacacaugaucguaagcaagcaggagcgggggaagagccugcuguucaaaaccagcgccggggugaauauguguacccuaaucgccauggaccugggagaguuaugcgaggacaccaugaccuacaaguguccccgcaucaccgaggccgagcccgaugacguggacugcugguguaacgcuaccgacaccugggugaccuacgguaccugcagccagacaggcgagcauagacgcgacaagcgcucaguggcacuggcgccccacgucggccuagggcuugagacccgcaccgagacauggaugagcuccgaaggcgccuggaagcagauccagcggguugagacgugggcacuucgccaucccgguuucacaguaaucgcacuguuucucgcgcacgcgaucggcaccagcaucacccaaaaagggaucaucuucauccuacugauguuagugaccccguccauggcgaugcgaugcgucggcaucggcaaccgcgacuuuguggaaggacugucaggcgccacguggguggaugucguucuggaacacggcuccugcgucaccaccauggcgaagaacaagcccacccucgacaucgagcugcugaagacugagguaaccaacccagcggugcucaggaagcugugcauugaggcuaagaucagcaacaccaccacagacucacgaugcccgacccagggcgaggcuacccugguugaggagcaagacgcgaacuucguaugucgccgcaccuucguggacaggggcugggggaauggcugcggguuguucggcaaggggagccugcugacgugcgccaaguuuaagugcguuacgaagcuggaggggaaaauaguccaguaugagaaucugaaguacucggugaucguuacaguccacaccggugaccagcaccaagucggcaaugagacgaccgagcauggaacuaucgcuaccauaacgccccaggcccccacuagcgagauccagcucaccgacuacggggcgcucaccuuggacugcagcccucgcacaggccuggacuuuaacgagauggugcuccucacaaugaaggagaagaguuggcugguccacaagcagugguuccucgaccugccguuacccuggacuucgggggcgagcaccagccaggagaccuggaacagacaagaucuccuugugacguucaagaccgcccacgcaaaaaagcaggaagucguggugcugggcucccaggagggcgccaugcauacagcccucacuggagcgacugagauccagaccagcggcaccaccacgaucuucgccggacaucugaaaugucgccugaagauggauaaacucacccugaagggcauguccuacgucaugugcaccgggucauucaaguuagaaaaggagguagcggaaacccagcacggcacagugcuggugcaaguaaaguacgaggguaccgacgcccccugcaagaucccuuucuccacccaggacgaaaagggcguuacccagaacggccggcucaucacggccaacccgaucgucaccgacaaggaaaagcccgugaacauagaaaccgagccucccuuuggggaaaguuacaucguggucggcgcgggagagaaggcucugaaacuguccugguucaagaaggggagcucuauagguaagauguucgaggccaccgcccgcggggcgcggagaauggccauucucggcgacacggcuugggacuucggcagcaucggcgguguuuucacguccguagggaagcugguccaccagguguucgggaccgcauauggggugcuguucagcggcgucucguggaccaugaagaucggaaucggaaucuugcugacguggcugggacugaacagccgcuccaccagucugucuaugaccugcaucgccguggggauggugacccucuaucucgggguuaugguucaagccgacagcggguguguaaucaacuggaagggccgggagcuuaagugcggcaguggcaucuucgucacgaaugaggugcacacguggaccgaacaauacaaguuccaagcugacaguccgaagcgacucagcgcggcgaucggcaaggccugggaggagggggugugcggcaucagauccgccacacgucucgagaacaucauguggaagcagaucagcaaugagcugaaucacauacugcuugagaacgacaugaaguucacagugguggugggggaugcgaacggcauccuggcgcaggggaagaagaugauccgcccacagcccauggagcacaaguacucauggaaguccuggggcaaggccaagaucaucggcgccgacauccaaaacacgaccuucauaaucgacgggcccgacaccccggaguguccagauggccagcgcgccuggaacaucugggaagucgaagauuacggguucggcauauucaccacgaauauuuggcuaaaacuccgggacucuuacacucaaaugugcgaccaucgccugaugagcgcggccaucaaggacuccaaagccgugcacgcggacaugggcuacuggaucgaaagcgagaagaacgaaaccuggaagcuggcccgggccaguuucaucgaggugaagaccugcacguggcccaagagccacacccucugguccaaugggguccuggaaucagagaugauuauacccaagaucuacggcgggccgaucagccagcacaauuaccgccccggauacuucacacaaaccgccgggcccuggcacuugggcaagcucgaguuagacuucgaccugugcgagggcacgacggugguggucgacgagcacugugguaacagaggccccagccucaggaccacgacggugaccgggaagauaauucacgagugguguugccgguccugcacgcugccgccacugcgauuccggggugaggacgggugcugguacggcauggagaucagacccgugaaggagaaagaggagaaccucguacggagcaugguguccgcgggcagcggggagguggacagcuucucccugggcaucuugugcguuagcauaaugaucgaggaaguaaugcgcuccagguggucccguaagaugcucaugacaggcacgcuggccguguuccuuuuacugaucaugggccagcugaccuggaacgaccucauucgucugugcaucauggucggugccaacgcauccgaccgaaugggcaugggcaccacccaccuggcccucauggccaccuucaagaugcggccuauguuugccgugggucugcuguuucggcgccuuaccagccgcgagguccugcugcuuaccaucggcuuaagccuaauggccagcauggagcugcccaacucccuugaggagcugggggacggccucgccaugggcaucaugauguugaagcuacuuaccgaguuucagccccaucaacuguggacuacccuacucagcuugaccuucgucaagaccacgcuguccuuggacuacgccuggaagaccacugccaugauccugagcaucgugucccuguucccccucugccugagcacaacgagucaaaagaccaccuggcugccgguccuccugggguccuucggcugcaagccacugaccauguuucuuaucaccgaaaauaagaucuggggucgcaaguccuggccgcucaacgagggcaucauggcgaucgggaucgugagcauccugcucagcagccuucucaagaacgacgugccccucgcggguccgcugaucgccggcgggaugcucauugccugcuacgucauaagcggcuccagcgccgaucucucccuggagaaggcggcggaaguauccugggagcaggaggccgagcacuccggcgccagccacaauauccucguggagguccaggacgacgguacgaugaagauuaaggacgaggagagggacgacacacuaaccauccugcugaaggccacucuccuggcggugucggguguguaccccaugucaauccccgcaacgcuuuucgucugguacuuuuggcagaagaagaagcagcgcuccggugugcucugggacacccccucgccgcccgaaguggaacgggccguccucgacgacgggaucuaccgcauccugcagcgaggacuguuaggccgaucccagguaggggugggcgucuuccaggacgggguguuccacaccauguggcaugugacaaggggagcaguccugauguaccagggcaagaggcuagaacccagcugggccuccgugaagaaggaccucaucaguuacggggggggguggcgcuuccaaggcucauggaacacgggggaggaggugcagguaaucgccguugagccagggaagaacccaaagaacguccagaccacucccggcaccuucaagacgcccgaaggugaagucggggcgauugcacucgacuucaagcccgggaccagcggcuccccgaucgugaaccgcgagggaaagaucgugggacuguacgguaacgggguugugaccacgagcggcacguauguguccgccaucgcccaggccaaagcgagccaggaggguccccucccugagaucgaggacgaagucuucaagaagaggaaccucacgauaauggaccugcacccggguagcggcaagacucgcagauaccuccccgccaucgugcgggaggccaucaagcggaagcugcgcaccuuaauccucgccccgacgcgcgucguggcguccgagauggccgaggcccugaaggggaugcccauccgguaccagaccaccgccgucaaaagcgagcacaccggccgcgagaucguugaccugaugugccacgccacguucaccaugcgguuacuguccccgguacgcgugcccaacuacaacaugaucauaauggacgaggcgcacuucacagaccccgccagcaucgccgcuaggggguacaucagcacccguguggggaugggggaggccgcggccaucuucaugacggcaacgccgcccggcagcguagaggccuucccccaauccaacgccgugauccaggacgaagaacgugacaucccggagcgcagcuggaacuccggcuacgauuggaucaccgacuucccggggaagaccgugugguucguaccgagcaucaaguccggcaacgacaucgccaacugccuccgaaagaacgguaagcgcgugauacaauugucccggaagacguucgacaccgaguaccaaaagaccaagaacaacgacugggacuauguagucaccacggacaucuccgaaaugggagcaaacuuccgcgccgaucgggugaucgauccgaggcggugccugaagccugugauccuaaaggaugggcccgaacgcguaauucucgccgggcccaugcccgugaccguggccagcgcagcccagagacgcggccguaucgggcgcaaucagaacaaggagggcgaccaguacguuuauauggggcagcccuuaaacaacgacgaggaccacgcccacuggacagaggcaaaaaugcugcucgacaacaucaacacccccgagggcauuaucccggcgcuguucgagcccgagcgcgaaaaguccgcggccaucgauggggaguaccgucugagaggcgaggcccguaagacguuuguggaguuaaugcgccggggcgaccugcccgucuggcugagcuacaaaguggccuccgagggguuccaguacagcgaccgcagguggugcuucgacggagaacgcaacaaccaagugcucgaggagaacauggacguugagaucuggaccaaggagggggagcggaagaagcugcgccccagauggcuagacgcgcgaacauacuccgacccacucgcccugcgggaguucaaagaguucgccgccggccgccgcucagugucgggugaccugauccucgagauugggaaacugccucaacaucugacccuccgcgcacagaaugcgcuggacaaccuggucaugcuccacaacagcgagcagggcgggaaggcauaccggcacgccauggaggaguugccugacaccaucgagacccugauguugcuagccuugauugcgguccucacaggcggagugacccuguucuuccugagcggcaagggacucgggaagaccuccaucggccuucuuugcgugacggccaguagcacccuccuguggauggcaucggucgagccucacuggaucgccgccuccaucauccuggaauucuuccucauggugcugcugaucccggaacccgaccgccagcggacuccucaggacaaccagcucgcguacguggugaucggccugcuguucaugauccucaccguggccgccaacgagaugggcuugcuggagacgaccaagaaggaccucggaauaggcuacguggccgcagagaaccaucaacacgcgacuaugcuggacgucgaccugcgcccggcgagcgccuggaccuuguacgccgucgccacgaccguaaucacgcccaugaugcggcacacaauagagaacacgaccgcgaacaucuccuugaccgcaaucgccaaccaggccgcgauccugaugggauuagacaaggguuggccaauaagcaaaauggacaucggcgucccccugcuugcacucgggugcuacucacaggugaacccgcugacccugacggccgccgugcucauguuagucgcccacuaugccaucaucggccccgggcugcaggccaaggccacgcgcgaggcccagaagcgcacagccgcgggcaucaugaaaaacccgaccguggauggcaucguggccaucgaccucgaucccgucguguacgaugccaaguucgagaagcagcugggacagauuaugcugcuaauccugugcacgagccagauacugcucaugcggacgaccugggcgcugugcgaguccaucacccuggccacggggccgcuuaccacccugugggaagggagcccuggcaaguucuggaacacaacgaucgcgguguccauggccaacaucuuucgcgggaguuaccuggccggugcgggccuagcauucucucugaugaagucucucggggguggccggcgaggcacuggcgcgcagggagagacacucggcgagaaguggaagcggcaacucaaccaacuguccaaaagcgaguuuaacaccuauaagcgcaguggaauuauggaggucgaccgcuccgaggccaaggaggggcucaagcgcggggaaacgacaaaacaugccguaagccggggcaccgcaaagcugcgcugguucguagagagaaaccuggucaagcccgagggcaaggugaucgaccuggggugcggccgcgggggcugguccuauuacugcgcggggcucaagaaggucaccgaggugaagggcuacacuaagggcgggccgggacaugaggagccaaucccaauggccacguauggauggaaccuagugaagcugcacagcggcaaagauguuuucuucaugccgcccgagaagugcgacacccugcugugcgacauaggugaguccagcccgaaccccacgaucgaagagggccggacccugcgaguccuuaagauggucgagcccuggcugaagggcaaccaguucugcaucaaaauccugaaccccuacaugccgucuguggucgaaacgcucgagcagaugcagcggaaacacgggggcaugcugguucgaaacccccugagccggaacuccacacacgagauguauugggugucgugcgguaccgguaacauuguuucagccgugaauaugacgagccgcaugcuccugaaccgguuuacgauggcacaucggaagccgaccuacgagcgcgacguggaccugggggccgggacccggcacguggcgguagagcccgagguggccaacuuagacauuaucggccagcgcaucgagaauauaaagaacgagcauaaguccaccuggcacuacgacgaggacaauccauacaaaacgugggcguaccacgguagcuacgagguuaagcccucgggcagcgcauccucgauggugaacggggugguccggcugcugaccaaacccugggaugugauccccauggucacgcaaaucgccaugaccgacacgaccccguuuggccagcagcgcguuuucaaggagaagguggacacccggacgccgcgcgcgaagcggggcacgacccagaucauggagguuaccgccaaguggcucuggggguuccugucgcguaacaagaaaccccgaaucugcacccgcgaggaguucacacguaagguacgcagcaacgccgccauaggcgccguauucguugacgagaaucaguggaacagcgcgaaggaagccguggaggacgagcgguucugggaucuagugcaccgcgaacgggagcuccacaagcaggggaagugcgcuaccugugucuacaacaugaugggcaagcgcgagaagaagcugggcgaguucggcaaggcaaaaggcucccgagcgauaugguacauguggcugggggcccgcuuccuggaguuugaggcccugggauucaugaacgaggaccacugguucagcagagaaaacagucugagcggcguagagggcgagggucuccacaagcuaggcuacaucuuacgagauaucuccaagaucccuggggggaacauguacgccgacgacaccgcgggcugggauacacggaucacagaggaugaccugcagaacgaggcgaagaucaccgacaucauggaacccgaacaugcccugcuggccacaucgaucuucaagcucacuuaccagaacaaggucguccgcguucagcgccccgccaagaauggaacggugauggacgugaucagccggcgcgaccagcggggcaguggacagguugggaccuauggucugaacaccuucaccaacauggagguucagcugauccgccaaauggagagugaggggauuuuccucccaagcgagcuggagacgcccaacuuagccgagcguguccucgacuggcuggagaagcacggcgcggagcggcugaagcggauggcgaucucaggcgacgacugcguggugaagcccaucgacgaccgguucgcgacggcuuuaacagcacugaacgacaugggcaagguccguaaggacaucccccagugggagcccucgaagggcuggaacgacuggcagcaagucccguucuguucccaucacuuucaccaacuuaucaugaaggacgggcgagagaucgucgucccgugccggaaccaggacgagcucgugggccgcgcgcgggucucccagggggccggauggucccuaagagagaccgccugucugggcaagagcuacgcccagauguggcagcucauguacuuccaccggcgcgaccugcggcuggccgccaacgccaucugcuccgccgugccaguggacugggugccgacgucacgcacgaccuggagcauccacgcccaucaccaauggaugaccaccgaggauaugcucuccguauggaaucggguguggaucgaggagaacccguggauggaggacaagacgcacgugagcuccugggaggagguacccuaccuuggcaagcgcgaggaccaguggugcggcucuuugaucggauuaacugcgcgcgcaaccugggcuaccaacauccagguggcaauuaaccagguccgccgccucaucgggaacgagaacuaccuggacuacaugacuagcaugaagagguucaagaacgagagcgacccugagggggcgcucugguga

SEQ ID NO: 24062 - RNA, 9879 nt, Artificial Sequence
  derived and/or modified CDS sequence (opt11) from DENV-1__FJ882579__SS-prME
agcgugaccaugcuucucaugcugcugcccaccgcccucgccuuccaccugaccaccagaggaggcgagccccacaugaucguguccaagcaggagcggggcaaaagcuugcuguuuaagaccagcgccgggguuaacaugugcacgcugaucgccauggaccugggcgagcucugcgaggacaccaugaccuacaaguguccccgcauuaccgaagcggagcccgaugacguggacugcugguguaaugccacggacaccugggucaccuacggcacgugcagccagaccggcgagcaccggcgugauaagcggagcguggcccuugcgccccacgugggccugggacucgaaacccgcaccgagaccuggaugagcagugagggcgcguggaagcagauucaacgggucgagacaugggcccugcgccacccaggguuuacgguaaucgccuucuuccuggcccacgccauaggcaccucaaucacccagaaggggaucaucuucauccuccugaugcuggugacacccuccauggccaugcggugcgucgggaucggcaaccgcgacuuuguggagggccuuuccggggcgacguggguggacguagugcuggagcacggguccugcguuaccaccauggcaaaaaacaagcccacauuggacaucgagcuucugaagacagaggugaccaacccugcgguucuccggaaacuuuguaucgaggccaagaucagcaacaccaccacugacucccgcuguccgacccagggcgaggccacccugguggaggagcaggacgccaacuucgucugucggcgcaccuucguggaccggggcugggggaacggcugcgggcuguucggcaagggcagccuccugacgugcgccaaguuuaagugcgugaccaagcuggagggcaagaucguccaguacgagaaccucaaauacuccgugaucgugaccguccacaccggcgaccagcaccagguggguaacgagacgaccgagcacggcaccaucgcgaccauaacgccacaggcccccaccagugagauucagcugacugauuacggggccuuaacccucgacugcagcccccgcaccggccuagacuucaacgaaauggucuuguuaacgaugaaggagaaguccuggcuugugcacaagcagugguuccuggaccucccacugcccuggaccucaggggccagcaccagccaggagaccuggaaccgccaggaccugcucgugacauucaagaccgcccacgccaaaaagcaggagguggugguacuagguucccaggaaggugccaugcacaccgccuuaacgggggccacggagauccaaaccagcgguacaaccacgaucuucgccggccaccucaagugccgccugaagauggauaagcugacucucaagggcauguccuacgucauguguaccgggagcuucaagcuugagaaagagguggcagagacccagcacggcacgguccugguccaggugaaauaugagggcaccgacgcccccuguaagauccccuucucaacgcaggacgagaaggggguuacccagaacgggcgguuaaucacugccaauccaaucgucaccgacaaggagaagcccgugaacaucgaaaccgagccgccauucggggagagcuacaucguggucggcgccggggagaaggcgcucaaguuaucaugguuuaagaagggaagcuccaucggaaagauguuugaggccaccgcccgcggcgcccggcgcauggccauccugggugauacggcgugggacuucgggagcaucggggggguguuuaccuccguggggaagcucguccaccaggucuucggcaccgcuuacggggugcuguuuagcggugugagcuggaccaugaaaaucgggaucgggauccugcucacguggcugggcuuaaauucgcgcuccaccucacucucuaugaccugcauugcgguggggauggugacacuguaccugggcgugauggugcaggccgacagcgggugcgugaucaacuggaagggccgggagcugaagugugggucuggcauuuucgucacgaaugaagugcacaccuggaccgagcaguacaaauuucaggccgacagcccaaagcgacugagcgccgccauagggaaggccugggaagagggagugugcggcauccguuccgccacccgccuggagaacaucauguggaagcagaucagcaaugagcuaaaccacauacugcuggagaacgacaugaaguucaccgucguugucggggaugccaacggcauauuaacgcaagggaagaagaugauccggccccagcccauggagcacaaguacuccuggaaguccugggguaaggcgaagaucauuggugccgacauccaaaauaccaccuuuauaaucgacgggcccgacaccccagaaugccccgacggccaacgcgcauggaacaucugggaggucgaggacuacggauucggaaucuucacaacaaacaucugguuaaagcugcgggacuccuacacccagaugugcgaucaccgccuuaugagcgccgcgaucaaggacuccaaggccguucacgccgacaugggcuacuggaucgaguccgagaagaacgagaccuggaagcuggcccgggccuccuucaucgagguaaagacgugcacguggcccaagucccacacccugugguccaacggggucuuagagagcgaaaugaucaucccgaagauuuacggcggaccuaucucccagcacaacuacaggcccggcuauuuuacccaaacagccggucccuggcaccugggcaaguuagaacucgacuucgaccugugcgagggcaccaccgugguagucgaugagcacugcgggaaccggggcccgagccuccgcaccacgacggugaccgggaagaucauccacgaguggugcugccgguccugcacccucccgccccugcgcuuccgcggagaggacgggugcugguacgggauggagauucgcccagugaaagagaaggaggaaaaccugguacggagcaugguguccgcuggaagcggggagguagacagcuucucccucggaauccugugcgucagcauaaugaucgaggaggugaugcgcucccgguggagccgcaagaugcugaugacagggacccucgccguauuccugcugcucaucaugggccagcucaccuggaacgaccugauucgccucugcaucauggucggugcuaaugccucugaccggauggguaugggcacgacguaccuggcgcugauggccaccuucaagaugcgcccgauguucgcggugggguugcuguuccggcgccugaccagccgggagguguuacuccugaccauaggccucagccuggucgccagcguggagcugcccaacucccucgaggaauuaggggacggccucgccaugggcaucaugaugcucaagcugcugacggaauuccagccccaccagcucuggaccacccugcugagccucaccuucgucaagacgacccugucccuggacuaugcuuggaagaccaccgccaugguccucagcaucguguccuuguucccgcugugucucucaaccaccucccaaaagaccaccugguugccgguccugcucgggucauucggcugcaagccccugaccauguuuuuaaucacugagaacaagauaugggggcgcaagaguuggccccucaacgagggaauaauggcuauaggcaucgugagcaucuugcuguccagccuccugaagaacgacgugcccuuagccggcccgcucauugcgggcgggauguugaucgccugcuacgucaucagcggcuccagcgccgaccuguuacuggagaaggcagccgagguguccugggagcaggaggccgagcacuccggagccucccauaacauccugguggagguccaggacgacggcacaaugaagauaaaggaugaggagcgggaugacacccuaacaauccugcugaaggccacgcuccuggcagucagcgggguguaccccauguccauccccgccacacuguucguuugguacuucuggcagaaaaagaagcagcgcagcggcgugcuuugggacaccccuuccccucccgagguggagcgggcuguacucgacgacggcaucuaccgcaucuugcagcgggggcugcucggccgcagccaggugggggugggcgucuuucaagacgggguguuucauaccauguggcacgugacgaggggcgccguccugauguaccagggcaagcgccuggaacccuccugggccagcgugaagaaggaccucaucagcuacgggggcggguggcgguuccagggcagcuggaacaccggagaggaaguucaggucaucgccguggagcccggaaagaauccgaagaacguacagaccacccccgggacguuuaagacgcccgagggggaggucggagccaucgccuuagauuucaagccugggaccagcggcuccccgaucgucaaccgcgagggcaaaaucguggggcuauacggaaacggggucgugaccacguccggcaccuacguuucugccauagcccaggcuaaagccagucaagaggggcccuuaccagagaucgaggacgagguuuucaaaaagcggaaccugacuaucauggaccugcacccgggcagcggcaagacccgccgauaccuccccgcgaucgugcgugaggccauaaagcgaaagcugagaacgcugauucucgcccccacccgcgugguugccagcgagauggcggaggcccugaaggggaugcccauucgguaccagaccaccgccguaaaguccgaacacacgggccgcgagaucguugaccugaugugccacgcgaccuucacuaugcggcuccuuagcccggugcgcgugcccaauuacaauaugauuaucauggacgaggcucacuucacggaccccgccuccauagccgcccggggguacaucucgacgcgcgugggcaugggggaggccgccgcgaucuucaugaccgccacaccucccggcuccgucgaggccuucccccaaucaaacgcuguuauccaagacgaggaacgggauauccccgaacgcucguggaacagcggcuacgacuggaucaccgacuuccccggaaagacggugugguuuguccccucgaucaaaagcggaaacgacaucgcgaacugccugcggaagaacgggaagcgcgugauccagcucagucggaagacuuucgacaccgaauaccagaaaaccaaaaacaacgacugggacuacgucgucacgaccgauaucagcgagaugggcgcgaacuuucgcgccgaccgagugauugacccgcgccggugccugaagcccgugauccugaaagacggcccagagcgcgucauccucgccggccccaugccugugaccgucgccuccgcggcccagcggcgcggccggaucgggcgcaaccagaacaaggagggagaucaguacguguacauggggcaaccccugaacaacgaugaggaccacgcgcacuggacugaggccaagaugcugcucgacaauauuaauacgccagaaggcaucaucccggcccuguucgagccagaacgcgagaaguccgcugccaucgacggggaauaccggcugcgcggugaggcccggaagaccuucguggagcucaugcgccggggcgaccuccccgucuggcuguccuacaagguggccagugagggguuccaauacucugaccgcagaugguguuucgauggcgagagaaacaaccaaguacucgaggagaacauggauguugagaucuggacuaaggagggggagcggaagaagcugcggccccgguggcuggacgcccgcaccuacuccgauccucucgcacugcgggaguucaaggaguucgcagccggccggcggucagugagcggggaccugauacucgagauugggaagcugccacagcaccuaacgcuccgcgcccagaacgcucuagacaaccuggugaugcuccacaacuccgagcagggcggaaaggccuaccggcacgcuauggaggaacugcccgauacgauugagacccugauguugcuggcccugaucgcaguccucaccggcggggugacucuauucuucuuaaguggcaagggccuggguaagacgagcaucggccugcugugcgugacugcguccagcgcccuccuguggauggccuccgucgagccgcacuggaucgcggcgucuaucauccuggaguucuuucucauggugcugcugaucccggagcccgaccggcagcgaacgccccaggacaaccagcucgcguacguggucaucgggcuguuguucaugauccucaccgucgccgcuaaugagaugggccuccuugagacgaccaagaaggaccuagggauaggcuauguggccgccgagaaccaccagcacgcgaccaugcuggacgucgaucugaggccggcgagcgccuggacccucuacgccguggccacgaccgugaucacgcccaugaugcggcauaccaucgagaauacgaccgcuaauauaucucuuacagccauagccaaccaggccgcgauccugaugggccuggacaagggguggcccaucucgaagauggacaucggugugccccugcuggcucucgggugcuauagccaggugaacccccugacccugacggcggccgugcucaugcugguagcccacuacgcuaucaucggccccgggcugcaggccaaggcgacccgcgaggcccagaaacgcaccgccgcgggcaucaugaagaacccuaccguggacgguaucguggccaucgaccucgaucccgucguguacgacgccaaguucgaaaagcagcuggggcagauuauguuacuuauccugugcacgucccagauccugcucaugcggaccacuugggcccugugcgagagcaucacccuagcaacggguccucucaccacccugugggagggaucgcccggcaaguucuggaauaccaccaucgcggugaguauggcuaacaucuuccgcggcucguaucuggccggggccggccuugccuucucgcugaugaagucccucgggggcgggcggagaggcacuggcgcgcagggugagaccuuaggcgagaaguggaagcggcaacugaaccaacucagcaaaucugaguucaacaccuacaaacgcuccgguaucauggaagucgaccggagugaggccaaagagggccuuaagcguggggagacgacuaagcacgccguuuccaggggcaccgccaaacugcgcugguucguggagcggaaccuggucaagcccgagggcaaaguaaucgaccucgggugcggccgcgggggguggagcuacuacugcgcggguuuaaagaaggugaccgaggucaagggcuauaccaagggugggcccggacacgaggagccgauuccgauggcuaccuacggauggaaccuggugaagcugcacuccggcaaagacguguucuucaugccgcccgagaagugcgacacccuccugugcgacauuggggaaagcucuccgaaccccacgaucgaggagggacgcacucugcgcguccuaaagaugguggagcccuggcugaaaggaaaccaguucugcaucaaaauccugaaccccuacaugccgagcgugguugagacgcucgagcagaugcagcggaagcacgggggaaugcuggugcgcaauccccugagccggaacagcacucacgagauguacugggugucaugcggaaccggcaacaucgucucugccguaaacaugacgucccgcaugcuccugaaccgguucaccauggcccacaggaagcccacuuacgagcgcgacguggaccugggcgcagggacgcggcacguggcgguggagccggagguagccaaccucgacauaauugggcaacgcaucgagaacaucaaaaacgagcauaaaagcaccuggcacuacgacgaggacaacccguauaagacgugggccuaccacggcuccuacgaggugaagccuagcggcuccgccagcuccauggugaacggggucgugcggcugcugaccaaacccugggacgugauccccauggucacccaaauagccaugaccgacacgacgccguucggccaacagcgcguuuucaaggagaagguggacacccggacgcccagagcaaagcggggaacgacccagaucauggaaguuaccgcuaaguggcucuggggguucuugagccgcaacaagaagccccggaucugcacucgcgaggaguucacgcggaaggugcgcuccaacgccgccaucggcgccguguucgucgacgagaaccaguggaacucagcgaaggaggccguggaggaugagcgguucugggaccugguucacagagaacgggagcuccacaagcagggcaagugugcaaccugcgucuacaacaugaugggcaagagagagaagaaguugggcgaguucggcaaggccaagggcagccgggcgaucugguacauguggcugggggcccgcuuccucgaguucgaggcccugggcuucaugaaugaggaccauugguucucccgggagaacagccuguccgggguggagggcgaggggcuccauaagcucgguuacauccugcgcgacaucagcaagauccccggcgggaacauguacgcugacgauacagccggcugggauacccggauaacggaggacgaccuccagaacgaggcgaagaucaccgacaucauggagcccgagcaugcccugcuggccacgucaauuuucaagcucaccuaccagaacaaggugguucgcgugcagcgcccagccaagaacggaacggugauggacgucaucagccggcgcgaccagcggggcuccggccagguaggcaccuacggccugaacacauucacuaacauggaggugcaguugauucgccagauggagucggaaggcauuuuccuccccuccgagcuggagacgccgaacuuggcugagcguguccuggauuggcuggagaagcauggagcggagcgccugaagcgcauggccaucuccggggacgacugcguggugaagcccaucgaugaucgcuucgccaccgcccucacggcccugaacgauaugggcaagguccggaaggacaucccucagugggaacccuccaaaggguggaacgacuggcagcaagucccuuuuugcagccaucacuuccaucagcugaucaugaaggacgggcgcgagaucgugguccccugccgaaaccaggacgagcucgugggccgcgcgcggguaucccagggugccggauggagucuucgcgagaccgccugccuggggaaguccuacgcccagauguggcaacuaauguacuuccacagacgcgaccuacggcuggccgccaacgccaucuguagcgccgucccaguggacugggugcccaccucucgcacgaccugguccauccacgcccaccaccaauggaugaccaccgaagacaugcucagcgucuggaaccggguguggaucgaggagaacccguggauggaggauaaaacgcacgugagcagcugggaggagguccccuaccugggcaagcgcgaggaccaguggugcggaagucugaucgggcucacggcgcgggccaccugggcgaccaacauacagguugccaucaaccaggugcggcgccugaucggcaacgagaacuaccuggacuacaugacaagcaugaagcgguuuaagaaugagucggaccccgagggggcccuuugguag

SEQ ID NO: 24063 - RNA, 9879 nt, Artificial Sequence
  derived and/or modified CDS sequence (opt11) from DENV-1__JN819414__SS-prME
ucugugaccaugcugcucaugcugcugccgaccgccuuggccuuccaccugacuacccgcgggggggagccucacaugaucgugucgaagcaagaacgaggcaagagccuccucuucaagaccuccgccggagugaacaugugcacccugauugcuauggaccucggggaauugugcgaggacacaaugaccuacaaguguccccgcaucaccgaggcagagcccgacgacguagacuguuggugcaacgcgacagacacaugggugaccuacgggaccuguagccagaccggcgagcaucggcgcgacaagcgcuccgucgccuuagcuccucacguaggccuggggcucgaaacgcgaaccgagaccuggaugucauccgaaggcgccuggaagcagauccaacgagucgagaccugggcacugcgccaucccgguuucacaguuauagcccuguuuuuggcguaugcuauuggcaccagcauuacccagaaaggaaucaucuucauacugcugauguuggugacgccuuccauggccaugcgaugcgucggcaucggcaaccgcgauuucguggaaggccugagcggcgccacauggguagacgucgugcuggagcacggaagcugcgugaccacuauggccaaaaacaagcccacacuagacaucgagcugcuuaaaacagaggucaccaaccccgcggugcuccggaaguuaugcauugaagcgaagaucagcaacacuaccacggacaguagauguccaacccagggcgaggccaccuugguggaggagcaggaugcuaacuucgucugccgccgaacauuugucgaucggggcugggggaacggcugcgggcuguucgguaaagggagccuucuuaccugcgcaaaguucaaaugcgugaccaaguuggaaggcaagaucguucaauaugagaaccugaaguacuccgucauuguaaccguccacacgggagaccaacaccagguggggaacgagaccaccgagcacggcacuauagcgaccauuacgccgcaggccccuacaagcgagauccagcuuaccgacuacggggcucucacgcuggacuguagcccccggacuggguuagacuucaacgaaaugguccuccugacgaugaaggagaagucuugguuagugcauaaacagugguuucucgaccugcccuuaccuuggaccuccggggccagcaccagucaggaaaccuggaaccgccaggaccuccuggugacauucaagaccgcccacgcuaaaaagcaagaggugguggugcugggaucucaggaaggcgccaugcauacagcccucacuggggccacggaaauccaaaccagcggcaccacgacgauuuucgccggccaccugaagugccgccuaaagauggacaaguugacccucaagggcaugagcuacguaaugugcaccgggucauuuaagcuggagaaggagguagcggagacucagcacggcacgguacucguccaggugaaguacgagggcaccgacgccccgugcaagaucccuuucuccacacaggacgagaagggaguaacccagaacggcaggcugauaacggcaaacccaaucgugaccgacaaagagaagcccgugaacaucgagaccgagccuccguucggugagagcuacaucguggugggcgccggcgaaaaggcacugaagcucuccugguuuaaaaaggggucguccaucggcaagauguucgaggccaccgcccguggcgcccggcgcauggccauccucggcgacacggcgugggauuucggcagcauaggcggcguguuuacuuccguggguaagcugguacaucagguguuuggcaccgccuacggcgugcuguucagcggcgucuccuggaccaugaaaaucgggaucgguauccuccugacuuggcugggccuuaacucacgcuccaccucauuguccaugaccugcauagccgucggcauggugacgcuguaccucggcgucaugguccaggccgacagugguugcguaaucaauuggaagggccgugagcugaaaugcgggagcggcauauucgucacgaacgaggugcauaccuggacagagcaguacaaguuccaggccgauagcccgaagcgccuaagcgcggccaucgggaaggcgugggaagagggggucugcggaauccggucugccacccgauuagaaaacaucauguggaagcagaucucuaacgaacugaaccacauccuguuggagaaugacaugaaauucaccgucgucguaggggacgccaacggcaucuuggcgcaggguaaaaaaaugauccgaccccagcccauggaacacaaguacuccuggaaguccuggggcaaggcaaagauuauuggcgcugauauucaaaacacaaccuucauuaucgacggacccgauacaccggaaugccccgacggccagcgggccuggaauauaugggaggucgaggacuacgguuucgguauauucaccacuaacaucuggcugaaacuccgggacuccuacacccagaugugcgaccaccgccucaugagcgcggcgaucaaagacuccaaggccguucacgccgacaugggcuacuggaucgaaagcgagaagaacgaaaccuggaagcuggcccgcgcguccuuuaucgaggugaagaccugcaccuggccgaagagccacacccucugguccaacggcguccuggagagcgagaugaucaucccuaaaaucuacggcgggccgaucucccagcauaacuaccgcccuggguacuucacccagaccgccggucccuggcaucugggcaagcucgagcuggauuucgaucucugcgagggcacgaccguugucguagaugagcacugcgggaaccggggcccgagccuccggaccaccacggugaccgggaagaucauccacgaguggugcugccggagcuguacccugccgcccuuacgcuuccggggagaggaugggugcugguacggcauggagauucgcccggugaaggagaaggaggaaaaucuuguacgaucuaugguuuccgccggcagcggcgagguggacagcuucucccuaggaauacuaugcgucuccaucaugaucgaagaaguaaugcgcucacgguggagucgcaaaaugcucaugacagggacguuggccguguuccuguuguuaauuaugggccagcuuacuuggaacgaccucauccgcuugugcaucauggucggggcuaacgcaucggacagaaugggcauggguacgacguaucuggcucucauggccacguucaagaugcgcccgauguucgccguugggcuguuguuccgcaggcuaaccucucgggaagugcuguugcucacaaucgggcuuucccugguagccucgguggaguugccuaacuccuuggaggaacucggugacggccucgcaaugggcaucaugaugcugaagcuacuuacagaguuucaaccccaccagcuguggacaaccuugcucagccuuaccuucguuaaaaccacacugucgcuggacuacgccuggaagaccacugccauggugcuguccauagugagucuguucccgcucuguuugucuaccacgagucagaagaccaccuggcugccgguccuccugggaagcuucggcugcaagccuuuaaccauguuccucauaacagaaaacaagaucugggggcguaaaaguuggccccugaacgaaggcaucauggcgaucgggaucgucagcauucugcucagcucccugcuuaagaacgaugugccccucgcgggaccguuaaucgccggcgguauguugaucgccugcuacgucauuagcggcucgucagcagaccuacugcuggagaaggcagcggagguuuccugggaacaagaggccgaacacagcggggccucccauaacauucugguugagguccaagaugacggcacaaugaagaucaaggacgaggagagagacgauacccugacuauacuacucaaggcuacgcugcuggccgugucuggcguauaccccaugucaauucccgcuacgcuauucgucugguacuucuggcagaagaagaagcaacgcagcggggugcucugggacacccccuccccgcccgagguagagcgggccgucuuggacgacggaauauaccgcauccugcagcggggccuccuuggccgcagccaggugggcgugggcguguuccaggacggcguguuccacaccauguggcacgucacgcgcggagcgguccuaauguaccagggcaagagacucgagcccaguugggccagcguaaagaaagaccugauauccuacgggggcggcuggcguuuccaggggagcuggaacaccggagaggaagugcagguaaucgcagucgaacccggcaaaaaccccaaaaacgugcagacuacgccuggcacauuuaagacgccagagggugaaguaggcgccaucgcccuggacuucaaaccugggaccaguggcagcccgaucgucaacagagaaggcaaaaucgucgggcucuacggcaaugguguagugaccaccggcgggacguacgucuccgccaucgcccaggcgaaagcgagccaggagggcccucugcccgagaucgaagaugaggucuucaagaaacguaacuugacuaucauggaccuccaccccggcucagguaagacccgccgguaucugccugccauuguucgggaggcgaucaagcggaaacugcgaacccuuauucuggccccaacucgugucguugcgagcgagauggccgaagcccugaagggcaugccgauccgguaucagacuacugcugucaagagcgagcacacggggcgggagaucgucgaccuaaugugccacgcaacguucacaaugagacugcugucuccggugcgcgugcccaacuacaacaugauaauuauggacgaagcacacuuuaccgaccccgcaagcauugccgcacggggcuacaucucaacccgcguggggaugggcgaggcugcggccauuuucaugacggcaacgccgcccggaucugucgaagccuucccucaguccaacgccgugauucaggacgaagaacgcgacauacccgagcgcagcuggaauucuggguacgauuggaucaccgacuucccgggcaaaaccguaugguucguccccagcaucaaguccggcaacgauauagcgaacugccuccggaagaacggaaagcgcgugauccagcugucaagaaagacguuugauaccgaguaccagaagacuaaaaacaacgacugggacuacguggugaccacugacaucuccgagaugggggcaaacuucagggcugaucgggugaucgauccccgccggugcuugaagccagugauccucaaggacggcccggagcgcgucauccuggcgggcccuaugcccguuaccgucgcgagcgccgcccagcggcgagggcguaucggccgcaaccagaacaaggaaggggaccaguacgucuauaugggccagcccuugaacaacgacgaagaucaugcccacuggaccgaggcaaagaugcuccuggacaauaucaacacccccgaggggauuaucccggcucuguuugagcccgagcgcgagaaguccgccgccauugacggcgaguaccggcuuaggggcgaagcgcggaagacguucguggaauugaugcgcagaggggaucuucccgucuggcuaaguuacaagguggcgucagaaggcuuccaguacagcgacagacgguggugcuucgacggggaacgcaacaaccaggugcuggaggagaacauggacgucgagaucuggaccaaggaaggcgagcggaagaaguugcguccccgguggcucgacgcucguaccuacucggacccgcuugcccugcgagaguucaaagaguucgccgccggccggcgaagcguguccggcgaccucaucuuagagaucgggaaacugccucagcaccucacucuccgcgcccagaaugcgcuggacaaccucgugaugcugcauaauagcgaacaaggaggaaaggccuacaggcacgcgauggaggagcugccugacaccauugagacguuaaugcugcuggcguuaaucgcggucuugacugggggcguuacccuguucuuccucuccggcaaggggcugggcaagaccucaaucgggcugcugugcguuacggccagcuccgcccugcucuggauggccuccgucgaaccccauuggaucgcagcaaguaucauacucgaguucuuccugaugguucuucugaucccagaaccagaucgccagcggacuccccaagacaaccagcuggcguacgugguuaucggccuguuauucaugauccugaccguggccgccaacgaaauggggcuccucgagaccacgaagaaagaccugggcaucggcuacguggcagcggagaaucaccagcacgcgaccaugcuggacguggaccuccguccggcgucggccuggacccuuuacgccguggcuacgacggugaucaccccgaugaugcgccacaccaucgagaacacuacggcgaacaucagucugaccgccaucgccaaccaggccgcuauccucaugggacuggauaaaggcuggcccauauccaaaauggauauuggggugccccuguuggcacugggcugcuacucgcaggugaacccgcugacccucacggccgccgugcugaugcuggucgcgcacuacgccaucauaggucccggccuccaagcaaaagccacgcgcgaggcgcagaaacgcacugcagccgguaucaugaagaaccccacggucgaugggauuguggcuauagaccuggacccggucgucuacgacgccaaguucgagaaacagcugggccagauuaugcugcugauacuaugcacaucucagauccugcugaugcggacgaccugggccuuaugugaaagcaucacccucgcgaccgggccucugacgacgcugugggagggcagcccgggcaaguucuggaauacgacaaucgcugucuccauggccaacauuuuucgcggaagcuaccucgcgggcgcgggucuggcguucucccugaugaaaucucucggcggugggcggcggggcaccggggcccaaggugagacccugggcgaaaaguggaagcggcagcucaaucaacuuuccaagagcgaguucaauacuuacaagcgcuccggcaucauggaggucgaucggagcgaagccaaggagggccugaagcgcggcgagacgacgaagcaugccguuagcaggggcacugcgaaguugcgcugguucguagaaaggaaccuggugaagcccgaggggaaggugaucgaccucggcugcgggcgcggcggcugguccuauuauugugcuggccugaaaaaggugacggaagucaaaggguacaccaaaggggggccagggcacgaggagccuaucccuauggccaccuaugguuggaaccuagugaaguuacacucugguaaggacguauuuuuuaugccuccggagaagugcgauacuuuacugugugacaucggggaaucaucgccuaaccccaccaucgaagaggguaggaccuugcgggugcugaagaugguggaacccuggcugaaaggcaaucaguuuugcaucaagauccucaaccccuacaugccguccguugucgagacacuggagcaaaugcagcggaaacauggagggaugcugguaagaaacccccucagucggaacuccacgcacgagauguacuggguaagcugcggcaccgguaacauugucucagcugugaauaugaccagccggaugcuucucaaccgguucaccauggcccaccgcaaacccacauacgagcgagacguugaccucggggccggaacgcggcauguagccgucgaaccagagguugcgaaccuggacaucaucggucagcgcaucgaaaacaucaaaaaugagcacaagucaacguggcacuaugacgaagacaacccguacaagacaugggccuaccacggaucuuacgaggucaagcccuccggaagcgcguccuccaugguaaauggcgugguacgccugcuaacgaagccgugggacgugauucccauggucacucagauagcgaugacagacaccacgccuuucgggcagcagcgcguguucaaggagaaaguggacacgcggaccccgagagccaagcggggaacuacacagaucauggaggucaccgccaagugguuauggggcuuccucagcagaaauaagaagccacggaucugcacccgcgaggaguucacccggaagguacgcucaaacgccgcuauaggggcggucuuugucgacgagaaccaauggaacacggccaaggaagccguagaggaugagcgguucugggacuuaguacaucgugaacgagagcugcacaagcagggcaagugcgcuaccugcgucuauaauaugaugggcaagcgcgagaagaagcugggggaguuuggcaaggcgaaggggucccgggccauaugguacauguggcucggcgcacgcuuucuggaguucgaagcgcugggguuuaugaacgaagaucacugguucagccgggaaaacucucugagcggcguugaaggcgagggccugcacaaacuaggcuacauauuaagggacaucuccaaaauccccgguggaaacauguacgccgacgacaccgcggggugggacacacgaaucacagaggacgaccugcagaacgaggccaagauaacugacaucauggagcccgagcaugcccugcucgccaccucaaucuucaagcugaccuaccagaacaaggucguccgagugcagcgcccagccaaaaacgggacgguaauggacguuauuucccgucgcgaccagaggggguccggccaaguaggaacauacggucugaacaccuucaccaacauggagguccagcucauucgccagauggaaagcgaggguaucuuccuucccucagagcuggaaacuccaaauuuggcggagcgggccuuggacugguuggaaaagcacggggccgagcgucucaaacggauggcgaucucgggcgaugacuguguugugaagcccaucgacgaccgcuucgcaacagcucugaccgcccugaacgacauggggaaagugcggaaggacaucccucagugggagccauccaagggguggaacgauuggcaacagguuccguucugcagccaucacuuccaccagcucauuaugaaggacggccgcgagauuguuguacccugucggaaucaggacgaguugguggggcgcgcccgggugucccagggcgccggguggagccuaagggagaccgccugccucggcaagaguuaugcccagauguggcagcugauguacuuccaccggcgcgaccugcgcuuggcugccaacgcuaucugcagcgccgugccgguagacugggugccaaccucccgaacgaccuggucuauucacgcgcaccaucaauggaugacuaccgaggacaugcucucgguuuggaacagagucuggaucgaggaaaacccuuggauggaggacaagacacacgugagcucuugggaggagguaccuuaccuggguaagagagaggaccaguggugcggaucucucaucggauugaccgcccgcgccaccugggcaacuaacauucaagucgcgaucaaccaaguuagaagacugaucggcaacgagaacuaccucgacuauaugacuagcaugaagcgguucaagaacgaguccgaucccgagggcgcucucugguag

SEQ ID NO: 24064 - RNA, 9879 nt, Artificial Sequence
  derived and/or modified CDS sequence (opt11) from DENV-1__FJ873810__SS-prME
agcgugaccaugcugcucauguuguugcccacagcccucgccuuccaccugaccaccagagguggggagccacauaugaucgugagcaaacaagagcgggguaagucucuccuguucaagaccagcgugggggucaacaugugcacccugaucgcgauggaccugggcgaacucugcgaggacaccaugacguauaagugccccaggaucacggaggcagagcccgacgacguggacugcuggugcaacgccaccgacacuuggguaaccuacgggaccugcagccagaccggcgagcaccguagggaaaagcgguccguggcgcuggcgccgcacgucggccugggccucgagacccgcaccgaaaccuggaugagcucggagggcgccuggaagcagauucaacggguagagaccugggccuuacgccaucccggguucacaguaaucgcauucuucuuagcccacgccaucggcacgucaaucacccaaaaagggaucaucuucauccuccugaugcuggucacccccucgauggcuaugcggugcguaggcaucggcaaccgagacuucgucgaggggcucagcggcgccacgugggucgacguggugcuggagcaugggucaugcguaacgacuauggcaaagaacaagcccacccuugacaucgagcuguuaaaaacggaggugaccaacccggcgguccuacggaagcucuguaucgaggcgaagaucagcaauaccaccacggacucgaggugcccgacccagggcgaggccacccuggucgaggagcaggacgccaacuucgugugccgacgcacauucguggaccguggcuggggcaacggcugcgggcuguuuggcaaggggucucuccugacgugcgccaaguucaagugcgugaccaagcuggagggcaagaucgugcaguacgagaaucucaaauacucggugaucguaaccguacacacaggcgaccagcaccaggucgggaacgagacaacggagcauggcaccaucgccaccaucacgccccaggcgccaacaucugagauccaacugaccgacuauggggcccuuacgcuagacugcagcccccggacuggccuggacuucaaugaaauggugcuucuaacgaugaaggagaaauccuggcuaguucacaagcagugguuccuagaccucccgcugcccuggaccaguggagcaagcaccagccaggaaaccuggaacagacaggaccugcucgugacauucaagaccgcccaugccaaaaaacaagaggucgugguauugggcucccaagagggcgcgaugcacaccgcccuaaccggagccacugagauccagaccagcggcaccaccacgaucuucgcugggcaccucaagugccgccugaagauggacaagcuaacccucaagggcauguccuacgugaugugcaccggaagcuucaagcuggagaaggagguggcugagacacagcacgguacggucuugguccaggugaaguacgagggcaccgacgcgcccugcaaaauccccuucuccacgcaggacgaaaaagguguuacccagaauggacggcuaaucacggccaauccgaucgugacugacaaggagaagcccgugaacaucgagaccgagccgcccuucggggaauccuacaucgucguuggcgccggcgagaaggcuuugaagcuuaguugguucaagcgcgggagcuccaucgguaagauguucgaggcgaccgcucgcggggccagacgcauggcgauccugggagauacggccugggacuuuggaagcauaggcggaguuuucaccagugucgggaagcucgugcaccaggucuucggcacagcguacgggguccuguucuccggaguguccuggaccaugaagaucggcauugguauccugcucacguggcugggccugaacucccgguccacgucucucuccaugacuugcauugcaguugggauggucaccuuauaccuuggcgugauggugcaggccgacagcggaugcgucaucaacuggaaagggcgcgagcucaagugugguucgggcaucuucgugacgaaugagguacacaccuggacugagcaauacaaguuucaggccgacagcccgaaacgacucagcgcggcgaucggcaaggccugggaggaaggggugugcggcaucagguccgcuacccggcuggagaacaucauguggaagcagaucagcaaugagcucaaccacaucuugcuggagaacgauaugaaguucaccgugguggucggcgacgccaacggcauuuuggcucaggguaaaaagaugauccgcccccagcccauggaacauaaguacucauggaagucguggggcaaagcgaagauaaucggcgccgauauccagaacacgacguucaucauugacgggcccgacaccccggagugccccgacggccagcgggcauggaacaucugggagguggaagacuacggguuuggcguguucaccacaaacaucugguuaaaguuaagagacuccuauacccagaugugcgaccacagacugaugagcgccgcgaucaaagacuccaaagcgguucacgccgacaugggauauuggaucgagagcgagaagaaugagaccuggaaguuggcccgagcguccuucaucgaggugaagacgugcacguggcccaagagccacacccugugguccaacggggugcucgagagcgaaaugaucaucccaaaaauauacggagggccuaucucccagcacaacuaccggcccggcuacuucacgcagacagcgggcccauggcaccugggcaagcuggagcucgauuuugaucucugcgagggaacaaccgucgucguggaugagcacugcgggaaccgcgguccgucgcugcggaccacaacagucaccgggaagaucauucacgagugguguugccgcuccuguacccugccgcccuuacgguuucgcggagaggaugggugcugguacggcauggaaaucaggcccgugaaggaaaaagaggagaaccuggugcgcagcauggucucagcaggcaguggggaaguggacucauucucccucggcauccuguguguuucgaucaugaucgaggagguuaugcggucccgcuggagccgcaaaaugcugaugaccgggacgcucgcggucuuccugcuuuuaaucaugggccagcuaaccuggaacgaccugauccguuuauguauaaugguaggggccaacgcgucagaccgcaugggcaugggcacuacuuauuuagcgcugauggccacguucaagaugcggccaauguuugccguaggacuacuguucagaaggcugaccagucgggagguauugcuccugaccaucggccucucccuggucgccaguguugaguugcccaacucccucgaggaacugggagacggccuggcuaugggcaucaugaugcucaagcuacuuacggaauuccagccccaccagcuguggacgacccugcuaagccucaccuucgugaagaccacgcugucccuggauuacgcguggaagaccaccgccaugguccucagcauagugucacuguucccgcugugccucagcacuacgucccagaagaccaccuggcugccggugcuucuagggucauucggcuguaagccccuaacaauguuccugaucacggagaacaagaucugggggcggaaguccuggccccucaaugagggcaucauggcgaucgggauugugagcauacugcuguccucgcuccuuaagaacgaugugccccuggccggcccucucaucgcgggugggaugcuaauagccugcuaugugauaagcggcuccagcgccgaucuuucucuggagaaggccgcggagguaagcugggagcaggaggcggagcacuccggggccagccacaauauacugguugaggugcaggacgaugggacgaugaagauuaaagacgaggagcgugacgacacauugacgauccugcuaaaggcaacccugcuggccgucuccggaguguaccccaugagcauucccgccacgcuguuugugugguacuuuuggcagaagaagaagcagcgguccgguguccugugggacaccccaucaccgccggaggucgagcgcgcgguucucgacgacggcaucuaccggauccugcagcgcgggcuuuugggccggucccaggucggggugggggucuuccaggacgggguauuccauaccauguggcacgucacccgcggagccguguugauguaccaagggaagcgccucgagcccucaugggccuccgucaagaaagaccugaucagcuacgggggcggguggcgcuuccaggguuccuggaacacgggggaggagguccaggugauugcggucgagcccggcaagaacccgaagaacguccaaaccaccccuggcacguuuaagacuccagagggggaagugggcgccauagcccucgacuuuaagccgggaaccagcggcuccccgaucguaaaucgggaggguaagaucguggggcuguacggcaacgguguggugacaacguccggcaccuacgugagcgccaucgcccaggccaaagccagccaggaggggccccuccccgagaucgaggacgagguguuuaagaagcgcaaccuuacgaucauggaccugcacccggguaguggaaagacccgccgcuaucugcccgcgaucguccgggaggccaucaagcgcaagcuccgcacccuuauccuggccccuacgcgggucguggccucggagauggcggaggcccucaaggggaugcccauacgcuaccagaccacagcggugaagucugagcacaccggccgggagaucguggaccugaugugccacgccacguucaccaugcggcugcucuccccgguuagaguccccaacuacaacaugaucauaauggacgaggcccauuucaccgaccccgcuucuauagccgcccguggauacauuuccacacggguaggcaugggggaggccgcagcgaucuuuaugacggccacgccacccgggagcguggaggcguucccacaguccaaugccgucauucaggacgaggagcgagacauccccgagcggagcuggaacuccggcuacgacuggaucaccgacuucccagguaagaccgugugguucgugccaucuaucaaauccggcaacgacauagccaacuguuuacgcaagaacgggaagcggguaauccagcugagcagaaagacguucgacacagaauaccagaagacuaagaacaaugacugggacuacguggugacuacggauauaagugaaaugggugcgaacuuccgggccgaccgcgucauugacccccgucggugccucaaacccguaauccuaaaggaugggcccgagcgcgucauacuagcugggccgaugcccguaaccguugccucagcggcccagcgccggggucgcauagggcgcaaucagaacaaggagggcgaccaguacgucuacauggggcagccccucaacaacgaugaggaucaugcucacuggacugaggccaaaaugcugcuggacaacauaaacacucccgagggaaucauuccagcuuuguucgagcccgagagggagaagagugcagccauugacggggaguaccgccugcggggcgaggcccgcaagacguucguggagcugaugcggcgcggcgaccucccugucuggcugagcuacaaggucgccucugagggguuucaguacagcgaccggcgguggugcuucgacggcgagcggaacaaccaagugcuggaggagaacauggacgucgagaucuggaccaaggagggugagcguaagaagcugcggccccgcuggcuggacgcccggaccuauuccgacccauuagcgcuccgggaguucaaggaguucgccgcaggccggcgcucugucagcggagaucugauccuggaaaucgggaagcucccccagcaccugacccugagagcccaaaacgcccucgacaaccuggugaugcuucacaacuccgagcagggcgggaaagcuuauaggcacgcuauggaggaguugcccgauaccaucgagacucugaugcuccucgcccucauugcggucuugaccggcggggucacuuuguuuuuccugagcggcaaggggcuggggaaaacguccaucggccuccucugcgugacggcgagcuccgcccugcuauggauggcuucaguggaaccucacuggaucgccgccuccaucauccuggaguucuuccuaauggugcuccugaucccugagcccgaucggcagcgcacgccccaagacaaccagcuggcguauguggucaucgggcuccuguucaugauccugacggucgccgccaacgagaugggccuccuggaaaccacuaagaaggaucuggggaucggcuauguggccgccgaaaaccaccagcacgcgaccaugcuagauguugaccugcaccccgccagcgcguggacucuguacgccgucgcgaccacggugaucacccccaugaugcggcacacuauagagaacaccacggcgaacaucucccucaccgccaucgcuaaccaggccgccauucugaugggacuggauaagggguggcccauaagcaagauggacaucggcgugccccuccucgcgcuagggugcuacucccaggucaauccgcucacccuaacggccgcagugcugaugcucguggcccacuacgcuaucaucggacccgggcugcaggccaaagccacgcgggaggcccagaagcgaacagccgcgggcaucaugaaaaacccgacugucgauggcaucguggccaucgacuuagaccccgugguuuacgacgcgaaauucgagaagcagcucgggcagaucaugcuguuaauccugugcacaagccagauccugcugaugcggacgaccugggcccucugugaaucaaucacccuggcaaccgggccgcugacuacccucugggaagggagcccagggaaguucuggaauaccaccauagcgguuucuauggcgaacauauuccgcggcagcuaccuagccggggccggauuggccuucucccucaugaagucccucgggggcgggcggcgcgguacgggcgcccagggggaaaccuuaggcgagaaguggaagcggcagcucaaccagcuguccaagagcgaguucaauacauacaagcgcagcgggaucauggagguggaccgguccgaggccaaggagggccugaagcgcggggagaccacgaagcacgccgucagccggggcacagccaagcuccgcugguucguagagcggaaccugguaaagccggagggcaagguaauugaccugggguguggcagagggggcugguccuauuacugugcgggacugaagaaggugaccgaggugaagggguacaccaagggcgggcccggccaugaggagccgaucccgauggccacauacgguuggaacuugguaaaguugcacagcggcaaggacguuuucuucaugccgcccgagaaaugcgacacccugcucugcgauaucggggaguccagcccgaaccccaccauugaggaggguaggacccugcggguccugaagauggucgaacccuggcuccgggguaaccaauucuguaucaagauccugaaucccuacaugccgaguguuguggagacucuggaacagaugcagcgcaagcacggcggcauguugguucggaauccccugucccgcaacucaacgcacgagauguacuggguuagcugcgggaccggcaacaucguuuccgccgucaacaugaccucuagaaugcugcuaaaccgcuuuacuauggcccaccgcaagcccacguacgagcgggauguggaccugggggcggggacgagacacguggcggucgagcccgagguggccaaucuggacaucaucggccagaggaucgagaauaucaagaacgagcacaaguccaccuggcacuacgacgaggacaauccguacaagaccugggccuaccacggcagcuacgaggucaagcccuccgguagcgccuccagcauggugaacggaguggucaggcuccugacgaaacccugggacgugauuccuauggugacccaaaucgcgaugaccgacaccacccccuucggccagcagcggguauucaaggaaaagguggacacccgcacgccccgggcgaagaggggcaccacgcagaucauggaggugacugccaaguggcuguggggguuccucucgcgaaacaagaaaccccgcaucugcacccgggaagaguuuacccgcaagguccgcucgaacgccgccauuggagccguauuuguggacgagaaucaguggaacucggcgaaggaagcgguugaggacgaacgauucugggaccuagugcacagagagcgggagcugcacaaacaggggaagugcgccaccugcguguauaacaugaugggcaagcgggagaagaagcucggggaguucggcaaggcgaaaggaucacgcgcgauaugguacauguggcugggagcccgcuuccuggaguuugaggcgcucggcuucaugaacgaggaccauugguucagucgcgagaacagucugagcgggguagagggcgaggggcugcacaagcucggguacauccugcgggacaucuccaagauccccggugggaacauguacgccgacgacacagcgggcugggacacccguaucaccgaggaugauuuacagaacgaggcgaagaucacggacaucauggagcccgaacacgcccuccuggccaccucgauuuucaaauugaccuaccagaacaagguggugcguguccagcgaccggccaagaacggcaccguuauggacgugaucucccgucgggaccaacgcggcaguggccaggucggaacuuacggccucaacaccuuuaccaauauggaggugcagcugauccggcagauggaguccgagggcauauuccugcccagcgagcuugagacgcccaacuuagcugagcgcgcucuggacuggcucgaaaagcauggugccgagcggcuuaagcgcauggccaucucaggggaugacugcguggucaagccaaucgacgaucgguucgccacggcccugacugcucuaaacgacauggguaaggugcgcaaggacauaccccagugggagcccucuaagggcuggaacgacuggcagcaggucccguuuugcucccaucacuuccaccagcugaucaugaaggacggacgggaaaucgucgugcccugccgcaaccaggacgaguuggugggccgggcccgcgucagccagggcgcgggcuggucccuccgggagaccgcaugccucggcaagagcuaugcccagauguggcaacugauguacuuucaccggcgggaucuccgccuggcggccaacgccaucuguagugccgugcccguggacuggguccccacaagccggaccacguggagcauccaugcgcaucaccaguggaugacuaccgaggacauguugucaguguggaaccgcguguggauugaggagaacccuuggauggaggauaagacccacgucagcuccugggaggaggugcccuaccucggcaagcgcgaggaccaguggugcggcagcuugaucggccucacggcgcgggccaccugggccaccaacauccagguggccaucaaucagguccggcggcucaucgguaaugagaacuaccucgacuacaugaccagcaugaagagguucaaaaacgagucggaucccgagggggcguuaugguag

SEQ ID NO: 24065 - RNA, 9879 nt, Artificial Sequence
  derived and/or modified CDS sequence (opt11) from DENV-1__FJ850103__SS-prME
agcgugaccauguuacucaugcuccugcccaccgcccuggccuuccaccugacgacccgcggcggggagccgcauaugauugucuccaaacaggagcgcggcaagagcuuacucuucaagaccuccgcgggggugaacaugugcacgcugauagcuauggaucugggcgaacugugcgaagauaccaugaccuacaaaugcccccggaucaccgaggcggagcccgacgacgucgauugcuggugcaacgcuaccgacacgugggucaccuacgggaccuguagccagaccggcgagcaccgacgcgagaagcgauccguggcccuggcaccgcacgugggccuggggcucgagacgcgcaccgaaaccuggaugagcuccgagggcgccuggaagcagauccagagggucgaaaccugggcccugcgccauccuggguucacggucaucgccuucuuccucgcgcacgccaucggcaccagcaucacccaaaaggggaucauuuucauucuccucaugcuggugacccccuccauggcuaugcgcugcgucggaaucggcaaccgggacuucguggagggacucucaggcgccacaugggucgauguugugcuggaacacggguccugugucacaaccauggcgaagaacaagcccacacuggauaucgagcuucucaagacggaggucacuaaccccgcggugcuucggaaacuuuguauugaggccaagaucuccaauacuacaacggacucccgcuguccgacccagggcgaggccacccuuguggaagaacaggacgcgaacuuuguuugucgccgcacauucguggaccgaggcugggggaacggcuguggguuguucggcaaagggucgcuacucacgugcgcuaaguucaagugcgugaccaaacuggaaggcaagaucguccaguacgagaaccucaaguacagcgugauugugaccguucacacgggcgaccagcaccagguggggaacgagacgaccgagcauggcaccaucgcuaccauuacaccccaggcccccacgagcgagauccagcucaccgauuacggggcccugacccucgacugcuccccucgcacgggcuuggacuucaacgagauggugcugcucaccaugaaggaaaagagcuggcuagugcacaagcaaugguuccuggaccucccgcugcccuggaccuccggugccuccaccagucaagagaccuggaaucggcaggaccugcucgugacguucaagaccgcucacgcgaagaagcaggaggucgugguccuuggcagccaagagggcgccaugcauaccgcccugaccggggccacggagauccagaccagcggcaccaccaccaucuuugcgggucacuugaagugucgccugaaaauggacaagcugacccucaaaggcauguccuacgugaugugcaccggcagcuucaagcuggagaaagagguggcggagacucagcauggcacggugcugguucaaguuaaauacgaaggcaccgacgcccccugcaagauccccuucuccacacaagacgagaagggggugacccagaacggccgacugauuacggccaaccccaucgucacagacaaggagaagccggucaacaucgagaccgaaccacccuucggggaaagcuacauuguggucggggcuggcgaaaaggcgcucaaauuauccugguuuaagcgcgggagcuccaucgguaagauguucgaggccacugcccguggggccagacgcauggccauccuaggcgacacggcgugggacuucgggagcaucggcgguguguucaccuccguggggaaacucguccaccagguguucggcaccgcauauggggugcuguuuaguggcgucuccuggaccaugaagaucgguaucggcauacugcucacguggcuuggccugaacagccggaguaccagucucagcaugaccugcaucgcgguaggaauggugacgcuauaccucggagucauggugcaagccgacagcgggugugugauaaacuggaaggggcgcgagcucaagugcggguccggcaucuucgucaccaacgaggugcacaccuggacggagcaguacaaguuucaggcggacagcccgaagcggcugagcgcggccauuggcaaggccugggaggagggggugugcggcauucgcuccgccacaagauuggagaacaucauguggaagcagaucagcaaugagcucaaccauaucuuacuggagaacgacaugaaguucaccgucguagugggggaugcuaacggcauccuagcgcaggggaaaaagaugauccgaccccagcccauggagcauaaauauuccuggaaaagcuggggcaaggccaagaucaucggcgcagacauucaaaacacgaccuucaucaucgacgggccugacacgccugagugcccggacggccagcgggccuggaacaucugggaggucgaggacuacggauuuggcguuuucacgacgaacaucuggcugaagcugcgcgacuccuacacccaaaugugugaucaucggcucaugagcgcggccauaaaggacuccaaggcagugcaugcggacaugggauauuggauagaaagcgagaagaaugagacuuggaagcuggcccgcgcguccuucauugaggucaagaccugcaucuggccgaaaucucacacacugugguccaacgguguacuugaaagcgagaugauuauccccaaaaucuacggcggcccgaucucccagcacaacuaccggcccggauauuucacucagaccgccggacccuggcaccugggcaaguuagaguuggacuucgaccuuugcgaggguacuacggucgucguggacgagcacugcgggaacagaggccccagccuccgaacaaccaccgugacggguaagaucauccaugaguggugcugccgcuccuguacuuuaccaccccugcgguuccgcggcgaggaugggugcugguauggaauggagauccggcccgucaaggagaaggaggagaaucugguccgcuccaugguguccgcugguagcggggaggucgauagcuucucccucggcauccugugcgugagcaucaugaucgaggaagugaugcggucccgauggagccggaagaugcuuaugaccgggacccucgccguauuccugcugcucaucaugggucagcugacguggaacgaccugauccggcucugcaucauggugggagccaacgcgagcgaccgcaugggcaugggcacuaccuacuuagccuuaauggccacuuuuaagaugcggccgauguucgccguggggcuucuguuccgccggcugacgucgcgggagguucuccugcugaccaucggacucucccugguggccucgguagaacugcccaauucccucgaggaacugggggacggccuggcgaugggcauaaugaugcucaaacuuuugaccgaguuccagccgcaccagcucuggaccacccugcugagccucaccuuugugaaaaccacccuuagucucgacuacgccuggaagacgacugccauggugcucucuauugucucccuuuucccccugugccucagcacgaccucccagaagacgaccuggcugccggugcugcucgggagcuucggcugcaagccccugaccauguuccuaaucaccgagaauaagaucuggggacggaaguccuggccccucaacgagggaaucauggccaucggaaucgugagcauccuacuaagcagccuccugaaaaacgacgucccccucgcggggccccucaucgcuggcgggaugcugaucgccugcuacgugauaagcggcuccagcgcugaccugucccucgaaaaggcagcggaggucagcugggaacaagaagccgaacacuccggggccucgcacaauauccuggucgagguacaagacgauggcaccaugaaaaucaaggaugaggagagggacgacaccuugacuauccuccugaaggccacccugcucgcaguguccgggguguaccccaugagcauccccgcgacccuguucgugugguacuucuggcagaagaagaaacagaggagcggcguucugugggacacacccucgccgccggaggucgaaagggcggugcucgacgacgggaucuaucggauccugcagcgcgggcuccugggccggucccaaguuggggucggaguguuccaagaugggguguuccacaccauguggcacgucacacgcggagccgugcucauguaccagggcaagcggcuagagcccuccugggccucugucaagaaggaccugaucagcuacggaggcggguggcgguuccaggguuccuggaacaccggggaagaaguccaggugaucgccguggagcccggcaagaacccgaagaacguccagaccaccccuggcaccuucaaaacccccgagggugaagugggugcgauagcacucgacuucaagcccgggacgucagguuccccgauagucaaucgggaagguaaaaucgucgggcuguacggcaaugguguggugaccaccagcggcaccuacgucuccgccaucgcgcaagccaaggcgagccaggaaggaccucugcccgagaucgaggacgagguguucaagaagcguaaccugaccaucauggaccugcauccgggcucaggcaagacgcggcgcuaccugcccgcuaucgugcgggaguccaucaagagaaagcugcgcacccugauucucgcccccacaagggucguagccagcgagauggccgaggcccuaaaggggaugcccauccgcuaccagacgaccgcggugaagucggagcacacggggcgugagaucguggaucugaugugucacgccacguuuacgaugcgccugcucaguccgguucggguacccaacuacaauaugauaaucauggacgaggcccacuuuaccgaccccgccuccaucgccgcacgcggguacaucuccacccgggucggcaugggugaggccgcggcaaucuucaugaccgcuacgcccccuggcuccguggaggccuucccgcaaucgaaugcagugauucaggacgaggagcgcgacaucccugagcgguccuggaacuccggcuacgacuggauuaccgacuuccccgguaaaacugucugguuugugccguccaucaagucgggaaacgacaucgccaacugccugcguaagaacgggaagcggguaauacagcugucaagaaagaccuucgauacagaguaccaaaagaccaagaacaaugacugggacuacguagucaccaccgacaucagcgagaugggcgcuaacuuucgggccgaucgcgucaucgacccccggcgcugucuuaagccagucaucuugaaggacggacccgagcggguaauccuggccggcccaaugccagucacgguggccuccgcugcccagcgccggggccgcaucgggcgcaaucaaaacaaggagggggaccaguauguguacaugggccagccguuaaacaacgacgaagaccacgcucacuggaccgaggcgaagauguugcuggacaauaucaacaccccagaaggcaucaucccggcccucuuugagcccgagagagagaaaagcgcggccauagacggggaguaccgccugaggggcgaggccagaaagacauuugucgagcugaugcgccggggcgaccuccccguguggcuguccuauaagguggcuagcgagggauuccaguacucggaccggcgcugguguuucgauggcgagcgcaacaaccagguccucgaagagaacauggacguggagaucuggacgaaggaaggcgagcgcaagaaacuucggccccgcuggcuggacgcgaggaccuacagcgacccguuggcucuacgcgaguucaaggaguucgccgccggucgacgcagcgugucaggugaucugauacuggagaucggcaagcucccgcaacaccuuacccuacgagcccaaaaugcgcucgauaaccuaguuaugcugcacaauagcgagcagggagggaaggcguaccgccacgccauggaggagcuaccugacaccaucgagacgcuuaugcugcucgcccugaucgccguacugacggguggggugacccuauuuuuccuauccggcaagggccugggcaaaacaagcauaggccucuuaugcguaacagcuuccagcgcucugcucuggauggcguccguggagccccauuggaucgccgccagcaucauccuggaguuuuuccugauggugcuccugaucccggaacccgaccggcagcgcacgccccaggacaaucagcuggcguacguggugaucgggcugcuguucaugauccugaccguggccgccaacgagaugggccuccucgagaccacaaagaaggaccugggcaucgguuacguagccgccgagaaccaccaacacgcgacgaugcuagacgucgaucugcaucccgccuccgccuggacccuuuacgccguggccacgaccgucaucacgccuaugaugcggcacaccaucgagaacaccaccgcgaacaucagccucacggcaaucgccaaccaggccgccauucugaugggccucgacaaggguuggccuauuuccaagauggacaucggugugccccuacucgcgcuaggguguuacagccaggugaacccucucacauugacagccgccgugcuaaugcucguagcccacuacgccaucaucggccccggguuacaggccaaggccacucgcgaggcccagaagcgcacggcugcuggcaucaugaagaaccccacggucgacggcaucgucgccauagaccuggaucccguaguauacgacgcaaaguucgagaagcagcucgggcagauaaugcugcugauccucugcacgagucagaucuuacugaugagaaccacgugggcccucugugagagcaucacccuggccacugggccacugaccacgcucugggaggggagcccuggcaaguucuggaacacaacaaucgcggucucgauggccaacaucuucaggggcuccuaccuagccggggccggccuggccuuuagcuugaugaaaucccuggguggcgggcgucgcggcaccggcgcucagggggagacguugggcgagaaguggaagcggcagcucaaccagcuuagcaagagugaguucaacacauacaagcgauccgggauuauggaggucgaccggucagaggcgaaggagggccugaaaagaggggaaaccaccaagcacgcagucagucggggcacggcaaagcuccgaugguucguggagcgcaaucuggugaagcccgagggcaaggugaucgaccugggguguggccgagggggcugguccuacuacugcgcgggguuaaagaaggucaccgaggugaagggauauaccaagggcgggcccggccaugaggagccaauccccauggccacuuacggcuggaaccucgugaagcugcacuccggcaaggaugucuucuuuaugccacccgagaagugcgacacacugcuaugcgauauuggagagagcuccccgaacccuacgaucgaggagggccgaacgcugcgcgugcugaagaugguugagcccugguugaggggcaaccaguucuguaucaagauccugaaccccuacaugccgucggucguugagacccuggaacagaugcagagaaagcacggagggaugcucguacggaacccauuaucccgcaauucaacccacgagauguacugggucaguugugggacgggaaacaucguguccgccguaaauaugaccucccggaugcugcugaaccgcuucaccauggcccaccgcaagcccacguacgagcgcgauguggaccugggcgccggcacgcgucauguugcgguggagcccgaggucgcaaaccucgacaucauuggccagcggauugagaacaucaagaacgagcacaagaguaccuggcauuacgacgaggauaacccauacaagaccugggccuaccacggguccuacgagguuaaaccuagcggcuccgccagcuccauggucaacggaguggugaagcuccugaccaagcccugggacgucauucccauggugacgcagaucgccaugacggacaccaccccguuuggccagcaaaggguguucaaggagaaggucgacacgcggaccccacgcgcgaagcgcggaaccacucaaauaauggaggugacggcgaaguggcuguggggguuccucucucgcaacaagaagccccguauaugcacucgcgaggaguucacccggaaggugaggagcaacgccgcgaucggcgccgucuuuguagacgagaaccaguggaacagugcgaaggaggccguggaagacgaacgauucugggaccugguccaucgugagcgggagcugcacaagcaagggaagugcgccacgugcguauacaacaugaugggcaagcgagagaagaagcucggagaguucggcaaggcgaaaggcagccgggcuaucugguauaugugguuaggggccagauuccuggaguucgaggcccugggcuuuaugaaugaagaccacugguucagucgggagaacagccuguccgggguugagggagagggccugcauaaguuaggauacauacugagagacauuagcaagaucccgggagggaacauguaugcggacgauaccgccggaugggacacccggaucaccgaggaugaccuccagaacgaggcgaagauuaccgacaucauggagcccgagcaugcccuccucgccaccuccauauucaaguuaacauaccagaacaagguuguucgcguucagcgccccgccaagaacgggaccgucauggaugugauaagcaggcgcgaucagcggggcucaggacagguggggacguacgggcucaacacguucaccaacauggagguccaacugauccgacagauggagagugaggguauuuuccugccaagugagcucgagaccccgaaccuagccgagcgggcgcuggacugguuagagaagcacggcgccgagcgcuugaagcggauggccaucagcggggacgacugcguggugaagcccaucgaugaccgcuucgcaaccgcccugacggcgcucaacgacaugggcaaaguccggaaggauauuccccagugggagcccucaaagggcuggaacgacuggcagcaggucccguucugcagccaccacuuucaccaacugaucaugaaggacgggcgugaaaucguugucccaugccggaaccaggacgagcuggugggccgcgcacgggucucccagggggccggcuggagccuccgcgagacugccugccuggguaaauccuacgcccagauguggcagcugauguacuuccaucgccgugaccuccggcuggcggcaaacgccauaugcagcgcgguccccguggacuggguccccaccagccgaaccacgugguccauccacgcgcaccaccaguggaugacgaccgaggacaugcugagcgucuggaaccggguguggaucgaggagaacccguggauggaggauaagacucauguguccagcugggaggaaguccccuacuugggcaagcgcgaggaccaguggugcggcucccugaucggccugacggcccgcgccacgugggcgaccaacauccagguggccaucaaccaggugcggcgccucaucggcaacgagaauuaccuagacuacaugaccagcaugaagcgguucaaaaacgaguccgacccggaaggggcacugugguga

SEQ ID NO: 24066 - RNA, 9879 nt, Artificial Sequence
  derived and/or modified CDS sequence (opt11) from DENV-1__FJ850104__SS-prME
agcgugacuauguugcucaugcugcugccgaccgcccucgccuuccaccugaccacgcgcggcggggagccccacaugaucgugucaaagcaggagcgggggaagucacugcuguucaagaccucagcgggggucaacauguguacgcugaucgccauggaccugggcgagcucugcgaagauacuaugaccuacaagugcccgcgcaucaccgaagcggagccugacgacguggacuguugguguaacgugaccgacacgugggugaccuacggaaccugcagccaaaccggggagcaucggcgugacaagcgguccguggcccuggcaccccaugucggacucggcuuagagacccgcacagagaccuggaugagcuccgagggggccuggaagcagauucaaagggucgagacuugggcccugcgccaucccgguuuuacagugaucgcccuguucuuagcccacgccaucggcaccucaauuacacagaaagggauuaucuucauucuucugaugcuggugacacccuccauggccaugcggugcgugggcaucgggaaccgcgacuucguggaggggcugagcggcgccacguggguagacguuguucuggaacauggcuccugcgucaccacaauggcuaagaacaaacccacgcucgacauagaguuacugaagacggaggugaccaaccccgccgugcuccggaagcuaugcauagaggcuaaaauuucaaauaccacaacggauucccgcuguccgacccagggcgaggccaccuuagucgaggagcaggacgccaacuucgugugcagacguaccuuuguggaucggggcugggggaacggcugcggcuuguuugggaaggggagccugcugacgugcgccaaguucaagugcgucaccaagcucgagggcaagauugugcaguacgagaaccugaaguacuccgugauagucaccguacacacuggagaccagcaccaagucgggaacgagacgaccgaacacggaacgaucgcaaccaucaccccucaggcgccgacgagcgaaauccaacugaccgacuacggggcccugaccuuggacugcagcccccgcaccggccuagacuucaacgagauggugcuccugacgaugaaggagaaguccuggcuggugcacaagcagugguuccucgaccugccgcuucccuggaccuccggugccaguaccagccaggagaccuggaaccggcaggaccuccucguuacguucaagaccgcccacgccaaaaagcaggaggugguggucuugggcucccaggagggcgcaaugcacacugcccuaacaggggcuacggagauccagaccaguggcacaaccacgaucuucgcagggcaccugaagugccgccugaagauggacaaacucacgcucaagggcauguccuacgucaugugcaccggcagcuuuaaacuugaaaaagagguggcagagacccaacauggcacugugcuuguacaagugaaauacgaggguaccgaugcgccaugcaagauccccuucagcacucaggacgagaaaggugucacucagaauggccggcuaauuacggcuaaccccaucgugaccgauaaagaaaagccugugaacaucgagacugaaccgccuuucggggagucguacauugucgugggggcgggugaaaaagcguugaagcugagcugguucaagaagggaagcuccaucggcaaaauguucgaagcgacagcucgcggggcccggcgcauggccauccugggcgacacagcuugggauuucggguccauaggcggcguguuuacguccgucggaaagcuggugcaucaaguauucgggaccgccuaugggguccuguucagcggcguaaguuggaccaugaaaaucgggaucggcauccuccugacguggcugggccucaacagccgcucgaccucgcugagcaugaccugcaucgccguaggcauggugacccuguaccucggcgugauggugcaggccgacucagggugugucaucaacuggaagggcagggagcucaaguguggguccgguaucuucguuacgaaugaggugcacaccuggaccgagcaguacaaauuccaagccgacagcccgaaacgccugagcgccgcgaucggaaaggccugggaagaaggugucugcggcauccgcucugccacuaggcucgagaacauaauguggaagcagauuagcaacgaacugaaucacauccuccucgagaaugacaugaaauucaccguggugguuggugaugcgaacggaauccuggcccaggggaagaagaugauccggccccagcccauggagcacaaguacuccuggaagaguugggggaaggcgaagaucauuggcgccgacauccagaauacgaccuuuaucauugaugggcccgacaccccggagugccccgacgggcagcgagccuggaauaucugggagguggaggauuauggauucggcaucuucacaacuaauauuuggcugaaacuacgggauaguuacacgcagaugugugaccaccgacugaugucugccgcgaucaaggauuccaaggccgugcaugccgacaugggcuacuggaucgagagcgagaagaacgagaccuggaagcucgcacgggccagcuucauugaggucaagacguguacguggcccaagucacacacccuguggucgaacggggugcuagagucggagaugauaaucccgaagaucuacggcgggccgauaagccagcacaaccaccgucccggguacuucacacagaccgcgggacccuggcaucuggguaagcucgagcuggauuucgaccugugcgagggaacaacaguagucguugacgagcacugugggaaccgcggcccgucgcuccgcaccaccacggucacugggaaaaucauccaugaauggugcuguagguccugcacacucccgccccuacgguuccggggcgaggacgguugcugguacggaauggaaauccgucccgucaaggaaaaagaagaaaacuuagugcguucuauggucagcgccggaagcggggagguugacagcuuuucccuaggcauccugugcgugagcaucaugaucgaggaggugaugaggucccgguggagccgcaaaaugcugaugaccgggacacuggccgucuuccuucuccugaucaugggccagcuaaccuggaacgaccugauccgacugugcauuauggugggagccaacgccuccgacagaaugggcaugggcacuaccuaccuggcccucauggccacguucaagaugcgcccuauguucgcagugggccugcuuuucaggcgucucaccucccgggagguacugcuacucaccaucgggcugucccugguggccagcgucgagcucccuaacagccuugaagaacugggggacggacucgccauggguaucaugaugcugaagcugcucaccgaguuccaaccgcaucaguuauggacgacccugcugucacugacguuugugaagaccacccuaucacucgacuacgcguggaagacuaccgccaugguccugucgauagucucucuguucccgcucugucugagcaccacgucccagaagaccaccuggcugccggugcuccuggggagcuucggcugcaagccccugacgauguuccucaucaccgagaacaagaucuggggacgcaaguccuggccacugaacgagggcaucauggccaucgguaucgugagcauccuguuguccucgcuacugaaaaaugacgucccgcucgccggcccgcugaucgcgggagggaugcugauagcaugcuacguaaucagcgggagcagcgcugaccucucccuggaaaaggcagcugaggugucgugggagcaggaggcugagcacuccggggccucgcacaacaucuuaguggaggugcaagaugauggcacgaugaaaaucaaggacgaagaacgggacgacacccucaccauccugcuaaaggcgacccuccuagcaguguccggggucuaccccaugagcaucccggcgacucuguucgugugguacuucuggcagaaaaagaaacagcguucaggcgugcucugggacacccccagcccgcccgaggucgaacgggcugugcuggacgacggaaucuaccguauacugcagcggggccuguuaggccgcucccaaguaggggucggcguauuccaggacgggguguuccacacaauguggcaugucaccagaggggccgugcuaauguaccagggcaagcgcuuggagcccucgugggcuuccgugaagaaggaucucaucucauacggaggaggguggagauuccaggggaguuggaacacuggggaggagguccaggucaucgcaguagaacccgggaaaaaucccaagaauguccagaccacccccgggaccuuuaagacgccggagggggaggugggggccaucgcgcuggacuuuaaaccaggcaccagcggcuccccgaucgugaaucgcgaggggaagauugucgggcucuacggcaauggcguugucaccaccucuggcacguacgucuccgcgaucgcacaggcgaaggccagucaggaggggccccuccccgagaucgaggacgaggucuucaagaaacggaaucugaccaucauggaccuacacccaggcucuggcaagacccgcagauacuuaccggcuaucguacgcgaggccaucaagcguaaacugcggacccugauucucgcgcccacgcgcgucgucgcguccgagauggcggaggcccugaaagggaugcccauccgguaccagacaacagccgucaagagcgagcacacaggcagagagauugucgaccugaugugccacgccacuuucaccaugagacuccugucuccgguucgcgugcccaacuacaacaugauaaucauggacgaggcccauuucacagacccugcgagcaucgccgccagaggguacauauccacucgcgucggcaugggcgaggccgcggcgaucuucaugacggccacgccgcccgguagcguggaggcauuuccucaguccaacgccgugauccaggacgaagaacgggacauccccgagcgcucguggaacuccggcuacgacuggaucaccgauuuucccgggaaaaccgucugguuugugcccagcaucaaguccggaaacgacauugccaacugccugcggaaaaacgggaagagagugauacaacucucacggaagacguucgacaccgaguaucagaagaccaagaacaacgacugggacuacgucguaaccaccgacaucuccgagaugggugcgaacuuucgcgccgaccgggugaucgaccccagaaggugccugaagcccgucauccugaaggacgggcccgagcgcgugauccucgccggcccgaugcccgucacuguggcuagcgcggcacagcggcgcggccguaucgggcggaaucaaaacaaggagggagaccaguacguguacauggggcagccccuuaacaacgacgaggaccaugcccacuggaccgaggccaaaaugcugcucgacaacaucaauacccccgagggcaucauaccggcucuguucgagcccgagcgcgaaaaauccgcugcuaucgacggugaguaccguuugcgcggagaggcccggaagacauuugucgaacucaugcgccggggcgaccugcccguguggcucucauacaaagucgccucagaggguuuccaguauagcgacagacgguggugcuucgacggcgagcgcaauaaccagguucuggaggagaacauggacguugaaaucuggacgaaagagggggagcggaagaaacugagaccccgguggcuugacgcccgcacuuacucagacccgcuugccuugagggaauuuaaggaguucgccgccgggcgacggagcgucagcggagaccucauccuugagaucgguaagcucccccaacaccugacgcuccgcgcucagaacgcccucgauaaccugguuaugcuccacaacuccgagcagggcgggaaagcguauagacaugcuauggaggaacugcccgauacaauagagacgcugaugcuccuggcacugaucgcgguccucaccggaggggugacccuauucuuccugagcggcaagggacucgggaagaccuccaucggccugcuaugcgucacggccucguccgcccucuuauggauggccagcguggagccccacuggaucgccgccucaaucauccucgaguucuuucuuauggugcugcuuaucccggaacccgaccgccaacgaacgccccaggauaaccaguuagcguacgucguuauagggcuguuauucaugauacuuaccguggcggccaacgagaugggccugcuagaaaccaccaagaaggaccuagggauuggcuacgucgcugccgagaaccaccagcacgcgacaaugcuggacguugaucuccgaccagcuagcgccuggacuuuguacgccguggcaaccacugucaucacccccaugaugaggcauacgauagagaauaccacugcgaacauaucccugacagccaucgccaaccaggcggcaauacugaugggccucgacaagggauggcccauuagcaagauggacaucggcgugccccuguuggcgcucgggugcuacucccaagugaacccgcugacccuuaccgccgcggucuuaaugcuaguggcccacuacgcgaucaucggacccgggcugcaggccaaggccacgagggaagcacagaagcgcacugccgcuggcaucaugaagaacccgaccguggacgguaucgucgccauugaccuggaccccgucguguacgacgcgaaguuugaaaagcagcuugggcagaucaugcugcuuauccugugcaccagccaaauccugcucaugcggacgaccugggcucugugcgagucuauuacccuggccacgggcccgcucacgacccucugggaggggagccccggcaaauucuggaacaccaccauagccgugucgauggccaacaucuucagaggaucuuaccuggcgggggcaggccucgcauucucccugaugaaaucucuuggcggcggccggcgcgggacgggagcgcagggcgagacucugggcgagaaguggaagcggcagcugaaccagcugucuaaaagcgaguucaacaccuacaagcgcagcgggaucauggagguggaccgguccgaggcuaaagagggguuaaaacgcggugaaacuacgaagcacgccgugagccggggcacggccaagcuccgcugguucgucgagcggaaccuugugaaaccugaggguaaggugaucgaccugggcugcggccgcgggggcugguccuacuacugcgcgggccuaaagaaagucaccgaaguaaaggguuauaccaagggcgggcccggccacgaggagccgauuccgauggccacauacggguggaaccuggugaagcugcacagcgggaaggacgucuucuucaugccucccgagaaaugcgacacccuccuuugcgauauuggggaguccagcccaaauccuacgaucgaggagggccgcacccugagagugcucaagaugguggaacccugguuaaggggaaaccaguucugcaucaaaauccugaaccccuacaugccguccgucguggagaccuuagagcaaaugcagcgcaagcacgggggcaugcugguccggaauccccugaguaggaacuccacgcacgagauguauugggucagcugcgggaccgguaacaucguauccgccguuaacaugaccucucggaugcuccugaaccgcuucaccauggcccaccgcaaacccacuuacgagcgggaugucgaccugggggcagggacccggcauguggcgguggagcccgaggaagccaaccucgauaucauaggacaacgcaucgagaacaucaagaacgagcacaaauccaccuggcacuacgacgaagacaacccguacaagaccugggccuaccaugggucuuacgaggucaagcccaguggcagcgcaucgucgauggugaacggggucgugcgccucuugacgaagcccugggacgugauccccauggucacccagauagccaugacugacacuaccccguucggacagcagcgugucuucaaggagaagguagacacccgcacgccccgcgcgaagcgcgggacgacgcagaucauggaagugaccgccaaguggcucuggggguuucugucccguaacaagaagccucgcaucugcacccgugaagaguuuacccgcaaggugcggucgaaugccgccaucggcgccguauucgucgacgagaaucaguggaauagcgcgaaagaggccguugaggacgagcgcuucugggaccuggugcaccgggagcgcgagcugcacaagcagggaaagugugcaaccugugucuacaacaugauggguaagcgggagaagaagcugggagaauuugguaaggccaaggggucccgcgcgaucugguacauguggcuaggugcccgguuccuugaguucgaggcucucggcuuuaugaaugaggaccacugguuuagcagggagaacagccugagcgggguugagggcgaggggcuccacaagcugggcuauauccuccgggauaucucaaagaucccgggcgggaacauguacgccgacgacaccgccggcugggacacacggaucacagaggacgaccuccagaacgaggcgaaaaucacggacaucauggagcccgagcacgccuuauuagcuacaucaaucuucaaacuuaccuaccagaacaaggugguccgcgugcagcggcccgccaagaacgggaccguuauggacgucaucucccgaagagaccagcguggcucaggccagguggggacguauggccugaacaccuuuaccaacauggaaguccagcucauccggcagauggaguccgaagggaucuuccucccguccgagcucgaaaccccgaaccuggccgaacgcgucuuggacuggcuggagaaacauggcgcagaacgucugaaacgcauggccaucuccggagacgauugcguagugaagcccaucgacgaucgguuugccacggcgcugaccgcgcuaaacgacaugggaaagguccgcaaagacauaccccaaugggagcccagcaagggcuggaaugacuggcagcaggucccguucugcucccaucacuuccaccaacugaucaugaaggacggacgggagaucguugucccaugccgcaaccaggacgagcuugugggccgggcgcgagugucgcagggggcuggauggucacugcgugagaccgccugccugggcaagagcuacgcccagauguggcaacuuauguauuuccaccgcagagaccuucgucuggcggcgaacgccauuugcuccgccguccccguggacuggguucccaccagccggaccacuuggagcauucacgcccaccaccaguggaugacaacggaggacaugcucagugucuggaacaggguguggaucgaggaaaacccguggauggaagauaagacacacgucagcuccugggaagaggucccuuaccugggcaagagagaggaccaguggugcgggagccugaucgggcucacugcgcgugccaccugggccacuaacauccagguggccaucaaccaaguccgacggcugaucgggaacgagaauuaccuggacuacaugaccucaaugaagcgguucaagaacgaaucugaccccgaaggugcccucugguga

SEQ ID NO: 24067 - RNA, 9879 nt, Artificial Sequence
  derived and/or modified CDS sequence (opt11) from DENV-1__JN819405__SS-prME
ucugugaccaugcugcuaaugcugcuacccacugcccucgcguuccaccugacaacccgcggcggggagccccacaugauagugucgaaacaggagcgggggaagagccugcuguucaaaacaagcgcuggggugaauaugugcacccugauugccauggaccugggggagcucugcgaggacacuaugaccuacaagugccccaggaucacggaggccgagccagaugacguagacugcuggugcaacgccacugacaccugggucaccuacgggaccuguucacagacuggggagcaccgaagggacaaacggucaguagcccuggcgccccacgugggucugggccucgagacccggaccgaaaccuggaugagcuccgaaggcgccuggaagcagauccaacgaguggagaccugggcccugcgacaccccggguuuacggugaucgcccuguuccucgcgcacgccaucgggacgagcaucacccaaaagggaaucaucuucauccugcugaugcucgugaccccguccauggccaugcggugcgucggcaucggcaaccgggacuucguugaagggcugagcggcgcuacguggguggacgucgugcuggagcauggguccugugugaccaccauggccaagaacaagccgacccucgauaucgagcuguuaaagacggaggucacgaaucccgcgguguugcggaagcugugcaucgaagccaagaucagcaauaccaccacggacucccgcugcccgacacagggcgaagccacgcugguggaagagcaggacgccaacuucgucugccggaggaccuucgucgaccggggcugggggaacggcugcggcuuguucgggaagggaaguuuacugacgugcgccaaguucaagugcgugaccaaguuagaagggaagaucguccaguacgaaaaccugaaguauuccguuaucguaaccguacacaccggcgaccagcaccaaguggggaacgagacgaccgagcauggaaccauugcgaccauuacgccccaggcccccacgagugagauccagcuaacagacuacggggcccucacccuggacuguagcccccguaccggccuagacuucaacgagaugguccucuugacgaugaaggaaaaguccuggcuggugcacaagcagugguuccucgaccugccacugcccuggacaucuggggccucaacuagucaggagaccuggaacaggcaggaucuccuggugacguucaaaaccgcccacgcuaagaagcaggaggucguggugcugggaucccaggagggggccaugcacaccgcccucaccggugcgacugaaauccagaccaguggcaccaccacgaucuucgccgggcaccuaaagugucgccugaagauggacaagcucacacugaagggcaugucauacgucaugugcaccggguccuucaagcuagagaaagaaguggccgaaacccaacacggcacgguucugguccaggugaaguaugagggaaccgacgcccccugcaagauccccuucuccacccaggaugagaaaggggugacccagaacggccggcucaucacggccaacccuaucgugacagauaaggaaaaacccguuaacaucgaaaccgagccacccuuuggggaguccuauaucgugguuggcgccggcgagaaggcgcucaaguuaagcugguuuaagaaagggagcuccaucggcaaaauguuugaggcaaccgcccgcggggcccggcgcauggccauccucggcgacacggcgugggacuucgggagcaucggcggcguuuucaccuccguggguaaacugguccaucagguguucgggaccgccuacggggugcuguucagcggcguuuccuggaccaugaagaucgggauuggcauccuccugacauggcucggacucaacagccgauccaccagccuguccaugacuugcauugccgucggaauggugacccucuaccuuggcgucaugguccaggccgacagcgggugcgugaucaacuggaaaggccgggaacuaaagugcggauccgggauauucgucaccaacgagguucacaccuggaccgagcaauacaaguuccaggccgacagcccgaagcgccugagcgcggcuaucggcaaggccugggaggaagggguauguggaaucagauccgccacccgccuugagaauaucauguggaagcagaucagcaaugaacuaaaccauauccugcucgaaaacgauaugaaauucaccgucguggugggggacgccaacgggauccuggcccagggcaagaagaugauacgcccgcagcccauggagcauaaauauuccuggaaguccugggguaaggccaagauaauuggcgccgacauccagaauacuaccuucauaaucgacggacccgauaccccagagugcccggacggacagcgcgccuggaacaucugggagguagaggacuacgguuucggcauauucaccacgaauauuuggcugaagcuccgggacuccuacacccagaugugcgaccaccgacugaugagcgcggccaucaaggauucaaaggccguccacgcagacaugggcuacuggaucgaguccgagaaaaacgagaccuggaagcuggcacgggcgagcuuuaucgaggugaaaaccugcacguggcccaagagucacacucucugguccaacgggguccuggagagcgaaaugaucauccccaagauauacggcgggccgaucagucagcacaauuaccgccccggguacuucacccaaaccgccggcccauggcaccugggcaagcucgagcuugacuucgaccuaugugaaggcacgaccgugguggucgacgagcacugcgggaaccggggcccgagcuugcgcaccacgacagugaccgggaagauuauucacgagugguguugccgguccugcacacugccgccucugcgcuuccggggcgaggacgggugcugguacggaauggagauccgaccggucaaggagaaggaggagaaucucguccggagcaugguguccgccggaagcggggagguggacagcuucucccugggaauccugugcgucagcaucaugaucgaagaggugaugcgcuccagauggagccgcaagaugcuuaugaccgguacgcuggccgucuuccugcuccugaucaugggccagcugaccuggaaugaucugauccgccugugcaucauggucggggccaacgcguccgacagaaugggcaugggcaccacccaccuagcacucauggccacguucaagaugcgcccgauguuugccguggggcugcuauuccggcgccucacuucgcgggaggugcuucucuugaccaucggccuaucacugauggccucgauggaacuccccaauagccuggaggagcuaggggacggcuuggcgaugggcaucaugaugcugaaacuucucaccgaauuucagccccaccagcuguggacgacccugcugagccugacauucgucaagaccacgcucucccucgacuacgccuggaagaccacagccaugauucugucgaucgucucccuguucccccuaugccuguccacuacgucacagaaaacaaccuggcuuccgguccuccuggggagcuucggcugcaaaccccugaccauguuccucauuacagagaacaagauuugggggcgcaaaucauggccccugaacgagggcaucauggcaauugggaucgugagcauccugcucuccagccugcugaagaacgacgugccauuagcgggaccucugaucgcgggcgguaugcugaucgcgugcuacgucaucagcggguccucggcugaccucucccuggagaaggccgcggaggugucgugggagcaagaagcagaacacuccggggccagccacaacauccugguggaggugcaggacgauggcacgaugaagaucaaggacgaggagcgagacgacaccuugaccauccugcugaaggccacccugcuggccguguccgggguguaccccaugucaauacccgccacgcucuucguuugguauuucuggcaaaagaaaaagcagagaucaggcgugcucugggauacccccagcccgccagagguggagagagccguacuggacgacggcaucuaccgcauuuuacagcgcgggcuacucggucgcucccaggugggggucggcgucuuccaggaugggguuuuccacaccauguggcacgugacccggggcgccguccugauguaccaggggaagcgccuggagcccagcugggccucggugaagaaggaccuaauuagcuacgggggcggguggagauuccagggcuccuggaacacgggggaagaggugcaggucaucgccguggaaccagguaagaacccgaagaacguucagaccacccccggcaccuuuaagacgcccgagggggagguaggcgcgaucgcccuggacuucaaacccgggaccagcgggucccccaucgugaaccgcgaaggcaagaucguugggcuguacggcaauggggugguaaccaccucaggaacauacguguccgccauugcccaagccaaggcaucgcaggaggggccccugcccgagaucgaagacgagguuuucaaaaagcgaaaucugaccaucauggaccugcauccgggcagcggcaagacccgccgguaccuccccgccaucguccgcgaggccaucaagcggaagcuacgcacccugauccucgcccccacacgcgugguagcguccgagauggcugaggcccugaaggggaugcccauucgguaucagacaaccgccguuaagagcgagaccacgggccgcgaaauuguggaccugaugugccacgcaaccuucaccaugcguuugcuguccccgguucgggugcccaauuacaacaugaucauaauggacgaggcucauuucaccgaucccgcuucaauagccgcccgaggguacaucuccacgcgaguggggaugggggaggccgcugccauauucaugacagccacgccgcccggcagugucgaggcauucccccaguccaacgccgugauccaagacgaggagcgggacauccccgagagaagcuggaacucgggauacgacuggaucaccgacuuccccgggaagacggugugguuuguucccucuaucaaguccggcaacgacaucgcgaacugccugcgcaagaacgggaagcgcgugauccaguugucgcggaagaccuucgacaccgaguaccaaaagaccaagaacaacgacugggacuacguggugacgaccgacaucucagagaugggggcgaacuucagggcagaccgggugaucgacccccgccgguguuugaagcccgucauccugaaggacggccccgagagggucauccucgccgggccgaugcccguuaccguggcgagcgccgcccaacggcguggcaggauaggaaggaaccagaacaaggagggugaccaguacguuuacauggggcaaccucugaauaacgacgaggaucacgcacacuggaccgaggccaagaugcugcuugacaacaucaacacucccgagggcauaauaccggcgcuguucgaaccggagcgagagaaaucagccgccauugacggggaguaccggcugcgcggcgaggcccggaagacuuuuguggagcucaugcgccguggagaucugccgguauggcugagcuacaagguggccuccgagggauuucaauacagugaccgccgguggugcuuugacggcgagcgcaauaaccagguacuggaggaaaacauggacgucgagaucuggaccaaggaaggugaaagaaaaaagcuccgaccccgguggcuggacgcgcgcaccuauucggacccucuugcccugcgugaauuuaaggaauucgccgccgggcgccgcucggugucaggugacuuaaucuuagagaucgggaagcugccccagcaccugacuuugcgcgcgcagaacgcguuggacaaccugguuaugcuccauaacagcgagcagggcgggaaagccuaccgacacgccauggaggagcugcccgacacuaucgagacccugaugcuccuggccuuaaucgcggucuugacgggcggggugaccuuguucuuccuaucuggcaagggccucgggaaaacgucgaucggccugcugugcgugacugccuccuccgcgcuccuguggauggccucuguggagccccacuggaucgcagccucgaucauccuggaguucuuucucauggugcugcugaucccggagcccgauaggcagcggacgccccaggacaaccaacuagccuacguggucaucgggcuguuauuuaugaucuugaccguggccgcaaacgagaugggccugcuugagacgaccaagaaggaccuugggaucggcuacguagcagcggagaaccaccagcacgccacgaugcuggacgucgaucugcgcccugccagcgccuggacacucuacgcuguggcgacgacagugauaacgcccaugaugcgacacacgaucgagaacacuaccgcgaacaucagucugaccgccauugccaaccaggccgcuauccuaaugggguuggacaaaggguggccgaucagcaagauggacauuggcgucccccuccuggccuuagggugcuacucccaggucaacccgcugaccuugacggcugccguccucaugcuggucgcucauuacgcgauuaucgguccaggauuacaggccaaggccacccgcgaggcccaaaagaggaccgcggccggcaucaugaaaaacccgacaguggauggcaucguggccaucgaccucgaccccgucguuuaugacgcuaaguucgagaagcagcuggggcagaucaugcugcucauccugugcaccagccagauccugcucaugcguacuaccugggcccucugcgagagcaucacccuggcgacuggaccgcucaccaccuugugggaagggagccccgguaaauucuggaacacuacgaucgccgugaguauggccaacaucuuccgcggcagcuaccuggccggggcgggccucgccuucucccugaugaagagucucggcggcggccggcgugguaccggcgcacagggggaaacucucggcgagaaauggaagcggcagcugaaccagcugagcaaaagcgaguucaacacauacaagcgcucagggaucauggagguugacagguccgaggccaaggagggccugaagaggggggaaacgacaaagcacgccgucagucggggcaccgccaagcugagaugguuuguggagcggaaccuggucaaacccgagggaaagguuauagaccuugggugcggccgcgggggcugguccuacuauugcgccggccugaagaacuucacggagguaaaaggguacaccuccggaggacccggccacgaggagccgauccccauggccacguacgguuggaaucucguaaagcugcacuccggcaaggacguuuucuucaugccgcccgagaagugcgacacccugcuuugugacauaggggagucguccccgaacccgacuaucgaggagggccggacccugcguguacucaagaugguugagccauggcucaagggcaaccaguucugcaucaagauuuugaacccuuacaugccgagcgugguggagacgcucgagcagaugcagcggaagcacggaggcaugcugguccgcaacccccugucccggaacuccacccacgagauguauuggguauccugcgggacgggcaacauagucagcgccgucaauaugaccucccgcaugcuccugaaucgguucacgauggcgcaccggaagcccacuuacgaacgcgaugucgaccugggggccgggacccgucacguggcggucgagccagagguggccaaccuggacauuaucggccaacgcauagagaacauuaagaacgagcacaagagcaccuggcacuacgaugaggacaacccguacaagacgugggcauaccacggguccuaugaggugaaaccgagcggauccgccagcuccaugguuaacgggguggugcgucuucuuaccaagcccugggacgucauccccauggugacccagauagcgaugaccgacacgacucccuucggccagcagcgcgucuucaaggaaaagguggacacccguacaccccgcgccaagagggggacgacccagaucauggaggucacagcaaaguggcucuggggguucuuaagccgcaacaaaaagccgcggaucugcacccgugaggaguucacgcggaaagugcgcaguaacgccgcuaucggugcgguguucguggacgagaaccaguggaacucggcgaaggaagccguugaggacgagcgguucugggaccuggugcaccgcgagcgggagcuccacaagcaggguaagugcgcgaccugugucuacaauaugaugggcaagcgcgagaaaaagcugggggaguuuggcaaggcgaagggcagccgggcuaucugguacauguggcugggggcccgguuccuggaguucgaggcccugggcuucaugaacgaggaccauugguucucgcgggaaaacagccucuccggcgucgagggcgaggggcuccacaagcuuggcuacauucuacgggacaucucaaagaucccgggcgggaacauguaugccgacgauaccgcgggcugggacacccggaucacggaggacgaccuccagaacgaggccaaaauaacggacaucauggagcccgagcacgcccugcuggcuaccucgaucuucaaguuaaccuaccagaacaagguggugcgaguccagcgcccagcaaagaacgggacggugauggauguuaucagccgucgcgaucagcggggcuccggacaaguggguaccuauggccuaaacaccuuuacuaauauggaggugcagcugauccgccagauggagucagaggggaucuuucuccccucagagcuggaaacgccgaaccuggcggagcggguccucgacugguuagaaaagcacggcgccgagcgccugaaacggauggccaucagcggggacgacugcgucgugaagcccauagaugaccgcuucgccacugcucucaccgcuuuaaacgacaugggcaaagugcgcaaggacaucccacagugggagcccuccaagggcuggaacgacuggcagcaagucccguucugcagccaccauuuccaucagcugauaaugaaggacgggcgcgagauagucgugcccugccggaaccaggacgaguuggucggccgcgcucggguaucccaaggagccgguuggucacuacgugagaccgccugccuggggaaguccuacgcccagauguggcagcucauguacuuccaccggcgagaccugcggcuggccgcaaacgcaaucugcuccgccgucccggucgauuggguacccaccucaaggacgaccugguccauucacgcgcaccaccaguggaugaccaccgaagacaugcucagcguguggaaccgggucuggaucgaggagaacccguggauggaggauaagacucacgugucaagcugggaggagguccccuaccugggcaagcgcgaggaccaguggugcggcucacugaucgggcucaccgccagggcuaccugggcgacgaacauacaggucgccaucaaccagguucgacgccugauuggcaacgagaacuaucuggacuacaugacgagcaugaagcguuucaagaaugagagugaucccgagggggcgcucugguga

SEQ ID NO: 24068 - RNA, 9879 nt, Artificial Sequence
  derived and/or modified CDS sequence (opt11) from DENV-1__GQ199877__SS-prME
uccgugacuauguugcucaugcugcugcccaccgcgcucgcguuccaccucaccacccggggcggggaaccacacaugaucguguccaagcaggagcggggcaagagccuccuguucaagaccagcgcgggcgugaacauguguacccuaaucgcaauggaccugggcgagcucugcgaagacaccaugaccuacaagugcccccggauuaccgaagccgagcccgacgacguggauugcuggugcaacgcgaccgacaccuggguuaccuaugggaccugcagccagacgggcgagcaccggcgagagaagcgcuccguggccuuagcgccccacgugggccugggucucgagacccgcacagaaaccuggaugagcuccgaaggcgccuggaagcaaauccagcgggucgagaccugggcccugcgccaccccggguucacggugaucgccuucuuccuggcgcacgccaucggcaccagcaucacccagaaggggaucaucuucauccuuuugaugcuggugacccccuccauggccaugcgcugcgucggcauuggcaauagggacuucguggaagggcuaagcggcgcuacguggguggacgucgucuuagagcacggguccugcguaaccaccauggccaaaaacaagcccacccuggauaucgagcuccugaagacggaggugacaaaccccgcggugcugcguaaguuaugcaucgaggccaagaucagcaacaccaccacggauucccgcugcccgacccagggcgaagccacccugguggaagaacaagaugcgaacuucgucugccggcgcaccuucguggacagaggcugggggaacggcugcgggcuguucggcaaggggagcuuacugacgugcgccaaauucaagugcguaacuaagcuggagggcaaaaucguccaguaugagaaccuaaaguacucggugaucgucacuguccacaccggcgaccaacaccagguggggaacgagacgaccgagcacgguaccauagcgacaaucacgccccaggcccccacgucagaaauccaacugaccgauuacggggcccugaccuuagauuguagcccucggaccggccuggacuucaacgagauggugcuccucacgaugaaggagaagucgugguugguccacaagcaaugguuccuggaccucccgcugccauggaccucgggugcaagcaccagccaggagaccuggaacaggcaggaccucuugguuacguucaaaacagcacaugcgaaaaagcaggaggucgugguguuagggucccaggagggugcaaugcacaccgcccugacaggcgccacugagauccagaccaguggcaccaccacgaucuucgccgggcaccuaaagugcagauuaaaaauggauaagcugacucucaagggcaugaguuacguaaugugcaccgggagcuucaagcuggagaaggagguggcggagacccaacauggcacugugcugguccagguaaaauacgagggcaccgacgcccccugcaagauccccuucuccacgcaggacgagaagggggugacccaaaauggccggcugaucacggccaauccgauagucaccgacaaggagaagcccguaaacaucgagaccgagccgcccuucggggagagcuacauuguggucggcgcgggcgaaaaagcccugaaacuguccugguucaaacgggggagcuccaucgggaagauguucgaggccaccgcccgcggggcgcgccgcauggccauccugggcgacacggcgugggacuucgggagcaucggcgguguguucacuucaguggggaaguugguacaccagguguucgggaccgccuacggggugcuguucagcggugucucuuggaccaugaaaauugggaucggaauccugcucacguggcugggccugaacucucggucaacaagucuuuccaugacuuguaucgcugucggaauggugacccuguaccugggcgucauggugcaggccgacagcgggugcgugaucaacuggaagggcagggagcucaagugcggguccggcaucuucguaacuaacgaggugcacaccuggacagagcaauacaaguuccaggcugacagccccaaaagacugagcgcggccaucggcaaggcgugggaggagggagugugcggcauccguuccgccacccggcuggagaacaucauguggaagcaaaucagcaaugagcucaaccacauccugcuggagaacgacaugaaauucaccguugucgucggggacgccaacggcauccucgcgcagggaaagaagaugauccguccucagcccauggagcacaaguacuccuggaagaguuggggcaaagccaagaucaucggcgccgacauccagaauacgaccuucaucauugacgggcccgauacccccgagugccccgacggucagcgggccuggaacaucugggaggucgaggacuauggguuuggcguguucaccacgaacaucuggcugaagcugagggauaguuauacccagaugugcgaccacaggcugaugucugcggccauuaaggacuccaaagccguacacgccgauaugggcuacuggaucgagagcgagaagaacgaaaccuggaaacuggcccgcgcguccuucaucgaaguaaaaaccuguacguggcccaagagucacacccuguggucuaacggcgugcucgagagcgaaaugaucauccccaagaucuacggcgggccgauuucacagcacaacuaccggccgggcuacuucacccagaccgccgggcccuggcaucucgggaagcuggaguuggauuucgaccugugcgagggcacgaccguggucguugacgagcacugcgggaaccgaggcccgagcuugcggaccacuacggugaccgggaaaaucauccaugaauggugcugccgcuccugcacguugccgccccugcgguuccgcggcgaggacgggugcugguacggcauggagauccggcccgucaaggagaaggaggagaaccugguccgcagcaugguuagugccggcucuggggaggucgacucuuucucccucgggaucuuaugcgugagcaucaugaucgaggagguuaugcgcucccgcuggagccgcaagaugcugaugaccgggacgcuagccgucuuccugcugcucaucaugggucagcugaccuggaaugaccugauccggcucugcaucauggugggggccaacgcguccgaucggaugggcaugggcaccaccuaccuggcccugauggccacguucaagaugcggccgauguucgccgugggguuacuguuccgccgauugaccagucgcgaggucuugcugcugaccaucgggcucucccugguagcuagcgucgaacugcccucgagccucgaggagcucggggacggccuagcgaugggcaucaugaugcucaagcugcugacagaguuccagccccaccagcucuggacgacccuucugagccucacuuucgucaagaccacgcugagccuggacuacgccuggaagaccaccgcaauggugcucucaauagucagccuguucccgcugugccucuccacaacgagccagaagaccacauggcugcccgugcugcucgggucuuucggcuguaagccacugaccauguuccucaucaccgaaaauaagaucugggggcgcaagucauggccccucaacgaaggaauuauggccauagggaucguuuccauacugcugagcagccugcugaaaaacgacgucccccuggcgggcccgcucauugccggagggaugcugauugccugcuacgugaucaguggcagcuccgccgaccugagccucgagaaggccgcggaggucuccugggagcaggaagccgagcacagcggggccucccacaacauucucgucgaggugcaggacgacggcacgaugaagaucaaggacgaggaacgcgacgacacucugacgauccuccugaaggccacccugcucgccguuagcgggguauaccccauguccauccccgcgacguuguucgugugguacuuuuggcagaaaaagaagcagcgcagcggagugcugugggacacccccuccccgcccgaggucgagcgcgccguccucgaugacgguaucuaccguaucuuacaacgcgggcuguuaggccggucucaggugggggucggcguguuccaagacgggguguuccacaccauguggcacgucacccgaggcgcgguacucauguaccagggcaagcguuuagagcccuccugggcgucgguaaagaaggaccugaucucguacggaggggguuggcgcuuccaaggcucauggaacacgggggaggagguccaggugauugccguggagcccggcaagaacccgaagaacguccagacgacccccggcaccuuuaagacgcccgagggggaggugggcgcuaucgcccucgacuucaaacccgggaccuccggcagcccgaucgugaaccgagagggcaagauugucgggcuuuacggcaacgggguggugacgaccuccggcaccuacgucagcgcaauugcgcaggccaaggcgagccaagaggggccccugcccgagaucgaggacgagguguuuaagaagcgcaacuuaaccaucauggaccugcaucccggcuccgguaagacccggcgcuacuuaccugccaucgugcgggaggccaucaagcgcaaacuccgcaccuugauccucgcgcccacgagggucguggcgagcgaaauggccgaggccuugaaggggaugcccauccgcuaccagaccacagccguuaaaucagagcacaccggucgggagauugucgaccugaugugucacgccacguucacaaugcgccugcucagcccggugcgggugcccaacuacaacaugaucauaauggacgaggcgcacuucaccgaccccgccuccaucgccgcccgcggguacaucagcacucgggucggcaugggggaggccgcggccauuuuuaugacggccacgccgcccggcagcguggaggcauucccccagagcaacgccgucauccaggacgaggagagagacaucccggagcgguccuggaacagcggcuacgacuggaucaccgacuucccagggaagaccgucugguucguccccuccaucaagagcgggaacgacaucgcaaacugccugcgcaagaacgggaagcgggugauccagcugucccguaagacguucgacaccgaguaccagaagaccaagaacaacgacugggauuacgucgugaccacggacaucagcgagaugggcgccaacuuccgggccgaccgcgucaucgacccacggcgcugccucaagcccgucauccugaaggacgggcccgagcgggugauccuggccggcccgaugcccgucaccguggcauccgccgcccagagacggggccgcaucggacgcaaccagaacaaagagggcgaccaguacguguacauggggcagccacuuaacaacgaugaggaccacgcccacuggaccgaggcuaagauguuacuggacaacaucaauacccccgagggcaucauaccagcccucuuugagcccgaacgggagaaguccgccgccaucgacggggaauaccgccugcggggcgaggcccguaaaacguucgucgagcugaugcggcgcggcgaccuccccguguggcuguccuacaagguggccuccgagggcuuccaguauucagaccggcgcuggugcuucgauggcgagcggaacaaccaggugcuggaggagaacauggacguggagaucuggacaaaggagggugagcggaaaaagcucagaccccgcuggcuggacgcgcggaccuacagcgacccguuggcccugcgcgaguucaaggaguucgcugccggaaggcgcagcguguccggggaucugauccuggaaaucgggaaacucccccaacaccugacauuacgggcgcagaacgcgcuagauaaccuggucaugcugcacaauucggagcagggcgggaaagccuaucggcacgccauggaggaacuccccgacaccaucgagacgcugaugcugcucgcgcugauugcggugcugacaggcggggugacccucuuuuuccuguccggaaaaggccuggggaagaccucaaucggccuccugugcguaacagccuccagcgcccuucucuggauggccuccguggaaccccauuggauagcagcaagcaucaucuuggaguucuuucugauggugcuccugaucccggagccggaccggcagcgcacgccccaggacaaccagcuggcauacgucgugaucgggcuacuguucaugaucuuaacuguggccgccaacgagaugggguuacuggagaccacgaagaaggaccuggggaucggcuacgucgccgcggagaaccaccagcacgccaccauguuagauguggaucuccacccugccuccgccuggacccuguacgcuguugcgaccacggucauuaccccaaugaugcggcacaccaucgagaacaccacagccaauaucucucucaccgccaucgccaaccaagccgcuauacuaaugggccuggacaaaggguggcccauuuccaagauggacaucggcgugccccucuuggcccugggguguuacagccaggugaauccccucacccugacggcggcgguccugauguuaguggcgcacuacgccaucaucggccccggacugcaggccaaggccacgcgcgaggcgcagaagcgcacggcggccggcaucaugaagaaccccaccguggacggcaucgucgcgauugaccuggaucccgugguguacgacgccaaguucgagaagcagcucgggcagaucaugcugcucauccucugcacgagucagauccucuuaaugcggacgaccugggcccucugcgagucuaucacccuggcgaccgguccgcugacgacccucugggagggguccccgggcaaauucuggaacacuaccauugcggucagcauggccaacaucuuccgcggcuccuaccuggccggggcuggccuggcuuucucguuaaugaagucccucgggggcgggcggcgcggcacuggagcccagggggagacccugggcgagaaguggaagcggcagcucaaucaguugagcaagagcgaguuuaacacauacaagaaauccgggaucauggagguggaccgcagcgaggccaaagagggccugaagcgcggagagaccacgaagcacgccguuucccguggcaccgcgaagcuccggugguucgucgaaagaaaccuugugaagcccgagggcaaagugaucgacuuagggugcggccgcgggggcuggagcuacuacugcgccggacugaagaaggucacugagguaaagggcuacaccaagggcgggcccggacacgaggagccgauccccauggccaccuauggguggaacuuggugaaacugcacuccggcaaggacgucuucuucaugccgcccgaaaagugcgacacgcuguuaugugacauaggggagucgucgccgaacccuaccaucgaggagggccgcacccuacgggugcugaagaugguggagccguggcuacgggggaaccaguucuguaucaagaucuuaaaccccuacaugccgagcguugucgagacccuagagcagaugcagcgcaagcacgggggcaugcuagugcgcaacccgcugucccggaacagcacgcacgagauguacugggucuccugcgggacgggcaacaucgugagcgccgugaacaugaccucccggaugcugcucaaccgguucaccauggcccaccgaaagcccacguacgagcgugacgucgaccugggcgcggggacccggcacgucgccguggagcccgaggucgcaaaccucgacaucaucggccaacgcaucgagaacaucaagaacgagcauaagucaaccuggcacuacgacgaggacaacccguauaagaccugggccuaccacggguccuacgagguuaagcccagcggcuccgccaguaguauggucaacggaguggugcgucuccugacgaagcccugggacgucauccccauggugacccagaucgcgaugaccgacaccacgccguucggccagcagcgcguguucaaggagaagguggacacccggacgccccgggccaaaaggggcaccacucagaucauggaggugaccgccaaguggcuguggggguuccucagccggaacaagaaaccccggaucugcaccagagaggaguucacacguaaggugcgcagcaacgcugcaaucggcgcugucuucguggacgaaaaccaauggaacuccgccaaggaggccguggaggacgagcgguucugggaccugguccaccgggagcgggagcugcacaagcaagggaagugugcgacgugugucuacaauaugaugggcaagcgcgaaaagaagcucggcgaguucgguaaagcgaagggcagccgggccaucugguacauguggcugggggcccgcuuccuggaguucgaggcgcucggauucaugaacgaagaccacugguucucccgggagaacagccuguccggcguggagggcgagggucuucauaaauuaggcuacauccugcgcgacauuagcaagaucccgggcgggaauauguacgccgacgacaccgcgggcugggacacccggaucaccgaagacgaccugcagaaugaggccaagaucacggacaucauggaacccgagcacgcucuccuggccaccuccaucuucaagcugacauaucagaauaaggucgugagggugcagcgccccgccaagaaugggaccguaauggacgugauuagccgacgcgaccagcggggcuccggacagguggggacguacggccucaauacguucaccaacauggagguccagcuuauccggcagauggaaagcgaggggaucuucuugccguccgagcucgaaaccccgaaccuggcggagcgggcccuggauuggcuagagaagcacggggccgagcgccugaagcggauggccaucagcggggacgacuguguggugaaacccaucgacgaucgguucgccacggcccugaccgcgcucaacgacauggguaaggucagaaaggacauuccccagugggagcccuccaaaggcuggaacgacuggcagcagguaccauucugcagccaccacuuccaucagcugauuaugaaggacgggcgcgagaucgugguacccugccggaaccaggacgagcuggucggccgcgcucgggugucccagggggccgguuggagccuccgcgagaccgccugccuggggaaguccuacgcgcagauguggcagcugauguauuuccaucggcgcgaccuccgucuagccgcgaacgccauuuguagcgcuguacccguggacugggugcccaccucgcgcaccacgugguccauccacgcccaccaucaguggaugacaacggaggacaugcugagcgucuggaaccggguguggaucgaggaaaacccguggauggaggacaagacccauguauccagcugggaggagguccccuaccucggcaagcgcgaggaccaguggugcgggagccugaucgggcugaccgccagggccaccugggccaccaacauccagguugcgaucaaccaggugcggaggcucaucggcaacgagaauuaccuggauuacaugaccagcaugaagcgguucaagaacgagucagacccagagggagcucugugguaa

SEQ ID NO: 24069 - RNA, 9879 nt, Artificial Sequence
  derived and/or modified CDS sequence (opt11) from DENV-1__GU056029__SS-prME
uccgugacaauguuguuaaugcugcugcccaccgcccucgccuuucaccugacaacccgcggcggggagccccauaugaucguguccaaacaggagcgagggaaauccuuacuguuuaagaccagcgcaggggugaacaugugcacccuuaucgcgauggacuuaggcgagcucugcgaagacaccaugaccuacaaguguccgcgcauuacggaggcggagcccgacgauguugauugcuggugcaaugcaaccgacaccugggugaccuaugguaccuguagccagaccggcgagcauaggcgugaaaagagguccguggcccuugcgccccauguuggccuuggguuagaaacaagaacggagaccuggaugagcuccgagggcgcguggaagcagauacaacgggucgagacuugggcacuccgccacccugguuuuacggugaucgccuucuuccuggcccacgccaucggcaccagcauaacucaaaaggguauuauauucauccuccugaugcugguuacccccuccauggcgaugcggugcgucggcaucggcaacagggacuucguggagggauuauccggggccacguggguagacgucguguuagagcacggcuccugcgugaccacaauggccaaaaacaagcccacccuggacauagagcucuuaaaaacggaggucaccaaccccgcggugcuucggaaguuaugcaucgaggccaagaucagcaacaccaccacggacucccgcugccccacccagggggaggcaacccugguugaggagcaggacgcaaacuuugugugucggagaaccuucguggauaggggcugggggaacggguguggccuguucggcaaggggagccuacuaacgugcgccaaauuuaagugugugaccaagcuagagggcaagauuguccaguacgagaaccugaaguacucggugaucgugaccguacauacaggugaucagcaccagguagggaaugagacgaccgagcauggaaccaucgcgacgaucacgccccaagcccccacgagcgagauccaguuaaccgacuacggggcguuaacacuagacugcagcccucggaccggccuggauuucaacgagaugguacugcucacuaugaaggagaaguccugguugguccacaagcaaugguuccuggaccugccgcugcccuggaccucuggggccagcacuagccaggaaaccuggaaucgucaggacuugcucguaaccuucaagaccgcucacgcgaagaagcaggaggucgugguguuaggcucccaggagggcgcuaugcacaccgcccugaccggggccacggagauccagacaagcggcaccaccaccaucuucgcgggacaucucaagugccgccuuaagauggacaagcugacccucaagggcauguccuacgucaugugcaccgggagcuuuaagcucgagaaggagguggcggagacccagcacggcacggugcugguccagguaaaauaugaggguaccgaugcgcccugcaaaauuccauucuccacgcaggaugagaaagggguuacucagaacggccgccuaaucacggccaaccccaucgucaccgauaaggagaagccgguaaacaucgagaccgagccgcccuuuggcgaaaguuacaucgucguaggagcuggcgaaaaggcgcucaaguuguccugguucaagcgcgguagcucaaucggcaaaauguucgaggccacggcgcgcggcgcgcgucgcauggcaauccugggcgacacggcgugggacuucgggagcauuggcgggguguucacaucagucgggaagcucgugcaccagguguuuggcacugccuacgggguucuguucucgggugucuccuggaccaugaaaaucgggaucggcauacuacuuacauggcugggccugaacaguagauccaccagcuuguccaugaccugcaucgccguggggaugguuaccuuauaccugggcgugaugguccaagcugacagcggcugcgugauaaacuggaagggucgagagcugaagugcggguccggcauuuucgugacgaaugaggugcacaccuggaccgaacaguauaaguuucaggccgacagcccgaagcggcugagcgcugcuauaggcaaggccugggaggaggggguaugcggcauccgcagcgccacccggcuggagaacaucauguggaaacagauaagcaaugaguugaaccacauacuguuagagaacgacaugaaauucaccgugguggugggcgacgccaaugggaucuugguucaagggaagaagaugauccgcccacaacccauggagcacaaguacuccuggaaaucguggggcaaggcuaagaucaucggcgcugacauucagaacaccaccuucaucauugaugggcccgacaccccggagugccccgacggccagcgggcguggaacauuugggaaguggaggacuauggcuucggcguguucaccacgaacaucuggcuaaaacuccgcgacucauacacgcagaugugcgaccauaggcuuaugucagccgcaaucaaggacuccaaggccguacacgccgacaugggcuacuggaucgagucggagaagaacgagaccuggaaguuggcccgcgcguccuucaucgaagucaaaacgugcacguggcccaagagccacacccuguggaguaaugggguucucgagagcgagaugaucauccccaaaauuuacggcgggccgaucucccagcacaacuaucggcccggcuacuucacccagaccgcggggccuuggcaucucggcaaguuagagcucgacuucgacuugugcgagggcacgaccgucgugguggacgagcacugugggaaccgcggcccgagccugcggaccaccacggucaccgggaagaucauacacgaauggugcugucgcuccugcacgcugccgccccuccguuucagaggcgaggaugggugcugguacggaauggaaaucaggcccgugaaagaaaaagaggagaaccuggugcgcaguauggugagugccggcucuggagagguggacaguuuuuccuugggcauccugugugugagcauaaugaucgaagagguuaugcggucccgcuggagccgcaaaaugcugaugaccgggacgcucgccguguuucuguugcucaucaugggccaacuuaccuggaaugacuugauucgucucuguaucauggugggggccaacgcuuccgaccgcaugggcauggggacuaccuaccuggcccugauggcgacuuuuaagaugcgaccgauguucgccgucgggcuccuuuuccgacgguuaaccagccgcgaagugcuucugcuuacaauuggauuaucccugguagccagcguggagcugccaaacucccuagaggaguuaggggacggauuggcaaugggcaucaugauguuaaagcuccugaccgaguuccagccccaccagcuuuggacgacgcuccuaagucugaccuuuguaaagacagcucucuccuuagauuacgccuggaagaccaccgcgaugguucucucgauagugucgcuguucccccuuugccucucaaccaccagucagaagacuacuugguugccggugcugcucgggagcuucggguguaagccccugaccauguuccugaucaccgagaacaagaucugggggcguaaguccuggccgcucaacgaggguauaauggccauugggauaguuagcauccuguuauccagccuccuaaagaacgacgugccccuggcggggccacucauugccggcgggaugcugauugcgugcuaugugaucagcggauccagcgccgaucugucccucgagaaggccgccgaggucagcugggagcaggaggcggagcacaguggggcuucucacaacauccucguagaggugcaggacgacgguaccaugaagaucaaggaugaggagcgugaugacacgcugaccaucuuacugaaggccacacugcuugcugucucugggguguacccaauguccauccccgcuacgcuauuugugugguacuuuuggcagaaaaagaaacaacgguccgggguccuuugggacacgcccucaccucccgaggucgagcgcgcaguccucgacaacggcaucuaccgcauuuugcagcgugggcugcugggcagaucccaggucggaguagggguguuccaggaugggguguuccacaccauguggcacguaacccgcggcgccgugcucauguaccaaggaaaacgguuagagcccaguugggccuccgucaagaaggaccugauuagcuacgggggcgguuggcguuuccaaggcuccuggaacacuggggaggagguccaggugaucgcaguugagcccggcaagaacccgaaaaacgugcaaacuaccccaggcacguuuaagacccccgagggugaagugggcgcaauagcccucgacuucaagcccgggacuuccggcuccccgaucgucaaccgggagggcaagaucgucgggcuguacggcaacgggguaguaaccaccucuggcaccuacgugucggcgaucgcacaggcgaaggccagccaggaaggaccccugcccgagauagaggacgagguauucaagaaacgcaacuuaacgaucauggaucuccacccugguucuggcaagacccggcgguaccugccagcaauaguacgggaggccaucaagcgcaaacuuaggacccugauacuggcccccacccgggugguggcgucagagauggcagaggccuuaaaagggaugccaauccgcuaccaaacgaccgcgguaaagagcgagcacaccgggcgugagaucguggaccugaugugccacgccaccuucaccaugcggcuacucagcccgguacggguccccaacuacaacaugaucaucauggacgaggcgcauuuuaccgaccccgccagcauugccgcccgcggguauaucucaacccgggugggcaugggggaggccgcggccauauuuaugaccgccacgcccccuggcagcguggaggccuucccccagagcaacgcggugauccaggaugaggagcgugauauacccgagcggagcuggaacuccggcuacgacuggaucaccgacuuccccgggaagaccgucugguucgugcccagcaucaagagcggcaacgacauagcgaacugccuccgcaagaacgggaagagggucauacagcugagucgcaagacuuucgacaccgaguaucaaaagaccaagaacaacgacugggacuacgucguaaccaccgacaucuccgagaugggcgccaacuuccgugccgaccgcgugaucgacccucggcgcugccucaagccagugauccugaaggacgggcccgagcgggucaucuuagcuggcccgaugccagugacgguggcgagcgccgcccagcgccggggccgcaucgggcgcaaccagaacaaggaaggcgaccaauauguguauauggggcagccccucaacaacgacgaggaccaugcgcacuggaccgaggcaaagaugcugcuggacaacaucaacacacccgaggggaucaucccugcccuuuucgaacccgagcgggaaaaauccgccgcgaucgacggggaauacaggcuccggggcgaggccaggaagaccuucguggagcuuaugcggagaggcgacuugccugucuggcugagcuacaaagucgcauccgaaggguuccaauacagcgaccgccgcuggugcuucgacggugagcgaaacaaucagguccuggaggagaauauggacguggaaauauggacaaaagaaggggagcggaagaagcucaggccccgcugguuagacgcgcggaccuacucggacccgcuugcccuucgggaguucaaggaguucgccgccggccggcgcagcgucuccggcgaccugauccuggaaauagggaagcucccccagcaccugacccugcgcgcacagaaugcgcucgacaaucuggucaugcuucacaauagcgagcagggcgggaaggcuuaccgccacgcgauggaggaacuccccgacaccaucgagacccugaugcuguuggccuuaaucgcgguccugacgggaggggugacacucuucuuucugagcggaaaagguuuagggaagacgagcaucgggcuccugugcguaaccgccucguccgcccugcucuggauggccaguguggaaccccacuggaucgccgcguccauaauccuggaguucuuccugaugguccucuuaauuccggagcccgaccggcaacggacgccacaggacaaucagcuggccuacguagugaucggucuccucuucaugauccuuaccguggccgccaaugaaauggggcuccuggagacgacuaagaaagaccuggguauaggauacguggccgcggagaaucaccagcaugccacgaugcuagacguggacuugcauccagcgagugcguggacacuguacgcggucgcgaccacaguuaucacgcccaugaugcggcacaccaucgagaacaccaccgccaacaucuccuuaacggccaucgccaaccaagcagcgauacugaugggccuagacaagggguggcccauuucaaaaauggacaucggaguuccccugcuagcccuggggugcuacucccaggucaacccgcucacccugaccgccgccgugcuaaugcucgucgcccacuacgccauaaucggccccgggcuccaggccaaggccacucgcgaggcacagaagcgcacugcggcaggcaucaugaaaaaccccaccguugacggcaucguggcaauagaccuugacccggucguauacgacgccaaguucgagaagcagcucggucagauuauguuacugauacucugcaccagccagauucuguugaugagaacuacgugggcccucugcgagagcaucacccuggcgacagguccgcuaaccacccucugggaggggagccccggcaaauucuggaacacaacuaucgccguuuccauggcaaacauauuccgcggcagcuaccuggcaggggccggccuggcguucucccucaugaagucccucggcggcgggcggcgcggaaccggcgcccaaggggagacgcugggcgagaaguggaagcgucagcucaaccaacugaguaagagcgaguucaacaccuacaagcgcuccgggaucauggaagucgaccgguccgaggcaaaggagggccugaagcgcggggagacgaccaagcacgccgugucacggggcacugcgaagcucaggugguuugucgaacggaaccuggugaagcccgaggggaaggucaucgauuuggggugcggccgcggcggcuggaguuacuacugcgcugggcugaagaagguaaccgagguuaagggcuacaccaagggugggcccggccacgaagaaccgauccccauggcaaccuacggguggaaccucgucaagcugcacaguggcaaggacgucuucuucaugccgccugagaagugcgacacgcugcucugugauauaggggagagcuccccuaacccgacgauugaggagggccggacccuucgggugcucaaaauggucgagcccuggcuccgaggcaaucaauuuugcaucaaaauccugaaccccuacaugccguccguggucgagacccuggagcagaugcagcgcaagcacggagggaugcucguccggaacccccugucgcgcaauuccacccacgagauguauugggugucgugcgggacgggcaacauugugagcgcagucaacaugaccagccggaugcugcucaaccgcuucaccauggcccaccgcaagccgaccuacgagcgggacguggaucuuggcgcggggacgcgccauguggccgucgagcccgagguggcgaaccuggacaucaucggucagcggaucgaaaacaucaaaaacgagcacaagagcaccuggcacuacgaugaggacaauccguacaagaccugggccuaucacggcagcuacgagguuaagccuuccgggucugcguccucuaugguaaacgguguuguccgccuccugaccaaacccugggacgugaucccuauggugacucagauagcgaugaccgacacgaccccauucggccagcagcgggucuucaaggagaagguggacacccgcacgccccgcgccaagcgcggcaccacgcaaaucauggaagucacggccaaguggcuguggggguuucuaucccggaauaagaagccccgcaucugcacacgagaagaguucacccgcaagguucgcagcaacgcggccauaggcgcgguguuuguugaugagaaucaguggaacagcgccaaggaggccgucgaggacgaacgguucugggaccuggugcaccgugagcgcgaguuacacaagcaggguaagugcgcgacuugcguguacaacaugaugggcaagcgagagaagaagcucggcgaauuuggcaaggcgaagggcucccgcgccauaugguacauguggcugggugcccguuuccuagaguucgaagcccucggcuucaugaacgaggaccauugguucagcagagaaaacucccugagcgggguggagggggagggccugcacaagcuaggguacauacugcgcgacaucuccaagauaccggguggaaauauguaugccgacgacacggcgggcugggauacccgcaucacagaggacgaucugcagaaugaggccaagaucacugacaucauggagcccgagcacgcccucuuggccacuagcaucuucaagcugacuuaccaaaacaagguugugcggguucagcgccccgccaaaaacgggaccgugauggaugugaucucccgucgagaccagcgcgggucgggucaggucgggaccuacggucuuaauacguuuacgaacauggaggugcagcuuauccggcagauggaauccgaagggauuuuccuacccagcgaguuggagacaccgaaccuggcugagcgcgcccuggacuggcucgaaaaacacggcgcagagcggcugaagcguauggccaucucgggugaugauuguguugucaagcccauugacgauagguuugcuaccgcgcuuacugcccucaaugacaugggaaaggugagaaaggacaucccucaaugggaacccucaaagggcuggaacgacuggcagcaagucccuuucugcucccaccacuuccaucagcugaucaugaaggacggucgcgagaucgucgugccaugccgcaaucaagacgagcucgugggccgggcaagaguuagccagggggcuggcugguccuugcgagagaccgccugccucggcaagagcuacgcgcagauguggcagcugauguacuuucaccgccgggaccuccgccuagcagcuaacgcgaucugcagugccgugccgguggauuggguccccaccagccguaccacguggucaauccaugcccaccaucaguggaugacgaccgaggacauguugucgguuuggaaccguguguggaucgaagagaacccguggauggaggacaagacccacgugaguuccugggaggaggugcccuaucucggcaagagagaggaccagugguguggcagccuaauagggcuaacggcccgggccacgugggcgaccaacauccagguagcgaucaaccagguccgccggcucaucgggaaugagaacuaccuggacuauaugaccucuaugaagagauucaagaaugagagcgauuccgagggggcucugugguga

SEQ ID NO: 24070 - RNA, 9879 nt, Artificial Sequence
  derived and/or modified CDS sequence (opt11) from DENV-1__GU056030__SS-prME
agcguaacgaugcuucucauguugcuaccgaccgcuuuggcauuccacuuaaccacgcgcggcggcgagccccacaugaucguaucaaaacaggagcgcggcaagucccuccucuucaagaccagcgccggggucaacauguguacucugaucgccauggaccugggcgaacucugcgaggacacuaugaccuauaagugcccccgcaucacagaggccgagcccgacgacguggacugcuggugcaacgccaccgacaccugggucaccuacggaaccuguagccagaccggcgaacaucggagagagaagcggucgguggcccuggcgccccacgugggccugggacucgaaacgcguaccgagacuuggaugagcucagaaggagccuggaagcagauacaacggguagagacaugggcccugaggcacccgggguucacugugaucgcguucuuccuggcgcacgccaucggcacuagcaucacccaaaaggggaucauauucauccugcucaugcuggugaccccgaguauggccaugcggugcguuggcauaggcaacagagacuucgucgaagggcuguccggggccacguggguggacgucgugcuggagcacgguuccugcgugacaacgauggccaagaauaagcccacucuggacaucgagcuccugaagacugaggucacgaacccggcgguccugcggaagcugugcaucgaagcuaagaucagcaauaccacuaccgacucccguugcccgacccaaggcgaagccacauuaguggaagagcaggacgccaacuucgucugccggcgcaccuucguggaccggggcugggggaacggcugcgggcucuucgggaaagggucgcuacugacuugcgccaaguucaaaugcgugacaaagcuggaagggaagaucguccaauacgagaacuugaaguacuccgucaucgucaccguccacacgggcgaccagcaccaaguggggaaugagacgacugagcacggcaccaucgcuaccaucaccccccaggcccccacgagcgagauccaacugacagauuacggggcccugacacuggacuguuccccccgcacgggccuggacuucaaugaaaugguccugcuuacgaugaaggagaaauccuggcugguucacaagcagugguuccuugaucuaccgcugcccuggaccuccggggccagcaccagccaagaaaccuggaaccgucaggaccugcuggugacguucaagaccgcccacgcgaagaaacaggaggucgugguccugggcucccaggaaggugccaugcacacagcacugacuggggcgacggaaauccagacaagcgguaccacgacgauuuuugcggggcaucucaagugcaggcugaagauggacaaacuaacccucaaggguaugucguacgucaugugcaccgggagcuucaagcuagagaaagagguggcggagacccagcacggcaccguguugguccaaguucgguacgaggggacagacgcgcccuguaagauaccauuuuccacccaagaugagaagggggugacccagaauggucgccugaucacggcgaacccuauuguuacugacaaagagaagcccgugaacaucgaaacagagccgcccuuuggagagagcuacaucguugucggggcgggcgaaaaggcucucaagcugucgugguucaagcgggggucaagcaucgguaagauguucgaagccaccgcgcgcggggcucgccgaauggccauccugggcgacacggcgugggacuucggcagcaucgguggcguguucaccuccguggggaagcucguacaccagguguucggcaccgccuacggggugcuguucagcggcgucuccuggaccaugaaaaucgggaucgguauccuguugacuuggcugggccuuaacagccgcuccaccagcuuguccaugacuuguauagccguugggauggugacucuguaccugggcgucaugguacaggcggacagcgggugcguaaucaauuggaagggucgagagcucaagugcggcuccggaauuuucguuacgaacgaggugcacaccuggacugaacaguacaaguuucaggccgauaguccuaagcgccuguccgcagccauuggcaaggccugggaagagggcgugugcggcauccggucugccacccgacuggaaaauaucauguggaagcagaucagcaacgagcucaaucacauacuccuggagaacgacaugaaguucacaguaguggugggggacgccaacggcauucucgcccagggcaagaaaaugauccggccgcagccaauggagcacaaguacuccuggaagaguuggggcaaggcgaagaucaucggcgccgacauacagaauacgaccuucauaaucgacgggccagacacccccgaaugccccgacggccaaagagccuggaacauuugggagguugaggauuacgguuucggcaucuuuaccacgaauauuuggcugaagcugcgggacuccuacacucagaugugugaccaccgccucaugucugcagcaauuaaggacucaaaggccgugcacgccgacaugggcuauuggauugagucagagaaaaacgagaccuggaaacuggcccgugcguccuucaucgagguaaaaaccugcacguggcccaaaucgcacacccucugguccaacgggguccuugagagcgagaugaucauccccaagauuuacggggggccaaucucccagcacaauuaucgcccuggcuacuacacccagaccgccggccccuggcaucuggggaagcuagagcucgauuucgaccugugugagggcacuaccguggugguugacgaacacugcgguaacaggggcccgagucugcgcaccaccaccguuaccgggaagaucauacacgagugguguugucgguccugcacccugccgcccuugcgauuccguggugaggacgggugcugguacggcauggaaauucgccccguaaaggaaaaggaggagaaccuaguccggagcaugguguccgcgggaucaggcgagguggauaacuuuucccuagguauccugugugucuccauaaugaucgaggaggugaugcgcagcagguggucgaggaagauguuaaugacaggaacgcucgcuguguuccuguuacucauaaugggccagcugaccuggaacgaccugauccgccucugcaucauggucggcgccaaugcgucugacgguaugggcauggggacaaccuaucuugcccugauggcuacguuuaagaugcggcccauguucgccgugggcuuacuguuccgccggcugacgucccgcgaggugcuccugcugaccauuggccucagccugguagccuccguugagcugcccaacucgcucgaggagcuaggugauggccuggcgaugggaaucaugauguuaaagcugcugaccgaauuccagccccaccagcucuggacgacgcuguuaucccuuacguucgucaagaccacgcugagccuggacuaugccuggaaaaccaccgccauggugcucagcaucgugucacuguucccccugugccuaagcaccacgagccagaagaccaccuggcugccgguccuguuaggcaguuucgggugcaaaccgcugaccauguuccugaucaccgagaauaaaaucuggggaaggaagagcuggccucucaacgaggggaucauggccaucggcauugugucgauccuguugucaucccucuuaaagaaugaugugcccuuggccggcccccucauugcuggcggaaugcucaucgcuugcuacgucauuagcggcagcagcgccgaucugucccuagacaaggcugcggaaguuuccugggagcaggaggccgagcacuccggcgcuucccacaacauaucugucgaggugcaggacgacgguacgaugaagaucaaggacgaggagcgcgacgacaccuugaccauccuacucaaagcuacccuccuggccguguccggcguguaccccaugagcauucccgcuacccucuucgucugguacuuuuggcagaagaagaagcaacgaucgggcgugcugugggacaccccgagcccgcccgagguggagcgcgccgugcuggacgacggcaucuaccgcauucugcaacgcggucugcuggggcggucucaaguggguguugggguguuccaggacggcguguuccacacuauguggcacgucacccgcggcgccgucuugauguaccaggggaagcgguuggaacccagcugggccugcguuaagaaagaccuuaucuccuacggcgggggcuggcguuuccaggggaguuggaacacgggagaggaggugcaggucaucgccguggagccggguaaaaacccuaagaaugugcagaccaccccagggaccuucaagacgcccgagggagaggucggugcgaucgccuuagauuucaagcccggaacuagcggcagucccauuguaaaccgggaggggaagaucgucggccucuacgggaacggcgucgugaccacuucggggacguaugucagcgccaucgcccaggcgaaggcgagccaggagggcccccugcccgagaucgaggacgaaguauuuaagaagcguaaccugaccaucauggaccuccacccgggcaguggcaaaacccggcgcuaccugcccgccauagugcgugaggccaucaaacgcaagcugagaacccucauucuggccccgacgcggguggucgcaagcgagauggcugaggcccugaagggcaugcccaucagguaucaaaccacggccguaaaauccgagcacacagggcgggagauuguagaccucaugugccacgccacuuuuaccaugagauugcugucacccguccgagugcccaacuacaacaugaucauuauggacgaggcgcacuucaccgacccugccucuaucgcggccaggggguauauauccacccgggugggaaugggcgaggccgcagcuauauucaugaccgcuacgccucccggcuccgucgaggcuuucccgcagagcaacgcaguuauccaggacgaggagcgcgacauccccgagcggucguggaacagcggguacgacuggaucaccgacuucccggggaagaccgugugguucguaccauccauuaagagcgggaacgacauagcaaacugucuucggaaaaauggaaaacgggugauacagcuuucccgcaagacguucgacacugaauaucagaagaccaagaacaacgacugggacuacguggucaccacggacauuagcgagaugggggcaaacuuccgggccgaccgagugaucgacccacggcgcugcuuaaagcccguaauccucaaggacggccccgagagagucauccuugccggccccaugcccgugaccguugcguccgcggcccagaggcgggggcgcaucggucgcaaccagaacaaggagggagaccaguacguauauauggggcagccccugaacaaugacgaagaccacgcccauuggaccgaggccaagaugcugcuggauaacauaaacacgcccgaggggauaauaccggcccuguuugagcccgagcgggagaaguccgccgccauagacggggaguaccgccuccggggcgaggcacgcaagacguuuguggaacuuaugcggcgaggggaccugcccguguggcuauccuacaagguggccagcgagggcuuccaguacuccgaccggcgcugguguuucgauggugagaggaacaaccaagugcuggaggagaauauggacgucgagaucuggaccaaagagggcgagcgcaagaagcugaggccccgcuggcucgacgcgcgaaccuauagcgacccgcuggcccugcgcgaguuuaaggaguucgccgccggccggagaagugugaguggggaucucauccuggaaaucggcaagcugccccaacaccucacacugcgugcccagaaugcgcuggacaaccucgucaugcugcauaacagugagcagggcgggaaggccuaccgccacgccauggaggagcugcccgacaccaucgagacgcucauguugcuggcccucaucgcgguccugaccggcggcgucacccuguucuuccugagcggcaaagggcugggcaagacgagcauaggacugcucugcgucacggccucgagcgcccuguuguggauggcaagcguagaaccccacuggaucgccgcgucuaucauccucgaguucuuccugaugguacugcuuauccccgagccagaccggcagcgcacuccccaggauaaucagcuggccuacguggucaucggccuucucuucaugauccugaccguagcagccaacgagauggggcuucucgagaccacgaagaaggaucugggcaucggcuacguugccgcggaaaaccaccaacacgccaccaugcuggacguagaccuacaccccgccagcgcguggacccuguacgccguugcgaccacuguaauaaccccuaugaugcggcauaccaucgagaacacaacggcuaacauaagccugaccgccaucgccaaccaagcagcgauccucauggggcuggauaagggcuggccgaucuccaagauggacauuggggucccccuucucgcccugggcuguuacucucaggugaacccacugacccucaccgccgccgugcugauguuaguagcgcacuacgccaucaucgggcccggucuccaggcaaaggccacucgcgaggcccaaaaacgcaccgccgccggcaucaugaagaaccccacuguggauggaaucgucgccaucgaccuggacccggucguguacgacguuaaguucgaaaagcagcugggccagaucaugcuccugauccucuguacaucccagauccugcugaugcggaccaccugggcccugugcgaauccauaacccucgcuaccgguccgcucacgaccuugugggaggguucccccggcaaguucuggaacaccaccaucgcugugagcauggccaacauuuuccgcggguccuaccucgccggcgcagggcuggcguucagccugaugaagucgcucggcgggggccggcgcggcaccggcgcgcagggagagacacugggugaaaaguggaaacggcagcugaaucaacucaguaaguccgaguucaacacuuacaagcgcaguggcauaauggaggucgaucguucggaggccaaggagggucugaaacgcggcgagacaacuaaucacgccguguccagaggcaccgcuaagcugcguugguucgucgagcgcaaccuggugaagcccgaaggcaagguaaucgauuuaggcugugggcgcggcggguggagcuacuacugcgccggacugaagaaagucaccgagguaaagggcuauacuaagggagggcccgggcaugaagagccuauacccauggccacuuacggauggaaccuggugaagcuacauucggggaaggauguguuuuuuaugccgccggaaaagugcgauacuuuacucugugacaucggagagagcuccccgaaucccacaaucgaggagggccggacucuccgcguccugaaaaugguugagcccuggcuacgggguaaccaguucugcaucaagauucucaauccguauaugccgagugugguggagacccuggaacagaugcagcgcaagcacggcgggauguuaguucggaacccccucuccagaaacagcacgcaugagauguacuggguguccugcgggaccggcaacaucgucagcgccguaaacaugacuucccggaugcugcugaaccgcuucaccauggcccaccggaagcccacauacgagcgggacgucgaccuuggcgccggcacgcgccacguaaccgucgagcccgagguugccaaccuggauaucaucgggcagcggaucgagaauaucaagaacgagcauaagucuaccuggcacuacgacgaagacaacccguacaagacaugggccuaucacggcagcuaugaggugaaacccagcggguccgccagcuccauggugaauggugugguacgccuacucaccaagcccugggacguaauacccauggugacccagauugcgaugaccgacacuacccccuucggacagcaacgcguguuuaaggagaaggucgacacucguacgccccgggccaagcgcgggacgacccagaucauggaggugaccgcgaaguggcuguggggcuuucugucacggaacaagaagccccgaaucugcacgcgagaggaguucacgcggaagguccggagcaaugccgcgaucggggcgguuuucguugacgagaaccaguggaacagcgcuaaggaagcgguggaggacgaaagauucugggaccucguucauagggagcgcgaacuucauaagcaggguaaaugcgcgacaugcguauauaacaugauggggaaacgcgaaaaaaagcugggcgaguucggcaaagccaagggaucccgagccauaugguauauguggcucggcgcgagguuccuggaauucgaggcccugggguuuaugaacgaggaccacugguucucacgagaaaacucccucuccggcguagagggagaaggucugcacaagcugggauacauauugcgagacaucagcaagaucccgggcgguaacauguaugccgaugacaccgccgggugggacacccgaaucacggaggacgaucugcagaacgaggccaagauaacagauauaauggagcccgagcaugcgcugcucgccacaaguaucuucaaacugaccuaccagaauaagguagugcgagugcagagacccgccaaaaacgggacagugauggacgugaucagccgccgugaccaacgcggcuccggucaggugggcaccuacgggcugaacacauucacuaacauggagguccaacuaaucagacagauggagagcgaaggcauauuccugccgucagaacuggagacgccgaaccuagccgagagagugcuggacuggcuggagaagcauggggccgaacggcucaagcgcauggccaucagcggcgacgacugcguggucaagcccauagacgaccgguucgcaacggcccuuaccgcucucaacgacaugggcaaggugcgcaaagauaucccucagugggagcccagcaagggguggaacgacuggcagcaggucccuuucuguagccaccacuuccaccagcucaucaugaaggacggccgggagaucgucgucccgugucgcaaccaggacgagcugguggggcgggccagagucucacagggcgcgggcuggucgcugcgggagaccgcgugccucggcaaguccuaugcgcagauguggcagcuuauguacuuccaccgccgggacuugagacucgccgcgaacgcgauuugcagcgcggugccaguggacuggguacccacuucgagaacgacauggagcauccacgcccaccaucaauggaugaccacggaggacaugcugaguguauggaauagggucuggauagaggagaauccguggauggaggacaagacccacgucuccucgugggaagagguuccguaccugggcaagcgugaggaccaguggugugggucgcucauaggccugaccgccagagcuacgugggccaccaacauccaggucgccaucaaccaagugcgccggcucaucgggaacgagaacuaccuugacuauaugacgucuaugaaaagguucaaaaaugaauccgacccagagggcgcacugugguga

SEQ ID NO: 24071 - RNA, 9879 nt, Artificial Sequence
  derived and/or modified CDS sequence (opt11) from DENV-1__GU056031__SS-prME
ucgguaacuaugcuguuaaugcugcuaccgacggcucuggccuuccaccuaacaacacgugggggagaaccacauaugauaguuaguaaacaggaaagaggcaaaagccuacuauucaaaacaucagcgggaguaaacaugugcacacugaucgcaauggauuuaggggaauugugcgaagauacaaugacguacaagugcccaagaaucacggaagccgaaccggaugacgucgacugcuggugcaacgccacggacacguggguuacguaugguacauguagccaaacaggagagcauagacgagagaaaagauccgucgcucucgcgccacacgucggacugggcuuggaaacgcgaacggaaacguggaugaguagcgaaggggcguggaaacagauccagagaguagaaacuugggcauugagacauccgggauuuacggugauagccuucuucuuggcccacgcaauuggaacuagcauaacccagaaaggcauaaucuucauucuucugaugcucguaacacccucaauggcgaugcgaugcguaggaaucgguaaccgggacuuuguagagggccuaaguggcgcuaccuggguagacgugguacuugaacacggaucgugcguaacuaccauggccaagaacaagcccacccuggacauagaacuauugaaaacggaagucacaaaccccgccguacucagaaaacuuuguauagaagccaaaauaucuaacacaacgaccgauagcagaugccccacgcagggagaggcgacucuugucgaggaacaagaugcaaacuuuguuugcaggagaaccuuuguggaccgcggcuggggcaacggauguggccuuuuuggaaaagguagccuuuuaacgugcgcgaaauuuaaaugugucacgaaauuggaaggaaaaauaguacaguacgagaaucuaaaguacucagucauaguaacgguacauacuggagaccaacaucaagucgguaacgaaacaacagagcacgggacgauagcaacgauaacgccccaagcgccaacaagcgaaauucaacucaccgauuacggggcacuuacgcuggacugcagcccccgcacaggcuuggacuucaacgagaugguacuccuaacuaugaaagagaagaguuggcuuguacauaagcaaugguuccucgaccuuccauugccauggacgagcggagcuagcacaucgcaagaaacauggaaccgccaagaccucuuaguuaccuucaaaacggcucaugccaagaagcaagaaguuguagugcuaggaagccaggaaggcgccaugcacaccgcauuaacuggcgccacagaaauccagacaagcggcacgaccaccaucuucgccggucaccuaaaauguagguugaaaauggacaagcuaacauuaaaaggaaugaguuaugugauguguacgggcagcuucaaacuagagaaagaaguagcugagacucagcacggcacagucuuagugcaagugaaguaugaaggaaccgaugcgccuugcaagauuccguucucaacacaagacgaaaaaggcguaacccaaaaugggagauuaaucacggccaacccaauagucacugacaaggagaagcccgugaacauagagaccgaaccucccuucggggaaagcuauauagugguuggcgcaggggaaaaggccuugaaacugucgugguuuaaaagaggaagcagcauaggaaaaauguucgaggcuacggcgaggggcgcccggcgaauggcaauacuuggcgauacggccugggacuucggcagcauaggcggaguauucacaagcguagggaaacugguucaccaaguguucggcacggccuacgggguccuguuuagcggcguauccuggaccaugaagauagggauaggaauacugcuaacauggcugggacugaacagccgcuccacgagucuuucaaugaccugcauagcagugggaaugguaacgcuguaucugggcgugaugguucaagccgacagcggauguguaauaaacuggaaggggcgugaacucaaguguggaucuggcauauuugucacaaacgaagugcacaccuggaccgagcaauacaaauuucaagcagauucaccaaaacggcugucugcggccauaggaaaagcgugggaagaaggggucugcgggauacggagcgcaacccgcuuagagaacauaauguggaaacaaaucucgaacgagcugaaccacauccuacuagaaaacgauaugaaguuuacgguuguaguaggcgacgcuaaugggauacucgcacaaggcaagaagaugaucagaccucaaccgauggagcacaaguacaguuggaaaaguugggggaaagccaagaucaucggcgcugauauacaaaacacaaccuucaucauagacggaccggacacgcccgaaugcccagacgggcaaagagccuggaacauaugggaggucgaggacuacgguuuugggguauucacgacuaacauauggcucaagcuacgggauucguacacgcagaugugcgaucaccggcuaaugucagccgccauaaaagauucgaaagcgguccacgccgauaugggguauuggauagaaagugagaagaaugagaccuggaagcuggcuagagcuagcuucauagaaguuaagacuuguaccuggcccaagagccacacccuguggagcaacgggguacucgaaucugaaaugaucaucccgaagaucuacgggggcccaaucagccagcauaacuaucgcccggguuacuucacgcagacggcugggccauggcaccuagggaaacuugagcucgacuucaaccucugugagggaacgaccgucgucguggaugagcacuguggcaaucgcggaccauccuuacgaaccaccacugucacaggaaaaauaauacacgaguggugcugcagaucaugcacgcuaccgccacuacgguuucgaggugaagacggaugcugguacgguauggaaauaagacccgucaaggagaaggaagagaaccucgucagaucgaugguaagcgcaggcucgggagaaguagacaguuucagccuagggauuuuaugcguaucgauaaugauugaagaggucaugcgaaguagauggucgcgaaagaugcugaugaccggaacacuagccguauuccuauugcuaaucauggggcagcugacauggaacgaccucaucagacucuguauaauggucggagcgaacgccagugauaggaugggcaugggaacaacguaccuagcacugauggcgaccuucaaaaugagaccaauguucgcggucggcuugcuguuucgacgacuuaccucgcgcgaaguccuguuacugacgaucgggcuaucccugguagcauccguggagcugccgaacucauuagaagaauuaggcgauggccuggcgauggggauaaugaugcuaaagcugcuaacggaguuccaaccacaucagcucuggacgacacuccugagcuugacauucguaaagacaacguugagccuagacuaugcguggaagaccacggcuaugguacuauccaucguuucacuauucccacuaugccuaucgaccacaucccagaaaacaacauggcugccaguauuacugggaucauuuggguguaaaccgagcacgauguuccucauaaccgagaacaaaauaugggggcggaaaagcuggccgcugaacgaagggauaauggcgauaggcaucguaucuauccuccuuagcucccuucucaaaaaugacguaccgcuagccggaccucugaucgccggcgggaugcucaucgccugcuacguaauaagcgggaguagcgcagaccuaucccuagaaaaagcggccgagguuucaugggaacaagaggccgagcacuccggggcaucgcauaacauucucguggaggugcaagacgacggaaccaugaaaauuaaggacgaagaacgggacgacacauuaaccauccuauugaaagccacccuacuagccgucagcggggucuacccgaugucaaucccagcaacacuauuuguaugguacuuuuggcagaagaagaaacagcgcaguggaguacuuugggacacaccuucaccacccgagguagagcgcgcgguucuugaugacggaaucuaccgaaucuuacagagaggacuccucggccgaagucaagucggcgugggaguguuccaggacgggguguuccauacaauguggcacguaacccgaggagcaguacuaauguaccaaggaaagcgacuggagcccucaugggcauccgugaaaaaggaccucaucuccuacgguggcggauggcgauuccaagguucauggaauacaggcgaagaaguccaaguaauugccguggaaccggggaaaaaccccaaaaacguacaaacaacacccggcacauuuaagacgccagagggcgaggucggggcaaucgcacuagauuucaagccagggaccuccgggaguccaaucguaaacagagaggggaagauagugggcuuguacggcaacgggguagugacaacguccggcaccuacguauccgcuaucgcgcaggcgaaggcuucacaggaggggccucuucccgagaucgaagacgaaguguucaaaaagaggaacuugacgaucauggaccuacacccggggucaggaaaaacacgacguuacuugccagcgaucguuagagaagcaaucaaacgaaagcucaggaccuuaauauuggcaccgacgagagucgucgccucggagauggcagaagcccucaaaggaaugccaaucagguaucaaaccaccgcagugaaaagcgaacacaccggaagggagauagucgaccugaugugccacgcaacauuuacaaugcggcuauuaucaccaguacgaguaccaaacuacaacaugaucaucauggacgaggcgcacuucacagacccugcuuccaucgcagcacgcgguuacaucucgaccagagucgguaugggggaggcagcagccauauucaugacagccaccccgccgggcagcgucgaggcguucccccaaagcaacgcaguaauacaagaugaagaaagagauauaccagaacgaagcuggaacaguggauaugacuggauuacggacuuuccaggcaaaaccgucugguuugucccgucaauuaagucaggaaacgacauugcgaacugccugcggaagaauggcaaaagagugauacagcugagccgcaaaacuuucgacaccgaauaccagaagaccaaaaauaacgacugggacuacguagugacaacagacaucucggaaaugggcgcaaacuuuagagcagaccguguaaucgauccccgccgaugcuuaaagccgguaauacuaaaggacgggccugagcggguaauccuagcagggccgaugccaguaaccgucgcaagcgcggcgcagcgaagggggagaauaggacgaaaccagaacaaagaaggugaccaguacguauacauggggcaaccgcuaaacaacgacgaagaucacgcacacuggaccgaagcaaagaugcuuuuggacaauauaaacacacccgaaggcauaauacccgcucuauucgaaccagaacgagagaagucggccgcaauagacggugaauaccgauuaagaggagaggcucgcaagaccuucguagaacugaugagaaggggagaucugccagucugguuguccuacaaaguagcuagcgagggauuccaguacucugaccguagaugguguuucgacggagagcgcaacaaccaagugcuagaagaaaacauggacguagagaucuggacgaaagaaggggaaaggaagaaacucaggccgcgcuggcucgacgcccggacguacucggaccccuuagcgcugagggaguucaaagaguucgccgccggcaggcgcucggucagcggugaccuaauauuggaaauagggaaacugccucaacaccucacgcuacgggcccagaacgcucuggauaaucucgucaugcuccacaauagugagcaaggaggaaaggcguaccgucacgccauggaagaacuaccggauacuauagagacacuaaugcugcuagcucucaucgccguccugacgggaggggugacccuauucuuccugaguggaaagggucucgguaagacaagcauagggcugcuaugcguaaccgcaaguucagccuuacuguggauggccagcguggaaccccacuggauagcggcuagcauaaucuuggaguuuuuccuaaugguguuacuaaucccggagcccgaccgucagcgcacgccucaagacaaccagcucgccuauguagucaucggacuacuauucaugauccuaacuguagccgccaaugagaugggacucuuagaaacgaccaagaaagacuuaggcauaggguacguggccgcagagaaccaccaacacgccaccaugcuggacguggaccuucacccugcgucagcuuggacguuauacgcuguagcaacgacgguuaucacgccgaugaugcgccacaccaucgaaaacacaaccgcgaauaucagccuuacagccauagccaaccaagcagccauucuaaugggacuagacaagggauggccgaucagcaagauggacaucgggguaccccuauuagccuuaggauguuacagccaggugaacccacugacucuuaccgcugcgguucugaugcucguagcucacuacgccauuauaggcccgggacuacaagcgaaggcgacccgcgaggcucaaaaacgcacugcugcaggaaucaugaaaaauccgaccguagacgguaucguagccauagaucuagaucccguggucuaugacgccaaguucgagaagcaacuaggacaaauaaugcuguuaauacuuugcacaucgcaaauccucuuaaugaggacgacaugggcccuaugcgagucgauaacacuagcgacgggaccacuuacgacacuaugggaagggucgccgggcaaguucuggaacaccacgaucgccguuucaauggcaaauaucuuccgcggcuccuaucuggcgggagcuggucucgcauucagccugaugaaaagucuaggaggaggaagaagggguacuggcgcgcagggagaaacacuaggggaaaaauggaaaagacagcugaaccagcuaagcaagagcgaguucaacaccuauaaacgcagcgguauaauggagguagacaggucagaagcaaaagaagggcugaaacgcggagaaaccaccaaacacgccguuucgcgagggacagcgaaacugcgcugguuuguugagcggaaccucguaaagccugaaggaaaggucaucgaccugggguguggacggggaggguggaguuacuacugugcaggccuaaagaaaguaacagagguaaaaggauauaccaaaggagguccaggucacgaggagccaauaccuauggcgacauacggauggaaccucgugaagcuccauucaggaaaggauguguucuuuaugccgccggaaaaaugcgacacgcuucuuugcgacauaggagaaucgagcccuaacccaacuauagaagaaggaagaacacuacgcguuuuaaagaugguagagccguggcuacgggguaaucaauuuuguauaaagauacuaaaucccuacaugccauccgucguggaaacgcuagaacaaaugcagcggaagcacggcgggaugcuaguccgaaaccccuuaucacguaacucuacgcacgagauguacugggucucuuguggcaccggcaacaucguaucggcagucaauaugacgagucggaugcuucucaaccgcuuuaccauggcgcaccggaaacccaccuacgagcgagauguagacuugggagccgggacgagacacgucgcaguagaaccagaaguggcgaaccuugauauaaucggacaacggauagagaacaucaagaacgaacacaaaagcaccuggcacuacgaugaagauaacccauacaaaacuugggccuaccacggguccuacgaagucaagccguccggauccgcaaguagcauggugaauggaguaguacgacuucucaccaagcccugggaugugauaccaauggugacacagaucgccaugaccgacaccacuccguucgggcaacaaagaguguuuaaggagaagguugacacccgaacaccccgugccaaacgggguaccacccagaucauggagguaacggcaaagugguuauggggcuuucuuucccgaaacaaaaagccgaggaucugcacccgcgaggaguucaccagaaaagugcgcucgaacgccgcaauaggcgccguauucguggacgaaaaccaauggaacuccgccaaagaagcgguagaggacgagagauucugggaccuaguccacagagaacgagagcuucacaaacaagggaaaugcgcaacaugcgucuacaacaugaugggaaagagggagaagaaacucggugaguuuggaaaagcaaaaggaagccgagcuauaugguacauguggcuuggcgcgcgauucuuggaguucgaagcacucggauucaugaacgaggaccacugguucucuagagagaacucacuuucaggagucgaaggcgaaggacugcauaaguugggguacauccugagagauaucucuaaaaucccaggagggaacauguaugcugaugauacugccggcugggacaccaggaucacggaagacgacuuacaaaacgaggccaaaaucaccgauauaauggaaccagaacaugccuuacuugcgacgucaauuuucaaguugacguaccaaaacaaagucguaaggguccagaggccagcgaaaaacgggaccguuauggacguaaucaguaggagggaccaaagggggucgggacaggucggaaccuacggccucaacaccuucaccaacauggaaguacaacugauccgacagauggaaagugagggcaucuuucugcccucagagcuagaaacgcccaacuuggcagagcgagcccucgacuggcuggaaaaacacggagcggaacgucuaaaaagaauggcuaucaguggcgacgacugcgucgucaagcccauagacgacagauucgcgacggcacuaaccgcacuaaaugacauggggaaagugcggaaagacaucccccagugggaaccuagcaagggcuggaacgauuggcagcagguacccuucugcucacaccauuuccaccaguugaucaugaaagacggacgagaaaucgugguaccaugccgaaaccaagacgagcucgucgggcgggccagggugucccaaggugccggauggagccuacgagaaaccgccugccuagguaagucguaugcccagauguggcaacuuauguacuuccaccgccgagaucuccggcucgcagccaaugcaaucugcagugcagugccgguggacugggucccaacaagccgaaccacauggagcauacacgcccaccaccaauggaugacuacagaagacaugcugucgguauggaaucguguguggauagaagagaauccguggauggaagauaagacgcauguuucaucaugggaagaagucccauaucuaggaaaacgggaagaucaaugguguggcagucuaaucggccucacagcacgggcaacaugggcaaccaacauacaaguagccaucaaccagguacggcggcucaucggaaacgagaacuacagcgacuacaugacgucgaugaaacgauuuaaaaacgagagugacccggaaggggcacuaugguaa

SEQ ID NO: 24072 - RNA, 9879 nt, Artificial Sequence
  derived and/or modified CDS sequence (opt11) from DENV-1__GU056032__SS-prME
ucgguggccaugcuucucaugcugcugcccaccgccuuagccuuccaccugaccacccgugguggggagccccacaugaucguuagcaagcaggagcgggggaagagucuacuguucaaaaccagcgccggaguuaacaugugcacccugaucgccauggaucucggcgagcucugcgaggacacuaugaccuauaaaugcccgcgcaucaccgaggcugagccggacgauguagacugcuggugcaacgcuaccgauaccugggugaccuacggcaccugcagccagaccggcgagcaccgucgcgauaagcgauccguggcguuggcgccccacgugggccuagggcucgagacacgcaccgaaaccuggaugucuagugagggggccuggaagcagauccagagggucgagaccugggcccugcgacaccccggguucaccgugaucgcacuguuccucgcccacgccaucggcacgagcauaacccagaaggguauaauuuucauuuuacuaaugcucguuacccccuccauggccaugcggugcgucggcaucgggaaccgcgacuucguggagggacugucgggcgccacuuggguggacguugugcuggaacacggguccugcgugacgacgauggcgaagaacaagccuaccuuagacaucgaguugcugaagaccgaggucacgaaccccgcaguacuccggaagcuuuguauagaggcgaagaucagcaauaccacuaccgacagucgaugcccaacgcagggcgaggcuacccugguggaggagcaggacgcaaacuucguaugccgcagaaccuuuguagaucggggcugggguaauggcugcggccucuucggaaagggaagccugcugaccugcgcgaaguucaagugcgugacgaagcucgagggcaagaucguccaguacgagaacuugaaguauucagugaucgugacgguccacacaggcgaccaacaccagguggggaacgagaccacggagcacggcaccaucgccacgaucacuccccaggcccccaccucagagauccagcuuacggauuauggggccuuaacccuggacugcagcccccggacuggccucgacuucaacgagaugguccuccugacaaugaaggaaaaguccuggcuggugcacaagcagugguuccucgaucugccguugccauggacgaguggggcaagcacaagccaggagaccuggaaccggcaagacuugcuggugaccuucaagacggcgcacgccaagaaacaagaggucgugguucucgggucccaggagggggccaugcauaccgcccuuaccggggccaccgaaauccaaacgagcggcaccaccacgaucuucgcggggcaccuuaagugccgccucaaaauggacaaauuaacgcugaagggcacauccuacguuaugugcacggggagcuucaagcuggagaaggagguggccgagacucagcacgggacuguacucguucagguuaaguacgagggcacggaugcccccugcaaaauccccuucuccacgcaggaugagaagggugugacccagaacgggcgguugauuacggccaauccaauugucaccgacaaggagaaacccgucaacaucgagaccgaaccccccuucggggagagcuacaucguggucggcgccggcgagaaggcacugaagcuguccugguucaagaagggcuccucgaucggcaaaauguucgaagccacggccagaggcgccaggcgcauggcgauccuuggagacacggcgugggacuucgggagcauaggcggcguguucaccucgguggggaagcugguacaccaaguguucggcaccgccuacgguguucuguuuagcggggucucguggacaaugaagauugggaucggcaucuugcucacguggcugggccucaacagucgcuccacuagccuguccaugaccugcaucgccguggggauggugacucucuaucucggcguuauggugcaagcagacagcggcugcguuaucaacuggaaaggccgagaauugaagugcggguccggcaucuuugugacgaacgaggugcacaccuggaccgagcaguacaaguuccaggccgacagccccaagcgccugagcgcagccaucggcaaagccugggaggagggugugugcggcauacgguccgccacucgccucgagaacaucauguggaagcagaucagcaacgagcugaaccacauucuacucgaaaacgacaugaaguucaccguuguggugggggacgccaacggaauccuugcucaagggaagaaaaugauccggccacagcccauggagcacaaguacuccuggaaauccuggggcaaagcuaagaucaucggcgccgacauccaaaacacgaccuucaucaucgacgggccugacaccccggagugccccgacgaccagcgcgcguggaauaucugggaagucgaggacuacggguucgggauuuucaccacgaauaucuggcugaagcugcgggacuccuacacacagaugugcgaccacagacugaugagcgcugccauaaaggacuccaaggccgugcacgccgacaugggguacuggaucgagagugagaagaacgagaccuggaagcuggcucgggccuccuucaucgaggugaagacauguacguggcccaagagccauaccuuguggaguaauggggucuuggagagcgagaugauaauccccaagaucuacgggggcccaaucucccagcacaacuaccgcccugguuacuucacccagaccgccggccccuggcaccuggggaagcucgaacuggacuucgacuuaugcgaggggacgacagugguggucgacgaacauuguggcaaucgggggccgagccuccgcaccaccacggugaccggcaaaauuauccacgaauggugcugccgguccugcacccugccaccccuucgauuccgcggggaggacgggugcugguacgggauggagauccgccccgugaaagagaaggaggagaaucucguccggucaaugguguccgcgggcagcggcgaaguggacucuuuuucccugggaauccuguguguuuccaucaugaucgaggaggugaugcgcucacgguggagccgcaagaugcucaugacaggcacguuagcgguguuccugcuccugaucaugggucagcugaccuggaacgauuuaauccgccucugcaucauggucggcgcuaacgccagugaucguaugggcaugggcacaacauaccuggcccuaauggccacuuucaaaaugcggcccauguucgcuguugggcugcuguuucggcgccucaccagucgugaggugcuccuccucacaauagggcuauccuugguggcaaguguggagcuccccaacucccuggaggagcugggcgauggucuggccaugggcaucaugaugcugaagcugcucacggaguuccagccccaucagcuguggacgaccuugcucagccugaccuucauaaaaaccacgcugucccucgacuacgccuggaagaccacugccaugguccugagcaucgugucacuguuuccccucugccugagcacgacgucccaaaagacgacguggcugccggugcuccuggggucguucgggugcaagccccucaccauguucuugauuaccgagaacaaaauauggggccguaagagcuggccucugaacgaggggaucauggcggucggcaucgugagcaugcugcucuccucccuacugaagaaugacgugccucucgccgggccgcugaucgccggcggcaugcugaucgccugcuacgucaucagcggauccagugccgaucucagccuggagaaggcagcagaggugagcugggagcaggaggcagagcacuccggcacuagccacaacauccugguggagguccaggacgacgggaccaugaagauuaaagacgaggagcgggacgacacucuaaccauacugcuaaaggccacgcuccuggccgucuccgguguguaccccaugagcauucccgcaacccucuucguaugguacuucuggcagaagaagaagcagcguagcggggugcucugggacacucccagcccgccugagguggagcgggccguccuugaugauggaaucuaccggauacugcagcggggguugcucggucgcucccaggugggggugggggucuuccaggauggaguguuccacaccauguggcaugugacgcgcggcgccguccuaauguaccagggcaagagacuagagcccagcugggccuccgugaagaaggaccucaucaguuacggcggcggcuggcgguuccaggggucguggaacacgggcgaggaggugcaggucaucgccguggagcccgggaagaauccgaagaacgugcaaaccaccccuggcacguucaagacuccggagggugaggucggggcgauagcccuggacuucaagcccggcacguccgggagcccgauagugaaccgcgagggcaaaaucguuggccuguauggcaauggcguugugaccacgucggggaccuauguguccgccaucgcccaggccaaggcaucacaggagggaccauugcccgagaucgaggacgaggucuuuaagaagcggaaccugacaauuauggaccugcacccagggaguggcaagacucgccgguaccucccugccaucgugcgcgaggccaucaagcggaagcugagaacgcucauccucgcccccacccgaguaguagcauccgagauggccgaagcucugaagggcaugcccauccgguaccagacgaccgcggucaagagcgagcacacggggcgcgagaucguggacuugaugugccacgccacuuucaccaugcggcugcucucgccgguccgcgugcccaauuauaacaugaucaucauggacgaggcgcauuucaccgaccccgccagcauagccgcccggggcuacauauccacgcgcguggggaugggcgaagccgcggcaaucuucaugaccgcuacgccgcccgggagcgucgaagcauucccccaauccaacgccgugauucaggacgaggagcgggacaucccugagcgcucguggaacuccggcuaugacuggaucaccgacuuccccgggaaaacgguaugguuuguacccagcauaaaauccggaaacgacaucgcgaacugccugcgcaagaacggaaagcgcgugauacagcucucuagaaagaccuucgacaccgaauaccagaagaccaagaacaaugacugggacuacguuguaacgacggacaucuccgaaaugggggccaacuuucgcgccgaucgggugaucgauccccggcgaugccugaagcccgugauccugaaggauggccccgagcgcgucauacucgcgggaccgaugcccgugaccgucgcuagcgccgcccagcggcgcggccggaucggccgcaaucagaacaaggagggggaucaguacguguacaugggccagccccugaacaacgacgaggaccacgcacacuggaccgaggccaaaaugcuguuggacaacaucaacacgcccgaggggauuaucccggcgcuguucgagcccgagcgagagaaguccgccgccaucgauggugaguacagacugcgcggggaagcccggaagaccuucguggaacuuaugcguaggggcgaucugcccgucuggcugagcuacaagguggccuccgagggcuuccaguacucugaccgccgguggugcuucgacggggagcgcaauaaccaggugcuagaggagaacauggacgucgagaucuggaccaaggaaggcgaacggaaaaaacugcgcccgcgguggcuggacgcgcgcaccuacuccgacccgcucgcccuacgcgaguucaaggaguucgccgccggucgccggucugucaguggagaucugauacucgagaucggcaagcugccccagcaccuuacccuccgcgcccagaaugcgcuggacaaccuggugaugcuccacaacagugaacagggcgggaaggccuaccgacacgccauggaggaauugcccgacacgauagagacccugaugcuccuggccuuaaucgcgguccucaccgggggcgugaccuuguucuuccugagcggcaaaggucucgggaagacgaguaucggguugcugugcgugacugccagcuccgcccuauuauggauggcaagcguggagccccacuggaucgccgcgaguaucauccuggaguucuuccuuaugguguuacuaauaccugagcccgauagacagcggacaccccaagacaaccaguuagcguacguagucaucggcuugcuauucaugauccucaccguggcagcaaacgagaugggacugcuugagacgacuaaaaaagaccugggcauagggcacguggccgcggaaaaccaucagcacgcaaccaugcuggacgucgacuuaaggccggccagcgccuggacccucuacgcgguugcgacgaccguaaucacgcccaugaugcggcacaccaucgagaacacgaccgcuaauaucuccuuaacggccaucgcgaaucaagccgcgauccugaugggccuggacaaaggcuggcccaucagcaagauggacaucggugucccccugcuggccuuaggcugcuacucgcaggugaacccgcugacccugacggcagccguguugaugcuggucgcgcacuacgcuauuaucggacccggccuccaggccaaggccaccagggaagcccagaagagaaccgcggcugggauuaugaaaaaucccaccguggacggcaucgucgccaucgaccucgaucccguuguguaugacgccaaauucgagaagcaacuggggcagaucaugcugcucauccugugcacgucccagauacugcucaugcguaccacgugggcccucugcgaguccaucacucuggcgacggggccccucaccaccuugugggagggaagccccgggaaguucuggaacacuacgaucgcuguauccauggccaacauauucaggggcucuuaccuggccggcgcggggcucgcguucucccugaugaaguccuugggcgggggcagacgcgggaccggugcccaaggcgagacccucggggagaaguggaaacggcagcugaaccagcucagcaagagcgaguucaauacuuacaagcgcuccggcaucauggagguggauaggucugaggccaaagagggucucaagcgcggcgagacaacgaagcacgccgugagccgggggaccgcgaagcuucgcugguucguggagcggaaccuggucaaaccggaggguaagguaaucgaccugggcugcgggagaggcgggugguccuacuacugcgccggacucaagaaggugaccgaggucaagggguacaccaagggcggcccagggcaugaagagccgauccccauggcaacguacggauggaaccuggugaaacugcauaguggaaaagacguguucuucaugccgcccgaaaagugcgauacccuccugugcgacaucggcgaguccagcccgaaccccaccaucgaggaggggcggacccuucgcguccucaagaugguggagccuugguugcggggaaaccaguucugcauaaagauccugaacccguacaugccguccguggucgagacgcuagagcagaugcagcgcaagcacggagggauguugguccggaaccccuugagccgcaacuccacacacgaaauguacugggucagcugcgguaccgggaacaucgucuccgcuguaaauaugaccucucggaugcugcugaaccgcuucacgauggcccaccgcaaacccaccuacgagcgggacguggaucugggagcaggcacgaggcacgucgccguggagcccgaggucgccaaccucgacaucauugggcaacgaaucgagaacaucaagaacgagcacaaguccaccuggcacuacgacgaggacaacccguacaagacuugggccuaucauggcaguuacgaggucaagccuuccggcagcgccucaucuauggugaacggcgucguucgcuuauugaccaagcccugggacgucaucccaauggucacucaaaucgccaugacggacacgaccccguucgggcagcagcgggucuucaaggagaagguagacacccgcacuccccgggccaaacgcggcaccacccagaucauggaggucaccgccaaguggcucuggggcuucuuaucccggaacaagaagccccgcaucugcacccgggaggaguucacucguaaggugcggucgaacgccgccauaggggcuguauucguggacgagaaccaguggaacagcgccaaggaggccguggaggacgagcgcuucugggaccuggugcacagagagcgagagcugcacaagcagggcaagugcgcuacgugugucuacaacaugaugggaaagcgggaaaaaaagcugggcgaauuugggaaggcgaaagggucccgcgccaucugguacauguggcuaggcgcucguuuccucgaauucgaggcacugggguucaugaacgaggaccauugguucagccgcgagaacucccugagcggcguggagggggaggggcuccauaagcuggguuacauccugcgggacaucuccaagaucccgggcggcaauauguacgccgacgacaccgccgggugggacaccagaaucacggaagacgaccuccagaaugaagccaagauaaccgacaucauggagcccgagcacgcccugcuugccaccagcauuuuuaaguuaaccuaucagaacaaggugguccgcgugcagcggcccgccaagaauggaacggugauggacgugaucucccggcgggaccagcgcggaagcggccaggugggaaccuaugggcucaacacguuuaccaacauggaggugcagcuaauccggcagauggagagcgagggcaucuuucuccccagcgagcuggagaccccgaaccuggcggagcgcguccucgacuggcuggagaagcacggggccgagaggcugaagcgcauggcuaucuccggcgacgauugcguggugaagcccaucgacgaucgguucgccaccgcccuaaccgcacuuaaugacaugggaaagauccguaaagauaucccucagugggagcccuccaagggcuggaacgacuggcagcagguuccguucugcucccaccacuuccaccaacugaucaugaaagauggccgggaaauaguggugcccugccgcaaccaggaugaacucgucgggcgggcgcgcgugagccagggcgccggguggagcuugcgggagaccgccugucuggguaaaagcuacgcccagauguggcaacucauguacuuccaccgucgggaccugcgccuggcggcuaaugccauuugcuccgccguucccgucgauugggugcccaccagccggacgacauggagcauccacgcgcaccaucaguggaugaccaccgaggauaugcuauccguguggaaccgagucuggauagaggagaacccguggauggaggacaagacgcacgugagcuccugggaggaagugcccuacuuggguaagcgcgaggaccaguggugcggaagcuuaaucggccucacugcccgugccaccugggcaacuaacauccagguugccaucaaccaggugcgccggcugauugggaaugagaacuaccuggacuauaugacgaguaugaagagauucaagaacgagucagauacugaaggugcgcuaugguga

SEQ ID NO: 24073 - RNA, 9879 nt, Artificial Sequence
  derived and/or modified CDS sequence (opt11) from DENV-1__GU056033__SS-prME
ucggugaccaugcuccuaaugcucuuacccaccgccuuggcguuucaccugacgacgcgaggcggggagccccacaugaucgugucaaaacaggagcgaggcaagagcuugcuguucaagaccaguguaggggugaauaugugcacauugaucgccauggauuuaggggaguuaugcgaagacacgaugacauacaagugcccccgcaucaccgaggccgaacccgacgauguggacuguugguguaacgccaccgacaccugggugacauacgggacguguucacagaccggcgagcauagacgggacaaacgauccguagcccuggcgccccacguagggcuugggcuagaaacgcgcacugagaccuggaugagcagugagggcgcguggaagcaaauccagagggucgaaaccugggcccuuagacaccccggguucacggugaucgcacuguuccuugcacaugcuaucgggacgucuaucacccagaaggggauaaucuucauccuauugaugcucgucacccccuccauggcgaugcgguguguuggcauugguaaucgagacuucguggagggguuaucgggcgccacgugggucgacguggugcuugagcacgggagcugcgugacuacgauggccaagaacaagccgacccucgacaucgagcugcuaaagaccgagguuaccaaccccgccguccuccggaagcuaugcauagaagcuaagaucagcaacaccacuacagauucccgcugcccuacucagggcgaagcgacccuagucgaggagcaggacgccaacuuuguuugcaggcgcaccuuugucgaccgcggaugggggaacggcugcggccuuuucggcaagggaucacuacuuaccugcgccaaauuuaagugcguaacuaaacuagaggguaagaucguucaguacgagaaccugaaauacucagucauagucacuguucacaccggagaucagcaccaaguggguaaugagacaaccgagcacggcaccaucgccacuauuacgccccaggcgccaacgucggagauacagcuuaccgauuacggcgcucucacccuagacugcagccccaggacuggccuugacuucaacgagauggugcugcugacgaugaaggagaaaagcugguuagugcauaaacagugguuccucgacuuaccgcugcccuggaccuccggagccagcaccagucaggagaccuggaaccggcaagaccugcuggucacguucaagaccgcgcacgcgaaaaagcaggagguagucguacugggcucccaagaaggcgcgaugcauacagccuugacuggggcuacugagauacaaacuucgggaacaacgacgauuuucgccgggcaccuuaaaugcagguugaagauggacaagcugacccugaagggcaugaguuacgugaugugcaccggaucauucaagcuagaaaaggaaguugcagagacccagcacggcacuguucuuguccagguaaaguaugagggcaccgacgcgcccugcaagaucccuuucuccacccaggaugagaaaggggucacccaaaacggccguuugauaacggcuaacccuauuguuacagacaaagaaaagccggucaauaucgagaccgagccgccguucggggaauccuacaucguggucggggccggagagaaagcccugaagcuguccugguuuaagaaggggagcuccaucggaaaaauguucgaggcgaccgcccgcggggcucgaaggauggccauccuaggcgauacagccugggacuuugggucuauuggcggggucuucacauccguagggaagcuagugcaccagguuuucgguacggcguacggagugcuauucagcggugugucguggaccaugaaaaucggaaucggcauccucuuaacguggcuagggcucaacucgaggucgaccagccuguccaugaccuguauagccguugggauggucacauuguaucucgggguuauggugcaggccgacagcgggugcguaaucaacuggaagggccgggagcugaagugcggguccggaauauuugucacgaaugagguucacaccuggaccgagcaauacaaguuucaagccgacagcccgaaaagacucagcgcagcgaucggaaaggcaugggaggaaggaguuugcggcauacggucugcuaccagguuagaaaacauuauguggaagcaaaucucuaaugagcugaaccacaucuugcuagagaacgauaugaaauucacugugguugucggggacgucaacggcauccuggcucaggggaagaaaaugauccgcccccagcccauggaacacaaguauucuuggaaauccuggggcaaggccaagaucauaggggcugacauacaaaauacgaccuucaucauagacggacccgacaccccagaauguccugaugaucagcgcgccuggaauaucugggaaguggaagacuacggcuuugggaucuucacgacuaauauauggcuuaaacucagagacucauacacccagaugugugaucaccgccucaugucugcagccauuaaggauucaaaggcgguccacgcagauauggguuauuggaucgaaucagagaaaaacgagacauggaaacuggccaaggccucuuuuaucgaggugaagacauguauuuggcccaagagccauacacucuggaguaacgggguguuagagagcgagaugauuauccccaagauuuauggugguccgaucucccagcauaacuacaggcccggguacuucacccagacugccggacccuggcaucucggaaaacucgaguuagacuuugaccuuugcgaagguacaacugucguaguugaugagcauugcggcaaccgcgggccgucucugcgaacaacgaccgucacgggcaaaaucauccacgagugguguugcagguccugcacguuaccgccacugcgguuccgcggggaggacggaugcugguacggcauggagauccggcccgugaaggagaaggaggagaaccucgucaggucaaugguaagcgcgggcagcggcgaggucgacuccuuuucucugggaauccugugcgugagcaucaugaucgaggaggucaugcggucccgguggagccguaagaugcucaugaccggcacccucgcuguauucuuacugcugaucaugggccaacugacguggaaugacuuaauccgucugugcaucauggucggcgcgaaugccuccgaccgaaugggcauggggaccaccuauuuggcucuaauggcaaccuucaaaaugcggccgauguuugccgucgggcugcuuuuccguagacucacgagucgcgaaguguuacugcuuacuaucggccuauccuuagucgcgaguguggagcugcccaauucccuugaggaacucggagacggcuuagcgaugggcauaaugaugcuuaaguuguuaacugaguuccagccacaccaguuguggacgacgcuacucagccugaccuucaucaagaccacgcuuucccuugacuacgccuggaagacuacggcgauggcauuaagcaucguguccuuauuuccccucugccugucgaccacuucgcagaagacaacuuggcugccggugcuccucggcucguucggguguaagccccugaccauguuuuugauaaccgagaacaagaucugggggcgaaaaagcuggccucugaacgaggggauaauggccaucggaauagugagcaucuuacucuccagccugcugaaaaaugacgugccccuggcugguccccuaaucgccgguggcaugcugaucgcgugcuaugucaucaguggauccagcgccgaccucaguuuagagaaggccgccgaaguaagcugggaacaagaggcggagcacagcggcacgucgcauaacauucugguggagguccaagacgacggcacaaugaagaucaaagacgaagaacgcgaugauacgcucaccauccugcugaaggccacccucuuagcaguauccggcguguaucccaugaguauccccgcgacgcuauucgucugguauuucuggcagaagaagaaacagagauccggggugcugugggacaccccgucaccuccagaaguugaacgugccguccuggaugaugguaucuaccggauuucccagcggggccugcuggggcggucgcagguaggcguagggguguuccaggauggcgucuuccacacaauguggcacgugacacgcggcgcgguccuaauguaucagggcaaacgguuagagcccuccugggccagcgucaaaaaggauuuaauuagcuacggaggggguuggcgcuuccagggguccuggaacacgggcgaggaagugcaggucaucgccguggaaccaggaaagaacccgaagaaugugcagacgaccccaggcaccuuuaagacgcccgagggcgaagucggugccaucgcccucgacuucaagccaggcaccuccgggagccccauugucaaucgggaggguaagaucguaggccuguacggaaacgggguugucaccaccucgggcacguacgugucugcaaucgcccaggccaaggcuucacaagaaggcccccugcccgagaucgaagacgaggucuucaagaagcgcaaccucaccauaauggaccuacacccgggguccggcaagacccgccgguaccugccagccaucguuagggaggcgaucaaacgaaagcucagaacccuuauccuugcccccacgcguguugucgccagcgagauggccgaggcguugaaaggcaugccuauccgcuaccaaacgaccgcggugaaaagugaacacaccgguagagagaucguggaucugaugugccaugcaacguucacgaugaggcuccucagcccgguccgggugcccaauuacaacaugaucauuauggacgaagcccacuucacugacccggccucgaucgccgcccgaggcuacaucagcacccggguggguaugggagaagcagcagccaucuuuaugaccgcuacgccucccggguccguggaggcauucccccagagcaacgccgucauacaggacgaggagcgggacauuccggagcggucauggaacagcggcuacgacuggaucaccgacuuucccgggaagacggugugguucguuccaucaaucaagagcggaaacgauauagcaaacugccuacgcaagaauggcaagcgggugauucagcugucgcgcaagaccuuugacaccgaauaucagaagaccaagaacaacgauugggacuacguggucacaacggacaucagcgagaugggggcaaacuuccgagcggauagagucaucgacccucgucguugccucaaacccgugauccugaaggacggccccgagagagucauucuugcggggccgaugcccgugacgguggccuccgccgcacagcgccgggggcgcauagguaggaaucagaauaaagaaggggaccaguacguguacaugggccaaccgcuuaacaacgaugaggaccacgcgcacuggacugaggccaagaugcuacuagacaacaucaauaccccagaggggauuaucccggcccucuucgagcccgaacgcgaaaagagcgccgcgauagacggugaauacagguuacgcggagaagcccgcaaaacguucguggagcuaaugcgucgcggugaccucccugucuggcuguccuacaagguggccagcgagggguuccaguacagugaccggcgcuggugcuucgacggggaacggaacaaucaggugcuggaggagaacauggacguagaaaucuggaccaaggagggcgagaggaagaaguugaggccccgguggcucgacgcuaggaccuacagugacccacuugcucugcgcgaguuuaaggaguucgcggccgggcggcgcucaguauccggugaucugauccuggaaauuggcaagcucccccaacaccuuacucugcgggcacaaaacgcacucgacaaccuugugaugcuccacaacagcgagcagggugguaaggcuuaucgccacgcuauggaggaguuaccugauacgaucgagacccugaugcugcucgcccuuaucgccgugcugaccggggguguaacguuauucuuucugucagggaagggccugggcaaaaccagcauaggguugcugugcgugacagccagcagcgcguuacucuggauggccucagucgagccccacuggaucgccgccagcaucauccuggaguucuuucucauggugcuacugaucccggaacccgaucggcagcgcacgccccaggacaaccaauuagccuacguggugauuggccuccuguucaugauacucaccguggcugccaacgaaauggggcuccuggagacuacgaagaaggaccuaggcauaggucacguggccgccgaaucucaucaacaugcuaccaugcucgacgucgaccuucguccagcgagcgccuggacccuauacgccguugccaccacggugauaacgccuaugaugcgccacacaaucgagaacaccacggccaacaucucauuaaccgcgaucgcuaaccaagccgccauucugaugggucuggauaagggguggccgauuagcaagauggacaucggcguaccucuccuagcgcuagggugcuacucccaagugaacccguuaacccugaccgcggccgugcuuaugcucgucgcucacuacgccaucauaggucccggucuccaggcgaaggccacccgggaggcccagaagcgcacagcugccggcaucaugaagaaucccacaguggacggcauaguugcgaucgaucuggacccggucguguacgacgcgaaguuugagaagcaguugggccaaaucauguuauugaucuuaugcaccagccagauacugcuuaugaggacaacgugggcccugugugaguccaucacuuuagcaaccggaccguuaacgacccucugggaagguucgcccgguaaguuuuggaauacuacaaucgccguguccauggcgaacaucuuccgaggcagcuaucuggcuggagcggggcuggccuucucgcucaugaagucgcugggcggaggacgacgggggacuggcgcccagggcgaaacucugggcgagaaauggaagcgccaauuaaaccagcugagcaagacggaguucaacaccuacaagagauccggcaucauggaagucgaucgcagcgaggcgaaggaaggcuuaaagcgcggcgagacgacuaagcacgccguuagcagggggaccgcuaaacuccggugguucgucgaacgcaaccugguaaagcccgaaggcaaggugaucgacuuagggugugggcgcggcggcuggucguacuacugugcaggucugaagaaaguuaccgagguaaaaggcuacaccaagggaggccucggucaugaggaaccaaucccuauggcgacguacggcuggaaucucgugaagcuccacagcgggaaggauguguucuucaugccacccgaaaagugugauaccuuacugugugacauaggagaaaguucccccaacccaacaaucgaggaggggcgcacccucagaguccucaaaaugguggaacccuggcugcguggcaaccaguucugcauuaagauccuuaacccuuacaugcccagcgugguggagacgcuggaacagaugcaaagaaagcacggcgggaugcucgugagaaacccucuguccaggaauagcacgcaugaaauguacugggugucaugcggcacaggaaacaucgucagcgcggugaacaugacaucccgcaugcuucuaaaucgguuuacgauggcccaccgcaagcccacuuacgaacgggacguggaccugggcgcggguacaaggcacguagccguggagccagagguggcgaaccucgacaucaucgggcagcgcaucgaaaacaucaagaacgagcacaagaguaccuggcacuacgacgaggauaaccccuauaagacgugggcauaccacggcucauacgagguuaagccaagcggcucagccagcagcauggugaacggcgucguaaaguuacugacgaaaccaugggacgugauaccaauggucacccagauagccaugacggauacgacccccuucgggcagcaacggguguucaaggagaagguggacacccgcaccccucgggcuaaacgcggcacuacccagauaauggagguaacagcaaaguggcuauggggcuuuuuaucacggaacaagaagccgcgcaucugcacacgcgaggaguucacacgcaaggugcgcagcaacgcagccaucggugccguguucgucgacgagaaccaauggaacuccgccaaggaggccguggaggaugaaagguucuggaaucugguacaccgugagcgggaacugcacaagcaaggcaagugcgcgaccugcgucuauaacaugaugggaaagcgcgagaaaaagcugggcgaguuugggaaagccaaaggcucgagggccaucugguacauguggcugggagcgcgguuucucgaguuugaggcccugggguucaugaacgaggaccacugguucucucgcgaaaauucucuuuccgguguggagggugaaggucuccacaaguuaggguacauacuccgcgacauuagcaagauaccugguggcaauauguacgccgacgacacggccgggugggauacccgcauaacugaggacgaccuccagaacgaggccaaaauuaccgacauaauggaaccagaacaugcacugcuggccaccucuauauuuaagcugaccuaccaaaauaaggugguaagggugcagcgacccgcuaagaacggcacggugauggaugugaucagccggcgugaccagagaggguccggccaaguggguaccuaugggcucaauaccuucaccaauauggaggugcagcugauccgucaaauggagucagagggaaucuuucuccccucagagcuagagacucccaaccuggccgagcgcguacuggacuggcuggagaagcacggggcagaacgguugaagcgaauggcgaucucuggcgaugauugcguggugaagccgaucgacgaucgguucgcaacggcgcuuacugcccugaaugacauggguaagguccgcaaagacauuccccagugggaaccgucaaagggcuggaacgacuggcagcagguccccuucugcucucaccauuuucaccagcuuaucaugaaagacgggagagaaauugucguuccgugccguaaccaggaugaguuaguggggcgugcuagggugucgcaaggggcgggguggagccuacgcgaaaccgccugucucggcaagagcuaugcccagauguggcaacuaauguacuuucaccggcgcgaccuacgucuggcagcuaaugcaaucugcagcgcaguaccagucgacuggguaccgacaagucgcaccaccuggucaauccaugcacaccaccaguggaugaccaccgaggacaugcucagcguguggaauaggguguggauugaggaaaaccccuggauggaggacaagacgcacguguccucaugggaggaaguuccuuaucugggcaagagagaggaucaguggugcggcagccucauaggccuuacggcacgggccacuugggccacaaauauacagguggccaucaaccagguucgucggcuuaucgguaaugaaaacuaccuagacuacaugacaagcaugaagcguuucaagaacgaguccgacccggagggcgcacuuugguga

SEQ ID NO: 24074 - RNA, 9879 nt, Artificial Sequence
  derived and/or modified CDS sequence (opt11) from DENV-1__GU131833__SS-prME
agcgugaccaugcugcucaugcugcugcccaccgcccucgccuuucaccugaccacccggggcggggagccccacaugaucguguccaagcaggagaggggcaagagccucuuguuuaagaccuccgccggggugaacauguguacccuaaucgccauggaccucggcgagcucugugaggacaccaugaccuacaagugcccccgcaucaccgaggcugagccggacgauguggacugcuggugcaacgccacugacaccugggucaccuacgggaccuguagccagaccggcgagcaccggcgcgauaagcggagcguugcccuggccccgcacguuggcuuggggcucgagacgcgcaccgagaccuggaugagcuccgagggcgcuuggaagcagauccagcgggucgagaccugggcccugcgccacccgggguucacggugauugcccuguuccucgcgcaugccaucggaaccagcaucacccagaagggaaucaucuucauccuguugaugcuagugacccccaguauggccaugcggugcgucggcauuggcaaccgcgacuuuguggaggggcugucuggcgccacguggguggacgucgugcuagagcacggguccugugugaccaccauggccaagaacaagcccaccuuggacauagagcugcugaagacggaggucaccaauccugcgguucuccggaagcuguguaucgaggcgaagaucagcaacaccaccacggacucccgcugcccgacccagggcgaggccacccugguggaggagcaggacgccaacuuugucugccggcgcaccuucguagacaggggcuggggaaacgggugcggacuguuuggcaaagggucccuacugacgugcgccaaguucaagugcgugaccaaguuggagggaaagauuguccaguacgagaaccugaaguauuccgugaucgucaccguccacacaggcgaccagcaccagguggggaacgagacgacggaacacggcaccaucgcgacaaucacgccgcaggcccccacgagcgaaauccagcugaccgauuacggggcccucacccucgacugcagcccgcggaccggccuggauuucaacgagaugguccuccugacgaugaaggagaaauccuggcuggugcacaaacagugguuccucgauuugccucugcccuggaccuccggugccagcaccagccaggagacauggaaucggcaggacuuacugguaacguucaagaccgcccacgcaaagaagcaggaggucguggugcugggcagucaggagggcgccaugcauaccgcccucaccggugccacggagauucagaccagcggcacuaccaccauuuuugccgggcaccugaagugucgccugaagauggacaagcuaacccugaagggaaccaguuacguaauguguacugggagcuuuaagcuugagaaggagguggcggagacucagcacggcaccgugcugguccaggugaaguacgagggcaccgacgcccccugcaagauacccuuccucacccaggacgagaaagguguuacccaaaacggaaggcugaucacggccaacccaauugucaccgacaaagaaaaaccggugaacaucgagaccgagccgcccuucggggagaguuacauaguggucggcgccggcgagaaggcguugaagcucagcugguucaagaagggguccaguaucgggaagauguucgaggcuacggcccgaggcgccaggcgcauggccauccucggcgauaccgcgugggacuucgggaguaucgguggcguauuuacaagcguuggcaaacuggugcaccaaguuuucggcacugccuacgggguccuuuucucaggcgucucauggacgaugaagaucgggauuggcauccugcugaccuggcucggacugaacucccguagcaccuccuugagcaugaccugcaucgcuguugggauggugacacucuaccugggcgucauggugcaagccgauuccgggugcgugauuaauuggaagggccgcgagcugaagugcgggagcggcaucuuugugaccaaugaggugcacacuuggaccgagcaguacaaauuucaggcugauuccccgaagcgccuuagcgcggccaucggcaaggccugggaggaagggguuugcgguauucggagcgccacccgccuggagaacaucauguggaaacagauuuccaacgaguuaaaccacauccuucuggagaacgacaugaaguucacagucguggucggggacgccaacggcauccuggcacaagggaagaagaugauccggccccaacccauggagcacaaguacagcuggaaguccuggggcaaggcuaagaucaucggcgccgauauccagaacaccaccuucaucaucgaugggccagacacgccggagugccccgacgaucagcgcgcguggaauaucugggaggucgaggacuacggguuugggaucuucacgaccaacaucuggcucaagcucagggauagcuacacccagaugugugaccaccgccuuauguccgcggccaucaaggacagcaaggccguacacgcagacaugggcuacuggaucgaguccgagaagaacgagaccuggaaacucgcccgggcgagcuucaucgaggugaagacgugcaccuggcccaaaucccacacccuguggagcaacggcguccuggaguccgagaugaucauccccaagaucuacgggggcccgaucagucagcacaacuaucgcccaggguacuucacgcagacggcaggccccuggcaccucgggaagcuggagcuggacuuugaccucugcgaaggaaccaccguggugguugacgagcacugcggaaaccgagggccgagccugcgcacgacgaccgugaccggcaagauuauccaugaguggugcugccggagcugcacgcugccgcccuuacgcuuccgcggagaggacggcugcugguacgggauggagauccgccccgugaaagagaaagaggagaacuuaguccgguccauggugagugccggcuccggcgagguggauagcuucagccuggguauccucugcguuuccauuaugaucgaggaggugaugcguagccgguggucccgcaagaugcugaugacgggcacccuggccguguuccuccuccuaaucauggggcagcucacuuggaacgaccugauccgccugugcaucauggucggcgcgaacgcgagcgaccggauggggauggguaccaccuaccucgcccugauggcgacauucaagaugcgcccgauguucgccguggggcuccucuuccggcggcugaccucccgggagguacuacucuuaaccaucggucugagccucgucgccuccguugagcugcccaacagucuggaggagcucggcgacgggcuggcgaugggcaucaugaugcugaagcuccugaccgaguuccagccccaccagcuguggaccacccuccugucccugacauuuaucaagacaacucuuagccuggacuacgccuggaagacgaccgccauggcccuguccaucgucagccucuucccccuaugccuguccacgaccagccagaagaccaccuggcucccgguguugcugggcuccuucggcugcaagccccucacgauguuccugaucacggagaauaagaucuggggucgcaagagcuggccccugaaugaggggauuauggcgauaggcaucguguccauccuccugagcucccugcucaaaaacgacgucccccuggccgggccgcugauugccggaggcaugcugauagccugcuacgugaucagcgguagcuccgccgacuugagccuggagaaggcggcggagguuuccugggagcaagaagccgagcacagcggcaccucccacaacauccucguagagguccaggacgacgggaccaugaagauaaaggaugaagagaaggacgauacccugacgauccugcucaaggccacccugcuggccgugagcgggguguaucccauguccauacccgcgaccuuguucgugugguacuucuggcaaaagaagaagcagcggagcggugugcugugggauacaccuagcccgcccgaggucgagcgcgcuguccuggaugacggaaucuaccggauucugcagcguggauuacuggggcggagccaggugggcguugggguguuccagaacgguguguuccacaccauguggcaugucacccgcggggccguccuuauguaccagggcaagcggcucgagcccuccugggccagcgugaagaaggaccugaucucuuacggcgggggcuggcgcuuccaggggagcuggaacaccggcgaagagguccaggugauugccguggagcccgggaagaacccgaagaacguccagaccacgcccgguaccuucaagacccccgagggcgaggugggggcgaucgcccuggacuucaagcccggcaccucagggagcccaaucgugaaccgggaaggcaagauuguagggcucuacgggaacgggguggugacgacuuccgggaccuacguuagcgccaucgcccaggcuaaagcgucccaggagggcccacuuccagagaucgaggacgagguguucaagaagcgcaaccuuaccaucauggacuuacacccggguagcggcaagacacggcgcuaccugcccgccaucgugcgugaggccaucaagcgcaagcugcggacgcucauccuagccccgacccgcgucguggcgagcgaaauggcggaggcucugaagggcaugcccauccgcuaccaaaccaccgccguuaaguccgagcacaccggacgggagaucguggaccucaugugccacgccaccuucaccaugcgccugcugucuccggugcgggugcccaacuacaauaugaucaucauggaugaagcgcacuucaccgaccccgccuccaucgccgcccgcggauauauaagcacccgggucgggaugggcgaagccgcggccaucuucaugaccgccacgccgcccgggagcguggaagccuucccucagucaaaugcagugauucaggacgaggaacgcgacauaccggagcgguccuggaacagcggcuacgacuggaucacggauuuucccggcaagacugucugguuugucccuuccauaaagagcggcaacgacauagcuaacugccuccgcaagaacggcaagcgggugauacagcuguccagaaagacuuuugacaccgaguaccagaaaacgaagaauaaugacugggacuacgucgugacuacugacauaucugaaaugggggccaacuuccgggccgacagagugaucgaccccagacgcugccugaagcccgucauccucaaggacggacccgagcgggucauacuggccgguccgaugcccgugaccgucgcuuccgccgcccagcgccgaggacgcaucggacggaaccagaacaaagagggggaccaguacguguacaugggccagccccugaacaacgacgaggaccacgcacacuggacggaggccaagauguugcuggauaacaucaacacccccgaggggauuaucccggcgcuauucgagcccgagcgcgagaaguccgccgccaucgacggcgaguaccggcuccgcggggaggcccgcaagaccuucgucgaacugaugcggcgcggcgaccugccaguuugguuguccuacaagguggccagcgagggcuuccaauacagcgaccggcgcugguguuucgacggugagcggaacaaccagguccuggaggagaacauggacguggagauauggaccaaggagggggagcgaaagaagcugcggccccgcuggcucgacgcgcggaccuacuccgauccgcuugcccugagagaguucaaggaguucgccgcuggacggcgcuccgugagcggcgaccuaauucuagaaaucgguaaacugccccagcaucuaacguuacgggcucagaacgcgcuggauaaccucgugauguugcacaacagcgagcagggagggaaggccuaccgccaugccauggaggagcuucccgacaccaucgaaacccucaugcugcuugcccucaucgccgugcugacggggggugugacgcuguuuuuccucuccgggaagggccugggcaagaccucaauaggguuacucugugucaccgccuccagcgccuugcucuggauggccaguguggagccccacuggaucgccgcgagcaucauccuugaguucuuucuuauggugcugcucaucccggagcccgaccggcagcgcacgccccaggacaaccagcuggccuacgucgugaucggccuccucuucaugauccuuacgguggccgccaacgagaugggucugcucgagaccaccaagaaggaucugggcaucggucacgucgccgcggagaaccaccagcacgccaccaugcuggacgucgaccuccggccggcaucugccuggacgcuguacgccguggcgaccaccgucaucaccccuaugaugagacacacgaucgagaacacaaccgccaacaucagccugaccgccaucgccaaccaggcugccauccucaugggccuggacaaaggcuggcccaucucaaagauggacaucggggugccccuacucgcccugggcugcuacagccaagugaacccgcucacgcucaccgcggccguccuuaugcugguggcgcauuacgcuauuaucgggcccggccuccaagcaaaggccacccgugaggcgcagaagcgcaccgcggcagggauaaugaagaaccccaccguggauggcauaguggccaucgaccuggaccccgugguguacgacgcuaaguucgagaagcagcugggccaaauaaugcuccugauccugugcaccucccaaauccuccugaugaggaccaccugggcccucugcgagagcauaacgcuagcgaccgguccccugaccacccugugggagggcucccccgggaaauucuggaacacgaccaucgccgucucaauggccaacaucuuccggggcuccuaccuagccggcgccggucucgcguuuagccugaugaagucccucggcgggggcagacgggggaccggcgcccagggcgagacccucggggagaaauggaagagacagcugaaccagcuaagcaaguccgaguucaacacguauaagcgguccgggauuauggagguggaccggagcgaggccaaggagggacugaaacggggcgagaccaccaagcacgccgugucucgcgggaccgcuaaacugcggugguuuguggagcgcaacuuggugaagcccgagggcaaggugaucgaccucggaugcgggagggggggguggaguuacuacugcgccggacugaagaagguuaccgaggugaaggguuacacgaaaggcggccccgggcacgaggagccuauccccauggccaccuacggcuggaaccuggugaagcuccacuccgguaaggacguauuuuucaugccgcccgagaaaugcgacacccucuugugcgacaucggcgagucguccccaaaccccaccaucgaggaagggcgcaccuugcgggugcugaagaugguggagcccuggcugcgcggcaaucaauucugcaucaagauccucaaccccuacaugccgagcguaguggagacccuggagcagaugcagagaaagcacggagggaugcuggugcgcaacccccucucccggaacagcacacacgagauguacugggucucuugcggcaccgggaauauugugagcgccgugaacaugacgucgcgcauguugcucaaccgguucacuauggcccaucgaaagccgaccuacgaacgcgacgucgaccucggcgcgggcacccggcacguggcuguggagcccgagguagccaaccuagacauaaucgggcagcgaaucgagaacaucaagaaugagcacaagucaacuuggcauuacgacgaggauaauccguacaagaccugggccuaucacggcuccuacgaggugaagcccagcggguccgccagcuccauggucaacggcguugugcggcuccucaccaagcccugggacguaauccccauggugacccaaaucgcgaugacggacaccaccccguucgggcagcaacgcguauucaaggagaaagucgacacccggacgccccgcgccaaacggggcaccacccagaucauggaagugaccgcccgcugguuaugggguuuccucucccggaacaagaagccccgcaucugcacgagagaggaguucacccgcaaagugcgguccaaugccgcuaucggcgcggucuuuguggacgagaaucaguggaauucugcgaaggaggccguagaggacgagcgcuucugggaccucguccacagagagcgugagcugcacaagcagggcaagugcgcgaccuguguguacaacaugauggggaagcgggagaagaagcugggugaguucgggaaggcgaagggcucgcgcgccaucugguacaugugguuaggcgcccgguuccuagaguucgaagcacugggguucaucaacgaggaccacugguucagccgcgagaauagccucuccggcguggagggcgaggggcugcauaagcugggguauauccuccgggacaucagcaagaucccgggcggcaacauguacgccgaugacaccgcggggugggauacgcgcaucacagaggacgaccugcagaacgaggcgaagaucaccgacaucauggaacccgagcacgcccugcucgccaccuccauuuucaagcugacauaucagaauaaggugguacgcgugcagcggcccgccaagaauggcaccgucauggacgugauuucaagacgugaccagcgcggguccggccaggugggaaccuacgggcugaacaccuucacgaacauggaaguacagcucauccgacagauggagagcgagggcauuuuucuacccuccgaacuggaaaccccgaaccucgcggaacgcgugcuagacugguuggagaagcacggggcagagcggcucaagcgcauggccaucagcggggaugacuguguggucaaacccaucgacgaccgguucgccaccgcccuaaccgcgcuaaacgacauggggaaagugcgcaaggacauaccucagugggagcccuccaagggcuggaacgauuggcaacaggucccuuucugcucgcaucacuuucaccaauugauaaugaaggacggccgggagaucgucgugccaugccgcaaccaggacgagcugguggggcgggcgcgcgucucccagggcgcaggauggucacuuagggagaccgcgugccucggcaagucguaugcccaaauguggcaacugauguacuuccacagacgggaccugcgccucgcagcaaacgccaucugcagcgccgugcccguggacuggguuccuaccucccggacgaccuggagcauccaugcgcaccaccaguggaugacaacggaggacaugcuuagcguauggaaccgcguguggauugaggagaacccguggauggaggacaagacccacgucuccucgugggaagaggugcccuacuuggggaagcgcgaggaccaguggugcggcucccucaucggcuuaaccgcgcgggcaaccugggcaacgaauauccaaguagcgauaaaccagguccgccgguugaucgggaacgagaacuauuuggacuacauggcgucaaugaagcguuuuaagaacgagucugacccggagggcgcacuaugguga

SEQ ID NO: 24075 - RNA, 9879 nt, Artificial Sequence
  derived and/or modified CDS sequence (opt11) from DENV-1__GU131834__SS-prME
agcgugaccaugcugcucaugcugcugcccaccgcucucgccuuccaccugaccacccgcggcggggaaccccacaugauagucagcaagcaggagcggggcaagagccuucuguucaagaccagcgccggggugaacaugugcacccugauagccauggaucugggagaacucugcgaagacaccaugacuuacaagugcccccgcaucaccgaggcugaacccgacgacguggacugcuggugcaaugccaccgauaccugggugaccuacgguacaugcucccagacgggcgagcaccggcgcgauaagcggaguguggcccucgcaccccacgugggccucggacucgagacccgcaccgagaccuggaugagcuccgagggcgccuggaagcaaauccaacggguggagaccugggcccugcgccacccaggcuucacuguaaucgcccuuuuccucgcgcacgccaucggcacuagcaucacccagaaggguauuaucuucauccuccugaugcuagugacccccaguauggcgaugaggugcgucggcaucggcaaccgcgauuucguagaggggcugucaggagccacguggguggacgucgugcuggagcacggcuccugcgugaccaccauggccaagaacaagcccacccucgacaucgagcugcugaagacggagguuacaaaucccgccguguuacggaaacuuugcaucgaggcgaagauuucgaacaccaccacggacagccgcugcccgacacagggcgaggcuaccuuaguagaggaacaggacgccaacuucgucugccggcgcaccuucguggaucggggcuggggcaacggcugcggccucuucggaaagggaucauuguugacgugcgccaaguucaaaugcguuacuaaacucgaggguaaaaucguucaguaugaaaaccugaaguacuccgugaucgugaccguccacacuggcgaccagcaccagguggggaacgaaacgaccgagcacggcaccaucgcuacgaucacgccacaggcccccacgucagagauccaguuaacagacuacggggccuuaacccucgauugcagcccucguacuggccucgauuucaaugagaugguccuccugacgaugaaggagaaguccuggcuggugcacaagcagugguuccuggaucucccgcugcccuggaccuccggggccagcaccagccaggagacauggaaucggcaggaucuccuggugacguuuaagaccgcccacgcgaagaagcaggaggucgugguacugggcagccaggagggcgccaugcacaccgcccucaccggggccacggagauccagaccagcggcaccaccacaaucuucgccggacaccugaagugccgccugaaaauggacaagcucacgcucaagggcauguccuacguaaugugcaccgggagcuuuaagcuggagaaggagguggcggagacccagcacggcacgguguuaguccaggucaaguacgagggcaccgacgccccaugcaagauccccuuuucuacccaagaugagaagggggugacccagaacggccggcucaucacggcaaacccgaucgucacugacaaggaaaaacccguaaacaucgaaaccgaaccucccuucggggagagcuauaucguggucggggcaggcgagaagacccuuaagcuguccugguucaagaagggguccuccaucgguaagauguucgaggcgacggcccgcggggccaggcgcauggccauccucggcgacaccgccugggacuucgggucuaucggcgguguguuuaccaguguggggaagcugguccaucagguguucggcaccgcguacggggugcuguucagcggcgucucguggacgaugaagaucgggauaggcauccuuuuaaccuggcuuggucucaauagccgcuccacaucauuaucuaugacgugcaucgccgucgggauggugacgcuguaccucggcgucaugguccaggccgauuccggcugcguaauaaauuggaaaggcagggagcugaagugcggguccgggaucuucgucacgaacgaggugcacacuuggaccgagcaguacaaguuccaagccgacagcccgaagcgccugagcgcagcgaucggcaaggccugggaggagggggugugcggcauacggagugccacccgcuuggagaacaucauguggaagcagauaagcaacgagcugaaccacauuuugcuagaaaacgacaugaaauuuacggucguugugggcgacgcgaacggcauccuagcccaggggaagaagaugauucgaccccagcccauggagcacaaguacuccuggaaguccugggggaaagcgaagauuaucggcgcagacauucagaacaccaccuucaucaucgacggacccgacaccccggaaugccccgacggccagagggccuggaacaucugggaggucgaggacuacggguucggcauauucacgaccaacaucuggcugaagcuccgggauuccuacacacagaugugugaccaccgccugaugagcgccgcgauuaaggacuccaaggccgugcacgccgacaugggauacuggaucgagagcgagaagaaugagaccuggaagcucgcccgggccuccuucaucgaggugaagacgugcaccuggcccaagucucacacacucugguccaauggcgucuuagagagcgagaugauaauccccaagaucuaugggggaccgaucucccagcacaacuaucgccccggcuacuucacccagacggcggggcccuggcaccuggguaagcucgaacuggauuucgaccuaugcgagggaaccacuguggucgucgacgagcacugcgggaaucggggcccgucucuccggaccacaacagugacugggaaaauaauccacgaguggugcugccgguccugcaccuuaccaccccugagauuccggggcgaggacgggugcugguacggcauggagauccgccccgugaaggagaaggaagagaaccucguccggucuaugguauccgcuggaagcggggagguggacagcuucucccugggcauccuguguguaagcaucaugaucgaggaggugaugcgcuccagguggagccgcaagaugcucaugacggggacccuggccguguuccugcuccugaucaugggccaguuaaccuggaacgaccucauccgccugugcaucauggugggggccaacgcguccgaccggaugggcaugggaaccacguaccuggcgcucauggcgaccuuuaagaugcgcccuauguucgccguggggcugcuguuccgaagacucaccagcagggagguccugcugcucacaaucggacugagccuggucgccagcgucgagcucccgaacucccuggaggagcugggggauggccucgccaugggcaucaugaugcuaaagcugcucaccgaguuccagccccaccagcucuggaccacccugcucagccugaccuucgucaagacuacccugucccucgacuaugcguggaagaccaccgccauggugcugaguauuguuucccuuuucccccucugccugagcacgaccucccaaaagacuacguggcuuccgguccuccucgggagcuucggcugcaagccccugaccauguucuucaucacugagaacaagaucuggggacggaaaucauggccccucaacgaaggcaucauggccaucgggauagucagcauccugcuguccagccuccuuaaaaaugacgugccccuggccggcccgcugauugccggcggcaugcugaucgccugcuacgucaucagcggcuccucagcggaccugucccucgagaaggccgccgaggugagcugggagcaggaggcggagcacuccggggcuagccacaacauucugguggagguccaagacgacggcaccaugaagauuaaggacgaggagcgggacgacacgcugaccauccuccugaaggccacgcuguuagccguguccgggguguaccccaugagcauuccggccacccuguucgugugguacuucuggcagaagaagaagcagcgcuccggcgugcugugggauaccccguccccgcccgagguggagcgggcuguccucgaugacggcaucuaccgcauccugcagcgggggcugcugggucgcucccaggugggggugggcguauuccaggacgguguguuucacaccauguggcacguaacacggggcgcaguccucauguaccaaggcaagcgccuggagccgagcugggccucugugaagaaggaccucaucagcuacgggggcggcuggcgguuccaaggcuccuggaacacaggggaggaagugcagguaauugcuguggagcccggcaaaaacccaaagaacgugcagacaacccccggcacguuuaaaacccccgagggggagguuggcgccaucgcgcucgacuuuaaacccgggaccagcggcaguccuaucgugaaccgcgagggcaagaucguggggcuguacggcaacggcgucgugaccacuagcggcaccuacgugucggccauugcccaagccaaggcaagccaggaggggccccugcccgagaucgaggacgaggucuuuaagaagaggaaccuuaccaucauggaccugcauccgggcagcggaaaaaccaggcgguaucugcccgcgaucgugagggaggccaucaaacggaagcuccgcacgcugauucuggcacccacccgcguggucgcauccgagauggcugaggcccucaagggcaugcccauccgauaccagacaaccgccgucaaguccgagcacacgggccgcgagaucguggaucucaugugccaugccaccuuuaccaugcgacugcucuccccggugcgcgugcccaacuacaacaugaucaucauggacgaggcccacuuuaccgaccccgcgucgaucgccgccaggggauacauuuccacgcgcgucggcaugggggaggccgcggcgaucuuuaugaccgccaccccgcccggcagcguugaggccuuuccucaaucaaacgccgugauccaggacgaagaacgggacauccccgagaggucuuggaacuccggcuacgacuggauuaccgacuuccccgggaagacggugugguucgugcccagcaucaaguccgggaacgauaucgccaacugcuuacggaagaacgggaagcgcgucauccagcugagcagaaagacauucgacacggaguaucagaaaaccaagaacaaugacugggacuacguggucacgaccgacauuucagagaugggcgcgaacuuccgcgccgaccgagugaucgacccccgacggugccucaagccggugauccucaaggacgguccggagcgcguuauccuugcgggcccgaugcccguaaccgucgccagcgcggcccagaggcgcggccggaucggccgcaaccagaacaaggagggcgaccaguacguguacaugggccagccacuuaauaacgacgaggaccacgcccacuggaccgaagccaagaugcuguuagacaacauaaacacacccgaaggcaucaucccggcccucuucgagcccgagcgggaaaaguccgcggccaucgacggggaguaccggcugagaggugaggcccggaaaaccuucguggagcugaugcgccggggcgaucuccccgucuggcugagcuauaagguggccuccgagggguuccaguacuccgaccgccgaugguguuucgacggagagcgcaauaaccaggugcuggaggagaacauggacguugagauuuggaccaaggagggggagcggaagaagcuccgcccccggugguuagaugcccgcacguauuccgacccgcuggcucuccgcgaguucaaagaguucgcggccggccgccggucuguaucaggugaccugauccuggagauagggaaacucccccagcaccugacccugcgagcccagaacgccuuggacaaccuggugaugcugcacaacuccgagcagggcggaaaggcguaccgucacgccauggaggaacuccccgacacgaucgaaacacugaugcuucucgcccugaucgccguccuaaccgguggggugacacuauuuuuccuguccggcaagggccuggggaagacguccaucggccuccugugcgugaccgcgagcuccgcccugcuauggauggccagcguugagccacacuggauagccgccagcaucauccuugaguucuuccugauggugcuccugaucccggagcccgaccgccagcggacgccacaggacaaccagcuggcguauguggugaucgggcuccuguucaugauccugaccguggccgccaacgagauggggcuccuggagacgaccaaaaaggaccugggcaucggauacguggccgccgagaaccaccagcacgcgaccaugcucgacgucgaucugcgcccagccuccgccuggacacuguacgccguggccaccaccguuaucaccccgaugaugcggcacaccaucgaaaacacgaccgcgaauaucucccuaaccgcgaucgccaaccaggcagccauccugauggggcuggacaagggguggcccaucucuaagauggauaucggagucccccuccuggcgcuggggugcuacucccaggugaauccgcucacccugacggcugcggugcugaugcucgucgcccacuacgcgaucaucggucccgggcugcaggccaaggccacccgagaggcacagaagcgcaccgccgcgggcauaaugaagaacccuacuguggacggcaucguggccaucgaccuggaccccgucguguacgacgccaaguucgagaagcagcuagggcagauaauguuacugauccucugcacgagccagauucugcuaaugaggaccacgugggccuuaugcgaguccaucacucuggccacgggcccgcuaaccacccucugggaggggagucccggcaaguuuuggaacaccacgauagcgguauccauggccaacauuuuccgcggcagcuaccuggccggggccggccuggccuucucccucaugaagucccucgggggcgggcggcgcggcaccggcgcgcagggcgagacgcugggcgaaaaguggaagcggcagcucaaucagcuguccaagagcgaguucaacaccuacaagcgcagcgggauuauggaggucgaccgauccgaggccaaggagggccugaagcgcggggaaacgaccaagcacgccgugagcagaggcaccgccaagcuccgcugguucguugagcggaaccuggucaagcccgaagguaaggugaucgaccucgguugcgggcgcgguggcugguccuacuauugcgcggggcugaagaaggugacugaggucaagggcuacaccaagggcgggccgggccaugaggagccgauccccauggccacguacggguggaaccuagugaagcugcacaguggcaaggacguuuucuuuaugccgcccgagaagugcgacacccuacucugcgauaucggggagagcagcccgaaccccaccauugaggaggggagaacucuccgcguacucaaaauggucgagcccuggcuccgaggcaaccaguucugcaucaagauccugaaccccuacaugccguccguugucgagacgcuggaacaaaugcagcgcaaacauggaggcaugcucgugcggaaccccuugagccgcaacuccacccacgagauguacugggugucaugcggcacuggcaacauaguuuccgccgucaacaugaccagccggaugcugcucaaccgcuucacgauggcccaccgcaagcccacauacgagcgggauguggacuuaggcgcugggaccagacacguugcgguggagcccgagguggccaaccuggacaucaucgggcaaagaaucgagaacaucaagaacgagcacaagagcaccuggcacuaugaugaggacaacccguacaagaccugggccuaccacgggucuuacgaggucaagcccuccggcagcgcauccagcauggugaauggggucgugcgccuccugaccaagccaugggacgugauccccauggucacgcaaaucgccaugaccgacacgaccccguucggccagcagcgggucuucaaagagaagguggacacccgcacgccccgggcgaagcgcggcacgacccagauaauggaggucacugccaaguggcuguggggguuccucagccguaacaagaagccuaggaucugcacccgggaggaguucacgcgcaaaguccggagcaacgccgccaucggcgccguguucgucgacgagaaccaguggaacagcgcaaaggaggcaguggaggacgaacgcuucugggaucugguucacagagagcgggagcugcacaagcagggaaagugcgcuacaugugucuacaacaugauggguaagcgggagaagaaacuuggggaguucggaaaggccaagggcucccgcgcgaucugguacauguggcugggggcacgguuccuggaguucgaggcccucggcuucaugaacgaggaccacugguucagucgagaaaauucccucagcggcguggagggcgaggggcugcacaagcucggcuacauucuacgcgacaucuccaagauaccgggcgggaacauguacgccgaugacaccgccggcugggacacccggaucacggaggacgacuuacaaaacgaggcgaaaaucaccgacaucauggagcccgaacacgcccuccuggccacaagcaucuucaagcugaccuaccaaaacaagguaguccgcgugcagaggccagccaagaacggcacagugauggacguaaucucccgacgggaccagcgcggcagcgggcagguugggaccuacggacucaacaccuucaccaacauggagguacagcugauccggcaaauggaguccgaggggaucuuccugcccagugagcucgaaaccccgaaucuggcggagcgcgugcuggacuggcucgagaagcacggcgcggagcggcugaagcgaauggccaucuccggagacgacugcguugugaagcccauugacgaccgguucgccacggcccucaccgcccucaaugacauggguaaggucaggaaggacaucccccagugggagcccagcaaaggguggaacgacuggcagcaggucccuuucugcucccaccacuuccaccaacugauaaugaaggacggucgggagaucgugguccccugccgcaaucaggacgagcuggugggcagagcgcguguuagccagggagccggcuggucccuccgggagaccgcgugccugggaaagagcuacgcucagauguggcagcugauguacuuccaccgccgggaccuccggcuggccgccaacgccaucugcuccgccgucccggucgacugggugcccaccucgcggacaaccuggagcauucacgcccaccaccaguggaugaccaccgaggauauguuauccgucuggaaucgcguguggaucgaagagaacccauggauggaagacaagacacacgugagcaguugggaagagguacccuaccucggcaagcgggaggaccaguggugcggcagccugaucgggcugaccgcgcgggccaccugggccaccaacauucagguggcuaucaaucaagugcgucgacucaucggcaacgagaacuaccuggacuacaugacguccaugaagcgcuucaagaacgagucugaccccgagggggcgcugugguga

SEQ ID NO: 24076 - RNA, 9879 nt, Artificial Sequence
  derived and/or modified CDS sequence (opt11) from DENV-1__GU131835__SS-prME
agcgugaccaugcugcucaugcuacuacccaccgcccucgccuuccaccugaccacccggggcggggagccgcauaugaucguaucaaagcaggagaggggcaagucgcucuuauucaagaccucugccggggucaacaugugcacccugaucgccauggaccugggcgagcucugcgaggauacaaugacguacaagugccccagaaucaccgaagccgagcccgacgacguagacugcuggugcaacgcaaccgacacgugggucacauacgggaccugcucccagaccggcgagcaccggcgcgauaagcggucuguggcccuggcgccccacgugggccuugggcucgagacgcggaccgagacauggaugagcagcgagggcgccuggaagcaaauccagcgggucgaaaccuggguccugagacacccuggguucacggugaucgcuuucuucuuagcgcacgcgauuggcaccagcaucacccaaaaggggaucaucuucaucuuacugauguuggucacgccuuccauggcuaugcgaugcgucggaaucggcaaccgugacuucgucgaggggcucagcggcgccacgugggucgacguggugcuugagcacggguccugcguuaccaccauggccaaaaacaaacccacacuggacaucgaacucuuaaagacggagguuaccaaucccgccgugcuucggaagcucuguauugaggcaaagaucagcaauaccaccacggacagccgcugcccaacccagggcgaagccaccuuagccgaagaacaggacgccaauuucgucugucggcgcaccuucguagaucggggcugggggaacggcugcggacuguucggcaaggggaguuuauugacgugcgcaaaguuuaaaugcgugacuaaacuggagggcaagaucguacaguacgagaaccucaaauacuccguaaucgugaccguccacacuggugaccagcaccaggucgggaacgaaacgaccgagcauggcaccaucgcgacaaucacgccccaggccccaacgagcgagauacaacugaccgauuacggggcccugacccucgacugcagcccccggacggggcuggacuucaacgagaugguccugcucacgaugaaggagaagagcugguugguacacaagcagugguucuuagaccucccgcugcccuggaccuccggagccucuaccagccaggagaccuggaaccggcaggaccugcucgugacguucaaaaccgcccacgcgaagaagcaggagguuguggugcugggcucccaggagggugccaugcacaccgcccugaccggggccacugagauccagacaagcggcaccaccacgaucuuugccggacaucucaaaugcagacugaagauggacaagcugacucucaagggcaccuccuaugucauguguaccgggagcuucaagcuggagaaggagguggcggagacgcaacaugggaccguguuagugcaggugaaguacgagggcaccgaugcccccugcaagauccccuuuucuacccaggacgagaaagggguaacgcagaauggccggcuaaucaccgccaacccgaucgucaccgacaaagaaaagcccgugaacauugagaccgagccgcccuuuggggagagcuauauaguggucggagcgggcgagaaagcgcucaagcugaguugguucaagaaggggucuucgaucgguaagauguucgaggcuacggcccgcggagcaaggcguauggccauccugggcgacaccgccugggacuucgggagcauuggcggcguguucaccuccguggguaagcucgugcaccagguguucgggaccgcguacggggugcuauucagcggaguauccuggaccaugaagaucgggaucgggauccugcuaacuugguugggcuuaaauuccagauccaccagcuuguccaugaccugcauugccgugggaauggugacgcuguacuuaggcgucauggugcaagcugacagcgggugcguuauaaacuggaaggguagggagcuuaagugcgguuccggaaucuucgucacaaacgagguacacaccuggaccgagcaguacaaguuccaggcggacagcccgaagagguugagcgcggcaauaggcaaggccugggaggagggggucugcggcaucagguccgccaccagacucgagaacaucauguggaagcagauuagcaaugagcucaaccauauccugcuggagaacgacaugaaguucacgguagugguaggggacgccaacgguauccucgcucaggguaagaagaugauccggccacagcccauggagcacaaauacuccuggaaguccugggggaaggccaagaucauuggcgccgacauccagaacaccacguucauaaucgacggccccgacaccccggagugcccagacgaccaacgcgccuggaacaucugggaggucgaggacuacggcuucgggauauucacgaccaacaucugguuaaaguuacgggacuccuacacccagaugugcgaccacaggcucaugagcgcggcgauaaaggauuccaaggcgguccacgccgacaugggcuauuggaucgaguccgagaagaacgagaccuggaagcucgcccgggcgucguucaucgaggugaagacgugcaccuggcccaaaagccacacucugugguccaacggggugcuugagagcgaaaugaucauucccaagaucuacgggggcccgaucucccagcauaacuaccgucccggguauuucacccagacggccggccccuggcacuuggggaagcuggagcuggacuuugaccugugcgagggcaccaccguggucguggacgagcauugcggcaaccgcgggccuagccuuaggaccacgaccgugaccggcaagauaauccacgaauggugcugccgguccugcaccuuaccgccccuccgguuccgcggggaggacggcuguugguacgggauggagauccgccccgugaaagagaaggaggagaaccuggugagaagcaugguguccgccggcagcggcgagguagauucguucucccucgggaucuugugcgucucaauuaugauagaagaggugaugcgcucccgauggagccgcaaaaugcuaaugacgggaacccucgccguguucuuguuacucauaauggggcagcugaccuggaacgaccugauccgccuguguaucauggucggagccaacgcguccgacaggauggggaugggcacuacuuacuuagcccugauggccaccuuuaagaugcgcccgauguucgccgugggccuccuauuccggcgguugaccucaagagaggugcugcuacugaccaucgggcucucccuugucgccagcguggagcugcccaacucccucgaggaguuaggcgacgggcuggcgaugggcaucaugaugcucaagcuguugaccgaguuccagccccaccaguuauggacaacccugcugucgcucaccuucaucaagacgaccuugucccuggauuacgccuggaagacgaccgccaugguccucagcaucguaucacuguucccccucugccucaguacgaccucccagaaaacuaccuggcugccggugcugcucggcuccuucggguguaagccccuuaccauguuucugaucacugaaaacaagauauggggccgcaagagcuggccccucaacgaagggaucauggcgaucggcaucgucucgauccugcuguccagccuccugaagaacgacgugccccuggcggggccgcucauugccggcgggaugcugaucgccugcuacgugauuagcgggagcagcgccgaccuguccuuagagaaggccgcggaggucagcugggaacaggaggccgagcacuccggcaccagccacaauauccugguggagguacaggacgacgggaccaugaagauuaaggacgaggaacgggacgacacccucacgauccuccugaaggccaccuuauuagccgucuccgggguguaccccaugagcaucccggccacguuauucgugugguacuucuggcagaaaaagaaacagcgcuccgggguccugugggacacucccagcccgccugagguggagcgagcgguguuggacgacggaaucuaccgcaucuugcagcggggccugcucgggcguucucaggugggcgucggggucuuucaggauggcguuuuucacacgauguggcacgugacccgcggcgcgguguugauguaccagggcaaacgccuggagccgagcugggccucggucaagaaggaucugauaagcuacggcgggggcuggcgguuccagggcuccuggaacacuggcgaggagguccagguaaucgccgucgagcccgggaagaacccgaagaaugugcagaccaccccaggcaccuucaagacccccgagggcgaagugggggccaucgcgcucgacuucaagcccggcaccagcggguccccgaucgucaaccgcgagggcaaaauaguuggccuguacggaaacgggguaguaacgaccagcgguaccuauguguccgcgauugcucaagccaaagcaagucaggagggcccccugcccgagaucgaggaugagguuuuuaagaagagaaaccucacuaucauggaucuucacccggguagcggcaagacacgccgguaccugcccgccaucgucagggaggccaugaagcggaagcuccgcacccugauccuggccccaacccgcgugguagccuccgagauggcagaagcccuaaagggaaugccaauucgcuaccagaccacggcuguaaagagcgagcacaccgggagagagaucguggaucucaugugccacgccacguucacuaugcggcugcucuccccggugcgcgugccuaauuacaacaugaucaucauggacgaggcccacuucacagaccccgcgagcauagcugcccggggcuacaucuccacccgagucgggaugggugaggccgccgcgaucuucaugaccgccacgccgcccgggagcguggaagccuuuccccaguccaacgcuguuauucaggacgaagagcgggacauacccgaacgcagcuggaacagcggcuacgaguggaucacggauuuccccgguaagaccgugugguucgucccuagcaucaaguccgggaaugacaucgcuaacugccugcguaagaacggaaaacgcgugauccagcuaaguagaaagaccuucgacacugaauaccaaaagacgaagaacaacgacugggacuacgugguuacgaccgauauuuccgagaugggggcgaauuuccgcgccgaucgagucaucgacccccgccgcugccucaagccaguuaucuugaaggacggccccgagcgcguaaucuuagccgggccgaugcccgucacgguggccagcgcggcccaacggcgcggccggauuggccgcaaccaaaauaaggagggggaccaguacgucuacaugggccagccccucaacaaugacgaggaucacgcccacuggacggaggcuaaaaugcuacuggacaacaucaacacccccgaggggaucaucccggcccucuucgaaccugagagggagaaaagcgcugcaaucgacggcgaguaccggcugcgaggggaggcccggaaaacuuuuguggagcugaugcgccggggcgaccuccccguguggcuaagcuacaaggucgcauccgagggguuccaguauucagaccgccgguggugcuucgacggggaacgcaacaaccaggugcuggaggaaaauauggauguugagaucuggaccaaggagggcgagcggaagaagcuccggccccgauggcuggacgcccgcaccuacagugacccgcuugcgcucagggaguucaaggaguucgccgcggggcgccggagcgugagcggcgaccugauccuggaaaucggcaaguugccccagcauuuaacgcugcgcgcgcagaacgcccucgacaaccucgugaugcugcauaauagcgaacaaggggggaaggcguaccggcaugccauggaggagcuccccgacacgaucgaaacgcugaugcuacucgcccugaucgccgugcugaccgggggggucaugcuguucuuccugagcgggaagggccugggcaaaacguccauagggcuccucugcgugacggcgagcuccgcacuucucuggauggccucuguggaaccccacuggaucgcggcuuccaucguucuggaguucuuucugauggugcuccugauccccgagccagaccgccaacggacuccccaggacaaccagcuggcguacguaguaaucggucuccuguucaugauccuuaccguggccgcaaacgagaugggacuccuggagacgaccaagaaggaccuagggaucggacacgccgccgcggagaaccaccagcacgccaccaugcucgacguggaccugcggccugcuagcgccuggacccuguacgcggucgcgacgaccguaauaacccccaugaugcggcacaccaucgaaaacacgaccgccaacaucuccuuaaccgcaauagcaaaccaggccgcaaucuuaaugggccuggacaagggcuggcccauuucaaagauggacaucgggguuccccuacucgcccugggcugcuauucccaggucaacccccucacguugacggccgccgugcugaugcucguggcucacuacgccaucaucgggccuggcuuacaggccaaggcuacuagggaggcucagaagcggacugcugcaggaaucaugaagaaccccaccguugacggcauuguggccaucgaucuggaucccguggucuaugacgccaaguuugagaagcagcuuggucagaucaugcugcugauccucugcacgucacagauucugcugaugcguaccacuugggcccuaugcgagucaaucaccuuggcgacggggccgcugacaacccucugggagggcucaccggggaaguucuggaacaccacgaucgccguguccauggccaacaucuuccgcggcucuuaccuggccggcgccggacuggcguucucccucaugaagucauugggggguggccggcgcgguaccggcgcccagggcgagacccugggggagaaguggaagcggcagcucaaccagcuguccaagccagaauucaacaccuacaaacgcagcgguaucauggaggucgaccggagcgaggccaaggaggggcugaaacgaggcgaaacgaccaagcaugcugucucccgugggacagcaaagcuccgcugguucguggagagaaaucuggugaagcccgaaggcaaggugaucgaccugggaugcgggagaggcggguggagcuacuacugugccggguugaagaaaguuaccgaggugaaggguuacaccaaaggcggcccggggcacgaggagccuauaccaauggccacguacgguuggaaucuagucaaacugcauuccggcaaggacguuuuuuuuaugccuccggagaagugcgacacacugcucugcgacauuggcgagagcucccccaacccgaccaucgaggaagggcgcacccugcgugugcugaagauggucgaacccuggcuacggggcaaucaguucugcaucaagauccugaacccguacaugcccacgguuguggaaacgcuggagcagaugcagcgcaagcacggugggauguugguucguaacccccuuucgagaaacuccacucacgaaauguacugggugagcugcgggaccgggaacaucguguccgccgucaacaugaccagcagaaugcugcucaaccgcuucaccauggcucaucgcaagccuaccuacgagcgcgauguggacuugggugcgggcacucgccacguggccgucgagccggagguggcuaaccuggacaucaucgggcagcggauagagaauaucaaaaacgagcauaaguccacauggcauuaugacgaggacaaccccuauaagaccugggccuaccacggcagcuacgaggugaaacccuccggaucagccaguagcauggucaacggcgugguccgacuccugacaaagcccugggacgugauucccauggugacccaaaucgcgaugacggacaccaccccuuucgggcagcagcgggucuucaaggagaagguggauaccaggacgcccagagccaagagagguacuacccaaaucauggaggugaccgccaaguggcuguggggauuccugucccggaacaaaaagccgcgcaucugcacgcgggaagaguucacucggaagguacggucuaacgccgcgaucggggccguauucguggacgaaaaccaauggaacuccgccaaggaggccgucgaagacgagcguuucugggacuuaguacauagggagcgcgagcugcacaagcaagggaagugcgcgaccugcguguacaauaugauggggaagagagagaagaaguugggcgaguucgggaaggcgaagggcagccgcgccaucugguacauguggcugggugcacgcuuucuggaauucgaagcgcucggguucaugaacgaggaccacugguucucgagggagaacuccuugagcggcgucgagggugagggcuugcacaagcucggguacauccugagagacaucuccaggauccccgguggcaauauguacgccgacgauaccgcggggugggacacucggaucacggaagacgaccugcaaaacgaggccaaaaucaccgacaucauggagcccgagcacgcauuacucgcaaccagcaucuucaaguuaacauaccagaauaagguggugcggguccagcgccccgcuaagaacgggaccgugauggacgugaucucccggcgcgaucagcgggggagcggccaggucggaaccuacgggcucaauaccuucacgaacauggaggugcaacugauccgccagauggaguccgagggcaucuuccugccgagcgagcucgagaccccgaaccuggcugagcguguacuggacuggcucgagaagcacggggcagagaggcuaaagcggauggcaauuucuggagacgacugcgucgugaagcccaucgacgaucgcuuugccacuagccugacagcccucaacgacaugggcaaggugcggaaggacaucccccagugggagccguccaaaggcuggaacgacuggcagcaggucccuuucugcucucaccacuuccaccagcucaucaugaaagacggccgcgagauuguggugcccuguaggaaccaggacgagcuggucgggagagcgaggguaucccagggcgccggguggucucuccgcgagaccgccugccugggaaaguccuacgcccagauguggcaacugauguacuuccaccggcgagaccuccggcucgccgcgaacgcgaucugcagcgccguucccgucgauugggugccgacguccaggaccaccuggucuauucacgcgcaucaccaauggaugaccacggaggacaugcugagcguuuggaaccgcgucuggauugaggagaaccccuggauggaggacaagacccauguauccucaugggaggagguucccuaucuagguaagcgggaggaccaguggugcggaucccuaauaggccugacggcgcgcgcaaccugggccacgaacauccaagucgcaauuaaccaggucaggcggcucauuggcaacgagaacuacuuagacuacaugaccucgaugaagcgguucaagaaugaguccgaccuggagggcgcccugugguag

SEQ ID NO: 24077 - RNA, 9879 nt, Artificial Sequence
  derived and/or modified CDS sequence (opt11) from DENV-1__GU131836__SS-prME
ucagugaccaugcugcuuaugcugcugcccacagcacuagcuuuccaccugaccacgcgcggcggggaaccgcacaugaucgucagcaaacaggagcgggguaagagcuugcuguucaagacuagugcaggaguaaacaugugcacucuuaucgcgauggaucuaggcgagcucugcgaagacaccaugaccuacaagugcccccgaaucacggaggccgaaccugaugacguggacugcugguguaaugcuaccgacaccugggucacauacgggacuugcagccagaccggcgagcaccggcgcgacaagcgguccguagcccuggcaccccacguaggccuaggucucgagacccgcaccgagaccuggaugagcuccgagggcgcuuggaagcagauccaacgggucgagaccugggcacugcgccaccccggguucacagugaucgcucuguuccuugcucacgccaucggcaccagcauuacucagaaggggaucaucuucauuuuacugaugcucgugacccccagcauggccaugcggugcgucggcaucggcaauagagauuucguggagggguugagcggcgccacguggguggacgucgucuuggagcauggguccugcgugaccacgauggccaaaaauaagcccacccuagauaucgagcuucugaaaacggaggucacuaaccccgcgguacuccggaaacugugcauagaagcuaagaucuccaacaccaccacggacucccgcugcccgacacaaggggaggcuacacugguagaagaacaggaugccaacuuugucugccggcgcaccuucguggaccggggcugggggaacgguugcgggcucuucggcaagggaagccugcugacgugcgccaaauuuaagugugugaccaagcuagagggaaaaauuguacaguacgagaaucugaaguauuccguaaucgugaccguccacaccggcgaccagcaccaaguggggaacgaaacgaccgagcacgggaccauugcuaccaucacgccccaggcccccacgucggagauccaguuaaccgacuacggggcacucacccuagacuguaguccccggaccggcuuggacuucaacgaaaugguccuccuaacgaugaaggagaaauccuggcuagugcacaagcagugguuucucgaccugccgcugccuuggaccucuggugccuccacuagccaggagaccuggaacaggcaagaccuccuugugacauucaaaaccgcccacgcgaagaagcaggaggucguggugcuuggcucccaggagggggccaugcacaccgcacuuacgggcgccacggaaauacaaaccagcggcaccaccacgaucuucgccgggcauuuaaaaugccgcuugaagauggacaagcucacccugaagggcaccuccuacgucauguguaccgggaguuuuaagcuggagaaggagguggccgagacgcagcauggcaccgugcugguccaaguuaaguacgagggcaccgacgccccguguaagauccccuucuccacccaggaugagaaaggugucacucagaauggccgccucaucaccgccaacccuaucgucacugacaaggagaagccggugaacauagagaccgagccaccuuucggggagagcuacaucguggucggcgcgggcgagaaagcccugaagcuauccugguucaaaaagggcagcuccaucggcaagauguucgaggcgacggccaggggggcccggcgcauggccauccucggggacaccgcgugggacuucgggagcaucggcgggguguucaccuccguggggaaacucguccaccagguauucggcaccgccuacggcgugcucuucagcggcgucucauggacgaugaagaucgggaucgggauuuugcugaccuggcugggccucaacagccgauccaccagccuuuccaugaccugcaucgccguggguauggugacccuguacuuaggcgucauggugcaggcagacucagguugugugaucaacuggaagggacgggagcugaagugcgggucaggaauauucguaacgaacgaggugcacacguggaccgaacaguacaaauuccaagccgacagcccgaagcgcuuaagcgcggccaucggcaaagccugggaagagggcgucugcggaaucagguccgcaacccgccucgaaaacaucauguggaagcagauuagcaaugagcugaaucacauccugcucgagaacgacaugaaguuuacggucgugguuggagacgccaacgggaucuuaguacaaggcaagaaaaugauuagaccccagcccauggagcacaaauacuccuggaagagcugggggaaggcgaagaucaucggagcugacauccagaacaccacuuucaucaucgacggaccugacaccccugagugccccgacgaccagagagccuggaacaucugggagguagaagauuacgguuucgggaucuuuacgacaaauaucuggcugaagcucagagacucuuacacccagaugugcgaccaccgucugaugagcgccgccauaaaggauucuaaggccgugcaugccgacaugggcuacuggaucgagagcgagaagaacgagaccuggaagcugucucgugccagcuucauagaagucaagacgugcaccuggccaaagucccacacccucuggagcaacggggugcuggagucagagaugaucauccccaagauuuacgggggcccgauuagucagcauaacuaucgccccggguauuucacccagacggccggccccuggcaucugggaaagcuagaguuggacuucgaccugugcgaaggcaccaccguggucguggacgagcacugcggcaaccggggcccgucccuccgcaccacgaccgucaccggaaagauaauccacgaguggugcugccgcucaugcacccugccuccccugcgcuuuaggggcgaggauggcuguugguacgggauggagauccgcccugucaaggagaaggaagaaaacuugguccgguccauggugagcgcaggcagcggcgaggucgacuccuucucccuggggauccugugcguauccauuaugaucgaggagguaaugcggagcagaugguccagaaagauguugaugacgggcacccuggccguguuucuucuucugaucaugggccagcugacuuggaacgaccucauccgccuguguaucauggugggagcuaaugccucggaccgcauggggaugggcaccacguaccuggcccuuauggcgaccuucaagaugcgccccauguuugcgguggggcugcuguuccggcgccucaccagccgggagguccugcuguugaccaucggacugagccuggucgccuccgucgagcuccccaacucacucgaggagcucggcgacggucucgccaugggcaucaugaugcugaagcuucucacggaguuccagccucaucaguuauggaccacauuacucagucugacguucaucaagacgacuuugagccuagauuacgccuggaaaaccaccgcgauggcgcuguccaucguuucccuguucccccucugucuauccaccaccucccagaaaacgaccuggcuuccaguccuacucggcuccuucgggugcaagccccugacgauguuccucaucaccgaaaacaagaucuggggucgcaagagcuggccccugaaugagggaauaauggccaucggcaucgucuccauacugcucucuagccugcugaagaacgauguuccucucgccgggccguugaucgcgggaggcaugcugaucgccugcuacgugauauccgggagcuccgcugaccucaguuuggagaaggccgccgaggucucaugggagcaggaggcggaacacaguggaaccucccauaacauccuaguggaggugcaagacgacggaacgaugaagaucaaggacgaggaaaaggacgauacccuaacaauccugcugaaggcaacccuucucgccgucagcggcguguacccgaugucuauccccgccacccuguuugugugguacuucuggcagaagaagaaacagcggagugggguccucugggacacccccucaccgcccgagguagagcgcgcuguacuggacgacgguauauaucggauccuccaacgcggccugcucgggcggagccaggucggcguggguguauuccaggacggcgucuuccauaccauguggcacgugacacgaggggcagugcuaauguaccaaggcaagcggcucgagcccaguugggccucugucaagaaggaucucauuucguacggcgguggcuggcgauuccagggguccuggaacacaggcgaagagguccaggugaucgccguugagccagggaagaacccgaagaacgugcagaccacgcccggcaccuucaaaacgcccgaaggugaagugggggccaucgcucuggacuucaagcccggcacauccggcagccccaucgucaacagggagggcaagaucguaggccuuuacgggaacggcguggucacuaccuccgggaccuacgugucagcuaucgcccaggccaaggccucucaggagggccccuuacccgagaucgaggacgaggucuuuaaaaagcguaaccugaccaucauggaccuccauccagggucaggaaagacgcggcgcuaccucccagccauuguccgugaagcgaucaagcguaaauugcggacccugauccucgcccccacccgagugguugcaagcgagauggccgaggcacugaagggcaugcccaucagauaccagaccacggcggucaaguccgagcauaccgggcgggaaaucguagaccugaugugccacgccacuuucaccaugcgacuccugaguccggugcgggucccuaacuacaacaugauuaucauggacgaggcccacuucacugauccugccuccaucgcggcccgcggguacaucagcaccagaguugggaugggcgaggcugcggccaucuucaugacggcgacgccgccuggguccguggaagcguucccccagagcaacgcagucauccaggacgaggagcgcgacaucccggagcgcagcuggaauagcggcuacgacuggaucacggacuucccaggcaagaccgugugguuugugccuuccaucaagagcgggaacgauaucgcuaacugccuacgcaagaacggaaagcgggucauccagcucucccggaagaccuucgauaccgaguaccaaaagacaaagaacaacgacugggauuacguggugacgacagauaucucugagaugggagcaaacuuccgcgcggaccgcgucaucgacccgcggcgcugcuugaagcccgugauucuuaaagacggccccgaacgggugauccucgccggaccgaugcccgucaccguugccuccgccgcgcagcgcagaggccgcaucggccggaaccagaauaaagagggggaccaguaugucuauauggggcagccccugaauaacgaugaggaucacgcccacuggacggaggccaagaugcuucucgacaacaucaacaccccagaggggaucaucccggcccuguuugagcccgaacgggagaaauccgcugcgauagauggcgaguacagacugcgaggggaggcucggaaaaccuucguggaacucaugagaagaggcgaccuacccgucuggcuguccuacaagguggcgucugagggcuuucaguacuccgaccggagaugguguuucgacggggaacggaauaaucaggugcucgaagagaacauggacguugagauauggacgaaggagggggagcguaagaagcugcggccucgauggcuggacgcccggacauauagcgacccgcuagcccugcgugaguucaaggaguucgcggccgggcggcgcagcgucuccggugaccuuauuuuggaaaucggcaaacucccccaacaccugacgcuccgagcgcaaaaugcccuggacaaccuggugaugcugcauaacagcgaacagggcggcaaggccuacagacacgcgauggaggagcugcccgacaccaucgagacccuuaugcucuuagcccugaucgccgugcugacagggggcgucacgcuauucuuucugucaggaaagggucucggcaagaccagcauagggcuccuguguguuauggcuucuagcgcgcuccuguggauggcuucugucgagccccauuggauagccgcaucuaucauccucgaguucuucuugaugguccuccugaucccggaaccggacagacaacgcacgccccaggacaaccaacucgcauauguggugaucggccugcucuuuaugauccucaccguagcagccaacgagauggggcuguuagaaacgaccaaaaaggaucucggcauaggucacguugccgccgaaaaccaccagcacgccaccaugcucgacguggaccugcgcccggcguccgccuggacccucuaugcgguagcgacgaccgugauuacccccaugaugagacauaccaucgaaaacacgaccgcgaacaucagccugaccgcgaucgccaaccaggccgcuauccugauggggcucgacaagggcuggccuaucuccaagauggauaucggggugccccuguuagcccuuggcugcuacagccaggucaacccacuaacgcugacggcggccgugcucaugcuaguggcucacuacgccauuaucggcccgggccugcaggcgaaggcaacccgggaagcccagaagcgcaccgcagcugggauaaugaaaaaccccacaguggacggcauuguagcgauugaccucgacccaguggucuaugaugcaaaguucgagaaacaacugggucagaucaugcugcugauccucugcacgucccagauccuucuaaugcgcacgacuugggcccugugugagagcauuacccuggcaacgggaccacucacuacccuaugggagggcucuccgggcaaguucuggaacaccacgaucgccguguccauggcgaacaucuuccgaggcuccuaucuggcaggggccgggcucgcguucagccugaugaaaucccugggcggggggcgccggggaaccggggcccagggcgaaacccuaggggagaaguggaaaagacagcuuaaucagcuuagcaagagcgaguuuaacaccuacaagcggucugguaucauggagguugaccgcucagaagcgaaagagggucucaagcggggcgagacgacaaagcacgcgguuucgcgcgggaccgccaagcugcgcugguucguggagcgcaaccuggugaagcccgagggcaaagucauagaccugggcuguggacggggcggguggagcuacuacugcgcgggccugaagaagguaaccgaggugaagggguacaccaagggcggcccagggcacgaggagccgaucccgauggcaaccuacggcuggaaucuggucaagcugcacucagggaaggacgucuucuucaugccccccgagaagugcgacaccuuacuuugcgacaucggugagucuuccccuaacccaaccaucgaggagggccgcacccuucgcguguuaaagaugguggaacccuggcugcgcggcaaccaguuuugcaucaagauccugaauccauacaugccuagcgugguggagacacucgagcagaugcagcggaagcacggcgggaugcucgugagaaacccccugucgcggaacagcacccacgaaauguacuggguguccugcggcacggggaauauagugucagccgucaacaugaccucccgcaugcuccugaaucgcuucacgauggcacaccgcaagcccaccuacgagcgcgacguagaccugggagccggcacucggcacguggccguagagcccgaggucccgaaccucgacaucaucgggcagaggauugagaacaucaagaacgagcauaagucgacauggcacuaugaugaggacaaccccuacaagacgugggccuaccacggcuccuacgagguaaaacccagcggauccgcuagcuccauggucaacgguguuguaagguuguuaacgaagccgugggacgugauaccgauggugacccagaucgccaugaccgacacgacccccuucgggcaacagcgcgucuuuaaggagaagguggacacccggacaccgcgggccaagcguggcacgacacaaauuauggagguuaccgccaaaugguuauggggcuuccugucccgaaacaaaaagccgcggauuugcacccgcgaggaguucacacggaaggugcgcagcaacgcggccaucggggcaguauucguggacgaaaaccaguggaacuccgccaaggaggccgucgaggacgagcgguuuugggaccuggugcacagagagcgggagcuccacaaacagggaaagugugcuaccugcguauacaacaugauggggaagagggaaaagaaacugggcgaauucggaaaggccaaaggcagccgcgcaauuugguacauguggcugggcgcacgcuuccucgaguucgaggcucuggguuucaugaacgaggaccacugguucucgcgggagaacagccuguccggcguggagggggagggccuacauaagcuaggguacauacuccgcgacaucagcaagauccccgguggcaacauguaugccgacgacacugccgggugggacacccgaauuacggaggacgauuugcaaaacgaagcgaaaaucaccgacauaauggagcccggccaugcacugcuggcgaccuccauauucaaguuaacguaccagaauaaggugguacgaguucagcgcccugccaagaacgggacggugauggaugugaucagccggcgugaccagcggggcuccggccaggucgggaccuacggccugaacaccuucacgaauauggaggugcaguugauccgccagauggagucagaggggaucuuccucccguccgagcuggaaaccccuaaccuggccgagcggguccucgacuggcuggaaaagcacggcgcugagcgccugaagcguauggccauaucgggugacgacugugucgugaagcccauugacgaccgcuuugcgaccgcccuuacagcuuugaacgacaugggcaagguucggaaggauaucccccagugggagccguccaagggguggaacgacuggcagcagguuccguuuugcagccaccacuuccaucagcugaucaugaaggacgggcgcgagaucguagugccaugucggaaccaggacgagcucgucggccgcgcccgggugucccagggcgcuggcuggagccugcgggagaccgcgugucuggggaaauccuacgcgcagauguggcaguugauguacuuccaccguagggaucugcggcuggccgcgaaugccaucuguucggcggugcccguugacuggguaccuaccagccgcacgaccugguccauccacgcacaccaccaguggaugaccaccgaagacaugcuaagcguauggaaccgcgucuggaucgaggagaaucccuggauggaggacaagacgcauguuuccucaugggaggagguucccuaucugggcaagcgcgaggaccaguggugcggcucacugauugggcucacagcccgcgccaccugggcgacuaacauacaagucgccauuaaccaggugcgacgccugaucggcaaugaaaauuaucuggacuauaugacguccaugaagagguuuaagaacgaguccgaccccgaaggggcccucugguag

SEQ ID NO: 24078 - RNA, 9879 nt, Artificial Sequence
  derived and/or modified CDS sequence (opt11) from DENV-1__GU131837__SS-prME
agcgugaccaugcuacuaaugcugcuaccaaccgcacucgcuuuucaucucaccacccgcggcggggaaccccacaugaucgugagcaagcaggaacggggcaagagccuguuguucaaaaccuccgcgggggugaacaugugcacccugaucgccauggaccugggggagcucugcgaggacacaaugaccuauaaguguccccgcauaaccgaggccgagcccgacgacguggacuguuggugcaacgcuaccgacaccugggucaccuauggaaccugcagccagacuggcgagcaccgccgcgacaagcgcuccguggcccuggcgccccacgugggcuugggucuugagacgcgcaccgaaaccuggaugaguagugagggcgcauggaaacagauccagcggguggaaacuugggcccugcgccaccccggcuucacggugaucgccuuauuccucgcgcacgccaucgggacgagcauaacccagaagggaauaaucuucauccugcugaugcuugugacccccuccauggccaugcggugcgucggcauagggaaccgagauuuugucgagggucugagcggggccacgugggucgacgugguacuagagcacggguccugcgugacgaccauggccaagaacaagcccacccuggacauagaauuacugaagacggaggucacuaaccccgcagucuugcggaagcuaugcauagaggcaaagauuagcaauacaaccaccgauucccggugcccgacccagggcgaggccacccugguggaggagcaggacgccaacuucgucugccggcguaccuucguggaccggggaugggggaacggcugcggccuguucggcaaggggagccugcugaccugugccaaauucaagugcgugaccaagcucgagggcaagauaguccaguacgagaaccugaaguacuccgucaucgugaccguccacacuggggaccagcaccagguagggaacgagaccaccgagcacgguaccaucgcgaccaucacuccccaggcccccacgagcgagauccagcugaccgauuacggggcccucacccuggacuguucgccccgcaccggccuggacuucaacgagaugguccuccugacgaugaaggaaaagucguggcuggugcacaagcaaugguuccucgaccugccgcugcccuggaccucaggggccagcaccagccaggagacuuggaaccggcaggaccuccuggugacguuuaagaccgcccacgccaagaaacaggagguaguggugcugggcucccaggagggcgccaugcacaccgcccuuaccggagccacggaaauccagaccagcggcacaaccaccaucuucgccgggcaccugaagugccgcuuaaagauggacaaguuaacccugaagggcauguccuacgucaugugcaccgggagcuucaagcuggagaaggagguggcggagacccagcacggcacggugcugguccaggugaaguacgagggcaccgacgcccccugcaagauccccuucucuacccaggaugaaaaggguguuacccagaacggccggcugaucacagccaacccgauuguuaccgauaaggagaagcccgugaacaucgagaccgagccgcccuucggggaaucuuauaucguggucggggccggcgagaaagcgcugaaauuaaguugguucaagaagggaagcucgaucggcaagauguucgaggcuaccgccagaggggcccggcguauggcaauccucggcgacacggcgugggauuucggcagcauaggcggcguguucaccaguguugggaaauuaguccaccaaguguucgggacggccuacggggugcuguuuagcggagucuccuggaccaugaagaucgggauagggauccuccucacguggcuggggcucaauucccgcagcacuucacugucgaugaccugcaucgccguggggauggugacccuguaccucggcgucaugguccaggcagauagcgggugcgugaucaacuggaaaggacgggagcugaagugcggguccggcaucuucgucacaaacgaagugcacaccuggaccgagcaguacaaauuucaggcggauagcccaaagagacugagcgcggcaaucgggaaagccugggaggaaggggugugcgggauccgguccgcaacccgccucgagaacaucauguggaaacagaucagcaacgagcuuaaccacauccugcucgaaaacgacaugaaguucaccgucguugugggggacgccaacggcaucuuagcgcaggguaagaaaaugauccggccccagcccauggagcacaaguacuccuggaaguccugggggaaagccaaaaucaucggcgccgacauccaaaacacgaccuucaucauugacgggcccgacaccccggaaugcccagauggccagcgcgcauggaauauuugggaggucgaggacuacggguucggcaucuucaccacuaacauauggcugaaacuucgggauucguacacccagaugugcgaccaccgccucaugucagcggcaaucaaagacuccaaagccgugcacgccgauauggguuauuggaucgagagcgaaaagaacgagaccuggaaguuggcacgggcguccuucaucgaggugaagaccugcacguggccuaagagccauacccucugguccaacggagucuuagaauccgagaugaucaucccgaaaauauauggcgggcccauaucccagcacaacuaccggcccggcuacuucacccagaccgccgggcccuggcaccugggaaagcucgaacuggacuuugacuugugcgaaggcacgaccguaguaguugacgagcauugcgggaaccgcggacccagccuccguacgaccacgguaacggggaagaucauccacgaguggugcugccgguccugcacacuaccgccgcugcgguuccggggcgaggacgggugcugguacggcauggagauucgacccgucaaggaaaaggaggagaacuuagucaggucgaugguguccgccggcagcggcgagguggacagcuuuagucuggguauccugugugucagcaucaugaucgaagaggugaugcgcuccagauggagccgcaaaaugcuaaugaccgggacccuggccguguuccugcuccugaucaugggccagcugaccuggaaugaccucauccgcuuaugcaucauggucggugccaacgcguccgaccgcaugggcauggguaccaccuaccuggcccucauggccacguucaagaugcgcccgauguucgccgugggguugcuguucaggcgacucacguccagagaaguccugcugcucaccauagggcugucccucgucgccagcguggaacuccccaacucacuggaggagcugggagacggccucgcgaugggcaucaugaugcugaaacugcugaccgaguuccagccccaccagcuguggacgacccuauuaagccugacguuugucaagaccacgcugagucuugacuacgcuuggaagaccacagccauggugcugagcaucgugucgcuguuuccccucugccugagcacaacgucccagaagaccaccuggcugccggugcuacuagggucauucggauguaagccccuaaccauguucuugaucacugagaacaagaucugggggcgcaaguccuggccacugaacgaggguaucauggccauugggauagugucuauccugcucuccagccuacuuaagaaugacgucccccuugcggggccguugaucgccggcgggaugcugaucgccuguuacgucauaagcggcuccagcgccgaccucucccuggaaaaagccgcggaggugucaugggagcaggaggccgaacauuccggggccagccacaauauccuuguggagguucaggacgacggcacuaugaagaucaaggaugaggagcgugaugacacacucaccauucugcucaaagccacgcuccucgccgucuccgggguguaucccaugagcauucccgcaacucucuucgucugguacuucuggcaaaagaagaagcagcgcuccggcguacuaugggauacccccagcccaccggaggucgagcgggccguccuggacgacggcauuuaucgcaucuugcagcgggggcugcucggccgcucccagguaggcgugggaguguuccaggacggugucuuccacaccauguggcaugugacccguggcgccguacugauguaccagggcaagagauuggagccgagcugggccuccgugaaaaaggacuugauaagcuauggggguggauggcgguuccagggguccuggaacacgggagaggaggugcaggucaucgccguugagcccggcaagaacccgaagaacgugcaaaccaccccaggaacauucaagacccccgagggcgaggucggugcgauugcccuggacuucaagccagggaccagcgguuccccaaucgugaaccgcgagggcaagauagugggguuguacggcaacggcgucgugacaaccagcggcacguacguguccgcaaucgcccaggccaaggcuagccaggaggggccucuccccgagaucgaagaugaggucuucaagaagcggaaucugaccaucauggaccugcacccuggcagcggcaagacacgcagauaccuccccgccaucgugcgcgaagccaucaagcggaaacuccgcacuuuaauacucgccccgacgaggguggucgcguccgagauggccgaggcccuuaagggaaugcccauucguuaccagaccaccgcggucaagagcgagcacaccggccgcgagaucguggaccugaugugccaugcgacguucaccaugcggcuccucuccccugucagggugcccaauuauaacaugauuaucauggaugaggcgcacuucaccgacccggccucaaucgccgcacgaggcuacaucagcacccgcgugggcaugggugaggccgcggccauauucaugacugccaccccgccaggcagcgucgaggccuucccgcaguccaacgccguuauccaggaugaggagcgggacauacccgagcgcagcuggaacuccggcuacgauuggaucaccgacuucccagggaagaccgugugguucguccccagcauuaaguccgguaaugacaucgcgaacugccugcggaagaauggcaagagagugauacagcugagccggaagacauucgacaccgaguaccagaagaccaagaacaacgacugggacuacguggucacgacagacaucuccgagaugggcgccaacuuccgcgccgaccgggugauugacccgcggcggugccugaagccggugauccugaaagaugggcccgagcgggucauacucgcaggccccaugccugugaccgucgcgagcgccgcccagcggagaggccgaaucgggcguaaucagaacaaggagggcgaccaguacguauacauggggcagcccuugaauaacgacgaagaucacgcccauuggaccgaggcuaaaaugcugcucgacaacauaaacacaccggaagguaucaucccggcucuuuuugagcccgagcgugaaaagagcgccgccaucgacggggaguaccgccuuaggggcgaggcacggaaaacguucguagagcucaugcgccguggcgaccugcccgucuggcugagcuauaagguggccagcgagggguuccaguacagcgaucgccguugguguuucgacggcgagcgcaacaaccaggugcucgaggagaauauggacguagagaucuggaccaaagagggggagcggaaaaagcugcgcccccgguggcuggaugcgcggaccuacuccgacccguuagcucuccgggaguucaaggaguucgcggcgggccgccggucugugagcggcgaccugauucucgagauagggaagcugccccaacaccucacgcucagggcccagaaugcgcuagacaaccuggugaugcuccacaacagcgagcaaggcgggaaagccuaccggcacgccauggaggagcugcccgacaccaucgaaacccuuaugcuccuggcccuaauagcuguccucacggguggggugaccuuauucuuccugagcgggaaggggcucgggaagaccuccaucggccugcugugcgugacggccagcucggcccuccuguggauggccagcgucgagccacacuggaucgcggccuccaucauccuugaguucuuucucauggugcugcugaucccagagccugaccgccagcggaccccacaggacaaccaguuagccuacgugguuaucgggcugcuguucaugauccucacaguggcagccaacgagaugggccugcuggagaccacuaagaaggaccucggaaucggcuacguggccgcggagaaccaccagcacgccaccaugcuggacgucgaccugcgcccggcaagcgccuggacguuauaugccgucgcgaccacugugaucacgcccaugaugcggcacacuaucgagaacacgaccgccaauaucucacugacagccaucgccaaucaggccgcuauccugaugggccucgacaagggguggcccaucagcaaaauggacauaggcgucccccugcuggcccucgguuguuauagccaggugaacccccugacguuaaccgccgccgugcugaugcugguugcgcacuacgcgaucaucggcccagggcugcaggccaaggcuacccgggaggcccagaagcgcaccgcggccggcaucaugaaaaaccccaccguagacggcaucguagccaucgaccucgacccugucgucuaugacgccaaguucgagaagcagcuggggcagaucaugcugcucauucugugcaccagucagauucugcucaugcgaacgaccugggcucuaugcgaauccauuacucuagcaaccggccccuuaacgacccugugggaggggagccccgguaaguucuggaacaccacaauugccguguccauggccaacaucuuccgcggcagcuaccuggccggggccggccucgcguuuagccugaugaagucccucgggggcggucgccgcggaacgggcgcccagggugaaaccuugggcgagaaguggaagcggcagcugaaccaauugucuaagucagaguucaauaccuacaaacgaagcgggaucauggaggucgaucgguccgaagcaaaggagggccucaaacgcggggagacuaccaagcacgccgugagccggggcacugcgaagcugaggugguucguggaaagaaaccugguaaaacccgagggcaaggucaucgaccugggguguggcagagggggcugguccuacuacugcgcuggacucaagaaggugaccgaggugaagggcuacaccaagggagggccaggccacgaggaaccuaucccgauggccacuuauggauggaaccuggugaagcugcacaguggcaaggacguguucuucaugccgcccgagaaaugcgacacgcuccugugcgacauaggggaauccagccccaaccccacuaucgaggagggccggacccugagaguucucaagaugguugaacccuggcugcggggcaaucaguucuguauuaagaucuugaaccccuacaugccgaguguggucgagacccucgagcagaugcagcgcaagcacggggguaugcuggugcggaauccgcuguccaggaacuccacgcaugagauguauugggugucuugcgggaccggcaacaucgucuccgccgucaacaugacaagccggaugcuccugaaccgguucaccauggcccaccgcaagccuacguacgagcgggauguggaccugggcgcagggacccgacacgucgcaguggagccugaggaagcaaaucucgacauaaucggccagcgaaucgagaacaucaagaacgagcacaaguccaccuggcauuacgacgaagacaacccguacaagaccugggccuaucaugggagcuacgagguaaagccuuccggcuccgcauccagcaugguuaauggggucgucaggcuacuaacaaagcccugggacguuauccccauggugacccagaucgcgaugaccgacacuacgccuuucggccagcagcgcgucuuuaaggagaagguggauacucgcacgccccgggcgaaacgcggcacaacccagauuauggaggugaccgccaaguggcuaugggguuuccugucacggaacaagaagccccgcaucugcacccgggaggaguucaccagaaagguccggagcaacgcggccaucggagcagucuucguggaugaaaaccaguggaacagcgccaaggaggcugucgaggaugagcgguucugggaccucgugcaccgggagcgcgagcuccacaagcaggggaaaugcgccacaugcguguauaauaugaugggcaagcgggagaagaagcugggugaguucgggaaagcgaagggcucgcgagcgaucugguacauguggcucggggcacgguuucucgaguucgaagcucucgguuucaugaacgaggaccauugguuuagccgagagaacuccuuaagcgggguggagggcgagggacuccauaagcuaggcuauauccugcgggacauuuccaagauuccgggcgggaacauguacgccgacgacaccgccggcugggacacccgcaucacggaggacgaccuccagaacgaggcaaagaucacggacauuauggagcccgagcacgcccugcuggcuaccuccauauuuaagcucacuuaccagaacaaaguagugcgcguccagcggccugccaaaaaugggaccgucauggacgugaucucccgccgggaccagcgcggaagcggacagguuggaacuuacgggcugaacaccuuuaccaauauggagguacaguugauucggcagauggagucggaagguauuuuccuccccucugaauuagagacuccuaaccuggcugagcgcguucucgauuggcuagagaagcacgggacugaacgacugaaaagaauggcuaucuccggggacgauugcgucgugaagcccaucgaugacagguucgccaccgcccugacagcgcugaacgacaugggcaaggugcgcaaagacaucccccagugggagccgucuaaggguuggaacgacuggcagcaggucccguucugcucccaucacuuccaccagcucaucaugaaggacgggcgggagaucguggugcccugcagaaaccaggacgagcucgugggccgggcgcgcguaagccagggugccggcuggucccuucgggagaccgcgugccugggcaagucuuacgcccagauguggcagcucauguauuuccacagacgggaccugcgccuggccgcgaacgccaucugcuccgccgugcccgucgacugggugcccaccagucggacgaccuggagcauccacgcccaccaccaguggaugaccacugaggacaugcucuccguguggaacagagucuggaucgaggagaacccuuggauggaggacaagacgcacgugagcagcugggaggaggugcccuaccugggcaaacgcgaggaccaauggugcggcagccugauagggcucaccgcucgggccaccugggccaccaacauccaggucgcgauuaaccaggugagacggcucauaggcaacgaaaauuaccuggacuauaugacgucuaugaagcgcuuuaagaacgagagcgacccugagggggcccucugguga

SEQ ID NO: 24079 - RNA, 9879 nt, Artificial Sequence
  derived and/or modified CDS sequence (opt11) from DENV-1__JN819415__SS-prME
agcguuaccauguugcucaugcuacugcccaccgcccuagccuuucaccugacgacaagaggcggggagccacacaugaucgugagcaagcaagagagaggcaagaguuugcuguucaagaccucugccgggguuaacaugugcacccugaucgccauggaucugggcgaacucugcgaggacacgaugaccuacaagugcccccgcaucaccgaagccgaacccgacgacguggacugcuggugcaacgccacggacacgugggugacauacgggaccugcagccagaccggcgagcaucggcgcgauaaacggucuguggcacuggcgccccauguaggucuggggcucgaaacgcgcaccgagaccuggaugagcuccgagggcgcauggaagcagauccaacgggucgagacuugggcccugcgccaccccggguucacggugaccgcacuguuccucgcgcacgccaucggcaccagcauuacccagaaggggauuaucuucauccugcugaugcucgugacgcccuccauggcuaugaggugcguuggaaucggcaaucgagacuucguugaggggcugagcggcgccaccuggguggauguugugcuggaacauggguccugcgucaccaccauggcuaagaacaagcccacgcucgacaucgagcugcugaagaccgaaguuaccaaucccgcuguccuccggaaguuaugcaucgaggccaagaucagcaacaccacgaccgacucccgcugucccacccagggggaggccacccugguagaggagcaagacgcgaacuucgucugccggcgaaccuucguggaccggggcugggggaacggcugcggccucuuuggcaaggggucgcugcugaccugcgccaaguucaaaugcgugaccaagcucgaggguaagauaguccaguacgagaaccucaaguacuccgugaucgucaccguccacacgggcgaccagcaucagguggguaacgagaccaccgagcacggcaccaucgcgaccaucacgccccaggccccgacuucagaaauccagcugaccgauuacggggcacucacccuggacugcagcccccggacgggccuggauuuuaacgagaugguccuucugaccaugaaagagaaauccuggcuggugcacaaacagugguuccuagaccugccgcugcccuggaccuccggcgccagcaccagccaggagacguggaaccggcaggaccugcuggugaccuuuaagaccgcccacgcgaaaaagcaggaggucguagugcugggcucccaggagggcgccaugcacaccgcccucacgggggccaccgagauccagaccucaggcaccacgaccaucuucgccgggcaccugaagugccgccugaagauggacaagcucacucuuaaaggcaccuccuacgucaugugcacggggagcuucaagcuggagaaggagguggcggagacucagcacggcaccgugcugguccaggugaaguacgagggcacagacgcccccugcaagauccccuucucgacgcaggaugagaagggggugacucaaaacggacggcucaucaccgcgaacccgauagucacagacaaagagaaacccguuaacaucgagacggaaccgcccuucggggagagcuacaucgucgucggcgccggggagaaagcacugaagcuguccugguucaaaaaggggagcucgaucgggaagauguucgaggccaccgcccgaggggcccgacgcauggccauccucggcgacaccgcaugggacuucgggagcaucggcggcguguucaccuccguggggaaacugguucaccagguguucggcacggccuacgggguucuguucagcggcgucuccuggacaaugaagaucggaaucggcauccuccugaccuggcugggucucaacagucgcucuacuagccugaguaugacguguaucgccguggggauggugacccuauaccucggcgucauggugcaggccgauagcgguugcgugaucaacuggaagggccgggaacugaagugcggguccggcaucuucgucacaaacgagguacacaccuggaccgagcaauacaaguuccaggcugacagcccgaagcgccugagcgcggccaucggcaaggcuugggaggagggagugugcgggaucagauccgccacgcgccucgagaacaucauguggaagcagauuagcaacgagcugaaccacaucuugcucgagaacgacaugaaguucaccguuguggugggcgacgccaacgggaucuuagcgcaggggaagaagaugauccggccccagcccauggagcacaaauacucauggaaguccuggggcaaggcaaagaucaucggcgcugacauccagaacaccacauuuauaauugacgggcccgacacgccggagugccccgaugaccagcgcgccuggaacaucugggaggucgaggacuacggguucgguaucuucaccacaaacaucugguugaagcuccgagacucuuacacccagaugugcgaccaccguuugauguccgcagccaucaaggacuccaaggccgugcaugcggacaugggcuacuggauagagagcgaaaaaaacgagacuuggaagcuggcccgggccucguucaucgaggugaagaccugcaccuggcccaagagccacacccucugguccaacggcguacuggagucggagaugaucauccccaagaucuacgggggccccaucucccaacacaacuaccgccccggguacuucacacagaccgcuggccccuggcaccuggggaagcucgagcuggacuucaaccugugcgagggcaccacuguaguggucgacgagcacugcggcaaucgagguccgagccugaggacgaccacagugacggguaagaucauccaugagugguguugucgguccugcacccuaccgccccugcgcuuccgcggggaggacggcugcugguacggaauggagauacgccccguuaaagaaaaggaagagaaucucguccguucaaugguuuccgccggcagcggcgagguggacagcuucucccuggggauucuuugcgucagcaucaugaucgaggaggugaugcgcagccgguggagccgcaagaugcucaugaccgguacccuggccgucuuccugcucuuaaucauggggcaacugacguggaacgaccucauccgccugugcaucaugguuggcgccaacgcguccgaccggauggggaugggcacgaccuaccuggcccucauggcgacauucaagaugcgcccuauguucgcggugggcuugcucuuccggcgcuuaaccucaagagaggugcugcugcucacgauugggcugucccuggucgccucuguggagcuccccaauucacuggaggagcugggcgacgggcuugcgaugggcaucaugaugcucaagcugcucaccgaauuccagccgcaccaacucuggacaacccugcucucccugacauucaucaagaccacccuaucccucgacuacgccuggaagacaacggccauggcuuugagcaucguuucccuauuccccuugugccugagcaccaccucccagaagaccacauggcugccggugcucuuggggagcuucgggugcaagccgcucacgauguuccucaucaccgagaacaagaucuggggccgcaaguccuggccccugaaugagggaaucauggcgaucggcaucguuagcauucugcucuccagccugcugaagaacgacgucccccucgcggggccccugauagccggcggcaugcuuaucgccugcuaugugauaaguggguccagcgccgaccucucucuggagaaagcggccgaggugagcugggagcaggaggccgagcacuccggaaccagccacaacaucuuggucgaagugcaggacgacggcacaaugaagaucaaggaugaggagaaagacgacacgcucaccauacuguuaaaggccacucuccuagccguguccggcgucuaccccauguccauccccgcgacucuguucgugugguacuucuggcagaagaagaagcagcgguccggggugcucugggacacgcccagcccgccagaagucgagcgcgccgugcuggacgacggcaucuaccggauccugcagcgcggccuccuugggcggucucaggugggcgucgguguguuccaggaugguguguuccacacuauguggcacgugacccgcggggccgugcucauguaccaagggaagcggcuggagcccuccugggcgucugugaagaaggauuugaucaguuacggcgggggcuggcgcuuccagggcuccuggaacaccggcgaggagguccaggugauagccguggagcccgggaagaacccuaagaacguccagacgacccccggcaccuucaagacgcccgagggcgaggugggggcgaucgcccuugacuucaagccaggcacaagcgggucgccgaucgugaaucgggaggguaagaucgucggucuguaugggaacggcguggugaccaccagcggcaccuacgucuccgccaucgcccaagccaaggcgucgcaggaaggcccccuucccgagauagaggacgagguguucaagaagcgcaaucuuacaaucauggaucugcaccccgggagcggaaagacccgccgcuaccuucccgccaucgugcgggaggcaaucaagcgcaagcugcggaccuuaauauuggccccgacccgcgucguggcauccgagauggccgaggcccugaaggguaugccgauccgauaccagacgaccgcagucaagagcgagcacaccgggcgggagaucgucgaccugaugugccacgcuacguucacgaugcgccuccugucaccagugcgggugccaaacuacaacaugaucauaauggaugaggcacacuucaccgaccccgccaguaucgccgcucgcggcuacaucuccacccgggucgggaugggcgaggcugcggccaucuucaugaccgcaacgccgcccgggagcguggaggccuucccucaguccaaugccgugauacaggacgaggaacgcgacaucccugagcggagcuggaacucuggcuaugacuggaucacugacuucccgggcaagaccgucugguucguuccgagcaucaaguccgggaacgacaucgcgaacugcuugcgcaagaacggcaagcggguaauccagcucagccgcaagaccuuugacacggaguaccagaagacuaagaacaacgacugggacuacguggugaccacagauaucuccgagaugggggccaacuuccgagcggaucgcguuaucgacccucggcgcugccugaagcccgucauccugaaggacggccccgaacgggugauuuuagccgguccgaugcccgugacggucgcgagcgcggcccagcgacggggccgcaucggccggaaccaaaacaaggagggggaccaguacguguacaugggccaaccccugaauaacgacgaggaccacgcucauuggacggaggccaagaugcugcucgacaacaucaauacacccgaggggaucaucccggcgcuguucgagcccgagcgcgagaaaagugccgccauagacggagaguaccgccugcgcggggaggcccgcaagaccuuugucgagcucaugcggcgcggcgaccuacccguguggcugagcuacaaggucgccucugagggcuuccaguacuccgaccggcgauggugcuucgauggggagcggaacaaccaggugcucgaggagaacauggacguggaaaucuggacgaaggagggcgagaggaaaaagcugcggccccgcuggcuggacgcgcggacguacuccgauccacuugcucugagagaguucaaggaguucgcagcagggcggcgaagcguuagcggcgaccugauacucgagaucggcaaacucccccagcaccuaacccuccgggcccagaacgcguuagacaaccuggucaugcuccacaacucagagcagggcgggaaggccuaucgccaugccauggaggagcugcccgacaccaucgagaccuugaugcuucuggcccugaucgcgguacucaccggcggggugacccuauucuuccugagcgggaaggggcucggcaagaccuccaucgggcugcugugugugacagccagcagugcccuccuguggauggccagcguggagccccauuggaucgccgcgucuaucauucuggaguuuuuccucauggugcugcugaucccggagcccgaccggcagcgcacgccccaggacaaccagcucgccuacgucgugaucggccugcuauucaugauccucacaguugccgccaacgagaugggacugcuagagaccaccaagcgggaccucggcaucgggcacgucgccgcugaaaaccaccagcacgccacuaugcuggauguagaccugcgcccugccagcgccuggacauuauacgccguggcgaccaccgugaucacgcccaugaugcgucacaccaucgagaacacaacagcuaacaucucccuaacggccaucgccaaccaagcugcuauccugaugggccucgacaagggcuggccaaucagcaagauggauauuggggugccgcuacuggcccucggcugcuacucccaggucaacccgcugaccuugaccgccgccguccucaugcugguggcgcacuacgccaucaucggacccggguugcaggccaaggcuacccgcgaagcgcagaagcgaacggccgccgggaucaugaagaaccccacuguggacgggaucguggcaauugaucucgaccccgugguuuacgacgccaaguucgagaagcaacugggccagaucaugcugcucauccucugcaccagucagauacugcuuaugcgcaccacuugggcccugugcgagagcaucaccuuggcaaccgggccgcucaccacgcugugggagggcucgccggguaaguucuggaacaccacuaucgcgguuuccauggccaacauauuccggggcagcuaucuggccggcgccgggcucgcguucucccugaugaagucccugggcgggggccggcgggggaccggcgcccagggagagacacucggggagaaguggaagcggcaguuaaaccagcuauccaagagcgaguucaacaccuacaagcgcagcggcaucauggagguggaccgguccgaagccaaggaggggcugaagaggggagagaccaccaagcacgccguuucucgugggaccgcgaagcuucgaugguucgucgaaagaaaucuggugaagcccgagggcaaggugaucgaccugggcugcgggcgcggcggguggucguauuacugcgccggacuaaagaaagucacggaggugaagggguauaccaagggcggaccggggcacgaagagccgauccccauggccaccuacggcuggaaccuggugaagcugcacagcgggaaggacgucuucuucaugccgcccgagaagugcgauacccuccucugcgacauuggcgaguccagcccuaacccaacgauagaggaaggacggacccugcgggugcucaagaugguggagccguggcugcggggcaaccaauucugcauaaagauccuuaaccccuacaugccguccgucguggagacccucgagcagaugcagcgcaaacacgguggcaugcuggugcggaacccucugagccgcaacuccacccacgaaauguacugggucucgugcggcacggggaacaucguaagugcggugaacaugaccagccggaugcuccugaaccgcuuuaccauggcccacaggaagcccaccuacgagcgagacguugacuugggcgcgggcacucgccauguggcuguggaaccagaggucgcuaaucucgacaucaucgggcagcgcaucgaaaacaucaagaacgagcauaaguccaccuggcacuacgacgaggacaacccguacaaaaccugggccuaccacggcagcuacgaggugaaacccuccgggagcgccuccuccauggugaauggcgucgugcgccuccugaccaagcccugggacgucauccccauggugacgcagauugcgaugacagacaccacuccguucggccagcagcggguguuuaaggagaaggucgacacccgcacgccccgggcuaagcgcggcaccacccaaaucauggaggugacggcaaaguggcucuggggcuuccugucucggaacaagaaaccccgcauuugcacccgcgaggaguucaccaggaaggugcggagcaacgccgccauuggggcgguuuuuguggacgagaaccaguggaauagcgccaaggaggccguggaggacgagcgauucugggaccucguccaccgagagcgcgaguuacacaagcaggguaagugcgcgaccuguguguacaauaugauggggaaacgggagaagaagcugggggaguucgggaaggcuaagggcucccgcgccaucugguacauguggcuaggggcgcgguuccucgaauucgaggcccugggguucaugaaugaggaccacugguucucccgcgagaacuccuugagcggcguggagggggaaggucuccauaagcuaggguacauccuucgggauaucuccaagauuccaggcggcaacauguacgcggaugacacggcgggaugggacacccgcauuacggaggacgacuugcagaacgaagccaaaaucacagacaucauggagcccgaacaugcccugcuggccacgagcaucuucaagcucacuuaucaaaacaaggucgugcggguucagcggccugccaagaacggcacuguaauggacgugaucagccgacgggaucagcgcggcagcggccaggugggcaccuaugggcugaauacguucaccaacauggagguccagcuuauccggcagauggaguccgagggcaucuuccuccccagcgagcuggagaccccgaaccuggcugagcgcguacucgauuggcuggaaaagcacggggcagaacggcucaagcgcauggccaucuccggugacgacugcgucgucaagcccaucgacgaccgguucgcaaccgcucucacugcccuaaacgacauggggaaggugcgcaaagacauaccccagugggagcccaguaagggcuggaacgacuggcagcagguuccuuuuuguucccaccacuuccaccagcugauuaugaaggacggcagagagaucgucgugcccugccggaaccaagacgagcucgucgggcgagcacgcgucagccagggcgccggauggucccuucgagagacggccugccugggcaagagcuacgcccagauguggcagcucauguacuuucaccgacgggaccugcgccuggcggccaacgccaucugcuccgccgugccaguggacuggguccccaccagccggaccaccuggagcauacacgcccaccaccaauggaugacgacugaggacauguuaucaguguggaaccgcguguggaucgaggagaacccguggauggaggauaaaacccaugucagcuccugggaggagguuccguaccuugggaagcgcgaggaucaguggugcggcuccuugaucggcuugaccgcccgggccacgugggcuaccaacauccagguggccaucaaccagguccgccggcugaucgggaaugaaaacuaccuggacuauaugaccuccaugaagcgcuucaagaacgagagcgaccccgaaggcgcgcucugguga

SEQ ID NO: 24080 - RNA, 9879 nt, Artificial Sequence
  derived and/or modified CDS sequence (opt11) from DENV-1__GU131838__SS-prME
agcgugacaaugcugcucauguuauuacccaccgcccucgcauuccacuuaaccacacgcgguggggaaccccacaugaucgugagcaagcaggagaggggcaagucucuccuguucaagacuagcgccgguguuaauaugugcacccugauugcuauggaccugggggaacugugcgaggacaccaugaccuacaagugcccucguaucacugaggcggagccugacgauguggacugcuggugcaacgccaccgacaccugggugaccuacgggacaugcucgcagacaggcgagcacagacgcgagaagcgguccguggcccuggcaccccacgugggccuggggcucgagacccgcaccgagaccuggaugagcuccgagggugcauggaagcagauccagcgggucgagaccugggcccugcggcaccccggguucaccgugauagccuucuuccuagcgcacgccaucggcaccagcauaacccagaaggggaucauauuuauucuacugauguuggugaccccguccauggccaugagaugcgucggcaucgggaauagagacuucguggagggucuaagcggcgcuacguggguggaugucgugcuagagcauggguccugcgugaccacgauggccaagaacaagcccacccuggacaucgagcucuuaaagacggaggucaccaaccccgcaguguugcgcaagcucugcaucgaggccaagaucagcaacaccaccacggacucccgcugcccgacccaaggcgaggccaccuuaguggaggagcaagaugcaaacuucgucugccggcgcacuuucguggacagaggcugggggaacggcugcgggcuguucggcaagggcucucuccugacgugcgcuaaguucaagugugugaccaagcuggagggcaagauuguccaguacgagaaccucaaguacuccgugauuguaaccguccacacuggcgaccaacaccagguggggaacgagacgaccgagcacgggaccauugcgaccaucaccccucaggcccccacgagcgagauccagcugaccgauuacggggcgcugacccuagacuguagccccagaacuggcuuagacuuuaacgagaugguccugcucacgaugaaggaaaagagcugguuggugcacaaacaaugguuccuggaccucccgcugccguggacauccggggcuagcacgagccaggagaccuggaaucggcaagaucuguuaguaacguuuaagaccgcccacgcgaagaagcaggaggucguaguacugggcucccaagagggcgccaugcacaccgcuuugaccggggcgacggagauccagaccagcggaaccaccacgaucuucgccgggcaccucaaaugccgccugaagauggacaagcuaacccucaagggcauguccuacgucaugugcaccgggucauucaagcuggagaaggagguggcggagacccagcacggcacgguucugguucaggugaaguacgaaggcaccgacgcccccugcaagaucccauucuccacccaagacgagaaaggggugacucagaauggccggcugaucacggcuaauccgauugucaccgacaaggagaaacccgucaacaucgagaccgagccgcccuucggcgagagcuacauaguggucggcgccggggagaaggcgcuuaagcuguccugguucaagcgcgguagcuccaucggcaagauguucgaggccacagcccgcggggcccgcaggauggccauccugggcgacacagcuugggacuucgggagcaucggcggcguguuuaccuccguggggaaacuuguccaccaggucuucggcacggccuacgggguucucuucagcggcgucuccuggaccaugaagaucggaauagguauccugcucacguggcugggccugaauagccggucgacgucccucagcaugacuugcaucgccgucgggauggugacacuauaucugggcgucaugguucaagccgacucugggugcgucaucaacuggaagggccgcgagcucaaauguggguccggcaucuucgucacgaaugaggugcacacguggaccgaacaguacaaauuccaggccgacagucccaaacggcugucggcggccaucgguaaggcaugggaggaggguguuugcggcauccgcagugccacucggcuagagaacaucauguggaagcaaaucucuaacgagcucaaccacauccugcuggaaaacgacaugaaguucaccgucguagugggggacgccaacggcauccuggcgcaggggaagaagaugauccgcccccagccgauggagcacaaguacuccuggaaguccugggguaaggcgaaaaucaucggcgcugacauccaaaauacgacuuucaucaucgacggccccgacaccccggagugucccgacggacagcgggccuggaacaucugggaggucgaggauuacgguuucggcguguucaccacuaacaucuggcugaaguuacgagacuccuacacgcagaugugcgaccaccggcucaugagcgcugccaucaaagacuccaaggccgugcacgccgauaugggcuacuggaucgaguccgaaaagaacgagaccuggaagcuggcccgcgcgucuuucaucgaggucaaaacaugcaccuggccuaagucucacaccuuaugguccaacggggugcucgaaagcgagaugauaauccccaaaaucuauggagggccaaucucccagcacaauuaccggcccggcuacuuuacucagacugccgggcccuggcacuuaggcaagcuggaacucgacuucgaucugugcgagggcacgaccguagucguggacgagcacugcgggaaccgcggacccucccuccgcaccaccacggucaccgggaagaucauacacgaguggugcugccgcuccugcacccugccgccucuucgguucaggggcgaggacgguuguugguacggcauggagauccgucccgucaaggagaaggaggagaaccuaguccgcagcauggugucugccggaucaggggagguagacagcuucucccucggcauucugugugugagcaucaugaucgaggaggugaugcggucccgcuggagccgcaagaugcugaugaccgggacgcucgccgucuuccugcugcucaucauggggcagcugacguggaacgauuugauccgucucugcaucauggugggcgccaacgcguccgaccgcaugggcaugggcacaaccuaucuggcccugauggcuaccuucaaaaugcggccgauguucgccguggggcuucuuuuccgccggcugaccagccgcgagguccucuuacugacaaucggccuaucgcugguggccagcgucgagcuaccuaacucucuugaggagcugggggacggucuggcgaugggcauaaugaugcuaaaguuacuuaccgaguuucagccccaccagcucuggacgacacuccugagccuaaccuucgugaagacgacauugucucuggacuaugcuuggaagacuaccgccauggugcucagcaucgucucccuguuccccuugugccucagcaccacgucccaaaagacuacguggcugccggugcugcucggcagcuucggcuguaagccacugaccauguuccucauaaccgagaacaagaucugggggcggaaguccuggccccuaaacgaggggaucauggccaucgggauagugagcauacuucuguccagccuccugaagaacgacguuccccuggccggcccgcucaucgccggcgggaugcugaucgcuugcuacgugaucagcgggucgagcgccgaccugucucucgagaagacggccgaagugagcugggagcaggaggcugagcacuccggggcgagucacaacauucugguugaaguccaggacgacggcaccaugaagaucaaagacgaggagagagaugacaccuugaccauacuccugaaggcuacgcuccucgccguguccggggucuaucccaugagcauccccgccacccuguucgugugguacuucuggcagaagaagaagcagcgguccggcgugcugugggacacccccaguccacccgagguugagcgcgcggugcucgacgacggcaucuaccggauccugcagcgcgggcugcugggcaggucgcaggucgggguuggaguguuccaagacgggguguuccacaccauguggcacgucacgcgcggcgccgugcucauguaccaaggcaaacgccuggagccuagcugggccuccgucaagaaggaccugaucucuuaugggggaggguggcgguuccagggguccuggaacaccggggaggagguacaggugaucgcuguggagccgggaaagaacccgaagaacguccagacaacccccggaacguucaaaacccccgagggcgaggucggcgcgaucgcgcucgacuucaaacccggaacaagcggcucaccgaucgugaaccgcgaaggaaagauagucggucuguaugguaacgggguggugacuacgagcggcaccuacgucagcgccaucgcccaggcaaaggcuagccaggaggggcccuuacccgaaaucgaggacgaaguguucaaaaagcgcaaucucaccaucauggaccugcacccgggcucgggcaaaacccggagguaccugcccgccaucgugcgggaggccauaaagcgcaaguuacgcacacuaauccuggcccccacccgcgucguagccuccgagauggcggaggcccucaaagggaugccgauucgcuaccagaccacggcggucaagucggagcauacuggcagagagaucguagaccugaugugccacgccacauucaccaugcgccuguuguccccggugcgugugcccaacuacaacaugaucaucauggacgaggcgcacuuuacugauccagcgaguaucgcggcccgcggauacauuaguacacgcgucggcaugggagaggccgccgcgaucuucaugaccgccaccccgcccggaagcguagaagccuucccacagucgaacgccgugauccaggaugaggagcgcgacaucccugagagauccuggaacuccggguacgauuggaucaccgacuuccccgggaagacgguaugguucgugcccagcaucaaguccggcaacgacauugcuaacuguuuacgaaagaacggaaagcgugugauacagcuaagccgcaagacuuuugacaccgaguaccagaagaccaaaaacaacgacugggacuacgucgugacaaccgacaucuccgagaugggcgccaacuuccgggcugacaggguuaucgacccccggcgcugcuuaaagccugucauauuaaaggacggaccagagcggguuauccuggccggcccuaugccagucaccguggccagcgcugcccagcgccggggaaggaucgggcgcaaccagaacaaggagggcgaccaguacgucuacauggggcagcccuugaacaacgacgaggaccacgcgcacuggaccgaagccaagaugcugcuggauaacaucaauacgcccgaggguaucauccccgcucucuuugagccugagcgggagaagucagcagccaucgauggggaauaccgauuacggggcgaagcccgcaagaccuucgucgaacuaaugcggagaggcgaccuuccgguauggcugucguacaagguggcguccgagggguuccaauacagcgacaggcguuggugcuucgacggugagcggaacaaccaaguccuggaggaaaacauggacguggagauauggaccaaagagggggagcgcaagaagcuccggcccagaugguuggaugcccgaaccuacuccgacccgcuggcgcuccgcgaguucaaggaguucgccgccggccggcgcagcgugagcggcgaccugauccuggagaucgggaagcucccccagcaccugaccuugagagcccaaaacgcucucgacaaccuagucaugcugcacaacagugagcagggcgggaaagcguaucgacaugcaauggaagaguuacccgauacgaucgagacucugaugcugcucgcucucauugccgugcugaccggaggggugacccucuucuuccugagcggcaagggacuggggaagacgucgauuggccucuugugcgucaccgcgagcuccgcuuuacucuggauggccagcguggagccccacuggaucgcugcuuccauuauccuagaguuuuuccuuauggugcuccugaucccggaacccgaccggcaaagaacgccacaggacaaccagcuggcauacgucgugaucgggcuccuguucaugauccugacuguagcggccaacgagaugggccugcucgagacgaccaagaaggaccugggaauaggcuacgucgccgccgagaaccaccagcacgcgaccaugcucgacguggaccugcacccggcaagcgccuggacccuguacgccguugccacaacgguuauuaccccgaugaugcggcacaccaucgagaacacgacagcgaauaucucccucaccgcuaucgccaaucaggccgccaucuugaugggccuggacaaaggcuggccaaucagcaaaauggacaucggcgugccccuccuugcgcuggggugcuacucccaagugaauccguugaccuugacagccgccguccuaaugcucguggcccacuacgcgaucaucggccccgggcuacaggccaaggccacccgcgaggcccagaagcgaaccgcagcgggcauaaugaaaaaccccacgguggacggcaucgucgccauugaucuggaccccgugguguaugacgccaaguucgagaagcagcucgggcagaucaugcucuuaauccucugcacgagccagauccugcugaugaggaccaccugggcccucugcgaauccaucacccuggcaacgggcccacuaaccacccucugggaggggagccccggcaaguucuggaacacaacuaucgcagucuccauggccaauaucuuccgcggcucuuaucuggcgggggcuggccuagcguucucccucaugaagucccucggcggcgggcggagagguacuggcgcgcagggagagacauuaggcgagaaguggaagcgacaguuaaaccagcuguccaagagcgaguuuaacaccuacaagcgcagugggaucauggaagucgacaggucagaggccaaggagggccuuaagcgcggcgagacgaccaagcacgccgugagcagggguaccgccaaguugcgcugguucgucgagcggaaccuggugaaaccagaggggaaggugaucgaccugggcuguggccgcggggguugguccuacuauugugcggggcugaaaaagguuacugaggugaagggcuacaccaagggcggucccggccacgaggaaccgauccccauggcaacguacggguggaaccucgugaagcugcacagcggcaaagacgucuucuucaugccgcccgagaagugcgacacccuguugugcgacaucggggaguccagcccgaaccccacuaucgaggagggcagaaccuuaagggugcugaagaugguggagccauggcuccggggcaaccaguucugcauuaagauccugaaccccuacaugccgucuguuguggagacgcuugaacagaugcagcggaagcacggagggaugcucgugcggaacccccugucucgcaacucuacgcacgagauguacugggucagcugugggaccggcaacauaguguccgccgugaacaugacuagccggaugcugcucaaccgcuucaccauggcccaucgcaagcccacauacgaacgcgacgucgaccuaggcgccggcacccgccacguggcgguugagccugaggucgccaaccuugacaucaucggccagcggaucgagaacaucaaaaacgagcacaaguccaccuggcacuacgaugaggacaauccguacaagacgugggcuuaccaugggucguacgaagugaaacccuccgguagcgccucauccauggucaacggggucgugcgacuccugaccaagcccugggacgucauucccauggugacccagaucgcuaugaccgacacgaccccguucggucagcagcggguguucaaggaaaaggucgacacccgaacuccccgggcgaagcgcgguacgacccagaucauggaggugacggccaaguggcuguggggguuucucucuagaaacaaaaagccccgcaucuguacccgagaggaguucacgcgcaagguccggagcaacgccgcgauaggcgccguauucguugaugagaaucaguggaacagcgcgaaggaggccguggaggaugagagauuuugggaucugguccaccgggagcgcgaacugcacaagcaggguaagugcgcgaccugcguauauaacaugaugggcaagagagaaaagaagcucggggaguucggcaaggccaaggguucccgcgcgauaugguacauguggcugggggcccgguuccuggaguucgaggcccucggcuucaugaaugaagaccacugguuuagccgagagaacagccugagcggggucgagggcgaggggcuucacaaacucggauacauccugcgggacaucuccaagauaccaggagggaacauguaugccgacgauaccgccggcugggacacucgcauuacggaagacgacuugcagaacgaggccaagauuaccgacaucauggagcccgaacacgcccuccuggccaccagcaucuucaaacuuacguaccagaacaaggucguacgcgugcagcggccggccaagaacgggaccgucauggaugucaucucgcgccgugaccagcgcggcagcggacagguuggcaccuacggccucaauaccuucacgaauauggagguccagcugauccggcagauggaaucagagggaauuuuucugcccuccgagcuggagacgccgaaccuggcggagcgggcucuggacuggcucgagaagcacggcgcggaacgacuuaagcgcauggcuaucuccggcgacgacuguguggugaagcccaucgacgaccgguucgcgaccgcacugaccgcgcucaacgauauggggaagguccgcaaagacaucccccagugggaaccgucgaagggguggaacgacuggcagcagguccccuucugcucccaccacuuucaccaacugaucaugaaggacgggcgggagauagugguccccugccgcaaucaggacgaacucgugggacgggcccgcguuagccagggggccggcugguccuuaagagagacagccugccugggcaagagcuaugcccagauguggcagcugauguacuuucaccgucgggaccuccggcuggcggccaaugcgaucuguuccgccguccccguggacuggguccccaccagccggacgacuugguccauccacgcgcaccaucaguggaugaccaccgaggacaugcuguccgucuggaaccgcguguggaucgaggaaaacccguggauggaggauaagacgcacgugagcucuugggaggaggucccguaccucggcaagcgcgaggaccaguggugcggcagccugaucgggcugacagcgcgagcaacgugggcuaccaacauccaaguggccauuaaucaggugcgccgccucaucgggaacgaaaacuaccuggacuauaugaccuccaugaagcgcuucaaaaacgagagcgaucccgaaggggcgcugugguaa

SEQ ID NO: 24081 - RNA, 9879 nt, Artificial Sequence
  derived and/or modified CDS sequence (opt11) from DENV-1__GU131839__SS-prME
agcgugaccaugcugcucaugcugcugcccacagcacucgccuuccaccugaccacccgcggcggggaaccccacaugaucgugagcaagcaggaacguggaaaaucacuucuguucaaaacguccgccggagugaacaugugcaccuuaaucgccauggacuugggcgaacucugcgaagacaccaugaccuacaagugcccccgcaucaccgaagccgagcccgacgacguggacuguuggugcaacgccaccgauaccugggugaccuacgggacaugcucacagaccggagagcaucggcgcgagaaacgguccguggcccuagcgccccacgugggacuggggcucgagacacgcacugagaccuggaugagcagugagggagcguggaagcagauucagcgggucgagaccugggcccugcgccauccaggauuuacggugauugcguucuuccuggcgcaugccaucggcacgagcauuacgcagaagggcauuaucuuuauccuucugaugcuggugacucccuccauggccaugcgguguguugguaucggcaaccgcgauuuuguggaggggcucucaggcgcgacguggguggacgucgugcuugagcacggguccugcgugaccaccauggccaagaacaaacccacccuggacaucgagcuccuaaagacagaggucaccaaccccgcggugcuccgcaaacucugcaucgaggccaagaucagcaacaccaccacggacucccguugccccacccaaggcgaggccacccugguggaggagcaggaugccaacuucguuugucggaggaccuucguagaccggggaugggggaacggaugugggcuguucgggaaaggaagccucuugacgugcgcuaaguucaagugcgucaccaagcuggaggguaaaaccgugcaguacgaaaaccucaaauacucggugaucguuacaguucacacuggcgaccagcaccagguggggaacgagaccaccgagcacggcacgaucgcgaccaucacuccccaagccccaaccagcgagauacaacuaaccgacuauggggccuuaaccuuagauuguagcccccggacgggccuggauuucaacgaaaugguacugcucacaaugaaggagaaaagcuggcuggugcacaagcagugguuccuggaucucccucugcccuggaccuccggggccucgaccagccaagaaacguggaaccgucaagaccugcucgugaccuucaagaccgcccacgcgaagaagcaagaggucguggugcucggcagccaagaaggggccaugcacaccgcacuuacgggugcgaccgagauccagacgucgggcacgaccaccauuuucgcgggccaccucaaaugccgccugaagauggacaagcugacccucaaggggauguccuacguaaugugcacagggucuuucaaacuugagaaggagguggcggagacucaacacggaaccgugcugguccagguuaaauacgagggcacagacgcccccugcaagauccccuuuuccacucaggaugaaaagggggugacgcagaacggccggcuaaucaccgcuaaucccaucgucacagacaaggaaaaacccgugaacaucgagacugagccgcccuucggagagagcuacaucguugucggcgcuggcgagaaggcucucaagcugaguugguucaagcgcgggagcuccaucggcaagauguucgaggcgacggccagaggggcucgccgcauggccauccugggggacaccgcgugggacuuugggagcauaggagggguauuuacguccgugggcaaacucguccaccagguguucggcaccgccuacggggugcuguuuagcggcguaucguggacgaugaagaucgguauaggcauccuucucacguggcugggccugaacagccggucaaccagccucuccaugaccuguaucgccguggggauggugacgcuguaccugggcgugaugguacaggcggacagcgggugcgugaucaacuggaagggccgcgaacucaagugcggguccggcaucuucgugaccaacgaggugcacaccuggaccgagcaguacaaguuccaggccgacucaccgaagaggcugucugcugccaucgggaaagccugggaagaggggguaugcggcauccgcucagcuacccggcucgagaacauuauguggaagcagauuuccaacgagcucaaccacaucuuacuggagaacgacaugaaguucacggucguggugggggacgcgaacggcauccucguccaggguaagaagaugaucagaccccagccaauggaacacaaguacagcuggaaguccugggguaaagccaagauuaucggcgccgauacucagaacaccacguucaucaucgacgggcccgacacuccagagugcccggacggccagcgggccuggaacaucugggagguggaggacuacggguuugguguguuuaccaccaacaucuggcuaaagcugcgcgacucguacacacagaugugcgaccaccggcugaugucggccgcgaucaaggacuccaaagccguccacgcagacaugggcuauuggaucgaguccgagaagaacgaaacguggaaguuagcacgcgccucauuuauagaggugaagaccugcaccuggccaaagagccacacccuuuggagcaacggggugcucgagagcgagaugaucaucccaaagaucuacggcgggccgaucucccagcauaacuaccggcccgguuacuucacgcagaccgcgggaccauggcaccuggggaaacuggagcuagacuucgacuuaugcgaaggaaccaccguagugguggacgagcacugcggcaacaggggaccuagccugcggaccaccaccgucaccgggaagaucauccacgaguggugcugucggucuuguacgcugccaccccugcguuuccgaggcgaggacgggugcugguacgggauggagauccggcccgugaaggagaaggaagagaaccuuguacgcagcauggucuccgccggcucaggggagguugauagcuucucccucggcaucuugugcgugagcaucaugaucgaggaggucaugcggucccgcuggucucggaagauguugaugaccgggacccuugccguguucuugcuacucaucaugggccaacugacauggaacgaccuuauccggcucugcaucauggugggggccaacgccucagaccgcauggggaugggcacgaccuacuuggcgcugauggccaccuucaaaaugagaccgauguucgccguagggcugcuguuccgccggcugaccucacgcgaggugcucuuauuaacgaucggucucucccugguagcaagugucgagcuucccaauagucucgaggaacugggggauggccuggccaugggcauaaugaugcugaaacugcugaccgaauuucagccccaucaacucuggaccacacuguugagccucacguuugugaaaaccgcgcuguccuuagacuaugccuggaagacgaccgccaugguccucagcaucgugagccuguuuccccugugcuugagcacgaccucccaaaagacaacuuggcugccgguacugcucgggagcuucggcugcaagccccugaccauguuccugauuaccgagaacaagauuuggggacgaaagaguuggccccucaacgagggcaucauggccaucgggaucgucagcauccugcuguccucucucuuaaagaaugaugucccccuggcgggaccgcucaucgccggugguaugcugauugcguguuaugugaucagcggcucuagcgccgaccugucccucgagaaggccgccgaggucagcugggagcaggaggccgagcacuccggggccagccacaacauccugguggaaguccaagaugaugguaccaugaagaucaaggacgaggaacgggacgacacgcugaccauucuccugaaggcaacgcuguuagcaguguccgggguguacccgaugagcauucccgcgaccuuauucgugugguacuuuuggcagaagaagaagcagcgguccggcgucuuaugggacacccccagcccgcccgagguggaacgcgccgugcucgacaacggaaucuaccggauccugcagcgcgggcugcugggccgaagucaagucggggucggcguguuucaggacgggguguuccauacaauguggcacgugacacgcggcgcagugcucauguaucagggcaaacgucuggaacccagcugggccuccgucaagaaagaccugaucagcuacgggggaggguggcgcuuccaaggcuccuggaacacgggggaagagguccaggugaucgcggucgagcccggcaagaacccaaagaacgugcagaccacacccggcacguuuaagacgccagagggggaagugggcgcgauagccuuagacuucaaacccgggaccagcggcuccccaaucgucaaucgggagggcaagaucguggggcuguacggcaacggggucgucaccacguccgggaccuacguguccgccauagcacaggccaaagcgucgcaggaagggccccugccugaaauugaggaugaaguguucaaaaagcgcaaccugacgaucauggaccugcacccgggcagcggcaagacuaggcguuaccugcccgccaucgugcgggaggccauuaagcgcaagcuccgcacgcugauccuggcacccacgagggucguggcgagcgagauggccgaggcccucaaggggaugccuauucgcuaccagaccacugccguaaagagcgagcauacgggccgggagaucguugaccugaugugccacgcaaccuucacgaugcggcuacucuccccggugcggguccccaacuacaacaugaucauaauggacgaggcacacuucaccgaccccgccucaaucgcggcaagggguuauaucucgacacgagugggcaugggggaagccgcggcaaucuucaugacggccacgcccccaggcagcguagaggccuuuccacaguccaacgccgugauccaagacgaggagcgcgauauccccgagcggaguuggaacucaggcuacgacuggauuaccgacuucccugggaaaacugugugguucgugcccuccaucaaauccggaaacgacauugccaacugccugcgcaagaacgggaagagggugauccagcucagccguaaaaccuucgacaccgaguaccagaagaccaagaacaacgacugggacuacguggugacgacggauaucucugagaugggcgccaacuuccgggccgaccgcgucaucgacccccgucgcugccucaaaccggugauccugaaggacgguccugaacgggucauccuggccgggccgaugcccgugaccguggcgagugccgcgcagcggagaggaaggaucgggcgcaaccaaaacaaggaaggcgaccaauacguuuacaugggccagcccuugaacaaugacgaagaccacgcccacuggaccgaggcgaagaugcuguuagacaauaucaacacgccggagggcauuaucccggcccucuucgagcccgagagggagaaguccgcagccaucgacggagaguaucggcuucggggcgaggcccgcaagaccuuuguagagcugaugagacgcggcgaccuccccguguggcugagcuacaaggucgccuccgaaggguuccaauauuccgaucgucgcuggugcuucgauggcgagcggaacaaccaggugcuggaggagaacauggauguggaaauauggaccaaggagggggagcgcaagaaacuccggccucgcuggcuggacgcgcggaccuacuccgacccgcuggcccugcgcgaguucaaggaguucgccgccggccgucgcagcgucaguggcgaucuuauccuggagaucggcaagcucccacagcaccugacccuacgggcgcagaaugcgcucgacaaccuugugaugcuucacaacuccgagcagggcgguaaggcuuaccggcaugccauggaggagcucccagacaccaucgagacccugaugcugcucgcccuuaucgcgguccugacgggcggaguaaccuuauucuuccuaagcggcaagggacugggcaagacgucuaucgguuugcugugcgugacugccagcagcgccuugcucuggauggccuccguggaaccccacuggauagccgcgucuaucauccuggaguucuuccugaugguucuccugaucccagagcccgaccggcaacgaacuccacaagacaaccaguuagccuacguggugaucgggcuccuguucaugauccugaccguggccgccaacgagaugggccugcuggagacgaccaagaaagaccucgggaucggguauguggccgcggagaaccaucaacacgccacaauguuggacguggaccuacaucccgccagcgccuggacccuuuacgccgucgcgacuaccgugauuaccccgaugaugcggcacaccaucgagaacaccaccgccaauaucuccuuaaccgcaaucgccaaccaggccgcgauccugaugggguuagacaagggguggcccaucaguaagauggauauaggcguaccccuccuggccuuaggaugcuacucccagguaaacccguugacacugacgagcgccgugcugaugcucguggcgcauuacgcgauuaucggccccgggcugcaggccaaggccaccagggaggcccagaagagaacugccgcgggcauaaugaagaaccccaccguugacggcaucguggccaucgaccuagaccccguggucuacgacgccaaauuugagaagcagcucgggcagaucaugcugcugauccuuuguacgucccaaauccuguugaugaggacuacgugggcgcucugcgagagcauuacuuuagccacgggcccccugaccacccucugggaggguucccccggcaaguucuggaacacgacaauugcggugagcauggccaacauuuuccgcggguccuaucuggccggggccggccuggccuucagcuugaugaagucccucggcgggggucggcgcgguaccggcgcacagggggagacccugggagagaaauggaagcggcagcucaaccagcugagcaagucugaguucaacaccuacaagcgcuccggcauuauggaaguggaccggagcgaggcaaaggagggccugaagcguggggagacgaccaaacacgcuguaucccgggguacggccaagcuccgcugguucguggagcgcaaccuaguaaagccagagggcaaggucaucgaccugggguguggucgcgggggcuggucauacuacugcgcggggcugaagaaggugaccgagguaaagggcuacaccaagggcgggcccggccacgaggaaccgauccccauggcuacguacggguggaaucucgucaagcugcacucgggcaaggacgucuucuucaugccgcccgagaaaugcgacacgcugcucugcgacauaggggagagcucaccgaacccuaccaucgaggaggggcggacucugcgugugcugaagauggucgagcccuggcuccgggggaaccaguucuguaucaagauacugaauccguacaugccgucugugguggagacgcuggagcagaugcagaggaagcacggggguaugcuaguccgaaacccccugucccgcaacagcacccaugagauguacuggguguccugugggaccggcaauaucgugagcgcggucaacaugaccucccggaugcugcuaaaccgguucacuauggcucaccgaaagcccaccuacgagcgggacguggaccugggagccgggacacgacacguggcggucgagcccgagguggccaaccuggacaucauaggccagcggaucgagaauauaaagaacgagcacaagucuaccuggcauuacgaugaggauaacccauacaagacgugggcguaccacgguuccuaugaggucaaacccagcggcuccgccucgucaauggugaacgguguggucagacuccugaccaagcccugggacgugauccccauggugacccagaucgccaugaccgacacgaccccguuuggucaacagcgagucuuucgcgagaagguggacacccggacgccccgcgcgaagcgaggcacgacccaaaucauggaggugaccgcuaaguggcuguggggauuccucagccgcaacaagaagccccggauaugcacucgcgaggaguucacgcggaaggugcgcagcaacgccgcgaucggcgccguguucguugacgagaaccaguggaacuccgcgaaggaggccgucgaggacgagcgguucugggaccuggugcaccgcgagcgggagcuucauaagcaggggaaaugugcgaccugcguguauaacaugaugggcaagcgggagaaaaagcucggggaguucggcaaagccaaggguucccgugcgaucugguacauguggcugggggcacgcuuccucgaauuugaggcccucggcuucaugaacgaggaccacugguuuucccgcgagaauagccuguccggugucgagggggaggggcugcacaagcucggcuauauccugcgcgacaucagcaagaucccgggcgggaacguguacgcagacgauacugccggcugggacacccgcauaacggaggacgaccugcagaaugaggcgaagauaaccgacauuauggaacccgagcacgccuugcuugccaccuccauauucaagcugacguaucagaacaaggugguacgaguucagcgccccgccaagaaugggacggugauggacgucaucucucggagagaccagcggggcaguggccaagucgggaccuauggccucaacaccuucaccaauauggaggugcaacugauucgccagauggaaagcgaagggaucuuccuucccucggaacucgagacgccgaaucuggcugagcgggcucuggacuggcucgagaagcacggcguagagcggcugaagcgaauggcuaucucaggggacgacugcgugguaaagcccaucgacgaucgcuucgccaccgcccugaccgcgcucaacgacaugggcaaggugcggaaggacauaccccagugggagcccuccaagggcuggaacgacuggcagcaggucccguucugcucccaccacuuccaccagcuuauaaugaaggacgggcgcgagauugugguccccugccggaaccaggacgagcugguuggccgcgcgcgggugucccagggggccggcuggagccuccgcgaaaccgccugccuggggaaguccuacgcgcagauguggcagcugauguacuuccaucggagagaucuccggcuggcggcgaaugccaucugcucagccguacccgucgacugggugcccaccagccgcacaaccugguccauccacgcccaccaccaauggaugaccaccgaggacaugcuguccgucuggaaccgaguguggaucgaggagaacccguggauggaagacaagacgcacgugucgucuugggaagagguccccuaccucggcaagcgggaggaccaauggugcggcucccugauagggcuuaccgcgcgcgccacaugggccaccaacauccagguggcaaucaaccagguucggcgccucauuggcaacgagaacuaccuggacuacaugacgagcaugaagcgguucaagaacgagucggacagugagggggcccugugguga

SEQ ID NO: 24082 - RNA, 9879 nt, Artificial Sequence
  derived and/or modified CDS sequence (opt11) from DENV-1__GU131841__SS-prME
agcguuacuaugcuucucauguuacugcccaccgcccuugccuuccacuugaccacccgcggcggggagccccacaugaucguaagcaagcaggagcggggcaagagccuccuuuucaagaccagcguaggggugaacauguguacccugauugcgauggaucugggcgagcucugcgaggacaccaugaccuacaagugcccccggaucaccgaggcugagcccgacgacguagacuguuggugcaacgccacggauaccugggugacguacgggacuugcagccagaccggcgaacaucggagagagaagcgguccguggccuuagcgccccaugucggccugggucucgagacacgcaccgaaacauggaugagcuccgagggcgccuggaagcagauccagcggguggagaccugggcccugcgccacccggguuucacgguaaucgcauuuuuccuugccuaugcgauaggcacuucgaucacccagaaaggcaucaucuucauccuccugaugcuggugacucccuccauggccaugcggugcgucgguaucggcaaccgcgacuucguggagggucucagcggcgccacguggguggacguuguccuggagcacggcucaugcgucacuaccauggccaagaacaaacccacccuggacaucgaacuccugaagacagagguuacaaaccccgccgugcugcggaaacucugcaucgaggcgaagaucagcaacaccaccacggacucccgguguccgacccagggugaggccacccuggucgaagagcaggacgccaacuucguaugccggcgcacauucguggaucgggguugggggaacggcugcgggcuguucggcaaggggagucucuugacgugcgccaaguucaagugcgucaccaagcuggagggcaagauugugcaauacgaaaaccucaaguauuccgucaucgucacagugcacaccggcgaccagcaccaggucgggaacgagacgaccgagcacgggaccaucgccacuaucacgccccaggcucccacgagugagauccagcuuaccgacuacggggcccucacccucgacugcagccccaggaccggacuggacuuuaaugagauggugcugcugacgaugaaggagaaguccuggcugguacacaagcagugguucuuagaccuaccucugcccuggaccagcggggcaagcaccagccaggaaaccuggaaucggcaggaccuuuuagucacguuuaagaccgcccacgccaagaagcaggaagugguggugcugggcucccaggagggcgcgaugcacaccgcccugacuggggcaacggagauucaaacgagcggcaccaccacgaucuucgccgggcaccuaaagugcaggcugaagauggacaagcugacgcucaagggcauguccuacgucaugugcaccgggagcuucaagcuggaaaaggagguugccgagacccaacacggcacgguccugguccaggugaaguaugagggcacugaugcgcccugcaagauccccuucuccacccaagacgagaagggggugacccagaacggccgguugaucaccgcuaacccgaucgugaccgauaaggagaaaccugugaacauugaaacggagccgcccuucggggagagcuacaucgucgugggggccggcgaaaaggcccugaagcuguccugguuuaagcgcgggagcuccaucgggaagauguucgaggcgaccgcccguggggcucgccguauggccauccugggugacacggcaugggacuucgggagcaucggcgggguguucacaucggucggaaaacucgugcaccagguguuuggcaccgcguauggugucuuguucagcggcguguccuggaccaugaagaucgggaucggcauccugcucacauggcugggguuaaacagccgguccaccagcuuguccaugacauguauugccgugggcauggucacccuguaccugggaguaaugguucaggccgacagcgguugcgucauaaacuggaagggccgcgagcucaagugcgggagugguaucuucgucacgaacgaggugcacaccuggaccgaacaguacaaguuccaggcagacagcccuaagagacugagugccgcgaucggcaaggcuugggaggagggugucugcggcauccgcucugcgacccggcuugagaacauuauguggaagcagauauccaacgagcucaaccacauccugcuugaaaacgacaugaaguucaccgugguggugggggacgccaacgguauccucgcccaagggaagaagaugauccgcccacagccuauggaacauaaguacuccuggaagucuuggggaaaggcgaagaucaucggcgccgacauccaaaauacgaccuucauuaucgacggccccgacaccccagaaugcccugacgggcagagggccuggaacaucugggagguggaggauuacggguucggcguguucaccacgaacaucuggcugaaacugcgcgacuccuacacacagaugugcgaccaccgccuaaugagcgccgcaaucaaggacuccaaggccguccacgccgacauggguuauuggaucgagagcgagaagaacgagaccuggaagcuugcccgcgccucguucaucgaggucaagaccugcacguggccuaagagccacaccuuauggagcaacggggugcucgagagcgagaugaucaucccuaaaaucuauggcgggccaauuagccagcauaacuaccggcccggcuacuucacccaaacggcggggcccuggcaccugggcaaguuggagcucgacuucgaccugugcgagggcaccaccgucguggucgacgagcauugcggaaaccgaggccccagccugcggaccaccaccgucaccgggaagaucauccacgaguggugcugccgcuccugcacccuccccccacuacgguuccgcggagaagacggguguugguacggcauggagaucagacccguuaaggagaaggaggagaaccuggugcgcagcauggucuccgccggcucaggcgagguggauucauuuuccuugggcauacugugcguaagcaucaugaucgaggaggucaugcggucgcgcuggucgcgcaagaugcuaaugaccgguacgcuagccguguuccugcuucuuaucaugggccagcugaccuggaacgaccucaucagauuaugcaucauggugggggccaacgccuccgacaggauggguauggggaccaccuaccuggcgcugauggcgacguucaagaugcgcccgauguuugccgucggucuccuguuccgcagacugaccagccgcgaggugcuccugcugaccauuggccugucccuggucgccaguguggagcugcccaacucccucgaggagcuaggggauggacuggcuaugggcaucaugaugcucaagcugcuuaccgaguuccaaccccaccaauuguggacgacccugcugagucuuacauucgugaagaccacgcugucccuugacuacgccuggaaaacgaccgcgaugguccucagcaucgugucccuguuuccccugugccucaguaccacgucccaaaagaccacauggcucccgguccugcucgguucuuucgguugcaagcccuuaaccauguuccugaucaccgagaacaagaucugggggcggaaauccuggccccuaaacgaaggcaucauggcaaucgggauugucucuauccugcuguccucgcuccugaagaacgacgugccccuugcugggccgcucauagcgggcgggaugcucauagccugcuaugugaucagcggcuccagcgccgaucuuucucuggagaaggccgcagaggucuccugggagcaggaagcagaacauuccggggccagccacaacauccugguggaggugcaggacgacggcacuaugaagaucaaggacgaagagcgcgacgacacacugaccauccuucugaaagccacgcugcucgccguuuccggcguguaucccaugagcauacccgccacgcuguucgugugguacuucuggcagaagaagaaacagcgguccgggguccucugggauaccccaagcccacccgaagucgagcgcgccgugcucgacgacggcaucuaccggauccugcagcgcggauuacugggccggucccaagucggggucgguguguuccaggacggggucuuucauaccauguggcacgugacccguggggccguguuaauguaccagggaaaaaggcuugagcccagcugggcauccgucaaaaaggaccucaucagcuacgggggcggguggcgcuuccagggcuccuggaacacgggggaggaaguccaggugaucgcuguggagccaggcaagaaccccaagaacgugcagacgacuccuggcaccuucaagacgcccgagggcgaggugggcgccaucgcgcuugauuucaaaccagggacgagcggcuccccgauugucaaccgugaggguaagauagugggucuguacggcaacgggguggucaccacaagcgguacguacguaagugccaucgcgcaggcaaaggccagccaggagggccccuuaccagagaucgaggacgagguguucaagaaacgcaaccuaaccaucauggaccuacauccggggucuggaaagacccggcgcuaccugcccgcuaucguacgggaggcaaucaagcgcaagcuccgcacccugauccuggcccccacgagggugguggcaucagagauggcugaggcuuugaaggggaugcccauccguuaccagacuaccgccgucaaguccgagcacacaggacgggagaucguggaucugaugugccacgccacguucaccaugcgccugcucuccccgguucgcgucccgaauuacaacaugaucaucauggacgaggcccauuucacagaccccgccagcauugcugcccgugguuacaucuccaccaggguaggcaugggggaggccgcugcgauauucaugacggccacaccgcccggcagcguagaagccuucccccaguccaaugccgucauccaggacgaggagagggacaucccggagcggagcuggaacucuggcuacgacuggaucaccgauuuccccgggaagacggugugguucgugcccucuaucaaguccgguaacgacaucgcaaacugccugcgaaagaacgggaagcguguuauacagcugagccgcaaaacguucgauaccgaguaucagaagaccaaaaauaacgacugggauuacgugguuaccacggacaucuccgaaaugggugcgaauuuccgagccgaucggguuauagacccccggcgauguuuaaaaccggugauccugaaggacgggcccgaacggguuauccuggcaggcccgaugcccgugaccguggccagcgcagcccaaagacgggggaggauugggcgcaaccagaacaaggagggcgaccaguacgucuauauggggcagccccucaacaaugaugaggaccacgcccacuggaccgaggccaaaaugcuccuggacaacauaaacacccccgaggggaucauaccagcccucuucgaacccgaacgggaaaaguccgcggccauugacggggaauacagacugcgaggcgaggcacgcaaaacauucguggaacucaugcggcgcggugaccucccaguuuggcugagcuacaaggucgcuagcgaaggguuccaguauagcgaccggcgaugguguuucgacggggagcggaacaaccaggugcuggaggagaacauggauguggagauauggaccaaggagggggagcgcaaaaagcucagaccccgcugguuggacgccagaacguauuccgauccgcuggcgcucagggaguucaaggaguuugccgcgggucggcgcuccgucagcggugaucuaauccuggagaucgggaaguugccccagcaccugacccugcgugcccagaacgcccucgacaaccuggugauguugcauaacagugagcagggcgggaaggcguaucgccacgcaauggaggagcuccccgacaccaucgagacgcugauguugcuagcccugaucgcugugcugacaggcggggugacccucuucuucuuaagcggcaagggccuggggaagaccuccauaggucuccugugugugacggcgucaucugcccugcuuuggauggccagcguggagccccacuggaucgccgccuccaucauccuggaguucuuccugaugguacuccuaauuccggagcccgaucggcagcgcacgccccaggacaaccagcuggcguacguugucaucggauugcucuucaugauccuaaccgucgcggcgaaugagaugggccucuuggagaccacgaaaaaggaccugggaauuggcuacguggccgccgagaaccaccagcacgcgaccaugcuggacguggaccugcacccggcguccgccuggaccuuguacgccgucgcgacaacagugauuacccccaugaugcggcacaccaucgagaacacaacggccaacauuucccuaaccgccaucgccaaccaagccgccaucuugaugggucuggacaagggguggccuauaagcaagauggauaucggagugccccuccuggcgcuggggugcuacucccaggucaacccacucaccuuaaccgcggccgugcugaugcucguggcccacuacgcgaucaucggcccggggcugcaggcgaaggccacgcgagaggcacagaagcgcaccgccgcggguaucaugaagaacccgaccguagacggcaucguggccaucgaccuagaucccguggucuacgaugccaaguucgagaagcaguuggggcagaucaugcugcuaauccucugcacuagccaaauccuguuaaugcggacgaccugggcccucugugagucaauaaccuuagccacgggcccgcucacgacccucugggaaggguccccaggcaaauucuggaauaccaccaucgcuguauccauggcaaacauuuuucgcggcagcuaccuggcuggggccggccuggccuucucccucaugaaaagucucgggggugggcggcgagggacgggcgcgcagggcgagacccugggcgagaaguggaagcggcagcuaaaucagcugagcaagagcgaguucaacaccuauaagagaagcgguaucauggaaguggaccgcucagaggccaaggagggccugaagcgcggagagacaacuaaacaugcggucagccggggcaccgccaagcuuagaugguucguggagcggaaccuggugaagccugagggcaaagucaucgacuuaggaugcggccgcgggggcugguccuacuacugugcgggguuaaagaaggugaccgaggugaagggauacaccaagggcggacccggccaugaggagccgauccccauggccaccuacggcuggaaccucgugaaacuccacagcggcaaggacguguucuuuaugccgcccgagaagugcgacacgcugcucugcgacauaggggaaaguagcccgaaccccaccaucgaggagggcagaacccugcgcgugcugaagauggucgagccuuggcuccggggcaaucaguucugcauaaagauccugaaucccuacaugccgagcgugguugaaacccucgagcaaaugcaaagaaaacacgggggcaugcuuguacggaaccccuuaagccgcaauuccacacacgagauguacugggugagcugcggcacugguaacaucguuuccgccguuaauaugaccagccggaugcuccucaaccgcuucaccauggcccaucgcaagccgacguacgagcgggacguggaccugggcgccgggacccgccauguggcggucgaaccggagguugccaaccuggacaucaucggccaacggauugaaaacaucaagaaugagcacaaguccaccuggcacuaugacgaggauaacccguacaagacaugggccuaucacggaagcuacgaggucaagcccuccgguagcgcgaguucaauggugaauggagugguucgccuccugacgaagccgugggacgugaucccgauggucacacagaucgccaugaccgacacuacaccguucggccagcagcggguauuuaaggagaaaguggauacucgcacgccucgggcgaagcgcggaaccacgcagauaauggaggugaccgccaaguggcugugggguuucuugucccggaacaagaagccccgaauuuguacccgagaagaguucaccaggaagguccggagcaacgccgcgaucggugccguguucguagacgaaaaccaauggaauagcgcaaaggaggccgucgaggacgagcgcuucugggaccuaguccacagagagcgcgagcugcacaaacaggggaagugugccacgugcguguacaacaugauggguaagcgggagaaaaagcucggggaguucggcaaggccaaaggcucccgagcgaucugguacauguggcucggggcccgguuccuggaguucgaagcccucgguuucaugaacgaggaccacugguucagcagggagaacucccugucgggcgucgagggggaaggguuacacaaacucggcuauauucugcgagacauaaguaagauuccgggcgggaacauguacgccgacgacaccgccggcugggacacccggauaaccgaggacgaccugcaaaacgaagcgaaaaucacggacauuauggagccggaacacgcacuccuggccaccagcaucuucaagcugacuuaccagaacaagguagugcgcguccagcggcccgccaagaacgggacugugauggacguuaucucccgccgggaccaacgcggcagcggccaggucgggacguacggccucaauacauucacgaacauggaggugcaacugauccgccaaauggaaucugaggggauuuuccuucccagcgaacuugagaccccgaacuuggccgagcgugcgcuggacuggcucgagaagcacggcgccgaacgacugaagcgcauggcaaucucuggggacgauugcguggugaagccaauugacgaccguuucgccacggccuugacggcgcucaacgacaugggcaaggugcgcaaggacaucccccagugggaaccuagcaaaggguggaacgauuggcagcaagugcccuucugcagccaccacuuccaucagcugaucaugaaggaugggcgggagaucgucgugcccugccgcaaccaggaugaacuuguaggccgcgcgcgcguaucccagggagccggcuggagccuucgggaaacugccugccugggaaagaguuacgcccagauguggcaguugauguacuuccaccgccgagacuugagacuggcggcgaacgccaucuguucagccgugcccguggauugggucccgaccagccggacuacuuggucgauucacgcgcaccaccaguggaugaccaccgaggacaugcugucaguguggaaccgaguguggaucgaggagaacccguggauggaggacaagacccacgucucaagcugggaggagguaccauacuuggguaaaagggaggaccagugguguggcagccugaucgggcugacggccagagccaccugggccacaaacauucaaguggccauaaaucagguacgacggcucaucggcaacgaaaacuaccuggacuacaugaccuccaugaagcgcuucaagaacgagagcgaccccgagggggcacugugguaa

SEQ ID NO: 24083 - RNA, 9879 nt, Artificial Sequence
  derived and/or modified CDS sequence (opt11) from DENV-1__GQ868601__SS-prME
agcguuaccauguuacuaaugcuguuacccaccgcccucgcauuccaccuuaccacccggggcggggagccccacaugauugugagcaagcaggagcgcggcaagagccuccuuuucaagaccuccguuggggugaacaugugcacacuuaucgcaauggaccuuggcgagcugugcgaggacaccaugacauauaaaugcccccgaauaaccgaggcagaacccgacgacguugauuguuggugcaaugcuaccgauacguggguuacauacgguaccugcucacagacuggcgaacacaggcgagacaagcguuccgucgcccuggcgccccacgucggcuuagggcucgagacgagaaccgagaccuggaugagcuccgagggcgccuggaagcagauccagaagguggagaccugggcccugcggcaccccggcuuuacuguaaucgccuuauuccucgcgcacgcgaucggcaccagcaucacccagaagggaaucaucuuuauccugcucaugcuugucaccccguccauggccaugaggugcguagguauaggcaaccgggacuuuguggaagggcugagcggggccacgugggucgaugugguucuggagcacgguuccugcgugaccaccauggcgaaaaacaagcccacccucgacaucgagcugcugaagacggaggugacgaacccugcugugcuccggaagcuguguaucgaggcgaagaucagcaauaccacuacugacucccggugccccacccagggcgaggccacccugguagaggagcaggacgcuaacuucgucugccgccggaccuucguggacaggggaugggggaacgggugcgggcucuucggcaagggaagucugcugacgugcgcuaaguucaagugugucacccggcucgagggaaagaucgugcaguacgagaaccugaaguacuccgugauugucaccgugcacaccggagaccaacaccagguugggaacgagacgacagagcacgggacaauugcuaccauaacgccccaggcgccuacgucagagauccagcuaaccgacuacggggcccucacccuggauugcagccccagaaccggccuugacuucaacgagaugguccuccucacgaugaaggagaaguccuggcuggugcauaaacagugguuccucgaccugccgcugcccuggaccaguggggccagcaccucgcaggagaccuggaacagacaggaccuccugguuacguuuaaaaccgcucacgccaagaaacaggagguggugguacuagggagccaggagggcgcgaugcacaccgcccucacuggagccacggaaauccagacaagcggaacaaccacgaucuucgccgggcaccugaaaugccgcuuaaagauggacaaacucacccuaaagggaaugaguuacgugaugugcaccgggagcuucaagcuggagaaggagguggcugaaacccagcacggcacgguccuuguccaaguuaaguacgaggguacugacgccccaugcaagaucccauuccucacgcaagacgagaagggugucacgcagaacggacggcugaucacggccaacccuaucgugacugauaaagagaagcccgugaacauugagacggagccgccguucggggaguccuacauuguagugggugcuggcgagaaggcgcuaaaacucagcugguucaagaagggcucuagcaucgggaagauguucgaggcuacugccagaggggcccggcgcauggccauucugggggauacggcuugggacuuugguuccaucggcggccuguucaccagcguggggaaacucauccaccaggucuuugggaccgcguacggugugcuguucagcggaguguccuggacuaugaagaucgggaucggcauccuccucacgugguuaggccugaacucccgcagcaccucucucagcaugaccugcauugccgucgggauggugacacuauacuuggguguaaugguccaggcugacuccgggugugugaucaauuggaagggucgggaacuuaagugugggagcgguaucuucgugacgaacgagguccacaccuggaccgagcaguacaaauuccaagccgacagcccuaaacgccugagcgccgcuaucggcaaggccugggaggagggggugugcggaauccggagugccacccgccuggagaacauaauguggaagcagauuucaaacgagcugaacuauauccugcuagagaaugauaugaaguucaccguggucguuggggaugccaauggaauccucgcccaggggaaaaagaugaucagaccccagcccauggagcacaaguauagcuggaaguccuggggcaaggcgaagaucaucggcgcagacauccagaacacgaccuuuaucaucgacggcccagacaccccggagugccccgacgaccagcgcgcguggaauaucugggaaguggaggacuacggcuucgggauuuucacgacgaacaucugguugaagcuacgggacagcuacacucagaugugugaccaccgccucauguccgcagcgaucaaggacagcaaggccguccacgcggauaugggauacuggauagagagugagaaaaacgaaacguggaagcuggcgcgggccagcuuuauugaggugaagaccugcaucuggccuaaaucccacacgcuauggagcaacggcgugcucgaguccgagaugaucauccccaagaucuacggcggaccuauaagccagcacaauuaccgccccggguacuucacccagaccgcgggacccuggcacuuagggaaguuagagcucgacuucgaccugugcgagggcaccacagucguggucgacgagcauugcggcuaccgggggccgucccugcgcaccaccaccgucacgggcaaaaucauacacgaauggugcugccgcagcugcaccuugccgccccugcgcuuccgcggggaggacggcuguugguacgggauggaaauucgcccugugaaggaaaaggaggaaaaccuggugagaagcaugguaagcgccggcuccggcgagguggacagcuucagccucgggauccuaugcguguccauccugaucgaggaggucaugcguucucgaugguccagacgcaugcugaugaccggaacacuugccguguuccuucuccugaucauggggcagcugacauggaacgaccugauccggcuaugcaucauggugggggccaacgcgagcgaccguauggggaugggcaccaccuaccuggcgcucauggccaccuucaagaugcggccaauguucgccgugggacuucuguuccggcggcucacgucacgggaggugcuucugcucaccaucgggcugagccugguggccuccguggagcuccccaacaguuuggaggagcugggcgauggccucgccaugggcaucaugaugcugaagcuucucacagacuuucagccccaccagcuguggacuacgcuccuaucccugaccuucauacggaccacccugucucucgacuacgcguggaagacgauggccauggcccuguccaucgugagccuguuuccccucugucuuuccacgacaagccagaaaaccacuuggcugccgguccuccuggguuccuuuggcuguaagccccugaccauguuucucauaacugagaacaagaucuggggccgcaaaagcuggcccaucaacgaggggaucauggccgugggcaucguauccauuuuguuaagcucccugcugaaaaacgacguuccguuagcggggccccucaucgccggcgggaugcugauugccugcuacguuaucagcgggagcagugccgaccugagccucgagaaggccgccgaggugucgugggaagaggaggcagagcacagcggcaccucccacaacauacuggucgagguucaggaugacgggaccaugaaaaucaaggacgaggagcgugacgacacucucaccauacuccugaaagccacccugcuagccgugucagguguauauccaaugucaauccccgccaccuuauucgugugguacuucuggcagaagaagaagcagcgcagcggggugcuaugggauacgccuuccccgcccgaggucgagcgggcaguucuugacgaugguauuuaccgaauccugcagcggggcuuauuagggagaucacaggucggaguggggguguuccaggauggcguguuccacaccauguggcacgucacacgcggcgccgugcucauguaccagggcaagcgccuggagccaucaugggcgagcgugaagaaagauuuaaucuccuauggcggaggcuggcguuuccagggcucguggaacacaggcgaagaaguccaggugaucgccguggaacccgggaagaacccaaagaauguacagacgacccccggcaccuuuaagacccccgaaggugaggugggggcgauagcgcucgacuucaagcccggaacgucggggucuccgaucgugaaccgggaaggcaagauugucggccuuuacggcaauggcgugguaacaaccuccgggaccuacgucagcgccaucgcccaagccaaagccucccaggagggccccuuacccgaaaucgaggacgaggucuucaaaaagcggaaccucacgaucauggaccugcaccccggguccggcaagacccgucgauaccugcccgcgauugugcgcgaggccauuaaacgcaagcuucguacccugaucuuagcgccgacccgggugguggccagcgagauggcggaagcccucaagggcaugcccauccgguaucaaacgacugccguaaagucagaacacaccgggcgcgaaaucguagacuugaugugccacgcuacuuucacaaugcggcuccuuucgccagugcgggugcccaacuacaacaugaucaucauggacgaagcccacuucaccgaccccgcguccauagccgcacggggcuacaucagcacccgcgucgggaugggggaggccgcagcaaucuucaugacagccacgcccccgggguccguggaagccuucccacaaagcaacgccgugauucaggacgaagagcgcgacauucccgaacgcucauggaacaguggcuaugacuggaucaccgacuuucccgggaagaccguaugguuugugccguccaucaagagcgggaacgacaucgcgaacugccuccggaaaaauggcaagcgcgugauccagcugucccggaagaccuucgacacggaguaccagaagaccaagaacaaugacugggacuacgucgucaccacggacaucagcgagaugggggcgaacuuccgcgcggaucgcgugaucgacccccguagaugccucaagcccgucauccugaaagacggccccgagcgggugauccuggccgggccgaugccagugacggucgccuccgcugcccagcgucgcggccgcaucgggcggaaccagaauaaggagggcgaccaguacaucuauauggggcagcccuuaaauaacgacgaggaccaugcacacuggaccgaggccaaaaugcuacuggauaacaucaacacgcccgaagggauuaucccagcccuuuuugaaccugagcgcgagaaguccgcggccaucgacggcgaguaccggcugcgcggcgaagcgagaaaaaccuucguggaguuaaugcgcaggggggaccuccccgucuggcuuuccuacaagguugccucugaggguuuccaguacuccgaccguagauggugcuucgacggggagagaaacaaccaggugcuggaagagaauauggacguugagauuuggacgaaggagggggagcggaagaagcuccgcccgcgcuggcuggacgcccguaccuacagcgauccgcuagcccuucgggaguuuaaggaauucgccgcuggucgccgcuccgugagcggggaccugauccuggagaucgggaaacuaccacaacaccugacccugcgcgcccaaaacgcccuugacaaccuggugaugcugcacaacagcgagcagggcggcaaggcguaccggcacgcuauggaagaauugccugacaccaucgagacauuaaugcugcucgcccugaucgccguccugaccggaggagugacucuuuucuuccucucugggaaggggcuuggcaagaccucuaucgggcuccugugcgugauggcuuccagcgcccugcucuggauggccuccguagagccccacuggauagccgccagcaucauccuggaauuuuuccugauggugcuccugauuccggaacccgauagacagcggaccccccaggacaaucagcuggcguauguggucaucggccucuuguucaugaucuuaacgguggccgccaacgaaaugggucuacuagagaccaccaaaaaggaucuggguaucgggcacguggcugcugaaaaccaucaccacgcgaccauguuagacguagaccugcgcccggccagugcauggacgcuguacgcugucgccacgaccgugaucacacccaugaugcgccauacgaucgagaauaccacggcgaacaucagccucaccgccauagccaaccaggccgccauacuuaugggccuagacaaaggcuggcccaucagcaagauggacauaggggugccccuacuggcgcuugguugcuacagccaaguuaacccgcucacgcugacagcagccgugcuaauguuagucgcccacuaugcuauuauuggucccggacuccaggccaaggccacccgggaggcccagaagcgcaccgcagccgguaucaugaagaaccccacgguggacggcaucgucaccaucgaucuugaccccgugguguacgacgccaaauuugagaagcaacucggucaaaucaugcugcugauccucugcaccucccagauccugcugaugcggaccaccugggcccucugcgagagcaucacccuggccaccgguccgcucacaacgcuaugggaagguuccccggggaaguuuuggaauaccacgaucgcuguguccauggcgaacaucuuucgcggcuccuaccuugccggcgcagggcuggcguucagccucaugaaaucacugggcgggggcagacgcgggaccggcgcccagggagagacgcugggcgagaaguggaagcggcagcucaaccagcuuagcaaguccgaauuuaacaccuacaagcgcagcggcaucauggaagucgaccgcagcgaggcuaaggagggacugaagcgcggcgaaacgaccaagcacgccgugucccgggggacggccaaacugcgcugguucgucgagcguaaucucgucaagccagaggguaaagugauagaucugggcugcggucgcggcggauggagcuacuacugugccggccugaagaaggucaccgaggucaagggcuacacuaaggggggccccggacacgaggagccaauacccauggcgacuuauggcuggaaccucgugaaacugcacuccggaaaggaugucuucuuuacgccgccugagaagugcgauacucugcucugcgacauuggggagagcucaccgaaccccaccaucgaggaggggcggacccugcgcguccucaagaugguggaaccuuggcuucggggaaaccaguuuugcauaaaaauacugaaccccuauaugcccagcgugguagagaccuuagaacagaugcaacgcaagcacggcgggaugcucgugcggaacccccugucccggaacagcacacacgaaauguacugggugucgugcggcaccgggaacaucgucucagccgugaacaugacaucccgcaugcugcucaaucgguucaccauggcccaccgcaagccuacauacgagcgggacguggaccuaggagccggaacccgccacgucgcgguggagcccgagguggcuaacuuggacaucaucgggcagcggauagagaacaucaaaaaugagcauaagagcacuuggcacuacgacgaggacaacccguauaagacaugggccuaucacggcuccuacgaggucaaacccagugggagcgccagcuccauggugaacggagugguacgccuccugacaaagcccugggacgugauccccauggucacccagauagcgaugaccgacaccacgccguuugggcagcagcgaguuuucaaagagaagguagacacaaggacgccacgggcuaaacgcgggaccgcgcagaucauggaagucacggccaaguggcuguggggcuuccucagccggaacaagaagccccgcauauguacccgggaggaguucacccgcaaggugcggucuaacgccgcuaucggggccgucuuugucgacgagaaccaguggaauagcgccaaagaggccguggaagacgagagguucugggaccuagugcaccgggagcgcgagcugcacaaacagggcaagugcgcaacgugcgucuacaacaugaugggcaagagagagaagaaacucggcgaguucggcaaagcuaagggaucacgcgcgaucugguacauguggcugggcgcuagauuccuggaguucgaggcccucgguuucaugaacgaggaccacugguucucuagagaaaacucccuguccggcguggaaggcgagggcuuacauaagcucggcuauauccugcgcgauauaagcaaaauaccgggaggcaauauguaugccgaugacacggccgggugggacacccggaucacggaggacgacuuacagaacgaagcgaagauuaccgacaucauggagcccgagcaugcgcuucuagcuaccaguaucuucaaguugaccuaccaaaauaaggugguccgcgugcagcggccggccaaaagcggcaccgugauggacguaauaucccgccgggaccagcgcgggagcggccaggugggcaccuaugguuuaaacacguucaccaacauggaggugcaguuaaucagacaaauggaguccgaagggaucuucagccccuccgagcuggagaccccgaaccuugccaagcgcguacuggauuggcuggaaaagcagggagcggagcggcucaagcgcauggccaucagcggcgaugacuguguagugaaacccaucgaugaccgguuugcaacugcccuuacggcacugaacgacauggguaagguccguaaggauaucccacagugggaacccagcaagggcuggaaugacuggcagcaggucccguuuugcucgcaccacuuucaccaguugauaaugaaggauggucgggagaucguaguccccugccgcaaucaggaugaguuggugggacgggcgcgcgugucccagggcgccggguggagccuccgggaaacugccugccucgggaaguccuacgcccagauguggcaguuaauguacuuccaccgccgggacuugcgccuugcggcgaacgccaucugcagcgcgguccccguggacuggguacccaccagccgcaccaccugguccauacacgcccaccaccaguggaugacgaccgaggacaugcugagcguauggaacaggguguggauagaggaaaacccguggauggaggacaagacucacgugucuagcugggaggagguccccuaccugggaaagcgugaggaccaguggugcggcucccucaucggccugaccgcccgggccacgugggccacgaauauucagguggccaucaaccaaguuaggagauugaucgguaacgaaaacuaccucgauuacaugacuagcaugaagcgcuucaaaaaugagucagaccccgagggggcccuaugguga

SEQ ID NO: 24084 - RNA, 9879 nt, Artificial Sequence
  derived and/or modified CDS sequence (opt11) from DENV-1__EU660390__SS-prME
ucuguuaccaugcugcucaugcugaugccuaccgcccuggccuuccaucucaccacccgugggggcgagccccacaugauagugucaaagcaggagcgcggaaagagccuacuguucaagacaucagcgggcgucaacaugugcacccugaucgcaauggaccugggagagcuuugcgaagacacgaugacauacaaguguccccggaucacagaggccgagcccgacgacguagacugcuggugcaacgccaccgacacgugggucaccuacgggacauguagccagaccggugagcaucggcgcgacaagcgguccguggcguuggcgccccacgugggccuggggcuggagacgagaaccgaaacguggaugagcucugagggcgccuggaagcagauccagagaguagagacaugggcccuccgccacccuggcuuuacggugaucgcccuguuccuggcucacgcaauaggcaccagcaucacucagaaggggaucaucuucaucuugcugaugcugguuacacccucaauggccaugcggugugugggcaucggcagucgcgacuuuguggagggacucuccggcgccacguggguugacgucgugcuagagcacgggagcugcgugacgaccauggccaaggacaaacccacccuggacaucgagcugcugaaaacggaagucacuaaucccgcgguacugaggaaacucuguaucgaagcgaagaucuccaacaccacgacggacagccgcugcccaacccagggggaagccacacugguggaggagcaggacgccaacuucguaugccggcggaccuuugucgaccguggcugggggaacggcugcgggcuguucggcaagggguccuugaucaccugcgccaaguucaagugcgugaccaaguuagagggcaaaauuguccaguacgagaaccugaaguacagcguuaucgugaccguacauaccggcgaccagcaccagguggggaacgagagcacagagcacgggaccaccgccaccaucacaccucaggcucccacaaccgagauccagcucaccgauuacggggcccuaacccuggauugcucgccccguacgggccuugacuucaaugaaaugguacuccuuaccaugaaggagaaaagcuggcucgugcauaagcagugguuccuggaucugccccugcccuggaccagcggcgccagcaccucccaggaaacauggaaccggcaagaccucuuggugaccuuuaaaaccgcccacgcuaagaagcaggaggugguggugcugggcagccaggagggggcaaugcacaccgcccuuacgggggcgaccgagauccagacuucaggcaccaccaccaucuucgcugggcaucugaagugucgccucaagauggacaagcugacgcucaagggaaugagcuacgucaugugcacagggucauucaaguuggagaaggagguagcggagacgcagcacggcaccgugcugguccagaucaaguacgaggggaccgacgcccccugcaaaauccccuucucuacccaagacgagaagggggugacgcagaauggccggcugaucacggccaacccgaucgugacugacaaagaaaagccaguaaauaucgaggccgagccgccuuuuggggaauccuacauagugaucggugccggcgaaaaagcccugaaacucagcugguucaagaagggguccagcaucggaaaaauguucgaggccaccgcacgaggagcccgccguauggcgauccugggugacaccgccugggacuucggcucuaucggcgggguguucacgagcgucgggaagcuaguccaccagaucuuuggcaccgcuuacggaguccuguucuccggaguaagcuggacgaugaagaucgggaucggcguuuuacucacguggcuuggccucaacucccguagcaccucccuguccaugaccugcauugccgugggccucgucacccuguaucugggcguuauggugcaggcggacagugguugcgucauuaauuggaagggccgggaacucaaaugcggaagcggcauuuuugucacaaacgaggugcacacauggaccgagcaguacaaguuccaggcggacagcccgaagaggcuauccgcggccauuggaaaggccugggaggagggggucuguggcauucgguccgccacccggcuggagaacaucauguggaaacagaucuccaaugagcuuaaccacauauugcuugagaacgacaugaagcucaccguuaucgugggggacguggcgggcauccugggacagggccguaaaaugauucgcccccagcccauggaguacaaguacaguuggaaguccuggggcaaggccaagaucaucggggccgacgcacagaauacaaccuucaucauugacgguccaaacacaccggaaugccccgacgaccagcgcgcguggaauaucugggaaguggaggacuacggguucggcaucuucaccacuaacaucuggcuaaagcuccgugacucguauacacagguaugcgaccaccggcugaugagcgccgccaucaaagacagcaaggccguucaugccgacaugggcuacuggaucgagagcgagaagaaugagaccuggaagcuggcgcgcgcaagcuucaucgaggugaagaccugcaucuggcccaagucccacacguuguggagcaacggggugcuggagagcgagaugaucauaccuaagaucuauggcgggccgaucagccaacacaacuaccggccuggcuauuucacccagaccgccgggccguggcaccugggcaagcucgaguuagacuucgaccugugcgaggguaccacagucgugguggacgagcacugugggaaccgugggccgucccuccggacaaccaccgucaccgggaagauuauacacgaauggugcugccggagcugcacgcugccgccccuacgguuuagaggugaggacgggugcugguauggcauggagauccggccagugaaggagaaggaggagaaccucguaaaguccauggugagcgccggcucgggggagguggacuccuucagccugggccuccuuugcaucucgaucaugauagaggaggugaugcgcagccgguggucucgcaagaugcucaugaccggcacacuugccguguuuuuccuccugauuaugggccagcugacuuggaacgaucucaucagacucugcauaauggugggcgcuaacgccagcgaucggaugggcaugggcaccaccuauuuggcccucauggcaaccuucaaaaugcggccgauguuugcagugggguuguuauuucggcgccugaccucccgggaggugcugcuucucaccaucggauugagccuuguagcguccguggagcucccgaacagccuggaagagcugggcgacggccuugccaugggcauuaugauccugaagcuuuuaaccgacuuccagucacaccaguugugggccacucugcucagccucacguucauuaagacgacauuuucccugcacuacgccuggaagacgauggccaugguccucucgaucgucucccuguucccccugugccucucaacgaccagucagaagaccaccuggcuucccguccugcuugguagccuuggcugcaagccgcugacgauguucuugaucgccgagaauaaaauuugggggcgaaaaagcuggccgcugaacgagggcaucauggccguaggcaucguaucgauccugcucagcagccuacugaagaacgacguaccccuggccggcccccugguggccggcgggaugcugaucgcgugcuauguuaucagcggcucgucugccgaccucucccuagagaaggcugccgaggucuccugggaggaggaggcugagcauuccggugcgucccacaacauccugguggaggugcaggacgacggcaccaugaagaucaaggaugaggagcgggacgacacgcucacuauccuauuaaaggcaaccuugcuggccgucucugguguuuauccccugagcauucccgcuacucuguuugugugguacuucuggcagaagaagaaacagcgcuccgguguccugugggacacccccagcccgccugaggucgagcgggcugugcucgaugauggaaucuaccgaauuaugcagcgagggcugcucggccgcucacaggucggggugggcguguuccaggagaacgucuuccacaccauguggcaugugacccgcggggccgugcugauguaccagggaaagcgccuggaaccuagcugggccagcgucaagaaggaccugauaagcuacggcgggggcuggcggcuacgcgggagcuggaacacaggcgaggagguccaagugaucgccgucgaacccgggaagaaucccaagaaugugcaaaccgccccgggaaccuucaagacccccgagggcgaggugggcgccauugcccuggacuucaagccuggcacgagcgggucccccaucguuaaccgggagggcaagaucgugggccucuacgggaacgguguggucaccaccagcgggaccuacgugagcgccaucgcacaggccaaggcgagucaggagggcccgcuccccgagaucgaggaugagguguuucgaaagcggaaccugacaaucauggaccuccacccagggagcggcaaaacccgccgguaccugccggccaucguccgugaggccaucaagcgcaagcugcggacucucauccuggccccuaccaggguggucgccucagagauggcggaagcccugaaaggcaugcccauccgguaucagacgacagccgucaagagcgagcacaccgggaaagagaucguagaccucaugugccaugccacuuuuacgaugagacugcugucuccggugagaguuccgaacuacaacaugaucaucauggaugaagcacauuucaccgaccccagcagcaucgcggcccgcggcuauauuagcacgcggguggggaugggcgaggccgccgccaucuucaugaccgcaacgccgcccgggucaguggaggccuucccgcagagcaacgccguaauccaggacgaggaacgcgacaucccugagagguccuggaauagcggauaugaguggauaaccgauuuuccaggcaagaccguaugguucgugccauccaucaaaagcgggaaugauauugccaacugccuacgcaagaacgggaagcgggucauccagcugucccgcaagaccuucgacacggaauaccagaaaaccaagaauaacgacugggacuacguaguuaccaccgacaucagcgaaaugggcgcaaacuuccgggcggaucgcguaaucgacccgcgcagauguuuaaagcccguuauccuaaaagauggccccgagagggugaucuuagccggucccaugcccgucacgguugcuuccgccgcucagcggcggggcaggauuggcaggaaucacaauaaggagggggaccaguacauauacaugggccaacccuuaaacaaugaugaggaucacgcccacuggaccgaagcaaaaauguuacuggacaacauuaacacaccggaggguaucaucccggcccuguucgagccggagcgggagaagucggccgcgguggacggagaguaccgccucaggggggaggcgcgcaaaaccuucguagagcucaugcgccgcggcgaccugccaguguggcuguccuacaaggucgcaucagaaggcuuccaguacucugaccgacgcugguguuucgacggggagcggaacaaccaggugcuggaggaaaacauggacguugagaucuggacgaaggagggagagcgcaaaaagcugcgcccccgauggcucgaugcccggaccuacuccgaccccuuagcacugcgcgaauucaaggaauuugcagccgggcgucgcucugucuccggcgaccucauccuggagaucggaaaacuaccgcaacaccucacccaacgggcccagaacgcgcuggacaaccuggugaugcuccacaacagcgagcagggcgggcgcgcguaccgacacgccauggaggagcugcccgacaccaucgagacgcugaugcucuuagccuuaaucgccguccucacggggggcguaacacucuuuuuccuuuccgggcgcggccucggcaagacgagcaucgggcugcugugcguuauggccucaucaguacuccuuuggauggcgagugucgagccccacuggaucgccgccagcaucauccuggaguucuuccucaugguacuccugauacccgagccggaucggcagcgcaccccgcaggacaaccagcucgcauacgugguaaucggacuccuauuuaugauccucacgguggccgcgaaugagauggggcugcuggagacgaccaagaaggaucucggcaucgggcacguggcugucgagaaccaccaccacgcugccaugcucgauguggaccuacaccccgcguccgccuggacccucuacgcaguggccacgaccaucaucaccccuaugaugcgccacacgaucgagaacacgaccgccaauauuagccuaaccgccaucgcgaaccaggccgcaauucugaugggccuugauaaaggauggccgauaaguaagauggacaucggagucccccuccuggcccucgggugcuacagccaggugaacccccuaacccugacggcggccgugcucaugcugguagcccacuacgcuaucaucgggccuggccugcaggccaaagcgacccgugaggcccaaaagcgcacagccgcagggaucaugaaaaaccccacuguugacgguaucguggccauagaccucgaccccgucguguacgacgcgaaauucgagaagcaacugggccagaucauguugcuaauuuugugcacgucccagauccuccucaugcguaccaccugggcccugugugagagcauaacccuggcgaccgggccucucaccacccugugggagggguccccaggcaaauucuggaacaccacaaucgcuguaucuauggcuaacauauuucgcgguuccuaccuggcgggagcugggcucgccuucagccucaugaagucccugggcgggggccggagagggaccggcgcccagggcgagacccucggggaaaaauggaagcgucagcugaaccaacuguccaagagcgaguuuaacacguacaagcgcuccggcaucauggagguagaccggagcgaggccaaggaaggguugaaaaggggugagacgacgaagcacgcagugucccgagggaccgccaaacuccgcugguucguagagcggaaccuuguaaagccugagggaaaggugaucgacuugggcugcgguagaggcggguggagcuacuacugugcaggcuugaagaaggucacugagguuaagggauauacgaagggcgggcccgggcacgaggagccaaucccgauggccaccuaugguuggaaccuggugaagcugcacuccggcaaggacguguucuucaucccccccgagaagugcgacacccugcugugcgauaucggugaaucgucccccaacccgacgauugaagaggggcggacgcugaggguccucaagaugguggagcccuggcugcggggcaaccaguucugcaucaagauccugaaccccuacaugccgagcgugguugagacacucgagcaaaugcagcgcaaacacggcggaaugcuagugcggaacccgcuguccaggaacagcacccacgaaauguacugggucucuuguggcaccgggaacauugugucggccgucaacaugaccucccgaauguugcugaaucgcuuuacgauggcucaccguaaacccaccuacgagcgggacgucgaucugggcaccgggaccagacacguugccguggaaccggagguagccaaccucgacaucaucgggcaacggaucgaaaacaucaagcacgagcacaagagcacuuggcacuacgacgaggauaaucccuacaagacgugggcuuaucacggcuccuacgaaguuaagccgagugggagugccucaaguaugguuaacggcgucguuaaguuacucaccaagcccugggacguaauccccaugguuacccagaucgcgaugacggacaccacccccuucggccagcaacgcgucuuuaaggagaagguggacacccggacgccgaaggccaaacgagguaccgcgcagaucauggaggugacagcccgguggcuguggggcuuuuugucccgcaacaagaagccucgcaucugcacccgagaggaauucacgcggaaggugcguagcaacgcggccaucggggccguguucguugacgagaaucaauggaacuccgcuaaggaagcgguggaagacgagagguucugggaucuagugcaccgcgagagggaacuccacaaacagggaaaaugugccaccugcgucuacaacaugauggggaagcgcgaaaagaagcugggcgaguucgguaaagccaaaggcucccgggccaucugguacaugugguugggcgcccgauuccucgaguucgaggcgcuaggauuuaugaaugaagaccacugguucucccgugagaacagccuguccggcguggagggggagggccuccacaaguuaggguacauucugcgcgauaucucuaaaauucccggcggcaacauguacgccgacgacaccgccgggugggacacacgcaucacagaggaugacuugcaaaacgaagccaagauaaccgauaucauggaaccugagcacgcccuccucgcgaaggcgaucuucaaacuuaccuaccagaacaaagugguccggguucaaagaccugccaaaaacgguacagugauggacgugaucuccaggagagaccagcgagguuccggacaaguuggcacguauggccugaauaccuucacgaacauggaggcgcaacugauucgccagauggaguccgagggcaucuucagcccguccgagcuggagacaccaaaccuggcugagcgggcguuagacuggcucgagaaguacgguguggagcgcuuaaagaggauggccaucucuggcgacgacugcguagugaagccgauugacgaccgcuucgccaccgccuugacggcacucaacgacauggggaaggugaggaaagacaucccucagugggagcccuccaaggguuggaacgauuggcaacaggucccauuuuguagucaucacuuccaccagcugauaaugaaggacggccgcgagauuguagugccaugccggaaccaggacgagcucguugggcgcgcgcgggugagucaaggcgccggguggagccuccgcgagaccgccugccuggguaaaagcuaugcccagauguggcagcugauguacuuccaccggcgcgaccuccggcuggcggccaacgccaucugcuccgccgugcccgucgacugggugcccaccagccgcaccacgugguccauacacgcccaccaccaauggaugacaacagaggacaugcuguccguguggaaccgugucuggaucgaggagaaccccuggauggaggacaagacacauauuucaagcugggaagacgugccguaccucgguaagcgggaggaccaguggugcggcucccuuaucggccugacugcgcgagcgaccugggccacuaacauucagguggccauuaaccagguccggcgcuugauaggcaaugagaacuaccuggauuauaugaccuccaugaagcguuucaagaaugaauccgaccccgagggcgcguuaugguag

SEQ ID NO: 24085 - RNA, 9879 nt, Artificial Sequence
  derived and/or modified CDS sequence (opt11) from DENV-1__EU660391__SS-prME
agcgugaccaugcugcucaugcuuaugccaaccgcccuggccuuccaccucacgacccggggcggugagccucacaugauaguuaguaagcaggagcggggcaagagccugcuguucaaaaccagcgcaggggugaacaugugcaccuugaucgccauggaccugggcgaguucugcgaagacaccaugacauacaagugccccaggauuaccgaggccgagccagacgauguggacugcuggugcaacgccaccgacacgugggugaccuaugggacgugcagccagaccggcgagcaccggcgggacaaacgguccguggcccuggcgccccacguggggcuagggcuggagacgcgcaccgagaccuggaugucuucagagggcgcuuggaagcagauucagcggguugagaccugggccuugcgucaccccggguucacggugauugcacucuuuuuagcgcacgccaucgggaccagcaucacccagaaggggaucaucuucauucugcucaugcugguaacacccuccauggccaugcggugcguaggcaucggcagccgggacuucguggaggggcuguccggagccacguggguggacguuguguuggaacacgggagcugcguuacuacaauggccaaggauaagccgacccuggacaucgagcugcugaagacggaggucaccaaccccgcggugcugcggaaacugugcaucgaggccaagaucagcaacaccaccacggacagccgcugccccacccaaggcgaggccacccucguggaggagcaggacgccaacuucgucugccggcgcaccuucguagaccggggcugggggaacggcugcgggcuguucggcaagggaucccugauaacgugcgccaaauucaagugcguuacuaagcucgagggcaagauaguccaguacgagaaccugaaguacagcgugauagugaccguccacaccggcgaccagcaccagguggggaacgaguccacggagcacggcaccaccgcuaccaucacaccacaggcccccucgacagagauucaacugaccgacuacggcgcccucacucucgacugcaguccgagaaccggccuggacuucaacgagaugguccuucugacuaugaaggagaaauccuggcuggugcacaagcagugguuccucgaccugccguugcccuggacgagcggcgccagcaccagccaagagacauggaacagaaaggaucuccucgugacguucaagaccgcucacgcuaaaaagcaggaggucguggugcugggcucccaggagggcgccaugcacaccgcccugacaggggccacagagauccagacaagcggaaccaccacgaucuucgccgggcaccugaagugucgccugaaaauggauaagcucacccugaagggcauguccuacgucaugugcaccgggucguucaaacuggaaaaggagguggcggaaacccagcacggcaccgugcucguccagaucaaguacgaggggaccgacgccccaugcaagauccccuucagcacccaggacgagaagggagugacccagaacggccggcucauuacggccaacccgaucgugaccgacaaggagaagcccgucaacaucgaagccgagccacccuucggcgagagcuacauugugauuggcgcuggcgagaaggcccugaagcuguccugguucaagaaggggagcuccaucggcaagauguucgaggccaccgcucgcggugcacggcgcauggcaauccucggcgacacggccugggauuucgggaguauaggcggcgucuucacguccgucgggaaacuggugcaccagaucuuuggcacugccuacggggugcuguucagcgguguuuccuggaccaugaagaucgggaucggcgugcuccugaccuggcugggacucaacagcaggucuacgagccugucuaugacaugcaucgccguggggcuagucacccuauaccugggcgugauggugcaggccgacagcgggugcgucaucaacuggaagggccgggagcugaagugcgggagcggaaucuuugugaccaacgaggugcacaccuggaccgagcaguacaaguuccaggcggacuccccuaagcgccucagcgccgccaucggcaaggccugggaggaggggguuugcggcauccggagugccacucgccucgagaacaucauguggaaacagauuuccaacgagcugaaccauauccucuuggaaaaugacaugaaguucaccguggugguuggggacguggcgggcauccuggcccagggaaagaagaugauccggccccagcccauggaguacaaguauucguggaaauccuggggcaaagcuaagaucauuggcgccgauguucaaaacaccacguucauuauagacgggcccaacaccccggagugccccgacgaccagcgcgcguggaacauuugggaggucgaggacuacggcuucgggaucuucacgaccaacaucugguuaaaacugcgggacuccuacacccaggugugugaccaccgccuuaugagcgccgcgauuaaagauuccaaggccgugcacgccgacaugggcuacuggaucgagucggagaagaacgagaccuggaagcucgcgcgggccuccuuuauagagguuaagaccugcauuuggccuaaaagccacacccugugguccaacggcgugcuggagagcgaaaugaucauccccaagaucuacgguggccccauaucccaacacaacuaccgacccggguauuucacgcagaccgcugggcccuggcaccucggaaagcuggagcuggacuucgaccucugcgagggcaccaccguggugguggacgagcacugcggcaaccgcgggccgagccugcgcacuaccaccgugaccggcaagaucauccacgaguggugcugccgguccugcacgcugccgccccugcgcuuuaagggggaggacggcugcugguacgggauggagauccggcccgucaaggaaaaggaagagaaccuggugaagagcauggugucagccggcucgggcgagguagacagcuuuuccuuagggcuccugugcaucagcaucaugaucgaggaggugaugcgcucccgauggagccgcaagaugcucaugacaggcacccucgccguguucuuccugcugaucauggggcaacucacauggaaugaccugauccggcugugcaucauggucggcgcgaaugccuccgaccguaugggcaugggcacgaccuaccucgccuuaauggccaccuucaagaugcgcccgauguucgccgugggccuccuguucagacgacugacgagcagggaggugcuacucuugaccauagggcugucccucgucgcuaguguggagcugcccaauucccuggaggaacuaggcgaugggcuggccaugggcaucaugauccuaaaguuauuaaccgauuuccaaagccaccaacugugggccacccuccugucccugaccuuuaucaagacgacauucagccugcacuaugccuggaagacaauggcaaugguuuugucuauagugagccucuucccccucugccuguccaccacgucucagaagaccaccuggcugcccgugcuccuggguucccugggaugcaagcccuuaaccauguuccugaucgccgagaacaagaucuggggccgcaaguccuggccccugaacgaggggaucauggccgucggcauagugaguauccuucuguccagccugcucaagaaugacgugccccuagccgggccccugaucgcaggaggcaugcuuaucgcgugcuacgucauuuccgggaguuccgccgaccugagccuagagaaggcugccgaaguuucaugggaagaagaggcggagcauagcggcgcgucccacaacauccuaguggagguccaggacgacgggacgaugaagaucaaggacgaggagcgugacgauacccugaccauccuguugaaggccacccugcuggccguaagcggcguguacccccucucaauacccgccacucuguucgucugguacuuuuggcagaagaagaagcagcgaagcggggugcugugggacacgcccagcccgcccgagguggagcgggccguccucgacgauggcaucuaccguaucaugcagcggggccugcugggucgcagccagguuggcgugggcgucuuccaggagaacguguuccacaccauguggcaugucacccggggcgcgguacugauguaccaagggaagcgacuagagcccuccugggccagcgugaaaaaggaccugaucuccuacggcggaggguggcgguuacaggggagcuggaacacuggugaggaggugcagguaaucgcaguggagcccggcaagaacccuaagaacgugcagacggcccccgggacuuucaagacguccgagggcgaggucggcgcaaucgcgcucgacuucaagcccgggacguccggcagccccaucgugaacagggaggggaagaucgugggccucuacggcaacggggucgugacgaccucaggcaccuacgugagcgccaucgcccaggcgaaggcgucccaggacgggcccuuaccggagaucgaggacgaggucuuccggaagcgcaaccuuaccaucauggaccuacacccaggcagugggaagacucggcgcuaucugcccgccaucgugcgggaggcuaucaagcgcaagcuccggacgcugauauuagccccaacccgcguggucgccuccgagauggccgaggcccuuaaaggcaugcccauccgcuaccaaaccacugccguaaaguccgagcacaccggcaaggagaucguggaccuaaugugccaugccaccuucaccaugaggcugcuuucccccguccgcguacccaacuacaauaugaucaucauggacgaggcccacuucacggauccgagcucgaucgcggcccggggcuacaucagcacccgcgugggaaugggggaggccgcagccaucuucaugaccgcgacgcccccgggauccguggaggccuucccccagagcaacgcggugauccaggacgaagagcgggacaucccugaaagauccuggaacagcggguaugaguggaucaccgacuuccccggcaagaccguaugguucgucccaucuauaaagagugguaacgacaucgccaacugccugcggaagaaugggaagcgcgucauucagcuuucccggaagaccuucgacaccgaauaccagaagacgaaaaacaacgacugggacuacguggugaccaccgacauaagcgaaaugggcgcaaauuuccgcgccgaccgggugauugacccccgcagaugccucaagccggugauucugaaagacgggcccgagcgcguuauccuagcuggccccaugcccgugaccguagccuccgccgcgcagcgucgcgggcggaucggucgcaaucacaacaaggagggcgaccaguacaucuacauggggcaaccgcucaacaacgacgaggaccacgcccacuggacggaggccaagaugcugcuggacaacaucaauaccccugaaggcaucauccccgcccucuucgaacccgagcgagagaaguccgccgcgaucgacggcgaguaccgccuccgcggcgaggcaaggaaaaccuucguggagcugaugcgccgcggggacuuaccgguguggcugagcuacaaggucgccucagagggcuuccaauacagcgacagacgguggugcuuugacggcgagcguaacaaucaggugcuggaagagaacauggacguggagaucuggaccaaggagggggagcggaagaaacugcgcccccgguggcuggacgcccgcacauacuccgacccgcuggcccuccgggaguucaaagaguucgccgccggccgccggagcgucucgggagaccugauacuggagaucggcaagcugccgcagcaccuuacccaacgcgcccagaacgccuuagacaauuuggugaugcugcacaacagcgagcaggguggacgggccuaccgccacgcgauggaggaacugccugacaccauagagacccucaugcugcuugcacucauagcggugcugacgggcggggucacccuguucuuccucuccggccgggggcugggcaaaaccagcaucggccugcucugcgugauggccagcagcguguuacuguggauggcguccguagagccccacuggaucgccgccagcaucauccucgaguucuuucugaugguacugcucauacccgagcccgaccgccagcggaccccgcaggacaaccaguuagccuacguggucaucgggcuccucuuuaugauccugaccguggccgcgaacgagaugggccuucucgaaaccaccaaaaaagaucuggggaucgggcacguggccgucgagaaucaccaccaugccgccaugcuggacguggaccuccaccccgcuuccgcuuggacguuauacgccguggccaccacgaucaucacccccaugaugcgccacaccaucgagaauaccacggccaacaucagccugaccgcgaucgcgaaccaggccgccauccucauggggcuggauaagggcuggccgaucuccaagauggacaucggagucccgcuacucgcccugggguguuacagccaggugaacccccugacccucaccgcggcggugcuuauguugguggcccacuaugccaucauaggcccaggacugcaggccaaggcgacgcgggaagcucagaaacgcacagccgccggcaucaugaagaaccccacgguggacgggauaguggcuaucgaccuggacccugucguauacgacgcgaaguucgagaaacagcugggccagaucaugcuccugauccuuugcaccucccagauucuccugaugcgcacgaccugggcucugugcgagagcaucacccucgccaccggcccgcugacgacccugugggaggggucaccuggcaaguucuggaacaccacuaucgccgugucgauggccaacaucuuccggggcucguacuuggcuggcgccggacuggcauucucccugaugaagucgcucgggggcggacgccggggcacgggggcccagggcgagacgcugggugagaaauggaagcgacagcugaaccaauuauccaaguccgaguucaacaccuacaagcgauccggaauaauggaggucgaccgcagcgaggccaaggaaggccugaagaggggggaaaccacgaaacacgcgguguccagaggcaccgccaaacugcggugguucguggagcgcaacuuggucaagccagaggggaaagugaucgaccugggcugcggccgcggcggguggagcuacuacugcgccggguugaagaaggugaccgaggucaagggauacacgaagggcgggcccggccacgaggagcccauccccauggccacguacggguggaaccuggugaaacuccauuccggcaaggacguguucuucaucccgcccgagaagugcgauacgcuacugugcgauaucggagaaagcagucccaaucccacaaucgaggagggccgcacccuuaggguguuaaaaaugguggagccguggcuccgcgggaaccaguuuuguaucaagauacucaaccccuacaugcccuccguggucgagacgcuggagcaaaugcagcggaagcauggcgguaugcucguacgcaacccacucucccggaacagcacccacgagauguauuggguguccugcgguacuggcaauaucguuucugcggugaacaugacgucacgcaugcugcugaaccgcuucaccauggcgcaucgcaaaccaaccuacgaacgcgacguggaccucggggcugggacccggcacgucgccguggagcccgagguggccaauuuggacaucaucggccagcgcauagagaauaucaaguacgaacacaagagcacuuggcacuacgaugaggacaaccccuacaagaccugggccuaccacggcuccuacgaggucaagccaagcgggagcgccuccagcauggugaacggcguagugaagcugcucacgaagccgugggacgugauccccaugguuacacagaucgccaugaccgacaccacgcccuucggacagcagcggguguucaaggagaagguggacacccgcacccccaaggccaagcgggggacagcccagaucauggaggucacggcgaaauggcuguggggguucuuaucccgcaacaagaagccacggauaugcacccgcgaggaguucacccggaaggugcguagcaacgcagccaucggcgccguuuucgucgacgaaaaccaguggaacuccgcaaaggaggccguggaagacgagcgguucugggaccucgugcaccgcgagcgggagcugcauaagcaggguaaaugugcaaccugcgucuauaacaugaugggcaagagggagaagaagcugggggaguucggcaaggccaaggggagccgggcaaucugguacauguggcucggcgcgcgcuuccuggaguuugaggcauugggcuucaugaacgaggaccacugguucucccgggagaauagccucucgggcguggagggcgaggggcugcacaagcuugguuacauccuccgcgacaucagcaagauuccaggcggcaacauguacgccgacgacacggccggcugggacacccggaucaccgaagacgaccugcagaacgaggccaagaucacagauauaauggagccggaacacgcucuccucgccaaguccaucuucaaguugacguaccagaacaaggugguccgcguucagcgcccggccaagaaugggacagugauggacgucaucagccgccgcgaccaacggggcaguggccaggugggaaccuauggccucaacaccuucacgaauauggaggcgcagcucauccgccagauggagagugaggggaucuucucccccagcgagcuggagacccccaaccucgccgguagggugcucgacugguuagagaagcacggugucgagagacugaagcggauggcgauauccggugacgacugcgucgugaagcccaucgacgaccgcuucgcgaccgcccucaccgcacugaacgacauggggaaaguccggaaggauaucccgcagugggagccuagcaagggcuggaacgauuggcagcagguccccuucugcucacaccacuuucaccaacugaucaugaaggacggccgcgagaucgucguccccugucggaaccaggaugagcucgucgggcgcgcccgugugucccagggcgcgggguggucacugcgcgagacggccugccugggcaagagcuaugcucagauguggcaguuaauguacuuccaccggcgcgaccugcggcuggccgcaaaugccaucugcagcgccgucccaguggacuggguuccaaccucccgcaccaccuggagcauccacgcucaccaucaguggaugacgacagaggacaugcucucuguauggaaccgggucuggaucgaggagaauccguggauggaggacaagacgcauaucagcuccugggaggacgugccauaccuggggaaacgcgaggaucaguggugcggcagucugaucggccucaccgcccgggcgacgugggcuaccaacauccaggucgccaucaaccaagugaggcgcuuaaucggaaaugaaaacuacuuagauuacaugaccuccaugaaacgguucaagaaugagagcgacccagagggugcccucugguga

SEQ ID NO: 24086 - RNA, 9879 nt, Artificial Sequence
  derived and/or modified CDS sequence (opt11) from DENV-1__EU660393__SS-prME
agcguuaccaugcugcucaugcugaugccgaccgcccucgccuuccaccuaacaacgcgaggcggggagccacacaugaucguguccaagcaggaacggggcaaaagccuccuguucaaaacauccgcaggggugaacaugugcacucugaucgccauggaucuuggcgagcugugcgaggacaccaugacauauaaguguccccggaucacugagacggaacccgacgacguggacugcuggugcaacgccacggacaccugggugaccuauggaaccugcagccagacaggcgagcacaggcgcgacaagcgguccguagccuuggcuccccauguggggcuggggcuggagacgagaacugagaccuggaugagcagcgagggcgcguggaagcagauccaacgggucgagacgugggccuugcgccaccccggguucaccgugaucgcccuguuccuggcucacgcgauaggcaccucgaucacccagaaagggaucaucuuuauccucuuaaugcuggugacgcccucaauggcuaugcggugcgucggaauaggcucacgcgauuuuguggagggucucucaggcgccaccuggguggacgucguccuggagcacgggagcugcgugaccacgauggcaaaagacaaacccacacuggacaucgaacuccugaagacugaggugaccaaccccgccguucugcguaagcucugcaucgaagcgaagauaucaaacaccacgacagauagccguugcccaacccagggagaagccacccugguggaggagcaggacgccaauuuugucugccggcgcacguucguggaccggggcugggggaauggcugcggucuguucggcaagggaucccuuaucacgugcgcgaaauucaaaugcguaaccaaguuggaggguaaaaucguccaguacgagaaccugaaguacucagugaucgugaccguccacacaggcgaccagcaucagguggggaacgaguccaccgagcacgggacuaccgccaccauaacgccacaagcacccaccacugaaauccagcucaccgacuauggggcgcugacucucgauuguucgccgcgcacaggccuugauuucaacgagaugguccuguuaacuaugaaggagaaaucuuggcucguacacaagcagugguuccuggauuuaccucucccauggaccucaggggccucaacaucccaggaaaccuggaaccggcaggacuugcuggucaccuucaaaaccgcccacgccaagaagcaagaagugguggugcugggcagccaggagggcgcuaugcacacggcccugaccggagccaccgagauacagaccuccggcacgacgaccaucuucgcagggcaccucaagugucgccugaagauggauaaacugacccugaagggcaugucuuaugucaugugcacugggagcuucaagcucgaaaaggagguggccgagacccagcacggcaccgugcugguccagaucaaguacgagggcaccgacgcgcccugcaaaauacccuucagcacgcaggacgagaagggaaucacccagagcgggcggcugaucacugccaauccgaucgugaccgauaaggagaagcccgugaacaucgaggcagaaccgccauucggggagucauacaucauuaucggcgccggcgagaaggcccuaaagcuauccugguucaagaagggaagcuccaucggcaaaauguucgaggccacugcacgcggagcccggcgaauggccauccugggggauaccgcaugggauuucgggagcaucggaggcgucuucaccuccguggggaagcuugugcaccagaucuucggcacugcuuacgggguguuguucucuggcguguccuggacgaugaaaaucgguauuggcguacugcugaccuggcucggccugaacucacgauccaccucucugucaaugaccugcaucgccgucgggcucgugacgcuguacuuaggcguuaugguucaggccgacucugguugugucaucaacuggaagggccgggaguugaagugcgggagcgggauauucgugacaaacgagguccacaccuggacugagcaauacaaguuucaggccgacucgcccaagcgccugucagcagccaucggcaaggccugggaggagggagugugcggcauaagguccgccacccgccuggagaauaucauguggaagcagauuucgaacgagcucaaccacauccugcuggagaacgauaugaaauuuacggugguggugggggacguggccggcauccucgcccaggggaagaagaugauccggccacagcccauggaguacaaguacagcuggaaguccuggggcaaggccaagauuaucggcgccgacguccagaauaccaccuucaucaucgacgggccgaacaccccggagugccccgacgaccaacgcgcauggaauaucugggaggucgaggacuacgguuucggcaucuucacgaccaacaucuggcugaaacugagggacuccuacacccagguaugcgaccaccgccucaugagcgcggcuaucaaggacuccaaggccguccacgccgauaugggcuacuggauugagagcgagaagaacgagaccuggaaacuggcacgggcgucauucauagagguuaagaccugcaucuggcccaaaagccacacccuguggucaaacgggguccucgagagcgagaugaucauccccaagaucuacggaggcccgaucagccaacacaacuaccggccuggguacuucacacagaccgccggccccuggcaccuggguaagcuggagcuagauuuugaccugugcgaggguacgaccguugugguagacgagcacuguggaaaccgagggccgagccugagaaccaccaccgucaccggcaaaauuauccacgaauggugcugucggucaugcacccugccgccccuccgcuuccgcggggaggauggcugcugguauggaauggaaauuagacccgugaaagagaaggaggagaaccuggucaaguccauggucagcgccgguuccggcgagguggacagcuucaguuuaggucugcugugcaucaguauuaugauugaagaggugaugcggucccgauggagcagaaagaugcucaugaccggaacauuggccgucuucuucuugcugaucaugggccaguuaaccuggaaugacuuaauaagacucugcauaauggugggcgcgaacgcuuccgaccgcauggggaugggcaccaccuaccuggcgcuaauggcgacuuucaagaugcggccgauguucgcugugggacuccuguuccgacggcuuaccagccgugagguccuccuucugacgaucgggcugucccugguugccagcguggagcuaccaaauucccuggaggagcugggcgacgggcuggcgaugggcaucaugaucuugaagcuucugacggacuuccagagccaccagcucugggccacgcugcugucccucaccuucaucaagaccaccuucagcuuacacuacgccuggaagacgauggccaugguccucuccaucgugagccucuuuccccugugccuguccaccaccagccaaaagacaacguggcuccccguccugcugggcucccucggguguaagccgcucacgauguuucugauagcggagaacaaaaucuggggccgccgcagcuggccccucaacgaggggaucauggcggugggcauagugagcauccuguuauccucucuuuugaagaacgacgucccccuggccgggccccuaaucgccggaggcaugcugauagccugcuaugugaucuccgguagcuccgcugaucugagccucgagaaggcagccgaaguguccugggaggaggaggccgaacacaguggugccucccacaacaucuuagucgaggugcaagaugacgggaccaugaaaaucaaggacgaggaacgggacgauacucugaccaucuugcugaaggcuaccuuauuagccgugagcgggguauacccuuugagcaucccggcgaccuuguucguaugguacuucuggcagaagaagaagcagcguagcggggugcuuugggacaccccaagcccacccgaagucgagcgagcggugcuggacgacgggaucuacaggaucaugcagcgggggcugcuggggcgcagccaagugggagucggcguguuccaggagaacguguuccacaccauguggcaugucacaagaggcgcugugcuuauguaucagggaaagcgccuggagccaagcugggcgucugugaagaaggaccucaucucguauggaggcggguggcggcuacagggcagcuggaacaccggagaagagguccaggucaucgccguggagccaggcaagaauccaaagaacguccagaccgccccagggacguucaaaacgccagagggggagguaggagccauagcgcuggacuucaagcccggaacuuccggaagccccaucgugaaucgcgaagggaaaaucgucgggcuguauggcaacgggguggugacgaccagcggcacguacgucucggcgaucgcccaggccaaggccagccaggaggggccgcuucccgagauagaggacgagguguuccgaaagcgcaaccugacuaucauggacuugcacccuggcuccgggaagacgcggcgcuaccucccggcaaucgugagagaggcuaucaagcgcaaacugcgcaccuuaaucuuggcccccacgcggguuguggcuagcgagauggccgaggcgcuuaagggcaugcccauucgcuaucagaccaccgcagugaaguccgagcauaccggcaaggagaucguagaucugaugugucacgccacguucaccaugaggcuccugagcccuguccgcgucccgaacuacaacaugaucauuauggaugaggcucacuuuacggaccccuccagcaucgccgcgcggggguacaucuccaccagagucgggaugggggaggccgcggcuaucuuuaugacggcaacgccgcccggcagcguggaggcguuuccucaguccaacgccgugauacaggaugaagagagggacauacccgagaggagcuggaacuccggguacgaguggaucaccgacuucccuggcaagacggugugguucgugccuagcaucaaguccgguaacgacaucgccaacugucugcggaagaaugggaaacgcgugauccaacucagucggaagacguucgauaccgaguaccagaagacaaagaauaacgacugggacuacgucgugacaacggacaucucugagaugggcgccaacuuucgcgcugaccgcgucaucgacccgcgccggugucugaaacccgucauccugaaggacggucccgagcgcguaauccucgcaggccccaugccggugaccgucgccagcgcggcccagaggcggggacggaucggccgcaaccacaacaaggaaggagaccaguacaucuacauggggcagccccugaacaacgacgaagaccacgcccauuggacggaagccaagaugcuacucgacaauaucaacacccccgagggcauaauacccgcccucuuugagccugagcgggagaaguccgccgccaucgacggcgaguaccgucugcggggcgaggcgagaaagacguucguggaacucaugcgcaggggagaccuacccguuuggcugagcuauaagguggccucggaaggauuccaguacucugacaggcgauggugcuucgacggcgagcgcaacaaccaggugcucgaggagaauauggacguagaaaucuggacaaaggagggggagcggaagaaacuaaggccccggugguuggacgcccgcaccuauagcgaccccuuggcccugcgggaguuuaaggaguucgccgcuggccgccggucagugucaggagacuuaauccucgagaucggaaagcuuccgcaacaccugacgcagcgcgcccagaaugcacucgacaaccuggugaugcuacacaacuccgagcaggguggccgggccuaccgccacgcuauggaggagcuccccgacacgaucgaaacccugaugcugcucgcgcuaaucgccguccugaccggcggugugacccucuucuuccugagcgggcguggucugggcaagacauccaucgggcuacugugugugauggcgucgucggugcugcuuuggauggccagcguggagccccauuggauugcggccuccauuauacuggaguucuuccugauggugcuccugaucccagagccggaccggcagcggacuccccaagauaaccaguuagcguacguagugaucgggcuccuguucaugaucuugacaguugccgccaacgaaaugggccucuuagagaccaccaagaaggaccuggggauagggcacguugcgguagaaaaccaccaccacgccgccaugcucgacguggaccuccaucccgccagcgcuuggacgcuauacgcggucgccacuacuauaauuacgccaaugaugcgucacacgaucgaaaauacgacugccaauauuuccuuaaccgccaucgccaaccaggccgcaauccugauggggcuggacaagggcuggcccaucucaaaaauggacaucggcgugccccucuuggccuuaggcugcuacucccaggucaacccccuaacgcucaccgccgcgguacuaaugcucguggcccacuacgccaucaucggcccggggcugcaggcgaaagccaccagggaggcgcagaagcggaccgccgccggcaucaugaagaauccuacgguagacgggaucgucgccaucgaccuggaccccgucguguacgacgccaaauucgagaagcagcucggacagauaaugcugcugauccucuguaccagccagauccuacuaaugcggaccaccugggcgcucugugaguccaucacgcuggccaccggaccccucaccacccuuugggaagggagcccgggcaaguucuggaacacuaccauugccgucuccauggccaacaucuuucgggggagcuaccuggccggcgcgggccuggccuucucgcucaugaagucgcucgggggcggucggcgggggacuggagcccagggcgagacgcugggggagaaguggaagcgccagcucaaccaauugagcaaguccgaguuuaacacguacaggcgcucugggauuauggagguagaccgguccgaggcaaaggaagggcugaagcgcggagagaccacuaagcacgcugugagccgaggcaccgccaagcuacgcugguucgucgaacggaaccugguuaagccagaggggaaggugaucgaccuuggcugcggccgugggggcuggaguuauuacugcgccgggcugaaaaaaguuacggaggucaagggcuacaccaaaggcggcccaggccaugaagagcccauaccgauggccaccuacggguggaaccuagugaagcugcacagcggcaaagacgucuucuucaucccuccagaaaaaugcgacacacugcuuugcgacaucggggaguccagccccaacccgacuaucgaggagggccggacccugcgcgugcugaagaugguggagcccuggcuacgagguaaucaguucugcauaaaaauccugaaucccuauaugccguccgucguggagacguuggaacagaugcagcgaaagcaugggggcaugcuugugagaaacccacugagccggaacuccacccacgagauguauuggguuagcugcggcacuggcaacauuguguccgccgugaauaugacaucccgcaugcugcuaaaucgguuuaccauggcacaccgcaaacccacguacgagcgggacguugaccugggcgccgggacccgccacguggccguggagccagaggucgccaauuuggacaucaucggccagcggaucgagaacaucaagcacgagcacaagucaacguggcauuaugaugaggacaacccuuacaagaccugggccuaccacggaagcuacgaggugaagcccagugguagcgcgagcuccauggugaacggggucgugaagcuccugaccaaacccugggacguuauccccauggugacgcagaucgccaugacggacacaacgcccuucggacaacagcgaguuuucaaggagaaggucgacacccggacgccaaaggcgaagcgcgggaccgcccagaucauggagguaacugcgaagugguugugggguuuccuuagccggaacaagaagccccgcauaugcaccagggaggaguucacgcgcaaggugcggucgaacgcggccaucggcgcagucuucguugaugaaaaccaguggaauucagcgaaggaggcgguggaagacgagcgcuucugggaccucguccacagggagcgcgagcuacauaaacaggggaaaugcgcgaccuguguguacaauaugaugggcaagcgugaaaagaaguuaggggaguuuggcaaggccaaggggucccgcgcuaucugguacauguggcugggcgcccgguuccuagaauucgaggcacuaggauuuaugaacgaggaccauugguucagucgcgagaacucccugagcgggguagaaggcgaagggcugcacaagcucggcuauauucugagagacaucucaaagaucccgggugguaacauguacgccgacgacaccgcaggaugggacaccaggauaacggaggacgaucugcagaacgaggcccgcauaaccgauauuauggaaccagagcacgcuuuacuggccaagagcauuuucaagcugaccuaucagaacaaggucgugcgggugcaacgucccgccaagaacggcaccgucauggacgucaucucccggcgcgaucagcggggcagugggcagguggggacguacggccucaauacguucaccaacauggaggcccaacugauacgacagauggagagugaggggaucuucagcccguccgagcuggagacccccaaccuggcugaacggguccuugacuggcuggagaaguauggcguggaacgccucaagcggauggccaucagcggggaugacugcguggucaagccgaucgaugaccgcuucgccacugcacugacggcccugaacgauaugggaaaggugcggaaggacaucccccaaugggagcccucuaagggguggaacgacuggcagcagguccccuucugcagucaucauuuucaccagcucaucaugaaggacggccgggaaaucgucgugccgugccggaaccaggaugagcugguuggccgugcccgggucagccaaggggccggcuggucccugcgcgaaaccgcgugucugggcaagagcuaugcgcagauguggcaauugauguacuuucaccggcgagaccugaggcuagcggcgaaugcaauaugcuccgcggugcccgucgacuggaucccuaccucccgcacgaccuggucuauccacgcccaucaccaguggaugacaaccgaagacaugcucucagucuggaaccgcgucuggaucgaggagaauccuuggauggaagacaagacucacaucuccucauggggcgaugugccguaccugggcaagcgggaggaccaauggugcggcucccucaucggacugaccgccagagccacaugggcgaccaacauucaaguggccaucaaccaggugcggcgccugaucggaaacgaaaauuaccucgacuacaugaccuccaugaagcgguucaagaacgaguccgaccccgagggcgcccuuugguga

SEQ ID NO: 24087 - RNA, 9879 nt, Artificial Sequence
  derived and/or modified CDS sequence (opt11) from DENV-1__EU660401__SS-prME
agcguuacaaugcuguuaaugcugaugcccacagccuuggccuuccaccucaccacccggggcggggagccccauaugauugucagcaagcaggagcguggcaaaucgcugcuguucaagaccagcgccggggugaacaugugcacccuuaucgcgauggacuuaggggagcugugcgaggauacaaugacguacaagugccccagaaucaccgaaaccgagcccgacgacguggacugcugguguaacgcuacugacaccugggucaccuacgggacuugcagccaaacgggggagcaccggcgggauaagcgcuccguggcccucgcgccucaugucggccuggggcuggaaacccgcaccgagaccuggaugucauccgagggcgccuggaaacagauacagcgggucgaaacgugggcccuaaggcaccccggguucacagugaucgcacuguuccuggcccacgcgauaggaacgagcaucacacagaagggcaucauuuucauccuccugaugcucguaacgcccucgauggcgaugcguugcguuggcaucggcagccgcgacuuuguagagggucuaucaggcgcgaccuggguggacgucgugcuggagcacgguagcugugucaccacgauggcgaaggacaagccaacgcuggacaucgagcuccuaaagacugagguaaccaacccagccgugcuucggaaacucugcaucgaagcgaaaauuucgaauacaacgaccgacucacguugcccgacacagggugaagcuacccugguggaagaacaggacgcaaacuucgugugccggcgcacguucguugacagggguugggggaacgguugcgggcuauucggaaaagggucuuuaauuacgugugcuaaguucaagugcgugaccaaguuagagggaaagauuguccaguacgagaaucugaaguauucugugaucgugaccguacacaccggcgaucagcaccagguaggcaacgaguccacagagcacggcacgacggcuacgaucaccccccaggcgccaaccaccgagauccagcucaccgacuacggcgccuuaacccuugacugcuccccaagaaccggucucgacuuuaacgagaugguccuucugacaaugaaagagaaguccugguuagugcauaagcagugguucuuggaccugccccucccauggaccagcggcgccagcacgagucaggagaccuggaaccgccaagacuuauugguaacauucaagacggcccacgccaaaaagcaggaagucgugguccucggcagccaggaaggugcaaugcacaccgccuugaccggggcaacagagauccagaccuccgggacgacgaccaucuucgcaggccaucugaagugccgccucaaaauggauaagcugacccugaaggguaugucuuacgugauguguaccgggagcuucaagcucgaaaaggaggucgcagagacccagcacggaacggugcugguucaaauuaaauacgaggguaccgacgcgcccuguaagauacccuucuccacgcaggacgaaaaggggguuacacagaacggccgcuuaaucaccgcuaacccgaucgugaccgacaaggagaagcccguuaacaucgaggcggaaccucccuucggugaguccuacaucauuaucggggccggagaaaaggcccugaagcucagcugguuuaagaaggguucaagcauagguaagauguucgaggcaacugcccgcggagcccgucgcauggccauccugggagacaccgcuugggacuuuggguccaucgguggcguguuuacgagcguggggaagcugguccaccagaucuucgggacugccuauggggugcuguucuccggcgugagcuggacuaugaagaucgguauuggcguccugcugacguggcuaggccuaaacucgcguagcaccucccuguccaugacgugcauagccgugggccucgugacacuguaucugggcgucauggugcaggcugacagcgguugcgugaucaacuggaagggccgggaguuaaagugcgggaguggcaucuucgucaccaaugaagugcacaccuggacagagcaguacaaguuccaggccgacucgccgaagcgccuauccgcugccaucggaaaggccugggaggagggcguuugugggauucguagcgcaacucgccucgagaacaucauguggaagcagaucaguaacgaacuuaaucacauccuguuggaaaacgacaugaaguucacggucgucguaggggauguugcaggcauucucgcgcaggggaagaagaugauucggccgcaaccaauggaauacaaguauagcuggaaguccuggggcaaggcaaaaaucaucggcgcagacgugcaaaauacaaccuucaucauagacgggcccaacacaccggagugcccugacgaccagcgagccuggaacaucugggagguggaggacuauggcuucgggaucuucacuaccaacaucuggcugaaauuacgcgacagccacacccaggucugcgaccaccgacucaugucggcugccaucaaggauucgaaggccguacacgcagacaugggguacuggaucgaguccgaaaagaaugagaccuggaagcuagcccgggcgagcuucaucgaaguaaagacgugcaucuggccuaaaucccacacucuguggagcaacgguguacucgaguccgagaugauuauacccaaaaucuacggcggaccuaucagccagcacaacuacaggccaggguacuucacccagaccgccggccccuggcaccucgggaagcuggaacucgacuuugaccucugcgagggcacgaccguggucguugaugaacacugcggcaaccgaggacccucccugaggacgaccacggugacgggcaagaucauacacgagugguguugccgguccugcaccuuacccccccuccgauuucgcggggaggauggcuguugguacgggauggaaauccgcccugucaaggagaaggaggagaaccuggucaaguccauggugagcgcuggaagcggcgaggucgacucguuuagccuuggccugcugugcauuuccauuaugauugaagagguuaugcggagccgauggucuaggaagauguugaugaccgggaccuuagcgguguuuuuucuacugaucaugggccagcugacauggaaugaccugauccgccucuguaucauggugggcgccaacgcgagcgaccgcaugggcauggguacaacguaucuugcacuuauggccacguuuaaaaugaggccgauguuugcggucggcuuauuauuccgccggcugacaucccgcgagguucuccuguugacaauuggguugagccugguggcgagcguugaacuccccaacagccuagaggagcugggggaugggcuggcgauggggauuaugauccugaagcugcugacagacuuccagucccaucagcucugggccacgcugcucucccucaccuucauaaagacuaccuucagccugcauuacgcuuggaagacgauggcuaugguucugucuaucgugucccuauucccccugugccuaagcaccaccucccagaaaaccacgugguugccggugcugcugggcagccuggggugcaagccgcugacuauguuccucaucgcugagaacaagaucuggggcaggagguccuggccccucaacgaagggaucauggcagugggcaucgucagcauucugcuuucaucccuccugaagaaugacgugcccuuagcggggccucugaucgccggaggcaugcugaucgccuguuaugugauaagcgggucgagcgcagaccugagccuagaaaaggcggccgagguuagcugggaggaggaggcggagcacuccggcgcgucgcacaacauacuuguggaggugcaagaugacggcaccaugaagaucaaagacgaggagagagacgacacccugaccauacuccugaaagccacauuacuggccgucucuggaguauacccgcugucgaucccugcaacucucuucgugugguacuucuggcaaaagaaaaaacaaagaucugggguacucugggacacgccuagcccacccgaagucgaacgagcggugcuggacgacggcauuuaccgcaucaugcaaagaggucuguuaggucgcucucaggugggggugggaguguuccaagagaacguguuccauacuauguggcacguuacgcguggagccgugcucauguaccaggguaagcgacuagagccgagcugggcuaguguaaaaaaggaccuuaucaguuaugguggcggauggcggcuacagggcucauggaacacuggugaggagguccaggugaucgccguugagccagggaagaaccccaagaacguacaaacagcuccugggaccuucaagacgcccgagggugaaguaggugcgaucgcccuagacuucaagccagguaccagcggcagucccauuguuaacagagaggggaagauugugggacuguacggcaacgggguggucaccaccagcgggacguacgugucugcgauagcacaggcuaaggccagucaagaggguccuuuacccgagauagaagaugagguguuccggaagcgcaaccugaccaucauggaucuccaucccggcagcggaaagacccggcgcuaccuuccggcaauuguccgggaggcaauuaagagaaaacugcgaacucuaauccucgccccaacccgagugguggccuccgaaauggccgaagcucugaaaggcaugcccauccgguaucagaccacagccgugaagucggagcacaccggcaaggagaucguugaccugaugugccaugccaccuucaccaugcgacucuugucccccgugagaguacccaacuauaacaugaucauuauggaugaggcacacuuuacggaucccagcuccauugccgcgcggggauacauuucgacacgcgugggcaugggggaggcggcugccauauucaugacggcaacgccgccgggcuccguggaagcauuuccgcagagcaaugccgucauccaggacgaggagcgggacaucccagagcgcucguggaacagcggguaugaguggaucacugauuucccgggcaaaaccgugugguuuguuccgagcaucaagagcgguaacgacaucgccaacugcuuacgaaagaacggcaagagagucauccaacucucacggaagaccuucgacaccgaguaccagaagacgaagaacaaugacugggacuacguggucaccacagacaucucggaaaugggcgccaacuuccgagcggaccgggugaucgacccgcgaaggugucugaagcccgucauucugaaagaugggccggaacgggugauccucgccggccccaugccggucacgguggcuuccgcggcccagcggcgagggcguaucgggcgcaaucacaacaaggagggagaccaguacaucuacauggggcagccccugaauaaugacgaggaccacgcgcacuggaccgaagcgaaaaugcugcucgacaacaucaauaccccagaggggauuauccccgcccuguuugaacccgaacgcgagaaguccgccgccaucgauggcgaguaucgguugcgcggcgaagcgcggaagacguucgucgaacucaugcgccguggggaucugccgguuuggcuguccuacaaaguggccagugagggguuccaguauagugaccggcgguggugcuuugacggcgagcgcaacaaccaaguccucgaggaaaacauggacguagaaauuuggaccaaggaaggugagcguaagaaguuaaggccccgguggcuggacgcccggaccuauuccgacccccucgcauuaagggaguucaaagaguucgccgcgggccgccggagcgucuccggagaccugauccucgagauaggcaagcugccgcaacaccucacccagcgcgcacaaaacgcccucgauaaccuuguuauguugcacaacuccgagcagggcggacgagcuuaccgccaugcuauggaggagcuacccgacacgaucgaaacucugaugcuccuugcauuaauugcggugcugaccgguggggugacacucuuuuuccucuccggccguggccugggaaagaccucaauaggucuccugugugucauggccuccagcgugcugcuuuggauggcauccguggagccgcauuggaucgccgccucaaucauucuggaguucuuccugauggugcuccuuauccccgagccggaccgacagcgcacgccccaggauaaccagcuggcauacgugguuaucggguuacuguuuaugauccugaccguugccgcuaacgagaugggccucuuggagacaaccaagaaggaccucgggauaggacacguagcgguggaaaaccaccaccacgcagccauguuggacguagaccuccacccggcaucagccuggacgcuguaugcgguggcaaccaccauuauaaccccuaugaugcgccacacgauagagaacaccacggccaacaucagccuaaccgcaauugcaaaccaggcugcuauucugaugggacuugacaaagguuggcccauuuccaagauggacaucggcgugccguuacuggcgcugggguguuauagccagguaaacccauuaacgcuuacggccgccgugcugauguugguggcccacuacgccaucauaggcccggggcugcaggccaaggcaacuagagaggcgcagaagagaaccgccgccggcaucaugaagaaccccacggucgacgggauaguggcgaucgaccuggacccagucguguaugacgccaaguucgagaaacaguuaggccaaaucaugcugcuuauucucugcaccucccaaauccugcugaugcgcaccaccugggcucugugugagucaaucacccuggccacaggcccucugacgacccucugggagggguccccgggcaaguucuggaacacgaccaucgccgucaguauggccaauaucuuucgcgguucuuaccuggccggagcgggccuggcauucucgcucaugaagagccucgggggcggccgacggggaacgggagcgcagggggaaacccugggugagaaguggaaaaggcaauugaaccagcugaguaaaucagaauucaacacguacaagcggucagggauaauggagguggaccguagugaagccaaggagggccugaagcgcggcgagaccacuaagcacgcggucucccgcgggaccgccaagcuccggugguuugucgagcgcaaccuggugaagcccgaagggaaggucaucgaccugggcugcggcagaggggguuggagcuauuacugcgccggucuuaagaaaguuacggagguaaagggauacacaaagggcggccccggccaugaagaacccauuccaauggccaccuacggauggaaucucgucaaguugcacuccgguaaggacguauuuuucauccccccggagaagugcgacacgcuguuaugcgacaucggugaaagcucucccaacccgacgaucgaagaaggccgcaccuugcggguucuuaaaaugguggagccauggcuccgcgggaaucaauucugcaucaagauccugaauccguacaugccuuccgugguagagacccuggagcaaaugcagcggaagcacgggggcaugcuugugcgcaacccccugaguaggaacagcacgcacgagauguacugggugucgugcgggaccggaaacaucgugucugccgucaacaugaccuccagaaugcugcucaaccgcuucaccauggcgcauaggaaaccuacuuacgagagagacguggaccugggcgccgggacucggcacguagccguggagcccgagguagcuaauuuagacaucauaggccagcgcaucgagaacaucaagcaugagcacaaaagcacguggcacuacgacgaggauaaucccuacaagacuugggcguaccacggguccuacgagguaaagccaucuggcagcgcgagcagcauggucaauggcguagugaaacuccucaccaagccaugggacgugauccccauggucacccagaucgcuaugacggauaccacgccguucgggcaacagcgggucuucaaggagaagguugacaccagaacgccgaaagcuaaacgagggacggcccaaauaauggaggugaccgccaaguggcucuggggguuucucucucggaacaagaaaccacggaucugcacacgcgaggaauucacgcggaagguacgcagcaacgcggccauaggcgccguauuuguugaugagaaccaguggaacucagccaaggaggcggucgaggaugagcgguucugggaccuggugcacagggagcgggaacuacauaagcagggaaagugcgcgacaugcguguacaacaugauggguaagcgcgagaagaagcucggagaauucggcaaggcuaaagggucgcgggcaauuugguacauguggcugggagccagauuccuggaguucgaggcacucggcuuuaugaacgaggaccacugguuuagucgagagaauuccuuauccggugucgagggcgagggccugcauaagcuuggcuauauccugcgggauaucagcaaaauccccgggggcaacauguacgccgaugacaccgccgguugggacaccaggauaacggaagacgaucugcagaacgaggcccgcaucaccgacaucauggagccggagcacgcccuccuggcgaaauccaucuucaagcugacuuaccagaacaagguugugcgcguccagcggccagcaaagaauggaaccguaauggacgugauuagcaggcgggaccagagaggcuccgggcaggucggcacuuauggccucaacaccuuuacgaauauggaagcucagcugauccggcagauggagagugagggaauuuucuccccgucggagcucgagaccccaaaccuugcagagcgcgugcucgacuggcuggagaaguacgggguagagagacucaaacgcauggccauauccggggaugacugcgucgugaagccgaucgacgaucgguuugcuacugcccugacagcgcugaacgauaugggcaaagugcgcaaggacauaccacagugggagcccucaaaaggcuggaacgacuggcagcaggucccuuucugcucccaccauuuccaccaauuaauuaugaaggacggacgggaaaucguggugccgugccgcaaucaggacgaguugguuggccgcgcgcguguaucccagggagccggcuggagcuugcgggagacugcgugccuugggaaguccuacgcccaaauguggcaacugauguacuuccaccgucgggaccugcgccuagcggccaacgcgaucugcagcgccgugccugucgacuggaucccuaccuccagaacgacguggucuauccaugcccaucaccaguggaugaccaccgaagacaugcuauccguuuggaaccgcgucuggauugaggaaaaucccuggauggaggauaagacacacaucagcucguggggcgacgucccguaccuugggaaacgcgaggaccaguggugcgggucucucaucggccucacggcucgggccaccugggcgaccaacauccaaguggcgauaaaccagguucggcgacugauugggaaugagaacuacuuagacuauaugaccucaaugaagcgauucaagaacgagggcgaucccgagggggcccugugguaa

SEQ ID NO: 24088 - RNA, 9879 nt, Artificial Sequence
  derived and/or modified CDS sequence (opt11) from DENV-1__FJ373305__SS-prME
agcgugacuaugcuguugaugcucaugcccaccgcccuggcuuuccaucuuaccacccgggggggcgagccccacaugauuguguccaagcaggagcggggaaaaagccugcuguuuaagaccuccgccgggguuaacaugugcacucucaucgccauggaccugggugaacucugugaagacaccaugaccuauaagugcccccggaucaccgagacggaaccagacgacguggacuguuggugcaacgcuacggacaccugggucaccuacgggacauguucccagacgggcgagcaucggcgugacaagcgguccguggcucuggcgccccacguggggcuggggcuggagacccgaacggagaccuggaugagcuccgagggcgcguggaaacagauccagcggguagagacgugggcgcuacgacaccccggguuuacugugauagcccuguuccucgcccacgcaaucggcaccagcaucacccagaagggaaucaucuuuauccuacugaugcucgucacacccuccauggccaugcggugugucggcauuggcagcagggacuucgucgaagggcucagcggggcaacauggguggaugucgugcuggaacacgggagcugcguaaccaccauggccaaagacaaaccgacgcuggacaucgagcucuugaagaccgaggucacuaaucccgcgguucuccggaagcuuuguauugaagcgaagaucuccaacaccaccaccgacagcaggugcccgacccagggggaggccacccuaguagaggagcaggacgccaacuucgugugccggcgcaccuucguggaccggggcugggguaacgggugcgggcuguucggcaaggguucccucaucacgugugcgaaguucaagugcguaaccaagcuagagggaaaaaucguccaguacgagaaccuaaaguacagcgugaucgugaccguccauacgggagaccagcaucaggucgggaacgagucaaccgaacauggaaccaccgccacaauuaccccucaggcgcccaccaccgagauucaauuaacagauuauggugcgcugacgcuggacugcucaccgcgcaccggacucgacuuuaacgagauggugcuuuuaaccaugaaggagaagucguggcucguucacaagcagugguuucucgaucugccccuccccuggaccucuggggccucaacgucccaggagacguggaaccggcaggaccuccuggugaccuucaaaaccgcccacgcuaagaagcaggaggucguggugcuaggcagccaggagggagcgaugcacacggcccugacuggugcuacagagauacaaaccuccggaacgaccaccaucuucgcaggccaucugaagugucgccucaagauggacaagcuaacccugaagggaaugucguacguuaugugcacugggagcuuuaaacuggaaaaggagguggcggagacacagcacggcacagugcugguacagauuaaauacgagggcaccgaugcgccaugcaaaaucccauuccugacgcaggacgaaaagggugugacccagaacggccgguugaucaccgccaacccgaucguuaccgauaaggaaaagcccguuaacaucgaggccgaaccccccuuuggggagagcuacauuaucauuggcgcgggcgagaaagcguugaagcuguccugguuuaaaaaggguagcuccauaggcaagauguucgaggccacggcucgcggggcucgacgcauggcgauccugggcgacaccgcgugggacuucggcagcaucggcggcguguucaccucaguaggcaaacucguccaccagaucuucggcaccgccuacggggugcuguucagcggcguguccuggacgaugaagaucggaaucggcguccuacucaccuggcugggccuuaauagccgguccacgagccucuccaugaccuguaucgcggugggguuaguuacgcuguaccucggcgucaugguucaggccgacuccgggugcgugaucaacuggaagggccgggaguuaaagugcgggucgggaaucuucgucaccaacgagguucacaccuggacggaacaguacaaguuucaggccgacagcccuaagaggcucucggcggccaucggcaaggccugggaggaggguguguguggcauccggucggccacgcgccucgagaauaucauguggaagcagauaucuaacgagcugaaucacaucuuacuugagaacgacaugaaguucacggucguggugggggacguggcugguauacuggcgcagggaaagaagaugauccggccccaacccauggaguauaaguacagcuggaaguccugggggaaggccaaaauuaucggcgccgaugugcagaauaccacuuucauuaucgauggucccaauaccccggagugccccgaugaccagcgcgcguggaacaucugggagguggaggacuauggcuucgguaucuucacaacuaacauauggcugaagcuccgggacaguuacacgcaaguaugcgaucaccgguuaaugagcgcggcgaucaaggacuccaaggccguacacgcagacaugggauacuggaucgagagcgagaagaacgaaacauggaaacuggcacgggcauccuuuaucgaggugaagacgugcauuuggccgaaaagccauacucucuggagcaacgguguauuagagagcgagaugauuauccccaaaaucuacggaggcccgaucucccagcacaauuaccgucccggauacuucacccagaccgcaggcccguggcaccugggcaaacuagaguuggacuucgaucugugcgaaggcacgaccgugguggucgacgagcacugcggcaaccgggggccgucccuccgcaccacaacgguaacugguaagaucauacacgaguggugcugccgguccugcacccuuccuccccugcgcuuccgcggggaggacggcugcugguacgggauggagauccgccccgugaaggagaaggaggagaaccucgucaagagcaugguguccgcaggcagcggcgagguggacucuuucucacuggggcugcucugcauuagcauuaucaucgaggaggucaugcgcagccgcuggagccggaagaugcucaugaccgguacccuggccguguucuuccuccugauuauggggcaacugaccuggaacgaccucauccgucugugcaucauggugggcgcaaacgcuuccgaucgcauggggaugggcacuacuuaccuggcacucauggccacguucaagaugcggccgauguucgccgugggccugcuguuccgccggcucaccagccgcgaggugcuccuguuaacgaucgggcugucacugguggcgagcgucgagcucccuaacucccucgaggagcugggcgacgggcucgccaugggcaucaugauccugaaguuauugaccgacuuucaaagccaccaguuaugggccacccugcuaaguuugaccuucauaaagaccacggucuccuugcacuacgccuggaaaacgauggccauggugcucucgauugugagccuguucccccugugucucuccaccaccagccagaaaaccaccuggcugcccgugcuucuuggcucccugggcuguaagccuuuaaccauguuccuuaucgcggagaauaagaucugggggcggcgcagcuggccccugaacgaggggaucauggccgucggcaucguguccaucuuguuaagcagccugcuuaagaacgaugucccccucgcuggucccuuaauugcaggcggcauguugaucgccugcuaugucaucuccgguaguuccgcggaccucagccuggagaaggccgcggaggugagcugggaggaggaagccgagcacagcggugccucgcacaacaucuugguggagguacaggaugacgggaccaugaaaaucaaagacgaggagcgggacgacaccuuaaccauccugcugaaggcgacgcuccuugcagugagcggcguauacccccugagcauucccgcgacccuauucgucugguacuucuggcagaagaagaagcagaggucaggaguccugugggacacccccagcccacccgagguggagcgcgccgucuuagaugacggcaucuacaggaucaugcagcguggccugcucgggcgcagucagguaggcgugggggucuuucaggagaauguguuccacaccauguggcaugugacucggggcgcuguguugauguaccaggggaagcgccuugagccuuccugggcgagcgugaagaaagaucucaucuccuacggcggcggguggcggcugcaggguagcuggaacaccggggaggaagugcaagucauagcaguggaacccggcaagaacccuaagaaugugcagacggccccagggaccuuuaagacgccggagggagaggucggagccaucgcccuagacuuuaagcccgggaccuccggaagcccaaucgugaaccgcgaggggaagaucgugggccucuacggcaaugguguagugaccaccuccggcacguacgugagcgccaucgcgcaggccaaagcgucacaagagggaccacugcccgagauagaggacgaaguuuuccguaagcgcaaccugaccaucauggacuuacacccgggcuccgguaagacccggcgcuaccugccggcuaucgugagagaagcaaucaagcgcaagcuacgcacccucauccuugcuccuacacggguggucgcgucggagauggcagaagcgcuaaagggcaugcccauucgauaucagacaaccgccgucaagagugaacacacaggaaaggaaaucguugaccucaugugccacgccacguuuacuaugcgguuacucucacccgugcgcgugccaaacuacaacaugaucauuauggacgaagcacacuuuaccgaccccuccucgauagccgcucggggguacaucaguacccgcgugggcaugggggaggccgccgcaauuuucaugacggcgacaccacccgggagcguugaggcguucccgcaauccaacgccgugauccaagaugaggagcgugauaucccagaacgcucguggaacuccggguacgaguggauaaccgauuuucccggcaagacggucugguucguccccagcaucaagucaggcaacgacaucgccaacugccuccggaaaaaugggaagcgcgugauccagcugucgcggaagacguucgauaccgaauaccagaaaaccaagaacaacgacugggauuacgugguaaccacggacaucucagagaugggcgcaaauuucagagcugacagagucaucgacccacgccggugccugaaaccagugauccuuaaggaugggccugaacggguuauccuggcaggccccaugccggugacagucgccucggcugcgcagcggcgaggucggaucggccgcaaccacaacaaggagggggaucaguacauuuauauggggcaaccccuaaacaacgaugaggaccacgcgcacuggaccgaggccaagaugcuccuagauaacauuaacacacccgaagggaucauccccgcccuguucgaaccggagcgcgagaaguccgccgccaucgacggggaguaccggcucagaggggaggcgcggaagacguucguagaacugaugcgccggggcgaucucccaguauggcucucauacaaggucgccucugagggcuuccaguacagcgaucgacggugguguuucgacggcgagcgcaacaaccaggugcuggaggagaacauggacguggagaucuggaccaaggagggugagcggaagaaguugcgcccucgguggcucgacgcgcgaaccuacagcgacccacuggcucugcgggaguucaaagaauucgccgcgggccgccgguccgugagcggggaccucauccuggagaucggcaaacugccgcagcacuuaacccagcgcgcccagaacgcucuggacaaccuggugaugcuacacaacucagagcagggcggucgggccuaucgccacgcgauggaggagcugcccgacacgaucgagacauuaaugcuccuggcacuuauagccguucucacaggcggggucacacucuucuuccugagcggcagggggcucggcaagaccucuaucgguuugcugugcgugauggccagcucuguccugcucuggauggcgagcgucgaaccccacuggaucgcggcauccauuauucuagaguucuuccucauggugcuguuaauacccgagccggaucgccagcggacgccacaagacaaccaacucgcuuauguggucaucgggcuacuuuucaugauccuuacaguggcugccaacgagaugggacuacuggagacgaccaagaaggacuuggggauuggacacguggccguggagaaccaccaccaugcugcgaugcuggacguggacuugcaccccgccagcgccuggacacucuacgcgguagccacgaccaucaucacaccaaugaugcgccacacgaucgagaauaccaccgccaacaucagccugacugccauagccaaccaggcagccauccucaugggccuugauaagggcuggcccaucucaaagauggacaucggcgucccucuucuggcccucggcuguuacucccaaguaaauccccugacccugacggccgcugugcuuaugcuggucgcgcacuacgccaucauaggcccggggcugcaggccaaggcgacgcgggaggcucagaagcggaccgccgcugguaucaugaagaaccccacugucgacgggaucguggccaucgaccucgauccagucguguacgaugcaaaauucgagaagcagcugggccagauaaugcugcugauccugugcaccucucagauccuucuaaugagaacuaccugggcccugugugagucgauuacgcuggcgaccgggccccucaccaccuugugggaggggagcccgggcaaauucuggaacacgacaauagcuguguccauggccaauaucuuccgggguagcuaucuugcaggagcgggucucgccuucagucugaugaaaucccucgggggcggaagacgggggaccggggcacaaggugaaaccuuaggggagaaguggaagcgccagcugaaccagcugagcaaaucggaauucaacacauauaagcguagcgggaucauggaagucgaccgcuccgaagccaaggagggcuugaagcgcggggagaccaccaagcacgcugugagccguggcacagccaaacugcgaugguucguggaacggaaccucguaaagcccgaggggaaggugaucgacuugggcugcggucgcggagggugguccuauuacugugccggguuaaagaaagugacggaggucaagggcuacaccaagggaggccccggccaugaggaacccaucccgauggccaccuacgguuggaaccuggugaaguuacauagcggcaaggacguguucuucaucccgccugagaaaugcgacacgcuccugugcgacaucggggagaguuccccaaacccgacgaucgaggagggccguacuuugcguguuuugaagaugguggaaccaugguugcgugggaaccaguucugcaucaagauacugaacccuuacaugcccucaguggucgagaccuuagagcagaugcagcggaagcacggcggcaugcugguacgcaauccccugagccggaacuccacccaugagauguacugggugucuugcgggaccggcaacauuguauccgcagugaauaugaccagccggauguuacugaaccgguucaccauggcccaccggaagccuaccuacgagagagacguggacuuaggggccggaaccaggcacgucgccguggaaccggagguggcgaacuuggacaucauaggccagcgcauagagaacaucaagcacgagcacaagucaacguggcacuacgacgaggacaaccccuauaagaccugggcauaccacggaagcuaugaggucaagccguccggcagcgcguccagcauggugaacggggucgugaagcugcugacaaagccaugggacgugauaccaauggucacgcagaucgccaugacggauaccaccccuuuuggccaacagcggguguucaaggagaaaguggacacccgcacuccuaaggcgaaacggggcaccgcccagaucauggaagucaccgccaaguggcucuggggcuuccugagucgcaacaagaagcccagaaucugcacccgugaggaguucacgcggaagguucgcuccaacgcggccaucggagccguuuuuguggaugagaaccaguggaacagcgcaaaggaggcgguggaggacgaaagauucugggaucugguccaccgcgagagagagcuccacaagcaggggaagugcgcaaccugcgucuacaacaugauggguaagcgcgagaaaaagcugggggaguucggcaaggccaaggggucccgggccaucugguacauguggcugggcgcgcgcuucuuagaguuugaggcgcugggguucaugaacgaggaccauugguucucucgggagaacucccugagcgguguggaaggagaggggcuacacaaguuaggguacauccuuagagacaucuccaagauccccgggggcaacauguacgccgacgacaccgcgggcugggacacccggaucacugaggaugaccuucagaaugaagcccgcauaaccgacauuauggaaccagagcacgcccugcuggccaagagcauuuucaaguuaaccuaccaaaauaaggugguccgcgugcagcggcccgccaagaaugguaccguaauggaugugaucuccaggcgcgaccagcgcggcucuggucagguggggacauacggccugaauaccuucaccaacauggaggcccaacugaucagacagauggaguccgaggggaucuucagcccauccgagcucgagaccccuaaccuggccgagcgcguguuggacuggcucgagaaguacggcguugagagacugaagagaauggcaaucuccggggaugacugcguagugaagccgaucgacgaccgauuugcgacggcccucaccgcccuaaacgacaugggaaagguccgcaaggacaucccccagugggagccguccaagggguggaacgacuggcagcagguccccuuuugcucgcaucacuuucaccagcugaucaugaaggacggccgggaaaucguaguucccugccgcaaccaggacgaacuggucggccgggcccgcgugucccaaggggcgggcuggagccuccgagaaaccgcgugcuugggaaagucguaugcucagauguggcagcugauguauuuccaccgccgggaucucagacuagcagcaaaugccauaugcuccgccguccccgucgauuggauccccaccagccgaacgaccugguccauucaugcccaccaccaguggaugaccaccgaggacaugcugaguguguggaaucgcgucuggaucgaagagaacccguggauggaagacaagacccacauaagcagcuggggugauguuccguaccuugggaaacgcgaggaucaguggugcgggucccugaucggucugacggcccgggccacaugggcgacaaacauccagguugcgaucaaucaaguccgucgacucauuggcaacgagaauuaccuugacuacaugaccagcaugaaacgcuucaagaacgagggcgaccccgagggggcccucugguga

SEQ ID NO: 24089 - RNA, 9879 nt, Artificial Sequence
  derived and/or modified CDS sequence (opt11) from DENV-1__EU660402__SS-prME
agcgugaccaugcuguuaaugcugaugcccaccgcgcuggcauuccaucucaccacccgggguggggaaccucacaugaucgugagcaagcaagaacgaggcaagagucugcuguucaagacgagcgccggggugaacaugugcacccucauugccauggaucugggcgaguucugcgaggacacgaugacauacaagugcccccgcaucacggaggccgagcccgaugacguagacugcuggugcaacgcaaccgacacgugggugaccuacgggaccugcagccaaaccggcgagcaccggcgggacaagcggaguguggcccuggcgccccacguaggucucgggcuggagacccgcacggagaccuggaugagcucugagggcgccuggaagcagauacagcggguagagaccugggcucugcgccacccuggguucacggucaucgcccucuuccuggcacacgccaucggcaccagcaucacccagaagggaauuauuuucauccuguugaugcugguaacucccucaauggccaugcggugcgucggcaucggcucucgcgauuucguggagggguuauccggcgccacguggguggacguuguguuggagcacgggagcugcgugaccaccauggccaaggacaagcccacucuggacauugagcuguugaagacggaagugacgaauccugcggugcugcggaagcugugcaucgaagccaagauauccaacaccaccacggacagccgcugcccgacccaaggcgaggcuacccucguggaggagcaggacgccaacuucguuugccggcgcacguucguggaccggggcugggggaacgguugugggcuguucggcaaagggucgcuuaucacgugcgccaaguucaagugugugaccaagcucgaaggcaagaucguccaauacgagaaccugaaguacagcgugauagugacaguccacaccggcgaucagcaccagguagggaacgaguccacggagcauggcaccaccgcgacaaucacgccccaagcccccucuacggagauccagcugaccgacuacggggccuuaacccuugacugcucaccccgcaccggauuagacuucaacgaaaugguacuccugacgaugaaagaaaaguccuggcuggugcacaaacagugguucuuagaccugccgcugccauggaccagcggggccuccacuagccaggagaccuggaaccggcaggaccugcuggugacguucaagaccgcucacgcgaagaagcaggaggucguuguguuggggucccaggaaggcgccaugcacaccgccuuaaccggggccacggagauccagaccagcggcaccaccacgaucuucgccggacaccugaagugccgucugaagauggacaagcucacucugaagggcauguccuacgucaugugcaccggcagcuucaagcucgagaaggaggucgcggagacccagcacggcacggugcucguccagaucaaguacgagggcaucgacgcgccuuguaaaauccccuucuccacccaggacgagaagggagugacccaaaauggccgacugaucaccgcgaacccgauaguaacugacaaggagaaacccguuaacaucgaggccgagccacccuucggggagucauacaucguaaucggugcgggcgagaaggcccuuaagcuguccugguucaagaaggggagcuccaucggcaagauguucgaagccaccgcccgcggggcccggcggauggcgauccucggcgauacagccugggacuucggaucgaucgguggcguguuuaccuccgucgggaaguuagugcaucagaucuucggcacggccuacggcguucuguucagcggcgucuccuggaccaugaagaucggcauuggcgugcuccugaccuggcugggcuuaaacagccguucuaccagucugucuaugacguguaucgccguuggacuggugacccucuaccugggcguaauggugcaggccgacucugguugcgucauuaacuggaagggcagggaacugaagugcgggagcgguaucuucguuacaaacgaaguacacacauggacggagcaguacaaguuucaggcggacucaccgaaacgccucagcgcugccaucggcaaggccugggaggagggugucuguggcauucggucagcgacccgccuggagaacaucauguggaagcaaaucucuaacgagcugaaccauauccuccuugagaacgacaugaaacuaaccguuguggucggagacguggcgggcauucuugcccagggaaagaaaaugauccggccccagcccauggaguacaaguacucguggaagauuugggguaaggcgaaaaucaucggcgccgaugugcagaacaccaccuucaucaucgacgggccuaacacccccgaaugucccgacgaccagcgcgcuuggaacaucugggagguagaggacuacggguucgguaucuuuacuaccaauaucuggcuuaaacuucgggacagcuacacccagguaugcgaccaccgucucauguccgcagccaucaaagacucaaaggcgguccacgccgauaugggcuauuggaucgaguccgagaagaaugaaacuuggaagcuggcgcgagccagcuuuauugaagugaagaccugcaucuggcccaagucccacacgcuguggaguaacgguguguuagaguccgagaugauuauccccaagaucuauggcgggcccaucucccagcauaacuaccgccccgguuacuuuacccaaacggccggcccguggcaccuggggaaguuggaguuggauuucgaccugugcgagggcaccaccguggucguggaugagcacugcggcaaccgggggccgucccugcgcaccacgaccguuaccggcaagaucauucacgaguggugcugccggagcugcacacuaccaccccuuagguucaagggggaggacggcugcugguaugggauggagauucggccagucaaggagaaggaggagaaccuggugaaauccaugguaagcgccggcucuggcgaggucgacucuuucagccucgggcuucugugcaucuccaucaugaucgaggaggugaugcgaucccgguggucgcgcaagaugcucaugacgggcacgcucgcaguauucuucuugcugauaaugggucagcugaccuggaaugaccugauccggcucugcaucauggucggcgcgaacgccuaugaccgcauggggaugggcacgaccuaccuggcccugauggccaccuucaagaugcgaccgauguucgccgugggccuacucuuccggcgccugaccaguagagaggugcuccugcugaccaucgggcugucccuggucgcgagcguggagcuuccgaacucccucgaggaauuaggggacgggcuggcaaugggcauuaugauccucaagcugcuaacggauuuccagucccaccaacucugggcuacccugcugucccuaaccuucauacgcacaacguucucucuccauuacgccuggaagaccauggcgaugguccuguccaucguuagccuuuucccucugugccuguccacuaccagccagaaaaccaccuggcuucccgugcuacuuggcucucucgggugcaaaccacugaccauguuucugaucgccgaaaacaaaauaugggggcguaaguccuggcccuuaaaugagggaaucauggccgucggcaucgugucaauccugcugagcagccuccugaagaaugacguaccccuggccgggccccucaucgcuggcggcaugcugaucgcgugcuacgucaucuccggcuccagugccgaucugagccuugagaaagccgccgagguguccugggaggaggaggccgagcacagcggcgcaucccacaacauccuggucgaaguccaggaugacgggaccaugaaaaucaaggacgaggagcgcgacgacacgcuaaccauucuuuugaaggcuacccuguuggccguuagcggaguguacccgcuguccauccccgcgaccuuguucgucugguacuucuggcaaaagaagaagcagcggagcggagugcucugggacacacccagcccucccgaaguagagcgggcaguuuuggacgacggcaucuacagaaucaugcagcgcgggcugcucggucggagccaggugggcgugggggucuuccaagagaacguauuccacaccauguggcacguuacccgcggcgcaguccucauguaccaagggaaacggcucgagccgucuugggccucggugaaaaaggaucugaucuccuauggcggcgguuggcgccuacaaggcaguuggaacaccggggaagaggugcaggucaucgccguggagccaggcaagaaccccaagaacguccagacggcgcccgggacauucaagacguccgagggagaagucggagccaucgcucucgauuuuaagcccgggacgagcggcucccccaucgugaacagggaggggaagaucgugggccuguauggcaacggggucgugaccaccucuggcaccuacguuagcgcuauugcacaggccaaggcuucccaggaggggccacucccggagauugaggacgaggucuucagaaagcggaaccugacgaucauggaucugcaccccggcagcgggaagacccgccgguaccuccccgccaucgugagagaggccauaaaaaggcgacugcgaacgcugaucuuggccccuacccgaguugucgcgagcgagauggccgaagcccugaagggcaugcccauccgcuaccagaccaccgcagucaagagcgagcacacuggaaaggagauuguggaucugaugugccacgccaccuucaccaugagacuccugucccccguccgcguccccaacuacaacaugaucaucauggacgaggcccacuucaccgacccgagcuccaucgccgcccggggguacaucuccacucgcguuggaaugggggaggcugcugccaucuuuaugacagcgacgcccccuggcuccguugaggccuucccccagagcaacgccguaauccaagacgaggaaagagacauccccgagcgcagcuggaacagcggcuaugaguggaucaccgauuucccggggaagacggucugguucguccccuccaucaagucgggcaacgauaucgccaacugccugcgcaaaaacgggaagagaguaauccagcucucccggaagaccuucgacaccgaguaccagaaaacgaaaaacaaugacugggacuacguggucacgaccgacaucagcgagaugggcgcgaacuuccgcgccgaccgggugauugacccccgccggugcuuaaagcccgugaucuugaaggacgggcccgagcgcgucaucuuggccggcccuaugcccgugacuguagccuccgccgcgcagcggcgcgggcggaucggccgcaaccacaacaaggagggcgaccaguacaucuacauggggcagccgcugaauaacgacgaggaccacgcucauuggaccgaggccaagaugcugcucgacaauaucaacacccccgagggaauuaucccggcccuguuugagccagaacgcgagaagucugccgcgauagacggggaguacaggcugcgcggcgaggcgcggaagacuuuuguugagcucaugcgacgcggggaccugccggugugguuaucccacaaggucgccuccgagggcuuucaauacagcgaucggcguuggugcuucgacggcgagcgcaacaaccagguccucgaggagaacauggacguugagauuuggaccaaggagggggagcgaaagaaacugcgcccccgguggcuggacgcucguaccuacuccgacccccucgcccugcgggaguucaaggaguuugcggcgggccggaggagcgucuccggggaccugauacucgaaaucggcaagcugccacaacaccugacgcagagagcacaaaacgcacucgauaaccuggugaugcuucauaacagcgagcaaggagggcgggcguaccgccacgccauggaagaacuuccggacaccaucgaaacucuuaugcugcucgcccugaucgcggugcugaccggaggggucauguuguucuucuuguccggucgugggcugggcaagacgagcauaggccuccugugcgugauggccuccagcgugcugcuuuggauggcguccgucgagccccacuggaucgccgcauccaucauccuggaguucuuccugaugguucuccugaucccugagccugaccgccagcggacuccgcaagacaaccagcuagccuacguagucaucgggcuccuguucaugauccugacagucgccgcgaaugagaugggacucuuggagacuaccaagaaagaucuggggaucggccacguagccgucgagaaccaccaucacgccgccaugcuugacguagaccugcaccccgccagugcguggacgcuguaugccgucgccaccaccauaaucaccccuaugaugcgacacaccaucgagaacacuaccgccaacauaucgcucaccgccauagcgaaccaggccgccauccugauggggcuggauaagggcuggccgaucuccaagauggacauuggcgucccccuccuggcucugggaugcuauagccagguuaacccccucacgcugaccgcggccgugcugaugcucgucgcgcacuacgccaucaucgggcccgggcugcaagcgaaggccaccagggaggcacagaagcggacugcagcuggcauaaugaagaacccgacgguggacgggaucguagcuaucgaccuggauccagucguguacgaugcgaaguucgagaaacaacucggccaaaucaugcugcugauccucugcaccagucaaauacugcugaugcgcaccacgugggcgcucugcgagaguauaacguuggccaccggacccuuaaccacccucugggaggggucccccgggaaguuuuggaacacgaccaucgccgucucgauggccaauaucuuccggggcucguaccuggcgggcgccggccucgccuucagccucaugaagucccucggcggcgggcgccgggggaccggggcucagggcgagacgcugggcgagaaguggaagcgccagcucaaccaguugucaaagagcgaguuuaacacguacaagcgguccgggaucauggaggucgaucgcagcgaagcgaaggaaggccugaagcgcggggagacaaccaagcacgcagucagucggggcaccgccaaacuccgcugguuuguggaacgaaaucuggucaaaccggaggggaaggugauugaccugggcuguggccgcggcggguggagcuacuacugcgccgggcugaagaaggugacggaggucaagggguacacaaagggagggcccggccacgaggagcccauccccauggccaccuacggauggaaccucgucaagcugcacuccgguaaggacguguucuucaucccgccagaaaagugcgacacucugcucugcgacaucggcgagaguucccccaacccgacgauagaggagggacgcacgcugcggguccuaaagaugguggagccauggcuucgcgggaaccaauucugcaucaagauccugaacccguacaugcccagcguagucgagacccuagaacagaugcagcggaagcacggcggcaugcucgugcgcaauccccugucccggaacucaacacacgagauguacuggguaaguugugggacgggcaacaucgucagcgcggugaacaugacgucccgcaugcuccucaaccgcuucacgauggcccaccggaagccgaccuacgagcgcgauguggaccugggcgccggcacccggcacgucgccguggagccugagguggccaaccuggacaucauuggccagagaaucgaaaauauuaagcacgaacacaagagcacguggcacuaugacgaggacaaucccuauaaaacgugggcguaccacgggucuuacgaaguaaaacccagcggcuccgccagcagcauggugaauggggucguuaaauuacugaccaagccgugggaugugauacccauggucacgcaaaucgccaugacggacaccacccccuuuggccagcagcggguguucaaggagaagguggacaccaggacgccgaaggccaagcgggggaccgcgcagaucauggaggucaccgcgaaguggcuguggggcuuccuauccaggaacaagaagccucggaucugcaccagagaggaguucacgcggaaggugcgcagcaaugcggccaucggcgccguauucguugacgaaaaccaguggaacucagcgaaggaagccguggaggacgagagguucugggaccuggugcaccgcgagcgggagcugcauaagcagggaaagugcgcuacuugugucuauaauaugauggguaagcgcgagaagaagcucggggaguucgggaaggcuaaggggagccgggccauuugguacauguggcugggcgcgcgcuuccuggaguucgaggcccucggcuucaugaacgaggaccacugguucucccgggagaacagucuguccgggguggaaggugaagggcugcauaagcucggcuacauccugcgcgacaucagcaaaauucccgggggcaacauguaugccgacgacaccgccggcugggauacccgaaucacggaggacgaccugcagaacgaagccaaaaucaccgacauaauggagcccgagcacgcguugcuggccaaauccaucuucaaacugaccuaccagaacaaagugguccgcguacagcggccggccaagaacgguaccguuauggacgucauuagucgucgagaccagcgcggcuccggccaggugggaacguacggccucaacaccuucaccaacauggaagcccagcugauccgccagauggaguccgaggggauuuucagucccagcgagcuggagacccccaaucuagccggccggguccuugauuggcucgagaagcacggggucgagcgccuuaagcggauggcgaucuccggcgacgacugcguggugaagcccaucgaugacagguuugccacggcccugaccgccuuaaacgauauggggaagguccggaaagacaucccccaaugggagccuucaaaaggauggaacgacuggcagcagguccccuucugcagucaccacuuccaccagcucaucaugaaggacggacgcgagauagucguccccugccggaaccaggaugagcuggucgggcgcgcccgggugagccagggcgcgggguggagucugcgugagacggcaugucucggcaaguccuacgcccaaauguggcagcucauguacuuccaccggcgcgacuuaagacuugcagcgaacgccaucugcuccgccguaccgguggacugggugccgaccucccgcacgaccuggagcauccacgcgcaccaccaguggaugacgacagaggacaugcugucgguguggaaucggguguggaucgaggagaaccccuggauggaggacaagacgcacgugucauccuggggcgacgucccguaccugggcaagcgcgaggaccaauggugcggcagccucaucgggcucaccgcucgcgcgaccugggccaccaauauccagguagccaucaaccaagugcggcgccugcuaggcaacgagaacuaccuagauuacaugacgagcaugaagcguuuuaaaaaugagagcgacccggagggugcgcuaugguag

SEQ ID NO: 24090 - RNA, 9879 nt, Artificial Sequence
  derived and/or modified CDS sequence (opt11) from DENV-1__EU660403__SS-prME
agcgucaccaugcugcucaugcugaugcccaccgcccuggccuuccauuuaacuacgcgcggcggggaaccucauaugaucgugucaaagcaagaacguggaaagagccugcuguucaagaccuccgcaggggugaacaugugcacguugauugcaauggaccugggcgagcuaugcgaggacaccaugaccuacaaguguccucgcaucaccgagaccgagcccgaugacguggauuguugguguaacgccacggacaccugggucaccuacgggacgugcagccaaacgggcgagcaccggagagacaaacggucaguagccuuagcuccucacguaggucugggucuagagacucggaccgagaccuggaugucauccgagggcgcguggaagcagauucagagggucgaaacgugggcccuccgccaccccggguucaccguuaucgcccuguuccuagcccaugcgaucgguaccagcaucacacagaaggggaucauauucauacuccugaugcuggugacacccaguauggccaugaggugcguaggcaucgguagccgcgacuucgucgaggggcugucaggcgccacauggguggaugucgugcuggagcaugggagcugcgugaccaccauggccaaggacaagcccacgcuggacaucgagcucuugaagaccgagguuaccaaucccgcuguguugcggaaacucugcaucgaagcgaaaaucaguaacaccacgaccgacagccgcugcccgacccagggcgaggccacccugguggaagaacaagaugccaauuucgucugccggcgcacguucguggacagagggugggggaaugguugcggguuauucgguaaggggucucuuauaacgugcgccaaauucaagugcgugacuaagcuggagggcaaaaucguccaguacgagaacuuaaaguacuccguuaucgugacaguccacacgggcgaccagcaccagguggggaacgaguccaccgaacacggcaccaccgccaccauaacuccucaggcgcccaccaccgaaauccagcuaacugauuauggggcccugacguuggacugcucaccccgcaccggccuggacuucaacgagaugguccugcuuacuaugaaagagaaguccuggcucgugcacaaacagugguuucuggaccugcccuugcccuggaccucgggcgcaaguaccucccaggagaccuggaaucggcaggauuugcuugugaccuucaagaccgcccacgccaagaaacaggaggucgucgugcuaggcagucaggaaggcgcgaugcacaccgcccugaccggggccaccgaaauucagaccucgggcacuaccaccauuuucgccgggcaccucaagugccgccucaaaauggacaagcugaccuugaagggcaugagcuacgucaugugcacgggcuccuucaagcucgagaaggagguggcggaaacgcagcacggcaccguucugguccagaucaaguacgaggguaccgacgcgcccugcaagauccccuuccuaacucaggacgagaaggggguuacccagaacggcaggcugauaacggccaauccgaucgugaccgacaaggagaagcccgucaacauugaggcggagccgcccuuuggggaaagcuacaucaucaucggcgccggcgagaaggcgcucaaguuauccugguucaaaaaggggagcuccaucgggaagauguucgaggcgacggcccgcggggcccgucgaauggccauccugggcgacaccgccugggacuucgggagcauaggcggggucuucaccuccgugggcaagcucguucaccagaucuuuggaaccgcuuacggaguacuguuuagcggcgugagcuggacgaugaagauugggauaggcguccuccucacuuggcugggucugaacucuagguccaccucuuuguccaugaccugcaucgccguaggacuggugacgcuguacuuaggcgucaugguacaagccgacagcgggugcgugaucaacuggaaaggccgggaacugaagugcggguccggaaucuucgugaccaacgaggugcacacuuggaccgagcaguauaaauuccaggccgacagcccgaagcgccuuagcgcagcaaucgguaaggccugggaggaggggguaugcggcauccgguccgccacccgucucgagaacaucauguggaagcagaucagcaacgaacugaaccacaucuugcucgaaaaugauaugaaguucacagucguggugggggacgucgcuggcauccuggcucaggggaagaaaaugauacggccccagcccauggaguacaaguacuccuggaaaagcuggggcaaggccaagauuaucggcgcagacgugcagaacacaaccuucauuauugacgggcccaacacccccgagugccccgacgaccagagagcuuggaacauaugggagguagaggacuacggcuucgggaucuuuacgaccaacauauggcugaagcugcgggacuccuacacccaggucugcgaccacagacugaugagcgcggccauaaaggacuccaaggccgugcacgccgacaugggcuauuggaucgagagcgagaagaacgagaccuggaagcuggcgcgggccucauuuaucgaggugaagacgugcaucuggcccaagucucacacacucuggucgaacggcguccuagagagcgagaugaucauccccaagaucuacgggggcccgaucagucagcauaacuauaggcccggguacuucacacaaaccgccgggcccuggcaucuggggaaguuagagcuggacuucgaccugugcgagggcacgacaguggucgucgacgagcacugcggaaaccgggggccgagccuccggaccaccacggugaccggcaagaucauccacgaguggugcugccgguccugcacccugccgccacugcgcuuuagaggggaagacggcugcugguacgguauggagaucagacccguuaaggaaaaggaggaaaaccuuguaaaaagcauggugagugccgguagcggcgagguggacagcuucucccuggggcugcucugcaucagcauaaucauugaggaggucaugcggucucgcuggucccggaagauguuaaugaccggcacgcuggcuguguucuuucuccuuauaaugggucagcucacguggaacgaccucauccgucugugcaucauggucggagccaacgcguccgaccgcauggggaugggcaccaccuaccuggcucucauggcgacguucaagaugcggccgauguucgccguaggccugcuguuccgccggcucaccagccgcgaggugcugcuacucacuaucgggcugucccugguggccuccgucgaacuccccaacucacucgaggagcugggggacggccucgcgaugggcaucaugauccugaaacuucucacugacuuccagagccaccaacugugggccacgcuguuguccuuaaccuucaucaaaaccaccuucagccugcacuacgcuuggaaaacgauggcaauggugcucuccaucgucucucuguucccccugugucucuccaccaccucucagaagaccacguggcugcccgugcugcucggcuccuuggguugcaagccgcugacuauguuccucaucgcggagaacaagaucuggggccgucgcagcuggccauuaaacgaagggauuauggccgugggcaucgucuccauccugcucagcagccugcugaagaacgaugugccccuggccgggccccuaaucgccggaggcaugcugauugcuugcuacgugaucuccggauccucggcggacuugagccucgagaaggccgccgaggucuccugggaagaagaggccgagcauucaggcgcgucucacaacauccuuguggaggugcaggaugaugggacuaugaagauaaaggaugaggaaagagacgacacccucaccauccugcugaaggcgacgcuccuggccgucagcggcguguacccgcugagcauccccgccacccucuucgugugguacuuuuggcagaaaaagaagcaacgcagcgggguccugugggacaccccgagcccgcccgagguggagcgggccguccuggaugacggcaucuaccgcaucaugcagcgggggcugcucgggcgcagccaggucgggguagggguuuuccaggagaacguauuccacacgauguggcacgugacgcggggcgccgucuuaauguaucaggggaagcgccuggagcccucuugggcgagcgucaagaaggaucucaucucauauggcggaggguggcggcugcagggcucauggaauaccggggaggagguacaggugauagccgucgagcccggcaagaaccccaagaacgugcagacagccccagggaccuucaagacgcccgagggcgaggucggcgcaaucgcccuggauuucaaacccgggacguccggcagccccaucgucaacagggaagggaaaaucguugggcuguacgguaacggcguggucacaacauccggcacguacguaagugcgauagcgcaagccaaggccagccaagaagggccccugcccgagaucgaggacgaggucuuccggaagcgcaaccugaccauaauggaccuccaccccggcuccgggaagacccggcgauaucugccggcgaucguccgggaggcaaucaagcggaagcugcgcacccugauucuggcgcccacgcgggugguggccuccgagauggccgaggcgcugaaggggaugcccauccgcuaccaaacaaccgcggucaaguccgagcacacaggcaaggagauaguggauuuaaugugccacgccacauucaccaugcggcuguuaagccccgugcgcgucccgaauuacaacaugaucauaauggacgaggcccacuucacggaccccagcagcaucgcugcucgcggguacaucuccacccgcguuggaaugggugaagccgcggccaucuuuaugacggccacgccgcccgguagcguagaggcguucccgcaguccaaugccgucauucaagacgaggagcgcgacauccccgaacgcagcuggaacuccggguaugaguggaucacugacuuccccggcaagaccgugugguucguccccagcaucaagucaggcaacgauaucgccaauugccuccggaagaacgggaagcgcgucauccagcugucucggaagacguucgacaccgaguaccagaaaacaaagaacaacgauugggacuacguugugaccacugacauauccgagaugggcgccaacuuccgcgcggaccgagucauugacccacgccgaugccugaaacccgucaucuuaaaggacgggcccgagcgaguaauccuggccggacccaugcccguuaccguggccagcgcagcccagcggagggggcggaucggacgcaaccacaacaaggagggcgaccaguauauuuacauggggcagccccugaacaacgaugaagaccaugcacacuggaccgaggccaagaugcuccuggauaacaucaacacccccgaggggaucaucccggcccuguuugagccggaacgcgagaaguccgcugcaauugacggggaguacaggcucaggggcgaagcgcggaagacauucgucgagcugaugaggcgcggggaccugccaguguggcucagcuacaagguggccuccgaaggauuccaguacagcgaccgccgguggugcuucgacggcgagcgaaacaaucagguucuggaggagaacauggacguagagaucuggacgaaggagggggaaaggaagaagcugcgcccccgguggcuugacgcccgcaccuacucagacccucuggcccugcgggaguucaaggaguucgcggcgggccgccgguccgugucgggcgaccucauccucgagaucgggaaacugccacaacaccucacccagcgcgcccagaacgcccuggacaaccuggucaugcuccacaauuccgagcagggcgggcgugccuaccgacacgcgauggaggaacugcccgauacgaucgagacccugaugcugcuggcgcuuaucgcuguccucaccgguggggugacacuuuucuuccugagcggccgggggcucggcaagaccuccauuggacuuuugugcgucauggccagcagugugcugcuuuggauggccagcguugagccacacuggaucgcggccuccaucauccuggaguucuuucuaaugguccugcugaucccagagccugacagacagcggacgccccaggauaaccaacucgccuacguggugauaggacugcuguucaugauccugaccgucgcugccaaugagaugggccugcuggagaccaccaaaaaggaccucgggauuggucacguagcgguggaaaaccaccaccacgcugccaugcuggacgucgaccuccaccccgccagcgccuggacacuuuacgcuguggccaccacaaucaucacgccgaugaugcgucacacgaucgaaaauacaacagcaaacaucagccugaccgcgaucgccaaccaggcggcgauccugauggggcucgacaagggcuggcccaucagcaaaauggacaucggcguaccguugcuggcccuagggugcuacucccagguaaacccccugacucugacggcugcugucuuaaugcucguggcacacuacgccaucaucggcccggggcugcaggcaaaggccacacgcgaggcccagaagcggaccgcugccgggauuaugaagaaccccacggucgacgggaucguggccauugacuuagaccccguggucuacgacgcaaaauucgagaaacagcugggccaaaucaugcugcuaauccuuugcaccagccaaauccugcucaugcgcacuacuugggcgcuaugcgaauccaucacgcuggccacgggcccgcuaaccaccuugugggagggcagcccggggaaguucuggaacacgacaaucgccguguccauggccaacauauuccgagggucauauuuagccggggcuggccucgccuucucccugaugaaaucccucggaggagggcgucgggggaccggggcacagggcgagacccuaggcgagaaguggaagcgccaguugaaucagcugagcaagucagaguuuaacacguacaaacggagugggaucauggagguggaccgcucagaagccaaggagggccucaagcgcggggagaccaccaagcacgcggucagccgcggaaccgccaagcugagaugguucguggaacgcaacuuagugaagcccgaagggaaggucaucgaucugggcugcggccgcggcgggugguccuacuacugcgccgggcucaagaaggugaccgaagugaagggguacaccaagggaggccccggucacgaggagcccaucccaauggccacguaugguuggaaucucguaaagcuacauagcggcaaggacguguucuucaucccgcccgaaaaaugcgacacccuccugugcgacaucggggaguccagccccaacccgacgaucgaggagggucguacgcugcgggugcucaagauggucgagcccuggcugcgugggaaccaguuuugcaucaagauccugaaucccuauaugcccuccguaguggaaacccucgagcagaugcaacggaagcacggaggaaugcuugugcgcaacccgcucagccgaaauucaacccacgagauguacugggugagcugcgggaccggcaauaucguguccgccgucaacaugacgucccgcaugcuccugaaccgauucaccauggcgcaccggaagcccacguacgagcgagacguagaccucggggccgguacucggcacguagccgucgaacccgaagucgccaaccucgacauaauagggcaacggauagaaaauaucaaacacgagcacaaguccacguggcacuacgacgaagauaaccccuacaagaccugggccuaccacgggagcuaugagguaaagccuuccggaagcgcgucaucaauggucaacgggguggucaaguugcuuacuaaacccugggacguaauccccauggugacccagaucgccaugacagacaccacgccuuuuggccagcagcgggucuucaaggagaaagucgacaccagaacgccaaaggccaagcgggggaccgcccagaucauggagguuaccgccaaguggcucuggggcuuccugagccgcaacaagaagccccggaucugcacccgcgaggaguucacgcggaaaguccgcuccaacgccgccaucggcgcgguguucgucgacgaaaaccaauggaacagcgcuaaggaagcggucgaggacgagcgguucugggaccuagugcaccgcgaacgggagcuccacaagcaggggaagugcgcuaccugcguguacaauaugaugggcaaacgcgagaagaagcugggagaguuuggcaaagccaagggaucccgggccaucugguauauguggcuuggagcccgcuuccucgaguucgaggcccugggcuucaugaacgaagaccacugguucagccgggagaacucccucagcgggguagaaggcgaggggcuccacaaacugggauacauccugcgcgacaucaguaagauccccggcggcaacauguacgccgacgacaccgccgggugggauacccgaaucacggaagaugaccuccagaacgaggccaggaucacugacaucauggagccggagcaugcccugcuggcgaagucgauauucaaacugaccuaccaaaacaagguugugcgcguccagcgacccgccaagaacgguacugugauggacguaaucagccggcgggaccagcgcggcucagggcaggucgguacguacggccuaaacaccuucaccaacauggaggcacagcugauucggcagauggagucagagggcaucuucagccccagcgagcucgagaccccaaaccuagccgagcgcguacuggacuggcuagagaaguauggaguugagcggcugaagcgcauggccaucagcggugacgacugcgucgugaagccgauugaugaccgguucgcgacugcccugaccgcccucaacgacaugggcaagguacgcaaggacaucccacagugggaacccagcaagggcuggaacgacuggcagcaggucccauucugcagccaccacuuccaccaguugaucaugaaggacggccgggaaaucguggugccgugccgcaaccaggacgaguuggucggaagggcccgcgugucccaaggggcuggauggagcuuacgggagaccgcgugccuuggaaagagcuacgcgcagauguggcagcucauguacuuccaccggcgggacuuacgccucgccgccaacgcgaucugcucugcagugcccgucgacuggaucccgacgagucgcacgaccuggaguauccaugcccaccaucaguggaugaccaccgaggauauguuaagcguguggaaccgcguguggaucgaggagaacccguggauggaagacaagacgcacaucucuagcuggggugaugugccguaccuagggaagcgagaggaccaguggugcgguagucugaucggccugaccgcccgggccaccugggcgaccaacauucagguggcuaucaaccaggugcgccggcucauugggaacgagaauuacuuagacuauaugaccagcaugaagcgcuuuaagaacgaaggggaccccgagggagcccugugguga

SEQ ID NO: 24091 - RNA, 9879 nt, Artificial Sequence
  derived and/or modified CDS sequence (opt11) from DENV-1__EU660397__SS-prME
agcguaaccaugcuacucaugcugaugccuaccgcccuggcauuccaccucaccacucguggcggagagccccacaugaucgugagcaagcaggagcggggcaagagccugcuauucaagaccagcgccggugugaacaugugcacccucaucgccauggaucugggggagcugugcgaggacaccaugaccuacaagugcccccgcaucaccgagaccgaacccgacgacguggacugcugguguaacgccacggacaccugggugaccuaugggaccugcagccagacgggcgagcaccggcgcgacaagcgcuccguggcccucgcgccccacgugggccuggggcuggagacccgcaccgaaaccuggaugagcuccgagggcgccuggaagcagauccaacgagucgagacaugggcccuccgccaccccggguucaccgugaucgcccuguuccuggcccaugcgaucggcaccagcaucacccagaaagggaucaucuucauauugcugaugcucgugacgccuuccauggccaugcggugcgucggcaucggcagccgcgacuuuguggaagggcucuccggcgccaccuggguggacgucgugcuggagcacgggagcugcgugaccacuauggccaaagacaagcccacgcuggacaucgaguuguuaaaaacagaggucaccaaccccgccgugcugcggaagcucugcauugaggcgaaaaucuccaauaccacgacagacucacguugcccgacacagggcgaggccacccugguggaggagcaggaugccaacuucgucugccggcgaacguucguagaccggggcugggggaacggcugcggguuguucggcaagggaucccucaucacgugcgccaaguuuaagugcgugaccaagcuugagggcaagaucguccaguacgagaaccugaaguacagcgugaucguaaccguccacacgggggaccagcaccagguggggaacgaauccaccgaacacggcaccaccgcuaccaucacgccacaggcgccaacaaccgagauccagcucaccgacuacggggcgcugacgcuggacugcagcccgcgaaccggccucgacuucaacgagaugguccugcugacaaugaaggagaaguccuggcucgugcacaagcagugguuccuggaccugccccuccccuggaccucgggggccucgacgucccaggagaccuggaaccggcaggaccugcucgugaccuucaagacggcccacgccaagaagcaggaagucguggugcugggcagccaagagggcgcgaugcacacggcucugaccggcgccaccgagauccagaccuccggcacuacuaccaucuucgccgggcaccuuaagugccgccucaagauggacaagcucacgcugcgaggcaugagcuacguaauguguacgggguccuuuaagcucgagaaggagguggcugagacgcagcacggcaccguucugguccagaucaaguacgagggcacggacgcgcccugcaaaauccccuucaguacgcaggacgagaagggggucacccaaaacggccgcuuaaucaccgccaacccgaucgugaccgacaaggagaagcccgucaacauagaggccgagccgcccuuuggcgaauccuauauagugaucggcgccggcgagaaagcgcugaagcucagcugguucaagaagggguccaguaucggaaagauguucgaggccacggcccgcggggcccgccgcauggcuauccugggcgacacugccugggacuucgggucgaucggcggcguguucaccuccguagggaaacuagugcaccagaucuucggcaccgccuacggggugcuguucuccggggucagcuggacgaugaaaaucgggaucggcguucugcugaccuggcucggccugaacucccggagcaccagccugucaaugaccugcaucgccgugggguugguuacgcuguaccugggcgugauggugcaggccgacuccgggugcgucauuaacuggaaaggucgugagcucaagugcggaagcggcaucuucgugaccaacgaggugcacacguggaccgagcaauacaaguuccaggccgauucuccgaagcggcuguccgcggccaucggcaaggccugggaggaggggguuugcgguaucagaagcgcuacccgguuggagaacaucauguggaagcagaucuccaacgagcucaaccacauccugcuggagaacgacaugaaguucacggugguggucggggacguggccggcauccucgcgcaggggaagaagaugauccgcccccagcccauggaguacaaguacuccuggaagucguggggcaaggccaagaucaucggggccgacguacagaacacaaccuucaucaucgaugggcccaacaccccggagugccccgacgaccaacgggccuggaacaucugggagguagaggacuacggcuucgggaucuucacgaccaauaucuggcugaagcugcgcgacucuuauacucagguaugcgaccaucggcucaugucugcugccaucaaggacaguaaggccgugcacgccgacauggguuacuggaucgaguccgagaagaacgaaaccuggaagcuggcucgcgcgagcuuuaucgaggucaagacgugcauauggcccaaaucccauacccuguggucaaacggugugcucgaguccgagaugaucauccccaaaauauacgggggcccgaucagccaacacaacuacaggccgggguacuucacgcaaaccgccggccccuggcacuuagggaagcuggagcuagacuucgaccugugcgagggaacgaccguggucguggacgagcacugcgguaaucgcgguccgucccugagaacuacgacggugacgggcaagaucauccacgaguggugcugucgcucuuguacccugccgccccugcguuuccgcggggaggacggcugcugguacgggauggagauccgacccgucaaagagaaggaggaaaaccuggugaaguccauggugagcgccggaagcggcgaggucgacuccuuuagccucgggcugcugugcauuuccaucaugaucgaggaagucaugcgcagccgguggucccgcaagauguuaaugaccggcacacuggccguguucuuuuugcucaucauggggcagcucacuuggaaugaccugauccgccucugcaucauggucggcgccaacgccagcgaucggauggggaugggcaccaccuaccuggcccugauggcaacguucaagaugcgcccgauguucgccgugggucuccuguuuaggcgccucaccucccgggagguucuccuguuaaccaucgggcucagccuggucgccuccguggagcuccccaacagccucgaagagcugggcgacgggcuggcgaugggcaucaugauccucaagcugcuuaccgauuuccagagucaccagcucugggccacgcugcugagccuaaccuucaucaagaccaccuucuccuuacacuacgccuggaagacgauggccaugguccugagcaucgugagccucuucccccugugcuugagcaccaccucccagaagaccacauggcuccccgugcugcugggcagccucgggugcaagccgcugaccauguuccugaucgcggagaacaaaaucuggggccgacguuccuggccgcucaaugaggggaucauggcugugggcaucgugagcauccuucuaucuucucuccugaagaacgacgugccccuggcugggccccucaucgccggcggcaugcugaucgccugcuacgucaucagcgggucuagcgcggaucugucacucgagaaggccgccgaggugagcugggaggaggaggccgagcacagcggagccagccauaacauccugguggagguccaggacgacggcacuaugaaaaucaaggacgaggagcgcgacgacacccugaccauccuccuaaaggcgacacugcuagccguguccggcguuuauccgcucagcauccccgccacccuguucgucugguacuuuuggcagaagaagaagcagcggucagggguguuaugggacaccccuagcccgcccgagguggagcgcgccguccuggacgacggcaucuaccggaucaugcagcgcggccugcuggggcggagucaggugggcgugggcgucuuccaggagaacguguuccacaccauguggcacgugacgcgcggcgccguacugauguaccaggggaagcggcuggagcccuccugggcgagcgugaagaaggaccugaucagcuacggcggaggguggcgccuucagggcucauggaacaccggggaggaggugcaggucaucgcuguugagccuggcaagaaccccaagaacgugcagacugcgcccgggaccuucaagacgcccgaaggagaagugggggccauagcccuggacuucaagcccgggaccuccggcucccccaucgugaacagagaggggaagaucgugggccuguacggcaacggggucgugaccaccagcgggacuuacgugagcgcgaucgcccaggccaaggccucccaggaggggccgcuccccgagauugaggacgaggucuuccguaagcggaaccugaccaucauggaccugcacccaggcagcgggaagacccgccguuaccucccggcgaucguucgcgaggccaucaagcgcaaguuacggacucugauccuugcccccacgcgcgucguugccuccgagauggcagaggcgcuaaagggcaugcccauaagguaccagaccaccgccgucaagagcgagcacaccggcaaggagaucguggaccugaugugccacgccacauucacgaugcgccuccuguccccuguccgagucccgaacuacaacaugaucaucauggacgaggcccauuucaccgaccccucguccaucgccgcgagaggguacaucucgacccgggugggcaugggggaggcggcggccaucuucaugacugccacgccgccgggcuccgucgaggcguucccgcagagcaaugccgugauccaggaugaggagcgcgacauccccgagcgguccuggaacagcggguaugaguggaucaccgacuuccccggcaagaccgucugguucguccccuccaucaaaagcggcaacgacaucgccaacugcuugcgcaagaacgggaagcguguaauccaacuaucgcggaagacguucgacaccgaauaccagaagacaaaaaacaacgacugggacuacguggucaccacggacaucagcgagaugggcgccaacuuccgggcggaccgcgugaucgacccgcggcgcugcuugaagcccgugauuuuaaaggacgggcccgagcgcgucauccucgccggccccaugcccgugaccguagccuccgccgcccagaggcgggggcgcaucggccgcaaccacaacaaggagggcgaccaguauauauacauggggcagccccugaacaacgacgaggaccacgcgcacuggacugaagcgaagaugcugcucgauaacaucaacacccccgagggcauuauaccggcccuguucgagccggagcgggagaaauccgccgccaucgacggagaguaccgccuccggggcgaggcgcgcaagacuuucguggagcucaugcggcgaggagaccuucccguguggcugucauacaaggucgccagcgagggcuuccaauacagcgaccggagauggugcuucgacggcgagcggaacaaccaagugcucgaggagaauauggacguagagauauggaccaaagagggggagcgcaagaagcugcggccucgcuggcuggacgcccggaccuacucggacccccucgcccugcgcgaguuuaaggaguucgcggcgggacgacgcagcgucuccggcgaccugauccucgagaucggcaaguugccgcagcaccucacgcagcgggcccagaacgcccucgacaaccuggugauguuacacaacagcgagcaaggcggacgggcuuaccggcacgcgauggaagagcuccccgacacgauugagacgcugaugcugcucgcccugaucgccguucugaccggcggggucacccucuucuucuuguccggccgcgggcugggcaagaccagcaucggccuucucugcgucauggccuccagcgugcugcucuggauggccuccgucgagccacacuggaucgcagcaagcauuauucuggaguucuuccugauggugcuccugauccccgagccggaccgacagagaacgccccaggacaaccagcuggccuaugugguaaucggucuccuguucaugauccugaccguggccgccaacgagaugggcuugcuggagaccaccaaaaaggaucuggggaucggccacguggcggucgagaaccaccaccacgccgccaugcucgacguggaccugcaucccgcuagcgccuggacgcuguaugcgguggccacgaccaucaucaccccgaugaugcgccacacgaucgagaacacgaccgccaacaucagccucaccgccaucgccaaccaagcagccauccucauggggcuggacaagggcuggcccaucucaaagauggacaucggcgucccccuccuugcccuggggugcuacagccaggugaaccccuugacacugaccgccgcgguccugaugcucgucgcccacuacgccaucaucggcccaggguugcaggcaaaggccacccgggaggcgcagaagcgcaccgccgcuggcaucaugaaaaacccgacggucgacgggaucguggccaucgaccuggacccuguaguguacgacgccaaguucgagaaacaacucggccagauuauguuacugauccucugcaccucccagauccugcuaaugagaaccaccugggcgcuuugcgagagcauuacgcuggccaccggcccccuuaccacccucugggagggguccccgggcaaguucuggaacacgaccaucgccguuagcauggccaacaucuuccgcggguccuaccuggccggcgcgggccucgccuucagccucaugaagucccucgguggcgggcggcgcgggaccggggcgcagggcgagacccugggcgagaaguggaagcggcagcucaaccagcucucgaagagcgaguucaacacguacaagcgcucggggaucauggaggucgaccggagcgaagccaaggagggacugaagcgcggggagaccaccaagcacgcggugucacggggcaccgccaagcuccgcugguucguggagcggaaucucguuaagcccgaggggaaggugaucgaccuaggcugcggccgcgguggcuggagcuacuacugcgccgggcugaagaagguuacggaggucaaaggcuauaccaagggcgggcccggccacgaggagcccaucccaauggccaccuacggcuggaaccucgugaagcugcacuccggcaaggacguguucuuuaucccgcccgagaagugcgacacccugcucugcgacaucggggaaagcagucccaacccgacaaucgaggagggccggacccugcgcguccugaagaugguggagcccuggcuccgggggaaccaguucugcaucaagauccugaaccccuacaugcccagcguggucgaaacgcuugaacagaugcagcgcaagcacggcggcauguuggugcggaacccgcugucccgcaacagcacccacgaaauguacugggugagcugcgggaccggcaacaucgucagcgccgugaacaugacgucccgcaugcugcucaaccgguucaccauggcgcaccgcaagcccaccuacgagcgggacguggacuuaggggcuggcacccgccacgucgccgucgagcccgagguggcaaaccuugauaucaucggacagcggaucgagaacaucaagcacgagcauaaguccacguggcacuacgaugaggacaacccuuacaagaccugggcguaccacggguccuacgaggucaagccgucaggcuccgcuucaagcaugguaaacggggucgucaaguugcugaccaagcccugggacguaauccccauggucacccaaaucgccaugacggacaccacccccuucggccagcagcgcguguucaaggagaagguagacacccggacgccuaaggccaagcgcgggaccgcccagaucauggaggucaccgccaaauggcuguggggcuuccucucccggaacaagaagccccgcaucugcacccgggaggaguuuacccgcaaggugcggagcaacgcagccaucggcgccguguucgucgacgaaaaccaguggaacuccgccaaggaagcgguggaggacgagcgcuuuugggaccucgugcaccgggagcgggagcugcauaagcaggggaagugcgcgaccugcgucuacaacaugaugggcaagagagagaaaaaguugggggaguucggaaaggccaagggaagcagggccaucugguacauguggcuuggcgcccgcuuccuggaguuugaggcgcugggcuucaugaacgaggaccacugguucucccgcgagaauagcuuauccgggguggagggagagggguuacacaagcucggcuacauccugagggacaucagcaagauccccgggggcaacauguacgcggacgacaccgccggcugggacacccgcaucacggaggacgaccugcagaacgaggcccgcauuacugacaucauggaaccagagcacgcccuccuggcuaaguccaucuucaagcugaccuaccagaacaagguggugcgggugcagcgccccgcaaaaaaugggaccgugauggaugucauaagccggcgcgaccagcgcggauccggccaggugggcacuuacggccuuaacacguuuaccaauauggaggcccagcugauuagacagauggagagcgaggggaucuucuccccaucagagcuggagacccccaaccucgccgaacggguucuggacuggcuggagaaguacggcgucgagcgccucaagcggauggccauuuccggggacgacuguguagugaagccgaucgacgaccgcuucgccacggcccugaccgcccugaacgacaugggcaagguuagaaaggacauaccccagugggagcccagcaagggguggaacgauuggcagcagguccccuucugcucgcaccacuuccaccagcucaucaugaaggacggacgcgagaucguggucccgugccggaaccaggacgagcuggugggucgcgcccgggugagccagggggccggcuggagccugcgcgaaacugcgugccucggaaaguccuacgcccagauguggcagcugauguacuuucaccggcgcgaccugcggcucgccgccaacgcgaucuguagcgccguccccguggacuggauccccaccucccgcacaaccuggagcauccacgcucaccaccaauggaugacuacagaggacaugcucagcgucuggaaccgcgucuggaucgaagagaaccccuggauggaggacaagacgcacaucagcuccuggggcgacgugccguaccucggaaagcgggaggaccaguggugcggcagccucaucggucugaccgcccgcgccacuugggcgaccaacauacagguggccaucaaccagguccggcgccugaucgggaacgagaacuaccucgacuacaugaccuccaugaagcgguucaagaacgagagcgaccccgagggcgcccugugguaa

SEQ ID NO: 24092 - RNA, 9879 nt, Artificial Sequence
  derived and/or modified CDS sequence (opt11) from DENV-1__EU687247__SS-prME
agugugaccaugcugcugaugcuuaugcccaccgcccuggccuuccaccucaccacgcggggcggagaaccccacaugaucguguccaagcaggagcgggggaagagccugcuguuuaagaccuccgccggggugaacaugugcacgcucaucgccauggacuugggcgaguucugcgaggacacuaugaccuacaaaugcccgcgcaucacagaggccgagcccgacgacguggauuguuggugcaacgccaccgauacgugggucacguacgggaccugcagccagaccggggagcaccggcgggauaagcggucgguggcucuggcaccacacgugggccucgggcuggagacgcgcacagaaaccuggaugagcucugaaggcgcuuggaaacagauucagcgggucgagaccugggcccugcgccacccuggguucacggugaucgccuuguuccuggcgcacgccaucggcaccagcaucacacagaaggggaucaucuucauucugcucaugcuggugacccccaguauggccaugcggugcgucggcauuggcucuagagacuuuguggagggguuaaguggcgcaacguggguugacgucguacucgagcacggaagcugcguaaccaccauggccaaggacaaacccacccuggacaucgagcuucucaagacagaagucaccaaccccgcggugcuucggaagcugugcaucgaggccaagaucagcaacaccaccacagacucgcgcugcccgacgcagggcgaggcuacccucguggaggagcaggacgccaacuucguuugccggcgcaccuuuguggaucgcggcugggggaacggcugugggcuguucggcaagggcucccugaucacgugcgcuaaguucaaguguguuacuaagcucgagggcaagaucguccaguacgagaaccuaaaguauucagucauagugaccguccacacgggagaucagcaccagguggggaaugaguccacggagcacgggaccacagcgaccaucacgccccaggcucccagcaccgagauccagcugaccgacuacggggcgcuuaccuuagauugcagcccccgcaccggccuggacuucaacgagaugguccuccugacgaugaaggagaaaucguggcuggugcacaagcagugguuccucgaucugccgcugcccuggacuagcggugccuccacgucucaggaaacuuggaaccggcaggaccuccugguuacauucaagaccgcccacgcgaagaagcaggaggucguaguguuaggcucccaagaaggcgccaugcacaccgcacucaccggggccacggaaauccagaccagcggcaccaccacgaucuucgccgggcaccugaagugccgccugaagauggacaaacucacccugaagggcauguccuacguuaugugcaccgggagcuucaagcuugagaaggaaguggccgagacccagcacggcacgguacucguccagauuaaguacgagggcaccgacgcccccuguaagauccccuucucuacccaggacgagaagggggugacccagaacggccgguugauuacagcaaacccgauuguuaccgacaaggagaagcccgucaacaucgaggccgagccgcccuuuggggagagcuacauugucauuggcgcgggcgagaaggcacugaaguuauccugguucaaaaaggggucaagcaucggaaagauguucgaggccaccgcccgcggugccagacgcauggcgauacucggcgauaccgccugggacuuugggucaauaggcggcguguucacuuccgucgggaagcuagugcaccagauauucggcaccgccuacggggugcuguucagcggcgugagcuggaccaugaaaaucggaaucggugugcuccugaccuggcuuggcuuaaauagccgauccacgagcuugagcaugaccugcaucgccguggggcuggucacgcucuaccugggggugauggugcaggccgacagcgggugcgucaucaacuggaagggccgggagcugaagugcgggucaggcaucuucguuaccaacgaggugcacacguggaccgagcaguacaaguuccaggcggacagcccgaaaagacucagcgccgcaaucggcaaggccugggaggaaggggucugcggaauacgguccgcaaccagacuggaaaacaucauguggaagcagaucagcaaugagcugaaccacauccuccuggaaaacgauaugaagcugaccgugguggucggggauguggcaggcaucuuggcucaggggaagaaaaugauacggccccagcccauggaauacaaguacuccuggaagaucuggggcaaggccaaaaucaucggggccgaugugcaaaacaccacguuuaucaucgacgggcccaacaccccagaaugccccgacgaucagagggcuuggaacaucugggaggucgaggacuacggcuucgggaucuuuaccaccaacauuuggcuaaaguuacgggacagcuacacccaggugugugaccaccgccucauguccgccgccaucaaggacagcaaggccgugcacgccgacauggguuauuggauagaguccgagaagaacgagaccuggaaguuagcgcgggccagcuucaucgaaguaaagaccugcauuuggcccaagucccacacacuguggagcaacggcguacucgaauccgagaugaucauccccaagaucuacgggggcccgaucagccagcacaacuaccgcccaggguacuucacgcaaacggccggccccuggcaccuagggaagcuggagcucgauuuugaccugugugaaggcacuacgguugucguggaugaacacugcggcaaccgcgggccuucccugcgcacgaccaccgugacaggcaagaucauccacgaaugguguugcaggagcugcacuuuaccgccgcuccgcuucaagggggaggacggcugcugguacgggauggagauccggcccgucaaagaaaaggaggagaauuuagugaaguccauggugagcgccggaagcggcgaggucgacucuuucucucuagggcugcuguguauuaguauaaugaucgaggaggugaugcgaucccgauggucccgaaagaugcucaugaccggcaccuuagccguguucuuucugcuuaucaugggccagcugaccuggaacgacuuaauacggcucugcaucaugguaggcgcaaacgcgucagaccgaauggggaugggaacgaccuacuuggcccugauggccaccuucaagaugcgcccgauguucgccgugggccuccuuuuccgccgacugacaagucgggaggugcuucuacugacuaucgggcucagccuagucgcgagcguggagcugcccaauagccucgaagagcugggcgacgggcuggccaugggcaucaugauccucaagcugcugaccgacuuccagucccaccagcucugggccacacuucuguccuugaccuucaucaggacgaccuucucccugcacuacgcauggaagaccauggcaaugguccugagcaucgugucccucuucccccugugccugucgacaacaucccagaagaccacguggcucccugugcugcuggggagcuugggcugcaaaccacuaaccauguuccugaucgcggagaacaaaaucuggggacggaaguccuggccccucaacgaggggaucauggccgucggcaucgugagcaucuugcuaagcucccuacugaagaacgacguuccccucgcggguccucucaucgccggcgguaugcugaucgcgugcuaugucaucagcgguucgagcgcugaucugagcuuggaaaaggccgccgagguguccugggaggaggaggccgagcacuccggcgcgagccacaacauccuggucgagguccaggacgacgggaccaugaagaucaaagacgaggagcgcgaugacaccuuaaccauccuccuuaaggccacccugcucgccgugagcggcguguacccacuuagcauccccgcuacgcuguucguaugguacuucuggcagaagaagaagcagcgguccggagugcucugggacacucccucuccucccgagguggagagagcuguccuggacgacggcaucuaccggaucaugcagaggggucuguuggggagaucccaggugggaguuggcgucuuucaggaaaacguguuccacaccauguggcacgugacccggggagcuguccucauguaccagggaaagcggcuggagcccagcugggccuccguaaaaaaggacuuaaucagcuacggcgguggcuggcguuuacaaggcuccuggaauaccggggaagagguccaggucauagccguggagccuggcaagaacccuaagaauguucagacggcccccggcacuuucaaaacaagcgagggcgaggucggcgcgaucgcgcuggacuucaagcccgguaccucugguagcccuaucguaaaucgggagggcaagaucguaggguuguacggcaacggggucgugacgacgagcgggaccuacgucuccgcaaucgcgcaggccaaggcgagucaagaggggcccuugccggagauugaggacgaggucuuucgcaaacguaaccugaccaucauggaccuucaccccggcuccgggaagacgcgccgguaucuucccgccaucgugcgcgaggccaucaagaggaggcugcgcacccugauccuugccccaacacggguuguggcaagcgaaauggcagaggcccugaaaggcaugcccauccgcuaccagaccacggcugugaaguccgaacauaccgguaaggaaauaguggauuuaaugugccacgcgacauucaccaugcgccuccugagccccguccgcgucccuaauuacaacaugauuaucauggacgaggcccauuucacagacccgucgucuaucgcugccaggggguacaucaguacccgcgucggcaugggggaggccgccgccaucuuuaugaccgcaacgccgccuggcagcgucgaggccuuuccccaguccaacgcagugauccaggaugaggagagagauauaccggagcgcagcuggaacuccggguacgaguggaucacggacuucccaggcaagaccgugugguucguccccagcaucaaguccggcaacgauaucgccaauugucuacggaagaacggaaagcgggugauccaacucucacgcaagaccuucgacaccgaguaccagaagacgaagaacaaugauugggacuacgucgucaccacagacaucuccgagaugggcgcuaacuuccgcgcggaccgggugaucgauccgcgccggugucuaaagccggugauucugaaagacgggcccgagagggucaucuuggccggccccaugcccguaaccgucgccagcgccgcgcagcggcgcggccggauaggucgcaaucacaacaaagagggagaccaguacaucuacauggggcagccccugaacaacgacgaggaucacgcgcacuggacggaggccaagaugcugcucgauaauaucaauacccccgagggcaucauccccgcccuauucgaacccgagcgcgagaaguccgccgcgaucgacggggaguaucgccugcguggugaggcccggaagacauucguggaacucaugcgccgcggggaccugccuguguggcuuagcuauaaggucgccagcgagggcuuccaguacagugauagacgguggugcuuugauggggagcgcaacaaucagguucucgaggagaacauggacguggagauauggaccaaggagggggagcggaagaagcuucgcccacguuggcuggacgcccgcacuuacucagauccccucgcccugcgggaauucaaggaguucgcggcgggccgccgcucggucagcggggacuuaauccucgagauuggcaagcuuccucagcacuugacccagcgagcccagaaugcgcucgacaaccugguuaugcugcacaacuccgagcagggcggccgggcguaccgccacgccauggaggagcuccccgacaccaucgagacguugaugcugcucgcccuuaucgccgugcugacgggcggggugacucucuucuuccugagcggccgagggcuggggaagacuucaaucggccuccugugcgugauggcgagcucggugcugcucuggauggcgagcgucgagccccacuggaucgccgcguccauuauccuagaauucuuucugauggugcugcugaucccugaacccgaucgucagcggacuccgcaggacaaccagcuugccuauguugucaucggcuuauuguucaugauucugaccguugccgcgaacgagaugggccuccuggagacgaccaagaaggaccuggggaucggccacguagccgucgagaaccaccaccacgcugccauguuagacguggaccuucaccccgccagcgcguggacacuguacgcuguggccaccacgaucaucaccccgaugaugcgccacacaaucgagaacaccacggccaacauaagcuugacggccaucgcuaaccaggccgccauacuaauggggcuggauaagggcuggccgaucucgaagauggacaucggcgucccccuccuugccuugggaugcuacucccaaguaaauccucucacccuuacagcggccgugcugaugcucgucgcccacuacgccaucaucggccccggcuuacaagcgaaggcgacgcgcgaagcucaaaagcggaccgccgccggcauuaugaagaacccgaccguggacgggaucgucgccaucgaccuggaccccgucguguacgacgcgaaauucgagaagcagcucggccagaucauguugcuaauccucugcacgucucaaauccuauugaugcgcaccaccugggcauugugcgaguccaucacucuggccaccggcccccugacgacccucugggagggaagccccggcaaauucuggaacaccacgaucgccguguccauggcuaacaucuuccggggaagcuacuuggcgggugccgggcuagccuucagcuuaaugaagucccuagggggugggcgccgggggacgggcgcacagggcgaaaccuugggcgagaaauggaagcgccagcucaaccagcugagcaaguccgaguucaacaccuacaagcguagcgggaucauggagguagaccgcuccgaggcgaaagaaggcuugaagcgaggcgagaccacgaagcacgccguuagccgcggcaccgccaaacuaaggugguucguggagcgcaaccugguaaagccggagggcaaggugauugaccugggaugcggucgcggcggaugguccuacuacugcgccgggcugaagaagguuaccgaagucaagggguacaccaagggcgguccaggacacgaggaacccauacccauggccacuuacggguggaaccucgugaaacugcacagcggcaaagauguguucuuuaucccucccgagaagugcgacacccuucugugcgacaucggggagucuagccccaaccccaccaucgaggagggcagaacccugaggguccugaagaugguagagccguggcugcgcgggaaccaguucugcaucaaaauucugaaccccuacaugcccuccguggucgagacgcuggagcagaugcaacggaaacacggcggcaugcucguacgcaacccccugagccguaacuccacgcacgagauguacuggguuagcugugggacgggcaacaucgucuccgcuguaaacaugacuagccgcauguuacucaacagguucacuauggcucaccggaagccaacguacgagcgcgacguggaccugggggccggcaccaggcacgucgcuguggagcccgaaguggccaaccuugacaucaucggucagagaauagagaauaucaagcacgagcacaaguccaccuggcacuacgacgaagacaaccccuacaagaccugggcguaccacgggagcuaugaggucaagcccagcggaagcgcuagcuccauggugaacggugucgugaagcuccuuacgaagccgugggaugugauccccauggucacacagaucgccaugacggacacgacaccguuuggccaacagcggguguuuaaggagaaggucgacacccgcaccccaaaggccaaacgugggacugcccagaucauggaagucacggcgaaguggcuguggggcuuccucucucgcaacaagaagccgcggaucugcaccagagaggaguuuacucgaaaagugcgcuccaacgccgccaucggcgccguguucgucgacgaaaaccaauggaauuccgcgaaggaggcgguggaggaugagcgguucugggaccuggugcaccgcgaacgggagcuucauaaacaagggaaaugcgccaccuguguguacaauaugaugggcaagcgcgagaagaagcuaggggaguuugggaaggccaaaggaucgcgagcuauuugguacauguggcugggcgcacgcuucuuagaguucgaggcgcucggcuuuaugaaugaagaucacugguuuagcagggagaauuccuugucagggguggagggcgaggggcuacacaaauugggguacauccuccgcgacaucuccaagauacccgggggcaacauguacgccgacgacacggcgggcugggacacccguaucaccgaggaugaccuacagaaugaggccaagaucacagacaucauggagccugagcacgcuuuacuagccaaauccaucuuuaaacugaccuaccaaaacaaaguggugcgcgugcagcgcccggcaaaaaacgggaccgugauggacguaaucucccgucgcgaccagcggggcagcggccagguuggcaccuacggccucaacacuuuuaccaacauggaggcccaacucauccgccagauggaguccgaggggauuuuuucuccguccgagcuggagacuccaaaccucgccggccgggugcugaacuggcuggagaagcaugggguggagcgccucaagcggauggcgaucagcggcgacgacugcguggugaagcccaucgacgaccgauucgccaccgcccugaccgcccugaacgacauggguaagguccggaaggacaucccgcagugggaacccucaaaaggcuggaacgauuggcagcaaguccccuuuuguagccaccacuuccaccagcuaauaaugaaggacggucgcgagaucguggugcccugcagaaaccaggacgagcugguggggcgcgcccgugugagccagggcgcgggguggucucugcgcgagacggccugccucggcaagucguaugcccagauguggcagcugauguauuuucaccggcgugaccugcggcucgccgcgaacgccauaugcuccgcugucccgguggacugggugcccaccagccggaccaccugguccauucaugcccaccaccaauggaugacgacggaagacaugcuguccguauggaaccguguguggaucgaggagaaccccuggauggaggacaagacccacguguccagcuggggcgauguccccuaccuugggaagcgagaggaucaauggugcggcucccucaucggguuaaccgccagggcaacgugggccaccaacauucagguggccaucaaucaggugcgucgccuccugggcaacgaaaacuaccuggacuacaugaccagcaugaaacgguucaaaaacgaguccgacccggagggggcacugugguga

SEQ ID NO: 24093 - RNA, 9879 nt, Artificial Sequence
  derived and/or modified CDS sequence (opt11) from DENV-1__EU660412__SS-prME
agcgugacuaugcugcucauguuaaugcccaccgcacuggcguuccaccuuaccacccgcggaggggagccccauaugaucgugagcaagcaggagcggggcaagagccugcuguucaagaccagcgcgggggucaacauguguaccuuaaucgccauggaccugggcgagcucugcgaagacacgaugaccuacaaguguccgcggaucaccgaggccgagcccgacgacguggacugcuggugcaaugccaccgacacguggguuaccuacgguaccugcagccagaccggcgagcaccgucgcgacaagcgguccguggccuuggcgccccacguggggcuggggcucgagacgcgcaccgagaccuggaugagcagcgagggugccuggaagcaaauccagagggucgagacgugggcccucagacaccccggguucacggugaucgcccuguuucucgcgcacgcuaucggcaccagcauaacccagaaggggaucaucuucaucuugcugaugcuggugacccccuccauggccaugcgguguguaggcaucgggagccgcgacuucguggaggggcucucuggcgccacguggguggauguugugcuggagcacgggagcugcgugaccaccauggcuaaggacaagccaacacuggacauugaacuccugaaaacagaggucaccaaccccgcaguguuacggaagcucugcaucgaggccaagaucuccaacaccaccacggauagccgguguccuacgcagggcgaggcuacccugguagaggaacaggacgccaacuucgugugcaggcgcaccuuugucgaccggggcugggggaacggcugcgggcuguuuggaaaggggucccucaucacgugcgccaaguucaaaugcgucacuaaacuggagggaaaaaucguucaauacgaaaaccugaaguacagcgugaucgugaccguccacaccggcgaccagcaccagguggggaaugaauccacggaacacggcaccacggccaccaucacgccccaggccccgaccacggagauacagcucacugacuauggagcccugacccuggacugcagcccccgcacaggucucgacuuuaacgagaugguacugcugaccaugaaagaaaagucguggcugguacacaagcagugguuccuggaccuaccccuccccuggaccagcggugcuagcacuagccaggagacguggaaccggcaagacuuacuggugaccuuuaagaccgcucacgcgaagaagcaagagguugugguguugggcucucaagagggcgcgaugcacacagcccugacaggugcuacggagauccagaccuccgggaccacgaccaucuucgccgggcaucugaagugccguuugaagauggacaagcugacgcugaagggcaugagcuaugucaugugcaccggguccuucaaguuagagaaggaaguggcggagacgcagcacggcaccguucugguccagaucaaauacgagggcacggaugccccaugcaagauucccuucagcacucaggacgagaagggggugacgcagaacggcagacugaucaccgccaacccgaucgugaccgacaaagaaaagcccguaaacaucgaggcugagccgcccuucggggaauccuacauagugauaggagcgggcgaaaaggcccugaagcucagcugguucaagaagggcuccaguaucggcaagauguucgaggcgacugcccgcggggcccggcgcauggccauucugggcgacacggccugggacuucgguuccauaggcggcguguucaccagcgucgggaagcuggugcaucaaaucuuuggcaccgccuauggugucuuguucuccggcgucagcuggaccaugaagaucgggaucggggugcuacugacguggcucgggcuaaauucccgcucgacuucccugucuaugacguguaucgccgucgggcucguuacccuguaccugggugugauggugcaggccgacuccggaugcgucaucaacuggaaaggccgggagcucaagugcgggagcggcaucuucgugacgaacgaggugcacaccuggaccgagcaguacaaguuccaggcggacagcccgaagcggcuauccgccgcuaucgguaaggcuugggaggagggggucugcgguauccggagcgccacacggcuagagaauaucauguggaagcagaucucaaacgagcucaaucacauucugcuggaaaacgacaugaagcucaccgugguggucggggauguugcgggcauccuggggcaagguaagaagaugauccggccacagcccauggaguacaaauacaguuggaaguccugggguaaggcgaagaucaucggggccgaugcacaaaacacgaccuucaucauagacggccccaauaccccggagugcccagacgaccagcgcgcguggaacauaugggagguggaggauuacggguuuggcaucuucaccacgaacaucuggcugaagcuccgggacucguacacccaagucugcgaccaucgauugauguccgcagccaucaaagacagcaaggccgugcaugccgacaugggguacuggaucgaguccgagaagaacgagacguggaaacuugcucgggccucuuucauugaggugaagacaugcaucuggcccaaaucccacacgcucuggagcaacgggguccuggaauccgagaugauuauacccaagaucuacggcgggccgaucucucagcacaauuaccgccccggguauuucacccaaacggccgggccguggcaccugggcaagcucgagcuagacuucgaccugugcgaggguaccacggucguuguggacgagcacugcgggaaucggggcccuagccuccggacuaccaccgugacggggaagaucauccacgaguggugcugccggagcugcacgcuuccgccccugcgcuuccggggagaagacggcugcugguauggcauggagauccggcccgucaaggagaaggaagagaaccucguaaaauccaugguuucugccggcaguggggagguggacucuuucagccugggccugcucugcaucuccaucaugaucgaggagguuaugcggagccguuggucccggaagaugcugaugacuggcaccuuggccguauuuuuccucuugaucaugggccaauuaacguggaacgacuuaauccgccuuugcauaaugguuggggcgaacgccagcgaccgcaugggcaugggcaccaccuacuuggcccucauggccaccuucaaaaugcgcccgauguucgccgucgggcugcuguuccgccggcucacaucccgcgaagugcuguuguugaccauaggccucagccugguggcauccgucgagcuaccaaacagucuagaggaacugggggacggacucgcaaugggaaucaugauccugaagcugcucacggauuuucaaucccaccagcugugggccaccuuacugagccugacguucaucaagaccaccuuuagccuccauuacgccuggaagaccauggcgaugguguugaguaucgucucccuauucccccugugccucucgacuaccucccagaagacuaccuggcuucccguguugcuggggagccugggcugcaagccguuaacgauguuucucauagccgagaacaagaucugggggcggaaguccuggccccugaacgagggcaucauggccguggggaucgucagcauccugcugagcucccugcucaaaaacgacgucccccucgccggcccucugauagcaggcggaaugcugaucgcaugcuacgucaucagcggcuccucagccgacuuauccuuagagaaggccgccgaggucaguugggaggaggaggcugagcacucuggggcuagucacaacauccugguggagguucaggacgacggcaccaugaagauuaaggacgaggagcgcgacgacacccucacgauucugcugaaagccacccugcuggccgucagugggguguacccgcugagcauccccgccacguuauucgugugguacuucuggcagaagaagaagcaaagauccggcguccugugggacacccccagcccucccgaggucgaacgcgccgugcuggacgacgguaucuaccgaaucaugcagcgcgggcugcucggcaggucccaggugggggugggcguguuccaggagaauguguuucacaccauguggcacguuacaagaggggcaguucugauguaccaaggcaaacggcucgagcccuccugggcuuccgucaagaaagaccugauuuccuacggagguggcuggcgcuugagggguuccuggaacacgggcgaggagguccaggugaucgcuguugagccgggaaagaacccuaagaacgugcagaccgcacccggaacuuuuaagacccccgaaggcgaggugggggccauagcguuagacuuuaagccagguaccagcgggucccccauagucaaccgcgagggcaagauagugggcuuauacgggaacggcguagugaccacuagcggcaccuacgugagcgcgaucgcacaagccaaggcgucccaggagggcccgcugccggagauugaggacgagguguuccggaagcgcaaccugacgauuauggaucuccaccccgggucggggaagacccggagauaucucccggccaucguccgggaggccauuaaacgcaaacuccguacccucauacuggcccccacgagaguggucgccagcgagauggcggaagcccugaagggcaugcccauccgcuaccagacgaccgccgucaagagcgagcacaccgggaaggagaucguggaccucaugugucacgccaccuucacgaugagacugcuuucgcccguccgugucccgaacuacaacaugaucauuauggaugaggcccacuucaccgacccaagcuccauagcggccaggggguacaucagcacacgaguggggaugggggaggccgccgccaucuucaugaccgcgaccccgcccggguccgucgaggcauucccgcagagcaacgcggucauucaggacgaggagcgcgacauccccgagagguccuggaacagcggcuacgaguggaucaccgauuuccccggcaagaccgugugguucgugcccucaaucaagagcgggaacgacaucgcaaacugccuccggaagaacggaaagcgcguaauucagcugucccggaagacauucgacacggaauaccagaaaaccaagaacaacgacugggacuaugucgucaccacugacaucagugagaugggcgcgaacuuccgcgccgaccgggucauugacccaagacggugccugaagcccgugauucucaaggacggacccgagcgugugauccuugccgggcccaugccgguuacgguggccuccgccgcccagcgccgcggccggaucggccgcaaccacaacaaggagggggaccaguauauauacaugggccagccccugaauaacgacgaagaccacgcccauuggacagaggccaaaauguuacuggacaacaucaauaccccagaagggaucauccccgcgcuguuugagccggagcgcgagaaguccgccgcuguagauggcgaguaccggcuccgcggggaggcccggaagaccuucguggagcugaugcguagaggagaccugcccguguggcucuccuacaagguugccagcgagggcuuccaguacucagaucgccgguggugcuucgacggcgagagaaauaaccaggugcuggaggagaacauggacguggagaucuggacaaaagagggcgaacggaagaagcugagaccccgguggcucgacgcccgcaccuacuccgacccccuggcacugcgggaguucaaggaguucgcugcggggcgccggagcgucaguggcgaccucauucuggagauuggcaagcuaccgcagcaccuaacccagcgagcccagaaugcccuggauaacuugguaaugcuccauaacagcgagcagggugggcgggcuuaccgccaugccauggaggagcugcccgacacuauugagacgcugaugcuccucgcccugaucgccgugcuaaccgggggugucacucuuuucuuccugucggggcggggcuugggcaaaacgagcaucgggcugcugugcgugauggccuccucggugcugcuguggauggcgucugucgaaccucacuggaucgccgccucuauaauccuggaguucuuuuugauggugcuucugauccccgagccggacagacagcgaacaccccaagacaaucaacucgccuauguggucaucggcuuacuguucaugauccucacgguggccgccaacgagaugggccuucuggagaccaccaaaaaggaccucggcaucgggcacguggccgucgagaaccaucaccacgccgcuaugcuggacguagaccugcaucccgccuccgcauggacauuauaugccgucgccacgaccaucaucaccccaaugaugcgccacaccaucgagaacacgaccgcgaacauuagccugaccgcgauugccaaccaggccgccauccuuaugggucucgacaagggcuggccgaucaguaaaauggacaucggcgugccccuccuggcacucggcugcuauagccagguaaacccucugacucucacugcggccguccucaugcuugucgcccacuacgccaucaucgggccgggccugcaggccaaggcgacccgcgaggcccaaaagcgcaccgccgccgguaucaugaagaaccccacggucgacggcaucguagccauugaccucgacccugucgucuacgaugcgaaguuugagaagcaguuagggcagaucaugcugcucauucugugcacgucccagauccugcucaugcggaccaccugggccuuaugcgagagcaucacccuggccacggggccuuugaccacacuuugggaaggcagcccggggaaguuuuggaacacaacuaucgccgugagcauggccaacaucuucagaggcuccuaucuggcgggcgccgggcucgccuuuucccugaugaaguccuuaggcgggggccggcgggggacaggcgcccagggcgagacccucggggaaaaauggaagagacaacugaaccagcugagcaagagcgaguucaacaccuacaagagguccgguauaauggaagucgaccgcucggaggccaaggaggggcucaagcggggcgagacgaccaagcacgcagugucccgcggaaccgccaagcuacguugguucguggagcgcaaucuugucaagcccgaggguaaggugaucgaucuggggugcggccggggcggguggagcuacuauugcgccggacucaagaaaguaaccgaggugaaaggguacaccaagggaggccccgggcacgaggagcccaucccuauggccacuuauggcuggaaccugguuaagcuacacuccgggaaagauguguucuuuaucccgcccgagaagugcgacacccuccugugcgauaucggcgaaagcagucccaacccgaccaucgaggagggccgaacucugcggguccucaagaugguggaacccuggcugcgcggcaaccaauucugcaucaagauccugaaccccuacaugcccuccguagucgaggcgcucgaacagaugcagcggaagcacggcggcaugcuggugcguaacccccugucacggaacagcacccaugagauguacuggguaucaugcggcacagggaacaucguuagcgccgugaacaugaccagccgcaugcuccugaauagguucaccauggcccaccggaaaccgacguacgagcgggacguggaccuaggcaccgggacccggcaugucgcaguagagcccgagguggccaaucucgacaucauagggcaacggaucgagaacaucaagcacgagcacaaauccaccuggcacuacgacgaggacaauccuuacaagacgugggccuaccaugggagcuacgagguuaaaccgagcggcuccgcuagcagcauggugaacggggucgugaagcugcucacaaagcccugggacgugauccccauggugacccagaucgcaaugaccgacacgacccccuucgggcaacagcguguguucaaggagaagguggacaccaggacccccaaggccaagcgggguaccgcccaaaucauggaagucacugcgcgcuggcucuggggcuuccucagccggaacaagaagccucgcaucugcaccagggaggaguucaccaggaagguccgcagcaacgcugccaucggugccguguucgucgacgagaaccaguggaacuccgcgaaggaagcgguggaggacgagcgcuuuugggacuuggugcaccgggagcgcgaguugcacaagcagggcaagugcgcuacuugcgucuacaauaugauggggaagcgggagaagaagcugggcgaguucggcaaggccaaagggucgagagcuaucugguacauguggcuaggugcccgcuucuuagaguuugaggcacuuggguucaugaacgaagaccacugguucucccgcgaaaacagccuguccggcguggagggggaggguuuacacaaacuuggguacauucugcgggacaucucuaagauucccggcggcaacauguaugccgacgacaccgccgggugggacacccgcaucaccgaggacgaccuccaaaaugaggccaagaucacugacaucauggagccggaacacgcgcuccuggccaaggccauauucaaacucaccuaccagaacaaaguggugcgcgugcagcggccagccaaaaacggcacugugauggaugucaucucccggcgggaccagcgcgggagcggccaggugggcaccuacgggcuaaacacguucaccaacauggaggcccagcugauccgucagauggaguccgagggcaucuucagccccuccgagcucgagacccccaaccuggccgagcgcgcucuggacuggcuggagaaguacgggguagaaaggcugaagcggauggcgaucaguggcgacgacugcgucgugaagccgaucgacgaccgguuugcuaccgcccuuacggcgcucaacgauaugggaaagguccgcaaggacauaccccaaugggagcccuccaagggcuggaacgauuggcagcaggucccguucugcucacaccauuuccaccagcugaucaugaaagacggccgcgagaucguggugccguguaggaaucaggacgagcuugucgggcgggcacgcgugucccagggcgccgguuggucccuccgugagaccgccugccugggcaaaagcuacgcgcagauguggcaguuaauguacuuccaccgccgggaccuucgauuggccgccaacgccauuugcucugccgugcccgucgauugggugccuaccagccgaaccaccugguccauccacgcgcaucaccaguggaugaccaccgaggacaugcugagcguguggaaccgcgucuggaucgaggagaaccccuggauggaggacaagacccacaucucuagcugggaggacguucccuaccucgggaagcgcgaggaccagugguguggcuccuuaaucggccugacggcccgggcgaccugggccacaaauauccagguggcgaucaaccagguacggcggcucaucgggaacgagaacuaucuggacuacaugauuagcaugaagcgcuucaagaacgaaagugacccagaaggcgcgcugugguga

SEQ ID NO: 24094 - RNA, 9879 nt, Artificial Sequence
  derived and/or modified CDS sequence (opt11) from DENV-1__EU660418__SS-prME
agcguaacgaugcucuuaaugcugaugcccaccgcacuggccuuccacuuaacuacaagggguggcgagccccacaugaucguuagcaaacaggagagggguaagagcuuacuuuucaagaccagcgccggggugaacauguguacccuuaucgcaauggaccuaggcgaguuaugcgaggauaccaugacauacaagugcccccgcaucaccgaaaccgagcccgaugacguggauugcuggugcaaugccacugacaccuggguuaccuacggcaccuguagucagacgggcgagcaccggcgugacaagcgguccgucgcccucgcgccccaugugggccuugggcuagaaacccggaccgaaaccuggaugagcuccgagggcgccuggaaacagauccagaggguggagacgugggcccuccgccaccccggguucacagugauugcgcuguuccuggcccaugcgaucggcaccagcaucacacaaaaagggaucaucuuuauccuucugaugcuggugacgcccuccauggcuaugcggugcguugguaucggcagccgcgauuucguggagggacucuccggcgccaccuggguggacguagugcuggagcacggguccugcgugacaacaauggccaaggauaagccgacuuuagauaucgaacuccuaaagaccgagguaaccaauccagccguguuacgaaagcucugcauagaggcgaagaucuccaacacgacgaccgacucucguugcccgacccagggcgaggccacccugguagaggaacaggacgccaacuuugucugccggaggacguuuguagaccgcggaugggggaacggguguggacuguucggcaaggggucucuuaucacgugcgcgaaauucaaaugcgugaccaagcucgagggcaaaaucguccaguacgagaaccugaaguauagcgugauuguaaccguccacaccggcgaccagcaucagguggggaacgagucuaccgaacacggcacaaccgcaaccaucacgccacaagcccccaccaccgaaauccaguuaaccgauuacggggcccugacgcuagauuguagcccccggaccggucuggacuucaaugagaugguccuguugaccaugaaggagaagucguggcucgugcacaagcagugguuucuugauuugccccuacccuggacuucgggggccuccacgagucaagagaccuggaauaggcaagaucugcuuguaaccuucaagaccgcccacgcgaagaaacaagaggucgugguccucgguagccaggaaggcgcuaugcacaccgcccugacaggggccaccgagauccagaccucuggaacgacaaccaucuuugcaggccacuuaaaaugccgccucaagauggauaaacuuacccugaaagguaugagcuacguaaugugcacaggcuccuucaagcucgaaaaggaagucgcagagacccaacaugggaccguacugguccagaucaaauaugaggguaccgaugcucccuguaaaauccccuucaguacgcaagaugagaagggcgucacacagaacggacggcuuauaacggcuaacccgauuguaaccgacaaggagaaacccgucaacaucgaagccgagccgcccuucggcgagucauauaucgugauuggcgcgggcgaaaaggcgcugaaacuuagcugguuuaagaaggguucuagcaucggcaaaauguucgaggccacggcccgcggggcucggcgcauggcgauccugggugacacggcgugggacuucggguccauuggcgguguguucaccagcguugggaagcucgugcaccagaucuucggcaccgcguacgggguccucuuuuccggggucaguuggacgaugaagauagggaucggcgugcuguuaaccuggcucggacuaaacucucgcagcacuucccuaagcaugacauguauagcugugggacucgucacgcuguaccugggugugauggugcaggcggauuccgggugugucaucaacuggaaaggccgggagcuaaagugcgggagcggcaucuucgugaccaaugaggugcauacguggacagagcaguacaaguuccaggcagacagcccgaagagguuauccgcggcaaucggcaaggcaugggaggaaggcgucugcggcauccgguccgccacccgccuggagaauauaauguggaagcagaucucaaacgagcucaaccauauccugcuggagaaugacaugaaguucacgguuguagucggggacgucgcgggcauccucgcacaggggaagaaaaugauccggccacagcccauggaguauaaauauagcuggaaauccugggggaaagccaagaucaucggcgccgauguccagaacaccaccuuuaucaucgacgggcccaacacgccugagugcccugacgaccagcgggcguggaacaucugggaggucgaggacuacggcuuugggaucuuuacgaccaacauuuggcugaaauugcgggacaguuauacacagguaugcgaccacagacucaugagcgcggcgauaaaagacagcaaggccguccaugcagacaugggauacuggaucgagucugaaaagaacgagaccuggaagcuggcccgggccagcuuuauugaagucaagacgugcaucuggcccaagucgcacacccugugguccaacgggguguuagaguccgagaugaucaucccaaaaauauauggaggucccaucagucagcacaauuaccggcccggguacuucacccagaccgccgggcccuggcacuuagggaaauuggagcucgacuucgaucuuugugagggcacgaccguggucguggaugagcauugcgguaauagggguccgucccugcgcaccacgacggucaccggcaaaauaauccacgaauggugcugccgguccugcacccucccaccccuccgcuuccgcggcgaagauggcugcugguacgggauggaaauccgcccugucaaggagaaggaagagaaccuuguaaagucaaugguuagcgcaggaagcggagagguugauuccuucagccucgggcuccuuuguauuuccaucaugaucgaggaggucaugcggagccgcuggucgcggaagaugcucaugaccggcacacuggccguguucuuccuguugauuaugggucagcugaccuggaacgaucucaucagacucugcaucauggucggcgccaaugcgagugaucgcauggggauggguaccaccuacuuggcguuaauggcgacguuuaagaugcggccuauguucgcggugggccuccuuuuccgacggcugacaucgcgugagguucucuuacugaccauagggcucucacugguugccucgguugagcugcccaacagccuggaagaacugggggacgggcuugccaugggcauuaugauucugaagcuguuaaccgacuuucaaucccaucagcucugggccacacugcugagccuaacuuucaucaagacuaccuucagucugcacuacgccuggaagacaauggccaugguccugagcauugugagccucuucccccugugccugucuacaacgagucagaaaacuacauggcuccccgugcuucuaggcagccuaggcuguaagccccugaccauguuucugauagcagagaacaagaucuggggccggcgcucuuggccccuaaacgaggguaucauggccguaggcaucgucagcauacuguuaagcucccuccuaaagaacgacgugccccuggccgggccuuugaucgcaggaggcaugcuuaucgcaugcuacguuaucagcgguuccagcgcugaucuauccuuagagaaagccgccgaggucagcugggaggaggaggcagaacacucaggcgcaagccacaacauucugguggagguccaggacgauggcaccaugaaaaucaaggacgaagaacgggacgacacccugaccauacuccugaaggcgacgcugcuugccgucucgggcguguauccgcugaguauuccggcaacauuguucgucuggcacuucuggcagaagaagaagcaacgcagcgggguacucugggacacgcccagcccgcccgaggugggccgggccguccuggacgauggaaucuaccgcaucaugcagcggggucugcugggccgcucccaagugggggugggggucuuccaggagaacguguuccauacgauguggcacgugacucgcggggcuguccucauguaccaggguaaacgccuggagcccagcugggcgucagucaaaaaggaucugauaucguacggaggggguuggagauugcaggguuccuggaacaccggcgaggaggugcaagucaucgcuguggagcccgggaagaaucccaagaacgugcagaccgcccccggaaccuucaagacacccgagggcgaggucggagccaucgccuuagacuucaaacccggcaccagcggcagccccaucgugaacagggaggggaagauuguggggcucuacggaaacggagucgugacaacgagcgggaccuacgugagcgcgauugcccaggccaaagccucacaggaggguccgcugcccgagaucgaggaugaggucuuccguaagcgcaaccuaaccaucauggaccuccaccccgggucgggcaagacccggcgcuaccuuccggcgaucguccgggaggccaucaagcgcaaguuacguacccuuauuuuagcacccacacggguggucgccuccgagauggcugaggcgcucaaggggaugccuauccgcuaccagacgacggccguuaagucugagcauaccggcaaggagaucguugaucugaugugccacgccacguuuacaaugcggcuacugucccccguacgugugccgaauuacaacaugaucaucauggaugaagcccacuucacggaucccuccuccaucgcggcgagaggcuacauaagcacccgcguggguaugggagaggcagccgccaucuucaugacggcuacgccgcccggaucagucgaggcguucccgcaaagcaacgccgugauucaggacgaggagcgggacauccccgagcguuccuggaacagcggcuaugaguggauuaccgacuuuccuggcaagaccgugugguucguccccuccaucaagucagggaaugauaucgccaacugucugcggaagaacgguaaacgcgucauccaauuaucccggaagaccuucgacaccgaguaccagaagaccaagaauaacgacugggacuacguggucaccacggacaucucagaaaugggggccaacuuccgcgcagaccgcguaaucgauccgcgccggugccugaaaccugugauacugaaggacgggcccgagagagucaucuuggccggaccgaugccagucaccguggcuuccgccgcacagcggcgcggaaggauuggccgcaaccacaacaaggagggggaccaauacauuuauaugggccagccccucaacaacgacgaggaucacgcgcacuggaccgaagccaagaugcugcucgacaauaucaauacgcccgagggcaucauccccgcccuguuugagccagagcgcgagaaguccgccgcuaucgacggcgaguacagacugcgcggggaagcacgcaagacguuuguagagcuuaugagacggggugaucuucccguguggcuguccuauaaggucgcgagcgaaggcuuccaguacucagaccgccgguggugcuucgauggggaaaggaauaaccagguguuagaggagaauauggacguggaaaucuggaccaaggaaggcgagagaaagaaacuacgcccccgguggcucgacgcgcgaacauauuccgacccccuggcccugcgggaguucaaggaguuugcggcuggacgccggagcguaucgggagaccugauccucgagaucgggaagcuaccgcagcaccugacacagcgcgcccagaacgcccucgauaaccuggucaugcugcacaacagcgagcagggcgggcgggccuaccgccacgcgauggaggaacugcccgauaccaucgaaacccugaugcugcucgcuuugauagccguccugacgggcggcgugacccuuuucuuccuuucgggucggggccugggcaaaaccaguauuggauugcuaugcgugauggccagcagcgugcuguuauggauggccuccguggagccccacuggauugcggccagcauaauccuggaguucuuccugaugguacuucuaaucccagagccggacaggcaacgaacuccacaggacaaucaacuggcauacguugucauuggccuccuguuuaugauccugaccguugccgcuaacgaaaugggccuccuugagaccacuaagaaggaucuuggcauuggucacgucgcggucgagaaucaucaccacgccgccaugcuagacguggaucugcaccccgccuccgcuuggacacuguacgcgguagccacgaccauaaucacgccuaugaugcgucacaccaucgagaacaccaccgccaacaucucgcuaaccgccaucgccaaccaggcggcuauucugaugggccuggacaaaggcuggccaaucuccaagauggacaucggggucccccuucuggcacuugggugcuacagccaggugaacccucucacucuaaccgccgcugugcugaugcuagucgcccacuacgcuaucaucgggccuggacugcaggccaaggccacccgcgaggcacagaaaaggaccgccgcagggaucaugaagaaucccacugucgauggcaucguugccaucgaccuggaccccgucguguacgacgccaaguucgaaaaacagcugggccagauaaugcugcugauccucuguaccucccagauacuccugaugcgcacgacgugggcucucugcgagucaaucacgcuggcaaccggcccccucaccacucugugggagggcucuccgggaaaguucuggaacacgacuaucgccguuagcauggcuaacauauuccggggcaguuaucuggcuggcgcgggguuggccuucagccucaugaagucccugggcggcggacggcggggaaccggggcacagggcgagacccugggggagaaguggaagcgucagcuuaaccaacuguccaagagcgaguucaacacguacaagcgguccggaauaauggagguagaccgcucggaggccaaggaaggucuaaagaggggcgaaaccaccaaacacgcggugucccgcgguacggccaaacuccggugguucguugagcgcaaccuagugaagcccgaggggaaggucaucgacuuaggcugcggaagaggcggguggagcuauuacugcgccgggcugaaaaaggugacggaagucaagggguacaccaagggcggccccgggcacgaggagcccauaccgauggccacauacggcuggaacuuggugaaacugcacuccggcaaggacgucuucuucaucccgccggaaaagugcgauacgcugcucugugacauuggcgagagcuccccaaaccccacgauugaagaagggcgcacccugcgggucuugaagaugguggaaccuugguuacgggggaaccaguucuguauaaagauccugaacccuuauaugcccucgguggucgagacccuugaacaaaugcagcgaaaacacggagggaugcucguucggaacccacugucccgaaauucgacccacgagauguauugggucaguugcggcacggggaacaucguaucggccgugaacaugaccucacgcauguuacucaaccgcuucacgauggcgcaccggaaacccacguacgagcgcgaugucgaccuuggcgccgguacccggcacgucgcgguggagcccgaaguggccaauuuggacaucaucggucagcgaaucgaaaauaucaaacaugaacacaagagcacguggcacuacgacgaggacaaucccuauaagaccugggccuaccacggcuccuacgaggucaaaccgagcggguccgcaagcagcauggugaacggagucgucaagcuccugaccaagccgugggacgucaucccuauggucacccaaaucgcgaugacggacacaacccccuucgggcagcagcgcguguuuaaagagaaggucgacacuaggacgccgaaggccaaacggggcaccgcgcaaaucauggaggucacagccaaguggcuguggggguuccucucccgcaacaagaagccgaggaucugcacuagagaggaguucacucgcaaggugcgaagcaacgcggccaucggggccguguuugucgacgagaaccaauggaacuccgccaaggaagcuguugaagacgagcgguucugggacuugguacaccgcgagcgggagcugcacaagcaggggaagugcgcgaccugcgucuacaacaugaugggaaagcgugagaaaaagcucggcgaguucggcaaggccaaagggucgcgggccauaugguauauguggcugggcgcccguuuccuggaguucgaggcucucggauucaugaacgaggaccacugguucucgcgggaaaacagucuuuccgguguggagggggagggccugcauaaacucggcuacauccugcgcgacaucucaaauaucccgggaggcaacauguacgccgacgacaccgcugggugggacacacggaucaccgaagacgaccugcagaacgaggcccgcaucaccgacaucauggaaccggagcacgcccuccuugccaagagcaucuuuaagcugacauaccagaacaaggucguacgagugcagcguccagcaaagaacggcaccgugauggacgucaucaguagacgggaccagcgugguuccggccaggucggcacguacgggcugaacaccuucaccaacauggaggcccagcucauucgccaaauggaguccgaggggauauuuucgcccagcgagcuugagacccccaaucuagcggagaggguucuggacugguuagaaaaguacggggucgagcggcucaaacgcauggccauuucaggcgacgacuguguggugaagccuaucgacgacagguucgcaacugcccuuacagcccugaacgacauggggaagguccgcaaggauaucccccagugggagccgucgaaggguuggaaugauuggcagcaggucccauucugcucucaccacuuucaccaacuuaucaugaaagacggcagagagaucgugguaccgugcaggaaccaggacgaacugguggggcgcgcccgugugagccaaggagcaggauggagccuucgcgagaccgcgugccucggcaaguccuacgcccaaauguggcagcucauguauuuucaccgucgugacuugcggcuagccgccaacgcgaucugcucggccguucccguggacuggauccccacuuccagaaccaccuggagcauccacgcccaccaccaguggaugaccacugaggacaugcuguccguguggaaccgcguuuggauugaggaaaaccccuggauggaggacaagacucacauuuccuccuggggugacgugccguaccucggcaagcgcgaggaccaauggugcggcucucucaucggguuaaccgcucgggccaccugggcgacuaauauacagguggcaaucaaccaggucaggcggcugaucgguaacgaaaacuacuuagauuacaugaccuccaugaagcgcuucaagaacgagagcgacccagaaggagccuuaugguga

SEQ ID NO: 24095 - RNA, 9879 nt, Artificial Sequence
  derived and/or modified CDS sequence (opt11) from DENV-1__EU677151__SS-prME
agcgugaccaugcuguugaugcugauccccacugccuuggccuuucaccucaccaccagaggaggggagccccacaugauugucagcaaacaggagcgggggaaaagccugcuguucaagaccagcgcgggcguuaacaugugcacccucaucgccauggaccugggcgaacugugcgaggacacaaugacguacaagugcccacguauaaccgaggucgagccugacgaugucgacugcuggugcaauaccaccgacacgugggugacuuacgggacaugcucacaaacgggcgagcaccggcgggauaagcggagcguugcccucgcgccccacgucggucuggggcucgagacccgagcggaaaccuggaugagcagcgagggggcguggaagcagauccaaaagguugagaccugggcuuugcggcauccaggauuuacggugaucgcccuuuuccuggcccacgccauagggacuagcauuacccagaaggggaucauauucauucuccuuaugcuggucaccccuuccauggcgaugcggugcguuggcaucggcagucgggacuucguggaggggcugucuggcgccacgugggucgacguggugcuggagcacgggagcugcgucacgacgauggccaaggauaagcccacccuggacauagagcuccuaaagacagagguaaccaacccagcagugcugcggaagcucugcaucgaggcgaagauauccaacaccaccacggauucacgaugccccacccagggcgaggccacucuggucgaggagcaggacgcgaauuucguuugcaggcggaccuuuguggauaggggcugggggaacgguugcgggcuguucggaaaggggucccucaucacgugcgcuaaguucaagugcgucaccaaguuagagggcaagaucgugcaguacgaaaaccugaaguacagcgugaucgucaccguccauaccggggaccagcaccagguagggaacgaguccacugaacacggcaccaccgcaaccauaacaccccaggcgcccacuagcgaaauccaacucaccgacuacggcgcccugacccuggacugcucaccgcggaccggccucgacuuuaacgagaugguucugcugacaaugaaggaaaaguccuggcucguccacaaacagugguuuuuagaccugccacucccauggaccucgggagccuccaccucacaggagaccuggaaccgccaggaccugcuggucacguucaagaccgcccacgccaagaagcaagagguggugguccucgguucccaggagggcgcgaugcacacggcccuaaccggggccacagaaauacagaccucugggaccaccacgaucuuugccgggcaccugaagugccggcucaagauggacaagcugacccugaagggcaugaguuacgugaugugcacugguuccuuuaaacuugagaaggaaguggccgagacccagcacggcacaguccuggugcagaucaaguacgagggcacugacgcgcccugcaagaucccauucagcacgcaagacgagaagggggugacccagaacggucgacugauaacggcaaauccgauagucacugacaaggagaagcccgugaauaucgaggccgagccgcccuuuggcgagagcuacaucgugaucggugccggcgaaaaggccuuaaaacucagcugguucaaaaaggggucaucaaucgguaagauguucgaagccacagcccgcggggcccgccggauggccauccugggcgacacagcgugggacuucgggucaauagguggcgucuucacaagcguggguaagcuggugcaucagaucuucgggacggcuuaugggguacucuucuccggcgucuccuggacuaugaagaucgggauuggcgugcugcugaccuggcucggccugaacagucgcucuacgagcuuguccaugaccugcaucgcugugggccucgucacgcuauaucugggcgugaugguccaggcagacagcggaugcguuaucaacuggaagggcagggagcuaaagugugggagcggcaucuucgugacgaaugagguucauacguggaccgaacaguacaaguuucaggccgauuccccgaagagacugagcgcggccaucggcaaggccugggaagaagggguaugcggcauccgcuccgccacaaggcuggagaacauuauguggcgccagaucagcaacgagcucaaucacauacuccuggagaacgacaugaaguucaccguagucgugggggacgucgucgguauccucgcacaggguaagaagaugauacgaccccagccgauggagcauaaguauucuuggaaguccuggggcaaagcgaagauaaucggcgcagacguacagaauaccaccuuuaucauagacggacccaauacccccgagugucccgacgaccagcgcgcauggaauauaugggaaguggaagacuacggcuucgggaucuucacaaccaacauauggcugaaacuccgggacagcuacacacaggucugugaucaccgccucaugagugccgcgauaaaggacagcaaggccguucacgcagauaugggcuauuggaucgagagcgaaaagaacgaaaccuggaagcucgcccgggcuuccuucaucgaggugaagaccugcaucuggcccaagagccacaccuuguggucuaacggcguucucgagucugagaugaucauuccgaaaauauaugggggcccaaucucccaacacaacuaccgcccuggguacuucacacagacagcgggccccuggcaccucgggaagcuagaguuggacuucgaccugugugagggcaccaccguugugguggacgaacauugcggcaacagaggugccagccugagaaccaccaccgugaccgguaagaucauccacgaguggugcugccguagcugcacgcucccgccacuaagguuuaagggggaggacggcuguugguacgggauggagauccggcccguuaaggaaaaggaggagaaccuugucaagagcauggugagcgcaggcuccggagaaguggauagcuucucccucgggcuauuaugcaucucgauuaugaucgaggagguaaugcgaucgcgguggagccgaaaaaugcucaugaccggcacacuggccguguucuuccuguugaucauggggcagcugaccuggaacgaccugauccgguccugcaucauggugggugccaacgcguccgaucgcauggggauggggacuaccuaucucgcccugauggccaccuucaagaugcgcccaaugguugcugugggccugcuguuccggaggcuaacgucucgggagguucugcugcugacgauagggcuuucgcucguggccucaguggagcugccuaacagccuggaggaacugggcgacgggcuggccaugggcauaaugauccucaaacuucucacugacuuccaauccuaucaacuaugggcuacccuccugagucuaacuuucaucaagacgaccuucucccuucacuacgccuggaagaccauggcuauggugcugagcaucgugucacugcucccccugugucuaagcaccacgucccagaagaccaccuggcugccagucuugcugggaucucuuggcugcaagccucugaccauguuucugaucgcggagaacaaaaucuggggccgcaagagcuggccucucaacgaagggaucauggccgucggcaucguguccaucuuacugagcucccucuuaaagaaugacgugccccuggccgggcccuuaaucgccggcggcaugcucaucgcaugcuacgucaucagcggguccagcgcagacuuaucccucgagaaggccgccgaggugagcugggaggaagaagcagagcacucuggcgccucgcacaacauccuaguggagguccaggacgacgggacgaugaagauuaaggacgaggagcgugacgacacccugacuauucugcuaaaagcgacccugcuugcuguguccggcguguauccccugagcaucccggccacccuguucgucugguacuuuuggcaaaagaagaagcagcgcuccggggugcucugggacacgcccucaccgccugagguagaacgggcgguccuggacgacggcaucuaccgcaucaugcagagaggccuguuaggccgcucccaggugggcgugggcguuuuucaagagaacguguuucacaccauguggcaugugacccggggcgccguacucauguaccagggaaagcgucuggagccgagcugggcuuccgugaagaaagaccuaaucaguuauggcggcggcuggcggcuccagggcucauggaacacuggggaggaagugcaagucauagccguggagccuggcaagaaccccaagaacgugcagaccgccccugggaccuucaagacgccugagggcgaggucggugccaucgcccuggacuucaaacccgggaccuccggcagcccuaucgugaacagagagggcaaaaucguaggccucuacggcaacggcguugugacuaccuccggcacguauguuagcgcuaucgcccaagcgaaggccagucaggaggggccccucccggagauugaagacgaggucuuccggaagcgcaaccuuaccaucauggaccuccacccaggaagcgggaagacgcggcguuaccugcccgcgaucguucgggaggcaaucaagcgcaaacuucggacccugauccucgccccgacccgcguggucgcguccgagauggcugaagcgcugaaggggaugcccauccgauaucagacuacggccgucaaaucagagcacacgggcagagagaucguggauuugaugugucacgccaccuucaccaugagacuguuaucccccguacggguacccaacuacaacaugauaauuauggaugaggcucacuucacagacccgagcaguaucgccgcucgcggguacaucagcacccggguaggcaugggggaggccgcagccauauucaugaccgcuacgccacccgggucagucgaggcguucccacagagcaaugccgugauccaggaugaggaacgcgacauccccgaacgguccuggaacagcggguacgaguggaucaccgacuucccuggcaagaccgugugguucguccccucaaucaagagcggcaacgacaucgccaacugccuccgcaagaacgggaagcggguuauccaauuaucccgcaaaacguuugacaccgaauaccagaagacaaagaacaacgacugggacuacgucgugaccacagacaucagcgagaugggcgccaacuuccgggcggaccgcgugaucgaccccagacgcugccugaagccggugauccugaaggacggccccgagcgggugauccucgccggacccaugcccgugacuguagccuccgcggcccaacggcggggacggauuggacggaaccacaauaaagagggugaccaguacaucuacaugggccagccacugaauaacgacgaggaccacgcccauuggacggaggccaagaugcuacucgacaacaucaauacccccgagggcaucauaccggcccuguuugagcccgagcgcgagaaauccgccgcuaucgacggggaauaccggcugaggggcgaggcgcgcaagaccuucgucgagcugaugcggcgcggggaccugccgguuuggcugucuuacaaggucgcuucagagggauuccaauacagcgacaggcgguggugcuucgauggcgagcggaauaaccaggugcucgaggagaacauggacguggaaaucuggacgaaggagggggagcgcaagaagcuacgaccacgcuggcuggacgcccggacguauuccgaccccuuagcacugcgcgaguuuaaggaguucgccgcgggccgccgcuccgucuccggagaccucauccucgagaucgggaaacucccccagcaccugacccagcgggcgcaaaacgcccucgacaaccuggucaugcugcacaauagcgagcagggcgggcgcgccuaccggcacgccauggaggagcucccagacaccaucgagaccuugaugcugcucgcccugaucgcagugcugaccggcggggucacucucuucuuuuuaucgggccgcgggcugggcaagaccagcaucggccucuugugcguaauggcuuccagcgccuuguuguggauggcgucaguggaaccucacuggauugccgccagcaucauccuagaguucuuccucaugguacuucugauccccgagcccgacagacagcgcaccccgcaggauaaucaacuggccuacguggucauugggcuccuguucaugauccugaccgucgccgcaaacgagaugggccuccuggagaccaccaagaaggaccucgguauuggccacguggccguggagaaccaccaccacgccaccaugcucgacguugaccuucaccccgcguccgccuggacucuguaugcgguggccacaaccaucaucacucccaugaugcggcacacgaucgagaauacuaccgccaacaucagucucaccgccaucgccaaccaggcggccauacucauggggcuggacaagggcuggccgaucuccaagauggacaucggcgucccccuccuggcccuaggaugcuacagccaggucaacccccucacucugacggcggccguucucaugcuaguggcccacuacgcgauuauaggccccggguugcaggcgaaggccacccgcgaagcucagaaacgcaccgcggccggcauuaugaagaacccaaccguugaugguaucguggccaucgaccuggauccgguggucuacgacgccaaguucgagaagcagcucggccagaucaugcugcugauucucuguacgucgcagauccuucugaugcgaacuaccugggcacucugugagagcaucacccuggccacuggaccacugacgaccuugugggaggggagccccggcaaguucuggaacaccacgauagccguuagcauggccaauaucuuccgcggguccuacuuggccggcgccggacuggcauucucccucaugaagucccucggaggcgggcggcgugggacuggugcucaaggagagacccugggcgagaaguggaagcggcagcucaaucaacucuccaaaucggaguucaacacauauaaaagguccggaauuauggagguggaccggagcgaggccaaggagggucugcgccgcggggagacgaccaagcacgcggucucucgcggcaccgccaagcuccguugguucguggaacggaaccugguuaagccggaaggcaaagugauugaucugggcugcggacguggcgguuggagcuacuacugcgccgggcugaagaaggugacugaagucaaggguuacacgaagggcgggcccggccaugaggagccaauccccauggcaacguacggguggaaccucguuaaacugcacuccggcaaggauguguucuuuaucccgcccgagaagugcgauacccugcucugcgacaucggggagagcucccccaaccccacgaucgaggagggacgcacgcuuagaguacugaagauggucgaaccguggcuccgggggaaccaguucugcauaaagauccugaacccauacaugccgagcguugucgagacucuggagcagaugcagcggaagcacggcggcaugcucguccgcaacccgcucucgcggaacucaacccacgaaauguacuggguaagcugcgggacgggcaacaucgugagcgccgucaacaugacaucccgcaugcugcucaacagguuuacgauggcgcaccggaagccgacguacgagcgcgauguagaucugggggcggguacccggcacguggcgguggagccggagguugccaaccuggacaucaucggccagcgcaucgaaaauaucaagcaugagcauaagagcacguggcacuacgacgaggacaaccccuauaagacaugggcguaccacgggucguacgaggucaaacccagcggcucugcguccagcauggucaacggcgucgugaaacuucugaccaaaccgugggacguaaucccaauggugacccagaucgcaaugaccgacacaacucccuuuggacagcagcgugucuucaaggagaagguggacacgcgcacacccaaagccaaacgggggaccgcacagaucauggagguuacggcccguuggcuguggggcuuccuuucucggaacaaaaagccucguaucuguacucgagaggaguucaccaggaagguucggagcaacgcagccauuggagcaguguucguggaugagaaccaguggaacuccgccaaggaggccgucgaggacgagcgcuucugggaccugguacaucgggagcgcgaguugcacaagcagggaaagugcgccacgugcgucuacaacaugaugggcaagcgggagaagaaguuaggcgaguucggcaaggccaagggcagccgcgccaucugguacauguggcugggcgcacgguuccuggaguucgaggcgcugggcuucaugaacgaggaucacugguucucgcgggagaacagccuaaguggugucgagggggagggccuucacaagcugggcuacauccugcgugacaucagcaaaauuccuggggguaauauguaugccgacgacacagccggcugggacaccaggaucacggaggaugaccugcagaacgaggccaagaucacggacaucauggagcccgaacacgcgcuccuggcgacauccaucuucaaguuaaccuaccagaauaaagugguccgcguucagcggccggcccgcaacgggacgguaauggacgugaucagccggcgcgaucagcggggcuccgggcaggucggcacauacggccuaaacaccuucaccaacauggaggcccagcucauacgccagauggagagcgaggggauauucagccccagcgagcuggagaccccuaacuuagccgagcgggucuuagacugguuagagaagcacggcguugagcgccucaagcggauggccaucuccggggacgauugcgucguaaagcccauugacgaccgcuucgcaacggcccugagcgcccugaacgacauggggaagguacggaaagacauuccccaaugggagcccagcaaggguuggaacgauuggcaacagguccccuucuguucccaucacuuccaccagcucaucaugaaggacggcagagagaucguugugcccugccggaaccaggacgagcucgucgggagagcgcgggugagccagggagccggcugguccuugcgugagaccgcgugccucgguaagucguacgcccagauguggcaauuaauguacuuccaccgacgcgaucugcggcucgcggccaacgcaaucuguucugcgguaccuguggacugggugccgacuucgaggaccacuuggagcauccacgcgcaccaccaauggaugaccaccgaggauauguugucaguguggaaccgggucuggaucgaagaaaaucccuggauggaagacaagacccacauaagcagcuggggcgacguccccuaccuggggaaacgagaggaucaguggugcggcucccucaucggccugacggcccgcgccacaugggcgaccaacauccagguggccaucaaccagguccgcagauugauaggcaacgagaacuaucucgacuacaugacgagcaugaagcgguuuaagaacgaguccgacccggagggcgcccugugguaa

SEQ ID NO: 24096 - RNA, 9879 nt, Artificial Sequence
  derived and/or modified CDS sequence (opt11) from DENV-1__EU677152__SS-prME
agcgugacgaugcugcucaugcucaugccaacggcccuggccuuccaccucacgacccggggcggggaaccccacaugaucgucucuaagcaggagcgggguaagagccuguuauucaagaccagcgcgggggugaacauguguacccucauagccauggaucugggcgaguucugugaggacacuaugacuuauaagugccccaggaucaccgaggccgaacccgacgacguggacuguuggugcaaugccacugacacgugggugacuuacgggacaugcucucagaccggcgagcaccggagggacaaacgcuccguagcccuggcgccgcacgugggccuaggccuggagacgcgcaccgaaacauggaugucguccgagggggcauggaaacagauacagcggguugagacgugggcucuacgccaccccggauucacugugaucgcacucuuccuggcccaugcaaucggcaccagcaucacccagaaggggauaauauucaucuugcucauguuagugacccccaguauggccaugagaugcgucggcaucggcucccgcgacuucguggaggggcuguccggugccacguggguggacgucguguuggagcacgggagcugcgugaccacaauggccaaagacaagccgacacuggacaucgagcuccuuaagacugagguuaccaauccagcggugcuccggaaacugugcaucgaagcgaaaaucuccaacaccaccacggacagccgcugcccgacacagggcgaggccacccucguggaggagcaggacgccaacuucgucugccggcgcaccuucguggaccgggggugggggaacggcuguggccuguucggaaaagggucccugaucacuugcgcaaaguucaagugugugaccaaacucgagggcaagacgguccaguacgagaaccugaaauacagcgugauagucacuguucacacgggcgaccagcaccaggugggcaacgaguccacagagcacggcaccaccgcgaccaucacaccccaggccccaagcaccgagauccagcugaccgacuacggagcccuuacccucgauuguagcccccguacgggacuggacuucaacgagaugguacugcugaccaugaaggagaaguccuggcucgugcauaagcagugguuccucgaccugccgcugcccuggaccagcggggccuccaccagccaggagacguggaaccggaaggaccuccuggugaccuucaagacugcccacgcgaagaagcaggaaguuguggugcucggcucccaggagggcgccaugcacaccgcccucaccggggcuacagagauccaaaccagcggcaccacaaccauauucgccgggcaucugaaguguaggcuuaagauggauaagcucacacucaagggcauguccuacgucaugugcaccggaucauucaagcuggagaaagagguugcggagacccagcauggcacagugcucguccagaucaaguacgaggggacggacgcgcccugcaagauccccuuuucgacucaggacgagaagggcguuacgcagaacggucggcugaucaccgccaacccgauugucaccgacaaggagaagccuguuaacauugaggccgagccacccuuuggggagagcuacauugugaucggcgcgggugaaaaggcccugaagcugagcugguucaaaaaggggucuucaaucggcaaaauguucgaggcgacggcacgcggggcacggcgcauggcgauacucggcgauacggcuugggacuucgggagcauuggcggcguguucacguccgucgggaaacuuguccaccagauuuucggcaccgcuuacgggguguuguucagcggcgucucauggaccaugaagaucgggauaggcguccucuuaacguggcugggauugaauagccgcuccaccagccuguccaugaccugcauagccguggggcugguaacccucuaccugggcgugauggugcaggccgacagcgggugcgucaucaacuggaagggccgggagcugaagugcgggucaggcaucuuugugacuaacgaagugcacacuuggaccgaacaguacaaguuccaggcggauucccccaagcgccugucugcugccaucggcaaggcuugggaagagggcguuugcggcauacgcuccgcaacccgccuggagaacaucauguggaagcaaauaagcaacgagcuaaaccacauccuacucgagaacgauaugaaguucacggugguggucggggacguggcgggcauccucgcccaagggaagaagaugauacggccccaaccuauggaguacaaguacuccuggaagaguugggguaaggcgaagaucauaggcgccgacguacagaacacaacauucauuauugacgggccgaacacaccggagugccccgacgaucaacgcgcguggaauaucugggaggucgaggacuacggcuucggaaucuuuaccacgaacauuuggcucaagcugcgggacuccuacacccaggugugcgaucaccgccugaugucugccgcaaucaaagacuccaaggccguucacgccgacaugggcuacuggaucgagagcgagaagaacgaaacauggaaacucgcgcgggccuccuucaucgaagucaagaccugcauuuggcccaagagccacacgcuguggagcaauggcgugcuggaaagcgagaugaucauccccaagaucuacggaggcccgaucucccagcacaauuaccgccccggguacuucacccaaaccgccggccccuggcacuuagggaagcuggagcuggacuucgaccucugugagggcaccacgguggucguggacgagcacuguggcaacagggggccgucccugcgaacgaccaccguuacggguaaaauaauacacgaguggugcugccgcucaugcacccugccgccccugcgcuucaagggggaggacggcuguugguacgggauggagauccggcccgucaaggagaaggaggaaaaccuggucaaaagcauggugucggccggcuccggcgaaguugacagcuuuucccugggccuacugugcaucaguaucaugauugaggaggugaugagauccagguggucccgcaagaugcugaugacaggcacccucgcuguguucuuccuacugauuaugggccagcucacguggaaugaccugauccguuuaugcauuaugguaggagcgaacgcuagugaccgcauggggaugggaaccacauaccucgcacugauggccaccuucaagaugcgcccgauguucgccguagggcuccucuuccggcgccugacgagcagggaggugcuccuccugacgaucggucuaucccucgucgcgagcguugagcugcccaacucccuggaggagcucggcgacggccuggccaugggaaucaugaucuugaagcuacuaaccgacuuccagagccaccagcugugggccacccuccugucacugacguucaucaagacgaccuucagccuccacuacgccuggaagaccauggcgaugguucuguccauagugagcuuauucccucuuugccugucgacgacaagucagaagaccacauggcugcccgugcuccuggguucccuggggugcaagccgcucacgauguuccugauugcggagaacaagaucuggggccgcaaguccuggccucugaacgaggggauaauggccgucggcaucgucagcauccuccuguccaguuugcucaagaacgacgugccccuagccgggccucugauagccggcggcaugcugaucgcguguuacgucaucuccggaaguuccgccgaccugagcuuggagaaggccgccgaggugucaugggaggaggaagcugagcacagcggggccucccacaacauccuggucgaaguccaggaugaugggaccaugaaaaucaaggacgaagaacgggacgacacccugaccauccugcucaaggccacccugcucgccgugagcggaguguacccgcucucaauucccgccacgcuguucgucugguacuucuggcagaagaagaagcagagguccggcguccugugggacaccccaagcccucccgagguggagcgggccguccuggacgauggcaucuaucguauaaugcagcggggccugcuggggcgcagccaggugggggugggugucuuucaggagaacguguuucauaccauguggcacgugacccggggcgcgguccugauguaccagggcaagcgccucgagcccuccugggccagcgugaagaaggaccugaucaguuauggcggcggguggagacugcagggcagcuggaacacgggggaggagguacaggucaucgcuguggagccagggaaaaaccccaagaacgugcaaaccgcccccgggacuuuuaaaacuuccgagggugaggucggcgccauagcacucgacuucaagccggggacgagcgguagcccgaucgugaaucgcgaggggaagaucgugggccuauacggaaauggggucgugaccaccuccggcacauauguaagcgcuauagcccaggccaaggccagccaggaggggcccuuacccgagaucgaggacgaggucuuuagaaagcgcaaccucaccaucauggaccugcaucccggaagcggaaagacgcggcgcuaccugcccgcuaucgugcgggaggcgaucaagcgcaagcuccggacacugauccuggcccccaccagagugguagccuccgagauggcggaggcccucaaaggcaugcccauccgauaucaaacgaccgcggucaagagugaacauaccggcaaggagaucguagaucugaugugccaugccaccuucaccaugcgacugcucuccccaguccgcgugcccaacuacaacaugaucaucauggaugaggcccacuucacggacccgucauccaucgcggcccggggguacauuagcacacgcguaggcaugggggaggccgcagccaucuucaugaccgcaacgccgcccggcagcgucgaggccuucccccagagcaacgccguuauccaggaugaggagagagacauuccggagcguuccuggaacagcggauacgaguggaucaccgacuucccuggcaaaaccgugugguucguccccuccaucaagagcggcaaugacaucgccaauugccugcggaagaacgggaagcgcgugauccagcugucccggaagaccuucgacaccgaguaccagaagaccaagaacaacgacugggacuaugugguuaccaccgacauuucggagaugggcgcgaacuuccgcgcugaccggguuaucgaccccagaaggugccuaaagccaguaauccugaaggacgggcccgaacgcguaauccuagccggccccaugcccgugacgguagccuccgccgcgcagcggcgcgggcggaucggccgcaaccacaacaaggagggcgaccaguacauauacaugggccagccguugaacaaugacgaggaccacgcacacuggacggaggccaagaugcugcuggacaauauuaacaccccugaaggcaucauacccgcacucuucgagcccgaacgggagaagucggcggcgaucgacggggaauaucgccugcgcggcgaggcccgcaagacguucguugaacuuaugcgccgcggggaccucccgguguggcugagcuauaaggucgccuccgagggcuuucaguacagcgaccgccggugguguuucgacggagagcggaauaaccaagugcuggaggaaaacauggacguggagaucuggacuaaggaaggcgagcggaagaagcuccgcccgcguuggcuagacgcacgcaccuacuccgacccccuugcacuccgggaguucaaggaguucgcagcugggcgccggucaguuagcggggaccuaauccuggagauuggcaagcucccccagcaccugacccaaagggcccaaaacgcccuggacaaccucguaaugcugcacaacucugagcaagggggucgugcguaccgccacgccauggaggagcugcccgauaccaucgagacguuaaugcugcuggcccucauugccgugcuaaccggcggggucacccuguucuuccuauccggcagagggcuugguaaaacgagcaucggacugcucugcguaauggccuccagcguacugcuguggauggcgagugucgagccccacuggauagccgccagcaucauccucgaguucuucuuaaugguucugcucauucccgagccagaucgccaaaggaccccgcaggacaaccagcuggcuuacguggucaucgggcuccucuucaugauucugacgguggccgcgaacgagaugggcuugcucgagaccacaaagaaagaucuggggaucggccaugccgccguagagaaccaccaccacgccgcuaugcuggacgucgaucuccacccugcguccgccuggacccuguacgcaguggccacgaccaucauaacgcccaugaugcgccacaccaucgagaacacgacggccaacaucagccugaccgcuaucgccaaccaggcggcaauccucaugggccuggacaagggcuggccuaucuccaagauggacaucgggguuccccugcuagcgcuagggugcuacagccaggucaacccccuaacgcucacggccgccguucugaugcuggucgcucacuacgccaucaucggacccggccuccaggcgaaagcaacccgggaggcccagaagcgcaccgccgccggcaucaugaagaacccuacggucgaugggaucguggcuaucgaucuggaccccguaguauacgaugccaaauucgagaagcagcugggccaaauuaugcuccugauucuaugcacaucccagauccuucugaugcgcacuaccugggcccucugcgagagcaucacucucgcgacaggcccgcugaccacccugugggaggggucccccggcaaauucuggaacaccacgaucgccgugagcauggcgaacaucuuccgggggagcuaccucgccggcgcgggccuggccuuuucccugaugaagucgcucggaggagggagacggggcacgggggcgcaaggcgagacccugggcgaaaaauggaagcgacagcugaaccagcucuccaaguccgaguucaacaccuacaaaagauccgggaucauggagguugaccgcagcgaagccaaggaaggucugaagcgcggggagacgaccaagcaugcagucucccgcggcaccgccaaacugagaugguucgucgagcgaaaccucguaaagccggaggggaaggucaucgaucugggcugcggccgcggcggguggagcuacuacugcgcagggcugaagaaagucacugaggugaagggguacacgaagggcgggcccggucaugaggagccaauacccauggcgaccuacggguggaaccuuguuaagcugcacuccggcaaggacguguucuucaucccgcccgagaagugugacacccugcuuugcgacaucggggagucuagucccaaccccaccaucgaggagggccgcacucuccgugugcugaaaauggucgagccguggcugcgggggaaucaguucugcaucaagauccucaacccauacaugccaagcgugguagagacccuugagcagaugcagcggaaacacggcggcaugcucgugcgcaacccccucuccaggaacucgacccacgagauguacuggguguccugcgggacaggcaacaucgucagcgccgucaauaugaccucccguaugcugcucaaccgguuuacaauggcccaccgcaagcccaccuacgagcgcgacguggaucucggggccgggacccggcaugucgccgucgagccugagguggcgaaccuggacaucaucggucaacgcaucgagaauaucaagcacgaacacaagucuaccuggcacuacgacgaggauaaccccuacaaaacaugggccuaucacgggucauacgaggugaagcccagcggcagcgcguccagcauggucaacgggguggucaagcugcucaccaagccgugggacgugauaccaauggucacgcagaucgccaugaccgauacgacccccuucggccagcagcgggucuuuaaggagaagguagacacgcgcacgcccaaagccaagcggggcacggcgcaaauuauggaggugacggcuaaguggcuguggggcuuccugucccggaacaagaagccacggauuugcacccgcgaagaguucacccggaagguccgcagcaacgccgccaucggcgcggucuucguggaugagaaccaguggaacagugccaaggaagccgucgaagacgagagauuuugggaccucguucaccgcgagcgggagcugcacaagcaggggaagugcgccacgugcguguacaacaugaugggcaagcgcgagaagaaguuaggggaguucggcaaggccaaaggcagcagggcgaucugguauaugugguugggcgcccgcuuccuagaguucgaggcccuaggcuuuaugaaugaggaccauugguucucccgggaaaacagccuuuccggggucgagggcgaggguuuacacaagcugggcuacauccuccgcgacaucagcaagaucccagguggcaacauguacgccgaugacaccgccggaugggacacacggaucaccgaagacgacuuacagaacgaggcgaagaucacggauauuauggagcccgagcacgcccugcucgccaaguccauauucaaacugacguaccagaacaagguggugcgcguccagcggccggccaagaacgguaccgugauggacgugaucagcaggcgcgaucagcgcggcagcggacaggucgguaccuacggcuugaacacguuuaccaacauggaggcucagcuaauccgucaaauggagucggaggggaucuucucccccagcgagcuggagacgcccaacuuggccggccggguucucgacuggcuggagaagcacgggguggagcgccugaagcggauggccauaucuggcgacgacugcgucgugaaaccuaucgacgacagguucgcaacugcgcucacagccuugaacgauauggggaaggugcggaaggacaucccgcagugggaacccucaaagggcuggaacgacuggcaacaagucccuuucugcagccaccacuuucaccaacugauaaugaaggacggccgggagaucgugguacccugccggaaccaggacgaguuggucgggagagcgagggugucucagggcgccggguggucucugcgagagaccgccugccugggcaagucguacgcccagauguggcagcucauguacuuccaccgccgcgaucuccggcuggcggccaacgccaucugcagcgccgugccggucgacuggguacccacaucccgcaccacauggagcauccacgcccaucaccaauggaugaccaccgaggauaugcuuucuguguggaaccggguuuggaucgaggagaaccccuggauggaggacaagacccacaucucguccuggggagacgugcccuaucuggguaaacgggaggaccaguggugcggaagucugaucgggcucacagcucgagcaaccugggccaccaacauccaaguagccaucaaccaggucaggcgccugaucggcaacgaaaauuaucuagacuacaugaccagcaugaagcgcuucaaaaacgagagcgacccagagggagcccucugguag

SEQ ID NO: 24097 - RNA, 9879 nt, Artificial Sequence
  derived and/or modified CDS sequence (opt11) from DENV-1__EU677155__SS-prME
ucagugaccaugcugcucauguugaugccuacagcauuagccuuucaccucacuacccguggcggcgagccccacaugaucgugagcaagcaggaacggggcaagagccugcuguucaagaccagcgcuggggugaauaugugcacccucauagcuauggacuugggcgagcugugcgaggacacaaugaccuacaagugcccacgaauuaccgagaccgagcccgacgacguggacugcuggugcaacgccaccgacacaugggugaccuacgggaccugcagccaaaccggcgagcacagacgggacaagcggucgguggcccuagccccgcacguagggcuaggguuagagacccgcaccgagaccuggaugagcucagagggcgccuggaagcaaauccagcgggucgaaacgugggccuuacggcaccccggguucaccgugaucgccuuguucuuagcccacgcgaucgguaccagcauuacucagaaggggaucauauuuaucuugcucaugcuggugacgcccuccauggccaugcggugcgucgggaucggcuccagagacuuuguagaagggcucuccggggcuaccuggguagacgucgugcuggaacacgggagcugcguuaccacaauggcgaaagacaaaccgacucuggacaucgagcuccugaagaccgaggucaccaaccccgccgugcucagaaagcucugcaucgaggcuaagaucuccaauaccaccaccgauucucgcuguccgacccagggcgaggccacccucguugaggagcaggacgccaacuuuguuugccgacgcacguuuguggauagaggcuggggcaacgggugcgggcuguucggcaaggguucccucaucacaugcgccaaauucaagugcgugacgaaacuggagggcaagauaguccaguacgagaaccugaaguacagcgugaucgucacaguccacacgggagaccagcaccaggugggcaaugaauccacugagcacggcaccaccgccacaaucacgccgcaggcgccuaccacagagauccagcucaccgacuacggagcccugacgcuggacugcaguccccgcacgggcuuagacuucaacgagaugguucugcugaccaugaaggaaaaguccuggcucgugcacaagcaaugguucuuggaccugccccuacccuggaccucuggcgcaagcacgucccaggagaccuggaaccgccaagaccugcuggugaccuucaagaccgcacacgcuaagaaacaagaggugguggugcucgggagccaggagggcgcgaugcacacggcccugaccggggccacugaaauccagacguccggcacgaccacgaucuucgccggccaccugaaaugccgcuugaagauggacaagcugacccugaaaggcaugaguuacguuaugugcacggggagcuucaagcucgagaaagagguggccgagacccagcacggcacagugcugguccagaucaaauacgaaggcaccgaugcgcccugcaagauccccuucagcacucaagacgagaaggggguuacccagaacggucgccuuaucaccgccaaucccaucgugacagacaaggagaaaccugucaacaucgaggccgagccucccuucggggaguccuacaucgugaucggcgccggcgagaaggcgcucaaguuaagcugguucaaaaaggguuccucuaucgguaaaauguucgaggccacggcccgcggggcccggcgcauggcaauccugggcgacacugcgugggacuuugggucuauaggcggcguguucaccagcgucgguaagcugguucaucagaucuucggcaccgccuacggggucuuguucuccggcgucagcuggacuaugaaaaucgggaucggcguccugcugacauggcucggccugaacucucgcagcacgucccuaagcaugaccugcaucgcuguugggcucguuacgcuuuaucuuggagugauggugcaagccgacuccgggugugucauaaacuggaagggccgggagcuuaagugcgggagcggcaucuucgugaccaaugaggugcacacguggacagagcaguacaaguuucaggcggauaguccgaagcgccugucugcugccauuggcaaggccugggaggaggggguguguggcaucaggagcgccacccgccuagagaacaucauguggaagcagaucuccaacgagcucaaccacauccuccuggaaaacgacaugaaguucacggugguaguaggggacguagccggcauauuagcccaggggaagaagaugauccggccccagccaauggaguauaaauacucguggaaguccugggguaaggccaaaaucaucggagcggacguccagaauacgaccuucaucauagaugggcccaacaccccggagugccccgacgaccaacgcgcguggaauauaugggagguugaagacuacggcuucggcauauucacgacuaacaucuggcuuaagcugcgggacagcuacacccaggugugcgaccaccgccucaugagcgcagcaauuaaggacagcaaggccgugcacgccgacaugggcuacuggauugaauccgagaagaacgagacguggaaacuggcucgugcgagcuucaucgaggugaagaccugcaucuggccuaaaucccauacgcuguggagcaacggcguguuggaguccgaaaugauuauccccaagauuuaugggggcccgaucagccagcacaacuaucgcccaggguacuucacccagaccgccggucccuggcaucuggguaaguuggagcucgauuucgaccugugcgaaggcacgacuguggucguggacgaacacugcggcaaucgggggccaucacugcgcacaaccacagugaccgggaagauuauccacgaguggugcugccggagcugcacucugccaccccuucgcuuccgcggggaggacggcuguugguacgggauggagaucaggcccgucaaagagaaggaggagaaucucguaaaguccauggucagcgccgggagcggggaggucgacuccuucagcuuagggcuccuaugcaucuccaucaugaucgaggaagugaugcggagccgcuggucccggaagaugcucaugaccggcacgcuagccguguucuuuuugcucaucauggggcagcucacguggaaugaccugauccgccucugcaucauggucggcgccaacgcgagcgaccgcauggggauggggaccacguaccuugcccugauggcgacguucaagaugcgaccaauguucgcagugggccuccuguuccgaagauuaaccagucgagaggugcuccugcugacgaucggacucagccuggucgccagugucgagcugccgaacagccucgaggagcugggcgacggacuggcgaugggcaucaugauccucaaacugcugaccgacuuccagucacaccagcucugggcgacgcugcugucacucaccuucauaaagacgacguucucccugcacuacgcguggaagacgauggccaugguccuaucgauagugucgcuauuuccccugugccugagcaccaccucccaaaagaccacgugguuacccguacugcugggcagccucgggugcaagccgcuuaccauguuccugauugcagagaacaagauuuggggccgacgcuccuggccccucaacgaagggaucauggcggucggcaucgugagcauccugcucagcucacuccugaagaacgacgugccccuggccgggccccucauugccggcggcauguuaaucgccuguuacguuauuagugguuccuccgcggaccuaucccuggaaaaggcagccgaagugucaugggaggaagaagccgagcacuccggcaccagccacaacauccuuguggagguccaggacgacggaaccaugaaaaucaaggacgaggagcgggacgacacuuugacgauucuccugaaggcuacuuuacuagcgguguccggaguguacccgcuaagcaucccagcuacacuuuucguuugguauuucuggcagaagaagaaacagcgcagcgguguccucugggacacccccagcccgccggagguggagcgggcuguccuugacgacggcaucuaccgaaucaugcagcguggccuacugggucgcagccaagugggcguaggcguguuccaagagaacguguuccacacgauguggcacguaacgcguggcgccguccuaauguaccaagggaagcgccuggagccaagcugggccucaguaaaaaaagacuuaaucagcuauggcggcgguuggcggcuccagggcuccuggaacacuggggaagaggugcaagucaucgcgguggagccggguaagaaccccaagaacgugcagacagcccccgggacguucaagacccccgagggcgaggucggcgccaucgcccuggacuuuaagcccgggaccagcggcucaccgaucgugaaccgcgaggggaagaucgucggucuguacggcaacggggucgugaccacgagcggaaccuacguguccgccaucgcgcaggccaaagccucacaggagggaccguugcccgagaucgaggacgaagucuuccggaagcgcaaccuuaccaucauggaccugcaccccggaagugggaagacccggcgcuaucucccggccaucguacgggaggcgaucaagcgaaagcugcgcacgcugauccucgcgccaacccguguugucgccuccgagauggccgaggcccugaagggcaugccgaucagguaccagacgaccgcgguaaagagcgagcauacgggaaaggagauaguggaucugaugugucacgcgacuuucacgaugcggcuccugucucccguucgcgucccgaacuacaacaugaucaucauggacgaggcccauuucacggacccaaguuccaucgccgcccgcggauacaucagcacgcgaguuggaaugggcgaggcggcagccaucuuuaugaccgccacgccucccgguagugucgaggcauucccucagagcaacgcggugauccaggacgaggagcgcgacaucccugagcgaucuuggaacuccgguuacgaguggauuaccgacuucccuggcaagacggucugguucgucccauccauaaagagcggcaacgacauagccaauugccugcggaaaaacggaaagcgcguuauccagcucucgcggaagacauucgacaccgaguaccagaagacaaagaauaaugauugggacuauguggucacgaccgacaucucagagaugggcgccaacuuucgcgcagauagggugaucgauccgagacggugucugaagcccguaauccuuaaggacgggcccgaacgcgucauucucgcgggcccuaugccggugaccgucgcguccgcagcucagcggcgcgggcgcauaggccgcaaucacaacaaggagggugaccaguacaucuacauggggcagccccugaauaaugacgaggaucaugcccauuggacggaagcgaaaaugcugcucgacaacaucaacacgcccgagggcaucaucccugcccuguucgagccggagcgcgagaaguccgccgcuaucgacggggaguaccggcugcgcggcgaggccagaaagaccuuugucgaacuaaugcgccggggcgaccuuccgguguggcugaguuacaagguagcuuccgaggguuuccaguacagcgaccgccgcuggugcuucgacggcgaacgcaacaaccaggugcucgaggagaacauggacguggaaaucuggacgaaggagggggagcggaaaaagcuacgcccccgguggcuugacgccagaaccuacuccgacccccucgcucugcgcgaguucaaggaauucgccgccggacggcgaagcgucucuggggaccucauacucgaaaucggcaagcuaccgcagcaccugacgcagcgcgcacagaaugccuuggacaaccuggugaugcugcacaacagcgagcagggcggacgggccuaccgccacgccauggaggagcuccccgacacaaucgagacccuuaugcugcucgcguuaaucgccgugcugaccggcggggugacgcucuucuuccuguccggccgugggcucggcaagacuagcaucggccuccugugugugauggccaguucaguccuauuguggauggccuccgucgagccccacuggaucgcagcgagcaucauuuuggaguucuuucugauggugcuccugauacccgagccggaccgccaacggacgccacaggacaaucaacuagccuacgucguaaucgggcuucuguucaugauccugaccguggcggcgaaugagaugggucugcuggagaccacgaagaaggaccuggggauuggccauguugccgucgagaaccaccaccacgcggccaugcuagacguggaccuucacccagccuccgccuggacccuguaugcuguagcgaccacgaucaucacgccgaugaugcgccacacaaucgagaacaccacagccaauauaagccuuacugcaaucgccaaccaagccgccauacugauggggcuugacaagggguggccuaucuccaagauggauauaggcgucccccuucuggcccuggggugcuacagucagguaaacccccugacgcuuacggccgccguacugaugcucgucgcgcacuaugccauuaucggacccggacugcaagccaaagccacccgcgaagcucaaaagcggacggcggcaggcaucaugaagaaccccacuguggaugggauaguggccaucgaucuggaccccgucguguacgacgcgaaguuugagaagcagcucggacagauuaugcugcugaucuuauguaccucccaaauacugcuaaugcgcaccacgugggcccucugcgagaguaucacauuagcgaccgggccgcugacuacacucugggaggggucgccugggaaguucuggaacaccacaaucgccgugagcauggcgaacaucuuccggggauccuaccuagccggcgccggccuggcauucagccucaugaagucccucgggggugggcgcagaggaaccggugcacagggcgagacgcucggcgaaaaguggaagcgccaguugaaccaguuauccaagagcgaguucaauaccuacaagcggaguggcaucauggaagucgaucgcucugaggcgaaggagggccugaagcgcggggaaaccaccaaacacgccgugucccgcgguacggcuaagcuccggugguucguggagcgcaaccuggucaagcccgaggggaaagugaucgaccucggcugcggccgcggcgguuggucauacuacugugcagggcugaaaaaggugaccgaggucaagggcuacacuaaggguggcccgggccacgaggagccuaucccgauggccaccuacggauggaaucucguuaagcugcacuccggcaaggauguguucuucaucccgccagagaaaugcgauacacuguugugcgacauaggggagagcucccccaacccuaccauagaggagggccgcacgcugagaguucugaaaaugguugagcccuggcuccgugggaaccaauucugcaucaagaucuugaaccccuacaugccuagcguuguugagacccuggagcagaugcagcggaagcacggcggcaugcuuguccgcaacccccugucccgcaacucuacccacgaaauguacuggguguccugugggacggggaacaucgugucggccgugaacaugacaagccgcaugcugcucaaccguuuuaccauggcccaucggaagcccaccuaugaacgcgacguggaucugggggcugggacucggcacgucgcaguggaaccugagguggcgaaccuggacaucaucggucaacgcauagagaacauuaaacaugagcacaagucuaccuggcauuacgacgaggacaaccccuacaagaccugggcauaccacgggucauacgaggucaagccgagcggcuccgccucuagcauggugaacgggguugugaaacugcugacaaagccaugggaugugauucccaugguuacucaaaucgcgaugacagacaccacacccuucggccaacagcgggucuucaaggagaagguggacacgcgcaccccaaaggccaaacgcggcaccgcccagauuauggaggucaccgccaaauggcuguggggcuuccucucgcgcaacaagaagccgcggaucugcacacgcgaggaauucacgaggaagguccguagcaacgccgcgaucggcgcaguguuugucgacgagaaccaguggaacuccgccaaggaggcgguggaagacgagcgguuuugggaccugguccaccgcgagcgcgagcugcacaagcaggggaaaugcgcgaccugugucuacaacaugauggguaagcgcgagaaaaaacucggagaguucggcaaggccaaggguagccgggcaaucugguauauguggcugggcgcacgcuuccuggaauucgaggcgcucggcuuuaugaaugaggaucacugguucuccagggagaacagccugagugggguggagggcgaggggcuccacaagcucggcuauauccugcgcgacaucagcaagauacccggcggcaacauguaugccgaugacaccgccggaugggauacgcgcauaaccgaggacgaccuacagaacgaggccaggaucaccgauaucauggaaccugagcacgcccuacuggccgguuccauauucaagcucaccuaccagaacaaaguaguccgcguccaacggccggcgaagaacggcacggugauggacgucaucucccgcagagaucagcguggcucuggccaggugggaaccuaugggcucaacaccuucacaaacauggaagcacaguugaucaggcagauggaguccgagggcaucuucucccccagcgagcuugagacgcccaacuuggcggagagagugcuugacuggcuggagaaguacgguguugagcggcucaagcguauggcaauauccggggacgauuguguggugaagccgauugaugaucguuucgccacggcgcugaccgccuuaaacgacaugggaaaaguucgcaaggauauuccccaaugggagcccaguaagggcuggaacgacuggcagcagguuccguucugcucccaccacuuccaccagcucauaaugaaggacggccgggagaucguggugccaugccgcaaccaagacgagcugguugggcgugcccgcgugagccagggcgccggguggagccugcgggagaccgccugccucggcaagucauacgcgcagauguggcagcucauguacuuucaccggcgggaucuucgccuugccgccaacgcuauaugcagcgcagucccgguggauuggauuccaacuucucggaccaccuggagcauccaugcccaccaucaguggaugaccacagaagacaugcuguccgucuggaaucgcguguggaucgaggagaaccccuggauggaagacaagacacacaucucguccuggggcgacgugccguaccugggcaaacgcgaggaucagugguguggaucacucauugggcugacugcccgggccaccugggccaccaacauccagguggcgaucaaucagguccgcagguugaucggcaacgagaacuacuuagauuauaugacguccaugaagcgcuucaagaacgagagugauccugagggagcccugugguag

SEQ ID NO: 24098 - RNA, 9879 nt, Artificial Sequence
  derived and/or modified CDS sequence (opt11) from DENV-1__EU677157__SS-prME
agcgugaccaugcuacucauguugaugcccaccgcccuggccuuccaccucaccacacggggcggcgagccucacaugauagugagcaagcaggagcggggcaagucccugcuauucaagaccagcgccgggguuaauauguguacguuaaucgccauggaccugggcgagcugugcgaggacaccaugacuuacaaguguccgcggaucacagagaccgagcccgacgacguugacugcuggugcaacgccacggacaccuggguuaccuacgggaccugcagccagacgggcgagcaccggagggacaagaggucaguggcucucgcgccccacguaggccugggacuggagacccgcacggagaccuggaugagcagcgagggcgccuggaaacagauucagcggguagaaacgugggcccuccggcaccccggguucaccgugaucgccuuguuccuggcccacgcgaucggcaccagcaucacccagaaggggaucauuuucauccucuuaaugcuggugacgcccuccauggccaugcggugcgucggcaucggcagccgcgacuucguggaggggcucucgggcgccaccuggguggacgucgugcuggagcacgggagcugcgugaccaccauggccaaagauaagcccacgcuggacaucgagcugcugaagaccgaaguuaccaaccccgccguccugcggaaguuguguaucgaggcgaagaucagcaacacgacgaccgacagccgcugcccgacacagggcgaggccacccucguggaggagcaggacgccaacuucgucugccggcgcacgcugguggaucggggcugggggaauggcugcggcuuauucgguaaggggucccugaucacuugcgccaaauucaagugugucacuaagcuggaaggcaagaucguccaauacgagaaucucaaauauagcgugaucgugaccguucacacgggcgaccagcaccagguagggaacgaguccaccgagcacggcacgaccgccaccaucacaccccaagcgcccacgaccgagauucagcugaccgacuacggagcccugacgcucgacugcagcccccgcaccggccuggacuucaaugagaugguccuccucaccaugaaggagaaauccuggcuggugcacaagcagugguuucuggaccucccccugccuuggaccagcggggccagcacgagccaggagacguggaaccggcaggaccugcucgugaccuucaagacggcucacgccaaaaagcaggaggucgugguuuuaggaagucaggagggugcgaugcacacggcccugaccggggccaccgagauccagaccuccggcacuacaaccaucuucgcggggcaccucaagugccgccugaagauggacaagcugaccuuaaagggcaugagcuacgucaugugcacgggauccuucaagcuagagaaggagcuggccgagacccagcacggcacugugcuagugcagauuaaguacgagggcaccgacgcgcccugcaagauccccuucaguacacaagacgaaaagggggucacccagaacggccgguuaaucaccgccaacccgaucgugaccgacaaagagaagcccgugaacaucgaggccgagccgcccuucggcgaauccuacaucgucaucggcgccggggaaaaggcgcugaagcugagcugguucaagaagggguccuccaucggcaagauguucgaggccacggcccgcggggcccggcgcauggccauccucggugacacggcgugggacuucggguccaucgggggaguguucacuagcguggggaagcugguccaccagaucuucggcaccgcauacggugugcuguucuccggcgugagcuggacgaugaagaucgggauuggcguccuccugaccuggcugggucucaacucccgcucgaccucccugagcaugaccugcauagccguggggcuggugacccucuacuugggcgucauggugcaggcggacuccgguuguguaauaaacuggaagggucgggaacugaagugcgggagcggaauauucgucaccaacgagguucacaccuggaccgaacaguacaaguuccaggccgacagcccgaagcgccuaucggcggccaucggaaaggccugggaggagggggugugugguauccggagugcaacccgacuggagaacaucauguggaaacagaucuccaacgagcuuaaucacauccucuuagagaacgacaugaaguucacgguaguggugggcgacgucgccggcauccuggcgcaggggaagaagaugauacggccccagcccauggaguacaaguacagcuggaaguccuggggcaaggcaaaaaucaucggcgccgacgugcagaacaccacguucaucauagacgggcccaacaccccggaaugccccgaugaccagagagcauggaacauuugggaaguagaggacuacggcuuugggauuuuuacgaccaacaucuggcuaaagcugcgggacagcuacacccagguuugcgaccaucgccugauguccgcggccaucaaggacagcaaggccgugcacgccgacauggguuacuggaucgaguccgagaagaacgagaccuggaagcuggcccgggcgagcuuuaucgaggugaagacgugcaucuggcccaagagucacaccuuauggagcaacggcgugcuggaauccgagaugaucauccccaagaucuacgggggcccgaucagccagcacaacuaccgccccggguacuucacacagaccgccggcccauggcaccucgggaaguuggaguuagacuuugaccucugcgagggcacgaccgugguagucgacgagcacugcggcaaccgggggccgucccugcgcacgacaacggugacuggcaagaucauccacgaguggugcuguagaagcugcacccugccaccccugcgcuucaggggggaggacgggugcugguacgggauggagauccgccccguaaaggagaaagaggagaaccuggucaaguccauggugagcgccggcagcggcgaaguggacuccuucagccugggauuguuaugcaucucgaucaugaucgaagaggucaugcggucucgcuggucccggaagaugcucaugaccggcacgcucgcaguguucuuccuguuaaucauggggcagcucaccuggaacgaccugauucgccugugcaucauggugggcgccaacgcgagcgaccgaauggggaugggcaccaccuacuuggcccugauggccacguuuaagaugcggccgauguucgccgucggcuugcucuuucgccgacuaaccagccgcgaggugcugcuccugaccaucgggcugagccucguggccuccgucgaguugccuaacagccuggaggagcugggcgacgggcuggcgaugggcauaaugauccugaagcugcugacggacuuccagucucaccaguuaugggccacgcuccugagccugacguucaucaagaccaccuucuccuuacacuacgccuggaagacgauggccaugguccugagcaucguuucccuguuuccccucugccugagcacuaccucccagaagaccacguggcugcccgugcuccuggggucgcuggggugcaagccgcucaccauguuccugaucgcagagaacaagauauggggccggcgaucauggccccugaacgaggggauuauggcuguaggcaucgucagcauccuccugagcucccugcucaagaacgacgucccccuggccgggccgcugaucgccggcggcaugcucaucgccuguuacgugauaagcggguccagcgcggaccugucccuggagaaggccgccgaggucucuugggaggaggaagcugagcacuccggcgccagccacaacaucuugguggagguucaggacgacgguacgaugaagaucaaggacgaggagcgggacgacacccuuaccauccugcugaaggcaacgcugcuggccgucuccggcguuuauccguugagcauccccgccacacuguucgugugguauuuuuggcagaagaagaagcagcgcagcgggguccugugggacacccccagcccgcccgaaguggaacgggccgugcuggacgauggcaucuacaggaucaugcaacggggacuccuggggcgcucccaggucggcguggggguguuccaggagaacgucuuccacaccauguggcacgucacucggggcgccgugcugauguaucaggggaagcgccucgagcccagcugggcguccgucaagaaggaccuaaucagcuacggcggaggguggcggcugcaaggguccuggaacacaggggaggagguccaggugaucgccguugaaccuggcaagaaccccaagaacgugcagaccgccccugggaccuuuaagacucccgagggugaggugggggccauagccuuggacuucaagccugggaccagcggaagccccaucgucaaccgugaggguaagauugugggccucuacggcaacgguguggucacaaccagcggcacguacgugagcgcgaucgcccaggccaaggccagucaggaggggccguuacccgagauagaggacgaaguguuccggaagcgcaaccucaccauaauggaucuucaucccggcagcgggaagacgcguagguaccugcccgcgaucguccgggaagccaucaagcgcaaacuccgcacgcugauccuggcacccacgcgggugguugccuccgagauggccgaagcucucaaaggcaugcccauccgcuaccagaccaccgcaguaaagagcgagcauaccggcaaggaaaucguugaccuaaugugccacgccacguucacgaugcggcugcucucacccgugcgcgucccgaacuacaauaugaucaucauggacgaggcccacuucaccgaccccagcuccaucgccgcgcggggguauaucucuacgcgcguggggaugggggaagccgcagccaucuucaugaccgcuacaccccccggcuccguggaggcguucccgcagagcaacgccgucauccaggacgaggagcgggacauacccgagcgcuccuggaacaguggcuacgaguggaucaccgauuuccccggcaagaccgugugguuugugcccucuaucaagagcggcaacgacauugcgaacugccugcggaagaacgggaagcgugucauccagcugucccggaagacguucgauaccgaguaccagaagaccaagaacaacgacugggauuacgugguaacaacggacaucagugagaugggcgccaacuuccgcgcugaccgcgucaucgacccccgacgcugucucaagcccgugauccugaaggacgggccugagcgcgugauucuugccggccccaugccggucaccguggccagcgccgcccagagacgcgggcggaucggccgaaaccacaauaaggagggggaccaauacaucuacauggggcagccacucaacaacgaugaggaccacgcgcacuggaccgaagccaagaugcuacuugacaacauuaacacccccgagggaaucauccccgcccucuucgagccggagcgcgagaaguccgccgcuauugacggcgaauaccggcugcgcggcgaggcccggaagacguucgucgagcugaugcgccgcggggaccuccccguguggcuguccuacaagguagccagcgagggauuccaguacagcgaccgccggugguguuucgacggcgagcgcaacaaccaggucuuggaggagaacauggacguggaaauuuggacaaaagagggagagcggaagaagcuacgcccuagguggcuggacgcccgcaccuacuccgauccccuggcccuuagggaguucaaagaguucgccgcgggccgccggagcguguccggggaccugauccuggagaucgggaaacucccgcaacaccugacgcagcgcgcccagaacgcgcuggacaaccucgucaugcuacacaacagcgagcagggcgggcgggccuacagacacgcgauggaagagcugccggacacgaucgagacccucauguugcuggcccuaauagcugugcugacgggcggggugacacuguucuuccucucugggagggggcucggcaagaccagcaucggccugcucugugucauggcuuccagugugcuccuguggauggccuccguggagccacacuggaucgcggccagcaucauccucgaguucuuccugaugguucugcucaucccggagccugaccgccagcggacgccccaggacaaccaauuagccuacgucguaaucgggcuccucuucaugaucuugaccgucgcugccaacgagaugggccugcucgagacuaccaaaaaggaccuggggaucggccacguggcuguggagaaccaccaccacgccgcuaugcuugacguagaccuccaucccgccuccgccuggacucuauacgcaguagccacuaccaucaucaccccgaugaugcgccauacgaucgagaacaccaccgccaacaucagccugaccgccaucgccaaucaggcggccauccucaugggccuggacaagggcuggccgaucuccaagauggacauugggguccccuuauuggcccuggguugcuacagccaggugaacccccugacgcucacagccgcagugcucauguugguggcccacuacgcaaucaucggcccggggcuccaagcaaaggccacacgcgaggcgcagaagcggaccgccgcuggcaucaugaagaacccaacggucgacgggaucgucgccaucgaccuagaccccguuguauacgacgcgaaguucgagaagcagcugggucagaucauguuacugauccucugcaccucccagauccuccucaugcgcacuaccugggcacugugcgaaaguaucacucucgccaccggcccccugaccacccuuugggagggcuccccaggcaaauucuggaacacgaccauugccgugagcauggccaacaucuuccggggguccuaccucgccggcgcgggccuggcguucagccugaugaagucccucgggggagggcgccggggcaccggggcucagggcgagacccuuggcgagaaguggaaaaggcagcugaaccagcucuccaagagcgaguucaacacguauaagcggucgggaaucauggagguggaccgcagcgaggccaaggagggccuuaagcgcggggagaccacgaagcacgcggucucccgcggcaccgccaagcugcggugguucguggagcgcaaucuggugaaacccgagggcaaggucaucgaccucggcugcggccggggcgggugguccuacuacugcgccgggcugaagaaggugacggaggugaagggguacaccaagggcgggcccgggcacgaagagcccaucccgauggccaccuacggguggaacuugguuaagcuccacaguggcaaagauguguucuucauaccucccgagaaaugcgauacccugcucugcgacauuggagagucgucccccaacccgacaaucgaggagggccgcacccuccggguacucaagauggucgagcccuggcuucgcgggaaccaguucugcauaaagauccucaaccccuacaugccgagcgugguggagacccuggagcagaugcagaggaaacacggcggcauguuaguccgcaacccgcucucccggaacagcacccacgagauguacuggguguccugcgggaccggaaacaucgugagcgccgucaacaugacgucgcguaugcugcugaaccgcuucacgauggcgcaucggaagcccacauaugagcgagacguggaucucggggcuggcacccgccacguugcagucgagcccgagguggccaaccuggacaucaucgggcaacgcauugagaacauuaaacacgagcauaagagcacguggcacuacgacgaagacaaccccuauaagaccugggccuaucacggguccuacgaaguuaagccuagcggcuccgcgagcagcauggucaacgggguaguuaagcugcucaccaaaccuugggaugugaucccgauggugacccagauagcuaugacggacacuaccccguucggccagcagcgcguauucaaggaaaagguggauaccaggacuccgaaagcgaagcgggggacagcccagaucauggagguuaccgccaaguggcuaugggguuuucugucccggaacaagaagccccgaaucugcaccagagaggaguucacgcggaaaguacgcagcaacgcggccauaggcgccguguucguggacgagaaccaguggaacuccgccaaggaagcgguugaggacgagcgcuucugggaccuagugcaccgcgagcgggaacuccauaaacaggggaaaugugcgaccugcguguacaacaugaugggcaaacgcgagaagaagcugggagaauucggcaaagcuaaggggagucgugccaucugguacauguggcucggcgcccgcuuccuugaguucgaggcgcugggcuucaugaaugaggaccauugguucucucgggagaacagccuauccggggucgagggcgagggguugcacaaacuggguuacauccuccgcgacaucagcaagauaccugggggcaacauguacgccgacgacaccgccggcugggacacccggaucacggaggacgaccugcagaacgaggcccgcaucaccgacaucauggaaccggaacacgcacugcucgcgaaguccaucuucaagcucaccuaccagaacaagguggugcgcgugcagcggccugccaagaacgggaccgugauggacgugaucagcaggcgggaccagcgcggcagcgggcaggucggcacguacggccugaacaccuucaccaacauggaggcccagcucauucggcagauggagagcgaagggauauucuccccgagcgagcuggagacccccaacuuagccaagcgcgugcucgacuggcuggagaaguacggcguggagcggcugaagcgcauggccauuaguggggaugauugcguugugaaaccgauugacgaccgguucgcgacggcccugaccgcccugaacgacaugggcaaagugcgcaaagacaucccccagugggagccaagcaagggguggaaugauuggcaacagguccccuucugcucccaccacuuucaccaacugaucaugaaggacggccgggagaucguggugccgugccggaaccaggacgaguuggucgggcgcgcccgcgugucucagggggccggcuggagccugcgggagaccgcgugucuggggaaguccuacgcccagauguggcaguuaauguacuuccaccgccgggaucugcgccuggccgcaaacgcuaucugcagcgccgugcccgucgacuggaucccgacaucccggaccaccuggagcauccacgcccaucaccaguggaugaccaccgaggacaugcucuccguauggaaccggguguggaucgaggaaaaccccuggauggaggauaagacgcacaucucguccuggggcgacgugccguacuuggggaagcgcgaggaccaguggugcggcagccuaauuggcuuaacugcgcgggccaccugggcaaccaacauacagguggccaucaaccaggugcgccggcugaucgggaacgagaacuaccuggacuacaugaccucuaugaagcgcuucaagaacgagagcgacccugagggcgcgcucugguga

SEQ ID NO: 24099 - RNA, 9879 nt, Artificial Sequence
  derived and/or modified CDS sequence (opt11) from DENV-1__EU677158__SS-prME
ucagugacuaugcugcugaugcucaugccgaccgcucuggccuuccaccuuaccacacggggcggggaaccccauaugaucgugagcaaacaggagcggggcaagagccuguuauucaagaccagcgcuggugugaauaugugcacgcucaucgccauggaccugggagagcuaugcgaggacaccaugaccuacaagugcccccggauaacugaaaccgagcccgacgacguugacugcuggugcaacgcaacggacaccugggucaccuacgggaccugcagucagaccggcgagcaccggcgggacaaacggaguguagcguuggcgccccaugugggccuggggcuggagacacgcaccgagaccuggaugagcuccgagggcgcuuggaagcagauccagcgggucgagacgugggcccuacggcaccccggguucaccgugaucgcccuguuucuggcccacgcgaucggcaccagcaucacccagaaggggaucauuuucauucuccugaugcuggugacgcccuccauggccaugcggugcgucggaaucggcagccgcgacuucguugaggggcucuccggcgccaccuggguugacgucgugcuggagcacgggagcugcgucaccaccauggcaaaggauaagcccacucuggacaucgagcuccugaagacggaggucacuaauccggccgugcugcggaaacucugcaucgaggcgaagaucuccaacacgacgacugacagccgcugcccgacccagggugaggccaccuuaguugaggagcaggacgccaacuucgucugccggcgcacguucguagaccggggcuggggaaacgguugcgggcuuuuuggcaaggggucccucaucacgugcgccaaguucaagugcgugaccaaacuugagggcaagaucguccaguacgagaaccugaaguacagcguaaucgugaccguccacacgggcgaccagcaccaggugggcaacgaauccaccgaacauggcaccacagcaaccauaacaccccaagcgcccaccaccgagauccagcucaccgacuauggggcccuuacacuugacugcagccccaggaccggccucgacuucaaugagaugguccugcugacaaugaaggagaaguccuggcucgugcacaagcagugguuccuggacuugccacuacccuggaccucaggggccagcaccucccaggagaccuggaaccggcaggaccugcuggugacguucaagaccgcccacgccaagaagcaggaagucguugugcucggcucgcaggagggcgcgaugcacacggcgcugaccggggccaccgagauccagaccucaggcacgaccaccaucuucgccggacaccugaaaugccggcucaagauggauaaacugacccuuaaggggaugagcuaugucaugugcacgggguccuucaagcucgagaaggaaguggcggagacccaacacggcaccgugcugguccagaucaaguacgagggcaccgacgcuccaugcaaaauccccuuccuaacgcaggacgagaagggugugacccagaauggccggcugaucaccgccaacccuaucgugaccgacaaagagaaacccguaaacaucgaagccgagccgcccuucggggagagcuauauuaucauaggcgccggcgagaaggcgcuaaaacuaucaugguucaagaaagggagcuccaucggcaagauguucgaggccacggcccgcggggcgaggcgaauggccauccugggcgacaccgcgugggacuucgggagcaucggcggcguguucaccuccguggggaagcucguccaccagaucuuuggcaccgccuacggggugcuguucagcggcgugucauggacgaugaaaaucgggaucggcgucuuacucaccuggcugggccucaacagccgcuccacaagccucaguaugaccugcaucgccguggggcuggugacgcuuuaucucggcgucauggugcaggccgacagcgggugcgugaucaacuggaagggccgggaauugaagugcggguccggcaucuucgucaccaacgaggugcacaccuggaccgagcaguacaaguuccaggccgauuccccgaagcgccugagcgcggccaucggcaaggcuugggaggagggggugugcggcauccgguccgcuacucgccucgagaacaucauguggaagcagaucagcaaugagcugaaccacaucuugcucgagaacgacaugaaguucacuguuguggugggggacgucgcugggauccuggcgcaggggaaaaagaugauccggccucaacccauggaguacaaguacuccuggaagaguuggggcaaagccaaaaucaucggggcagacguucagaacaccacuuucauaaucgacgggccuaacacgccggaaugccccgacgaccagcgcgcauggaacaucugggagguugaggacuauggcuuugggaucuucacgaccaacauuugguuaaagcugcgggacuccuauacccaggucugcgaccaccgccucaugagcgcagcaaucaaggacuccaaggccgugcacgccgacaugggcuacuggaucgaaagcgagaaaaaugagacguggaagcuggcccgggccagcuucaucgaggugaagaccugcaucuggcccaaaagccacacccucugguccaauggcguccuggaaagcgaaaugauaauccccaagaucuacgggggcccgaucucccaacacaauuacagacccggguauuucacccagaccgccggccccuggcaccuggggaagcucgagcuggacuucgaccugugcgaaggcacgaccgugguggucgacgagcauugcggcaaccgggggccgagccuccgcaccacuaccguuaccggcaagaucauccacgaguggugcugccggagcuguacacugccuccgcugcgguuucgcggggaggaugguugcugguacgggauggagauacggccggugaaggagaaggaggagaaccuggucaagucuauggugucugccggcagcggcgagguggacagcuucucccuggggcugcucuguaucagcauuaucaucgaggaggucaugcggucccgcuggagcagaaagaugcugaugaccgggacgcuggcgguguucgugcuccugaucauggggcaacugacguggaacgaccucauccgcuuaugcaucauggucggcgccaacgccuccgaccgcauggggaugggcacuaccuaccuggcccucauggccacguucaagaugagaccgauguucgccgugggccugcuguuccggcgccucaccagcagggagguucuguugcucaccaucgggcuuucccuagucgccagcguggagcuccccaacucccuggaggagcuaggcgaugggcucgcgaugggcaucaugauccuuaagcugcucaccgacuuccaaagccaccagcugugggccacgcuguugucccugaccuucaucaagaccaccuucagucuucauuacgccuggaagacaauggccaugguucucuccaucgugagccuguuccccuuaugccucuccaccaccucucagaaaaccacgugguugcccguauuacucggcucccucgggugcaagccguuaacuauguuccucauagcggagaauaaaaucugggggcggaggagcuggccucucaacgaagguaucauggccguaggcaucguauccauccugcuuagcagcuuacugaagaacgacgugccccucgccgggccccugaucgccggagggauguugaucgccugcuacgucaucuccgggagcuccgcggaccucagccuagaaaaggcagcggaggugucuugggaagaggaagccgagcacagcggcgccucccacaacauccugguggagguccaggacgacgguaccaugaagaucaaagacgaggagcgggaugauacucuuaccauucugcuaaaggcgacucuccuggccgugagugguguguacccgcucuccauccccgccacccucuucgucugguacuucuggcagaagaagaagcaacgcagcgggguccugugggacacccccagcccuccagagguggagcgcgccguccuugaugacggcaucuaccgcauaaugcagcggggccuccuuggccgcucccaggugggaguaggggucuuccaggagaacguuuuucacaccauguggcacgugacgcggggcgcaguccugauguaccaggggaagcgcuuggagcccuccugggcgagcgugaagaaggaccucaucucuuacggcggcggguggcggcugcaggguagcuggaacaccggggaggaggugcaggucaucgccguggagcccggcaagaaccccaagaacgugcagacagcccccgggaccuucaagacgcccgagggcgagguaggagccauagcccuggacuucaaacccgggaccuccggcagccccaucguaaaccgagaggggaagaucgugggccucuaugguaauggagucgugaccaccuccggcacguacguaagcgcaaucgcccaagccaaggccagccaggaaggcccgcugcccgaaaucgaagaugaggucuuucggaagcgcaaucugacgaucauggaucuccaccccggcuccggaaagacccggcgcuaccugccagcuaucgugcgggaggccaucaagagaaaauuacgcacccucauccuggcccccacgcggguggucgccagcgagauggccgaggcgcugaaggguaugcccauccgcuaccagaccaccgccgugaaguccgaacacaccggcaaggagaucguggaucucaugugccaugccaccuucaccaugcgccugcucagccccguccgugugccgaacuacaacaugaucaucauggacgaggcccacuucaccgacccauccaguaucgcggcgcguggcuauaucuccacccgcgugggcaugggugaggccgccgcuauauucaugacggcaacgccacccggcagcgucgaggcguucccgcaguccaacgccgucauacaggacgaggagcgggacauccccgagcgauccuggaacaguggguacgaguggauaacagacuucccaggcaagaccgugugguucguccccagcauaaaguccggcaacgacaucgccaacugccuccgaaagaacgggaagcggguaauccagcuaagccggaagacguucgacaccgaguaccagaagaccaagaacaacgacugggauuacgucgucaccacggacaucuccgagaugggcgcaaacuuucgggcggaucgggugauagauccgcgccggugucugaagccagugauccucaaggacgggccugagcgagucauucuggcgggccccaugccaguaaccguagcguccgcugcccaacgccgcgggcggaucggccgcaaccacaauaaggagggcgaccaguacaucuauauggggcagccccugaacaacgacgaagaccacgcgcacuggaccgaagccaagaugcuccuggacaacaucaacacccccgagggcaucauccccgcucucuuugagcccgaacgcgagaaaucggccgcgaucgauggggaauaccggcuccguggggaagcgcggaaaacauucguggaacugaugcgcagaggggaccugcccgucuggcucagcuacaaggucgccucugagggguuccaauacagcgacaggcggugguguuucgacggcgagcgcaacaaccaggugcuggaggaaaauauggacgucgagaucuggaccaaggagggggaacgcaagaagcuacgcccccgguggcucgacgcgcgcacauauagcgacccccucgcccugcgggaguucaaggaguucgccgcgggccgcagguccgucagcggggaccucauucuggagaucggcaagcugccgcagcaccucacccagagggcccagaaugcgcuggacaaccucgugaugcuccauaacuccgagcagggcggacgggcuuaccgccacgccauggaggagcugcccgauacgauagagacccugauguugcuggcccugaucgccgugcuaaccggcgggguaacccuguucuuccugagcggccggggucucggcaagacauccaucggccuccugugcgugauggccagcucagugcuacuguggauggcuagcgucgaaccccauuggaucgcggccucuaucauccuggaguucuucuugaugguucugcugauccccgagcccgaucgccaacguacgccccaggacaaucagcucgccuacguggucaucgggcuguuguuuaugauccuaaccguagccgcaaaugagaugggccugcuagagaccacgaagaaggaccucgggaucggucacguggcggucgagaaccaccaccacgccgccaugcuggacguggaccuucaccccgccagcgccuggacgcucuaugcggucgccaccaccaucaucacucccaugaugcgccacacgaucgagaacaccaccgccaacauuucccugacagcaaucgccaaccaggcugcaauccugauggggcucgacaagggcuggcccaucagcaagauggacaucggcguuccacugcuggcacuagguuguuacucccagguaaaucccuugacgcugacagccgcggugcucaugcuggucgcccacuacgccaucauuggcccgggacuacaagccaaggccacccgcgaggcucagaagcggaccgccgccggcauaaugaagaaccccacgguggacgggaucguagccaucgacuuggaccccgucguguacgacgccaaguucgagaagcagcugggccaaaucaugcugcucauacugugcaccagccagauccugcucaugcgcaccaccugggcacugugcgagucaaucacgcuggccacuggccccuugaccacccucugggaggggagcccggguaaguucuggaauacaacuaucgcuguguccauggcuaacaucuuccggggaagcuaucucgccggugcggggcuugccuucucccugaugaaauccuuagguggcggccgccgggggaccggggcccagggcgagacccucggcgagaaguggaagcgccaguugaaccagcuguccaaguccgaguucaacaccuacaagaggagcgggaucauggaggucgaccgcuccgaggcuaaggagggccucaagcgcggugagaccaccaagcacgcggugagccgcggcaccgcgaagcugagaugguucguggagcgcaaccugguaaagccugaaggcaaggugaucgaccugggcuguggccgcggcgggugguccuacuacugcgccgggcuaaagaaaguaacagaggucaagggguacacgaagggcggccccggccacgaggagccaaucccgauggcuaccuacggguggaaucuggugaagcugcacagcggcaaggauguguucuucaucccgccagagaagugcgacacucuccugugugacaucggggagucgagccccaacccgacgaucgaggaagggcgcacccuucggguccucaagaugguggagcccuggcugcgcggaaaccaguuuugcaucaagauccugaauccguacaugccgaguguggucgagacucucgagcagaugcagcggaagcauggcggcaugcuggugcgcaacccgcugucgcggaacuccacccacgagauguacuggguaagcugcgggacuggcaacauuguuuccgccgugaacaugacgagcagaaugcuccuuaaccgauuuaccauggcgcaucgaaagcccaccuacgagcgugacguggaccugggggcuggcacacggcaugucgccguggagcccgagguagccaaccucgacaucaucggccagcgcaucgagaacaucaagcacgagcacaagucgacguggcacuaugacgaggacaaccccuacaaaaccugggcuuaccacgggagcuacgaggucaaaccgucuggcucugcgucgagcaugguaaauggggucgugaagcugcuuacuaagcccugggacgugauccccauggucacgcagaucgcaaugacggacaccacccccuucggccagcaaaggguguucaaggagaagguggacacccgcacgccgaaggccaagcgugggaccgcacagaucauggaggucaccgccaaguggcucugggguuucuugagccgcaacaagaagccccgcaucugcacccgggaggaguucacgagaaaagugcgcucaaacgcggccaucggcgcaguguucgucgacgagaaccaguggaauagcgccaaggaggcgguggaggacgagcgguucugggaccuggugcacagagagcgggaacuccacaaacaggggaagugcgcgaccugugucuacaacaugaugggcaagcgcgagaagaaguuaggggaguucggcaaggccaaggggucccgggccaucugguacauguggcugggcgcgcgcuuucucgaguucgaggcgcugggcuucaugaaugaggaccacugguucucgcgggagaacucccuuagcgggguggagggcgaagggcuccacaaacugggcuauauccugcgcgauaucagcaaaauacccggggguaacauguacgccgaugacaccgccggcugggauacccgcaucacggaggacgaccuacagaacgaggcccggaucaccgacauaauggagccggaacacgcacuucuggccaagagcaucuucaagcucaccuaccagaacaaggucguccgcgugcagcgcccugcgaagaacggaaccgugauggacgucaucucgcgccgggaccagcgcggcuccggccagguggggacguacggccugaacaccuucaccaacauggaggcccagcugauccgccagauggaguccgagggaauuuucucacccuccgagcucgaaaccccgaaccuggccgagcgcguguuggacuggcucgagaaguacggugucgaacgguuaaagcgcauggcuaucagcggggacgacuguguggugaagccgaucgacgacagguuugcgacggcucugaccgcccucaacgacaugggcaagguccgcaaggauaucccccagugggagcccuccaagggguggaacgacuggcagcaaguccccuucugcucgcaccacuuucaucaguugaucaugaaggacggcagagagaucguggucccgugccgaaaucaggacgaacuggugggucgugcacgagucucccaaggggccggauggagccuccgggagaccgcaugccugggcaagucuuacgcccagauguggcagcugauguacuuccaccgccgggaucuccgccuggccgccaacgcgauuuguagcgcugucccaguggacuggauccccaccucccggacgaccugguccauucacgcccaccaccaguggaugacaaccgaggauaugcugagcguguggaaucgcgucuggaucgaggaaaaucccuggauggaagacaagacgcacaucuccagcuggggcgacgugccauaccuugggaagcgcgaggaccaguggugcggcuccuuaaucggccuaacagcacgggccaccugggcgaccaauauucagguugccaucaaccagguccgccggcucauagggaaugagaacuacuuagacuacaugaccagcaugaagcgcuucaagaacgagggcgaucccgagggggcccugugguag

SEQ ID NO: 24100 - RNA, 9879 nt, Artificial Sequence
  derived and/or modified CDS sequence (opt11) from DENV-1__EU677159__SS-prME
agcguuacuaugcugcucaugcugaugcccacagcccuggccuuucacuuaaccaccagaggcggggagccccacaugaucguguccaagcaagaacgggggaagucccuguuauuuaagaccucagcgggggugaacaugugcacgcucaucgccauggaucugggcgagcugugugaggacacaaugaccuacaagugcccacgcauuaccgaggccgaaccugacgauguggacugcuggugcaacgccaccgacaccugggugaccuaugguacgugcagccagacaggggagcaccggcgcgacaaaagaucaguggcgcucgcgccccacgugggccuggggcuggagacgcgcacagagaccuggaugagcucagagggagccuggaagcaaauccaacgggucgagacgugggcgcuacgccacccgggguuuacggucaucgcucuuuuccuggcgcacgccauuggcacgagcaucacacagaagggcaucaucuuuauacuccugaugcuggugacccccuccauggccaugcgcugugucggcaucggcagccgcgacuucguggagggguuauccggcgcaacguggguggauguugugcuggagcacgggaguugugugacaaccauggccaaggacaagcccacgcuggacaucgagcuccugaagacggaggucacgaacccagcggugcugcggaagcucuguauugaggcgaagauuuccaacaccaccacagacagccgcuguccgacucaaggcgaagccacccugguugaggagcaagacgcuaacuucgucugccggcgcaccuucguggaccggggcugggggaacggcuguggccuguucggcaaggggucccucaucacaugcgccaaauucaaaugcgugacgaaacuggagggcaagaucguacaguaugaaaaccugaaguauuccgugauaguuaccguccacacuggcgaucagcaccagguggggaaugaaucgacggagcacggcacgaccgcaaccaucaccccccaggcccccacgacagagauccagcuuaccgacuacggugcgcugacucucgacuguagcccacgcacgggcuuagacuucaacgagaugguccugcuuacgaugaaggagaagaguuggcucgugcacaaacaaugguuccuggaccuacccuuacccuggaccagcggugcaagcaccucccaggagacguggaaccggcaggaccuucuggugaccuucaagaccgcccacgcgaaaaagcaggaggucgugguccucggcagccaggagggcgccaugcacacagcccugaccggggccaccgagauacagaccuccgggaccacgaccaucuucgccgggcaucugaagugucgccucaagauggacaagcucacacugaagggcaugagcuacgucauguguacuggguccuucaagcucgagaaggaaguggcggaaacucaacauggcaccgugcugguacagaucaaguacgagggaaccgacgccccuuguaagauucccuucucaacccaggacgagaagggggugacgcagaacggccggcugauuaccgccaaccccaucgucaccgacaaggagaagcccgucaacaucgaggcggaaccacccuuuggggaguccuacaucgucauuggugccggggaaaaggcacugaagcucagcugguuuaagaaggguuccagcaucggcaagauguuugaggcuacugcccgcggggcccgccgcauggcgauccugggggacacggccugggauuucgggaguaucggcggcguguucaccagcgucgggaagcugguccaccaaaucuucggcaccgccuacggaguacuuuucuccggcgucagcuggaccaugaagaucgggaucggcgugcugcucacguggcucgggcugaacagucgcagcaccucccugagcaugaccuguaucgccgugggucucgucacccuguaucucggggugauggugcaggccgacuccggauguguaaucaacuggaagggaagggagcucaagugcgggagcggcaucuucgugacuaacgagguacacaccuggaccgaacaguacaaguuccaagcggacagccccaaacgccugucugccgccaucggcaaggcaugggaggaaggagucugcggcauccggagugccacgcgccuggagaacaucauguggaagcagaucuccaaugaauuaaaucacauucugcuggagaacgacaugaagcucaccguuguggucggggacguggcuggcaucuuagggcagggcaagaagaugauacggccccagccuauggaauacaaguauucuuggaaauccugggggaaagccaagaucaucggggcagacgcccagaacacgaccuucaucauagacggcccgaacaccccggagugccccgacgaucaacgcgcguggaacaucugggaaguggaagacuacggguucggcaucuuuaccacgaauaucuggcucaagcuuagggacagcuacacccaagucugcgaccaucggcugauguccgcggccaucaaagauagcaaggccgugcacgccgacaugggcuauuggauagaguccgaaaagaacgagaccuggaagcuggcccgggcuagcuucaucgaggugaagaccugcaucuggcccaagucccacacgcucuggucgaacgggguccuggagagugagaugaucauccccaagaucuauggcggacccauuagccagcacaacuaccgccccggcuacuucacucagaccgccgggcccuggcaccugggaaagcucgagcuggauuucgaucugugugagggcaccacggugguggucgacgagcacuguggaaaccguggccccucacuccgcacaaccacugugacggggaagauaauccacgaguggugcugccggagcugcacguugccaccccugcgcuuucggggugaggacgggugcugguacggcauggaaauuaggccagugaaggagaaggaggagaacuuggucaagucuaugguuucugccggcagcggggagguggacuccuucagccugggccuguugugcaucuccaucaugaucgaggaggucaugcgcagccgcuggucccggaagauguuaaugacggggaccuuggcaguguucuuccuucugauuaugggccaacuuacguggaacgaccucauucgccugugcaucauggugggggcgaacgcgagcgaccgcaugggcaugggcaccaccuaccuggcccucauggccaccuucaagaugcggccgauguucgccgugggccuucuguuccgccggcucacgucccgcgaggugcugcuguugaccauuggucugagccuaguggcauccguggaauuacccaacagcuuggaggagcugggggauggccucgccaugggcaucaugauccugaagcuguuaaccgacuuucagucccaccagcugugggccacccuacucagucugacguucaucaagacuaccuucucccugcacuacgccuggaaaaccauggcaauggugcucagcaucgucucccuguucccccuuugccucuccacgacaucccagaagaccaccuggcugcccguauugcucgggagccugggaugcaagccgcugacgauguuccuuaucgccgagaacaaaaucugggggcggaaguccuggccccugaacgaaggcaucauggccguggggaucgucagcauccugcucucgagucuacugaagaacgacgucccccucgcagguccccugaucgccggcgggaugcugaucgcuugcuacguuaucagcggcuccagcgcagaccucucccuggagaaggcagccgaggucagcugggaggaggaggccgagcauucuggggcgagccacaacauccugguggaggugcaggacgacggcacuaugaaaaucaaggacgaggagcgugacgauacccucacuauccugcugaaggcuacccuccuggcagucuccgguguguacccgaucagcauacccgccacgcuguucgugugguacuucuggcaaaagaagaagcagcgguccggcguccucugggacaccccaagcccgcccgagguggagcgcgccgucuuagaugacggcaucuaccggaucaugcagcgagggcugcugggccggucccaggugggugugggagucuuccaggaaaacgucuuccacaccauguggcacgugacacgcggggcgguacuaauguaccaaggcaagcgguuggagcccagcugggccagcgucaagaaggaccugauaucguacggcgggggauggcgcuugcgggggaguuggaacacgggcgaggaaguacaggugauugcaguugagcccgggaagaacccgaagaacguccagacagccccgggcaccuucaaaaccccagaaggcgaggugggggccaucgcgcuggacuucaagccugguacgagcggcucccccaucgucaaccgcgagggcaaaaucgucggcuuauacgggaacggcguugucaccaccagcgggaccuacgugagcgccaucgcgcaggccaaagcgucccaagaggguccgcuccccgagaucgaggacgaaguauuccggaaacgcaacuugaccaucauggaccugcacccgggaagcggcaaaacccgacgcuaccucccagccaucguccgggaggccaucaaacguaagcugcgcacccugauccucgccccaacccgcguggucgcuuccgaaauggcggaagcccugaagggcaugcccauccgcuaccagacgacagccguaaagagcgagcacaccgggaaggagauuguagaccugaugugccacgccacuuucaccaugcggcuacugucccccgugcgcgucccgaacuacaacaugauaaucauggacgaagcccacuucacagaccccagcuccauagcggcccggggcuacaucagcaccagaguagguaugggugaggccgcggcgaucuucaugacagcgaccccgcccgggagcguggaggccuucccccagagcaacgccgucauccaggaugaggagcgggacaucccugagcgcucauggaacucugguuacgaguggaucaccgauuuccccggcaagaccgucugguuugugccuuccauaaaaagcgguaaugacaucgcgaauugcuuacguaagaacggcaagcgagucauccaacugucccggaagaccuucgacacggaauaccaaaagaccaagaacaacgacugggacuacguggugaccaccgacaucagcgagaugggcgcgaacuuccgcgccgaccgggucaucgacccgcgccgcugccuuaaacccgucauccugaaagauggucccgaacgcguuauacucgccgggcccaugccugucacgguggccucggccgcgcagaggcgcggccgcaucggcagaaaccacaacaaggagggggaccaauacaucuauaugggacagccccugaacaaugacgaggaccacgcacauuggaccgaggccaagaugcugcucgacaacaucaauaccccugaggggaucauccccgccuuauucgagccggagcgcgagaaguccgcugcggucgacggugaauaccggcugcgcggcgaggcccggaagacguuugucgagcucaugcgccggggagaccugcccguguggcugucuuauaaggucgccagcgagggauuucaguacuccgaccgccgcuggugcuucgacggcgagcgcaacaaucaaguccucgaggagaacauggauguggaaaucuggaccaaggagggugagaggaagaaacuacgaccccggugguuagacgcucgcaccuacucugacccucuugcccugcgugaguuuaaggaguucgcggcgggucgccgguccguguccggcgaccugauccucgagauuggcaaacugccgcagcauuuaacccagcgcgcccagaaugcgcucgacaaccuggugaugcuacacaacucggaacagggcgggcgggccuaccgacacgcuauggaggagcuucccgacaccauugagacacugaugcugcucgcccuaaucgccgugcugaccgggggcgucacccucuucuuccugucuggucguggucugggcaagaccagcaucggacucuuaugcguaauggccuccagcguucuacucuggauggccuccgucgagccacacuggaucgccgccagcaucauccuugaguucuuccuaauggugcuucugauucccgagccggacagacaacggacgccccaggauaaccagcuggcauacguaguuaucggccuccuguucaugauccugacgguggccgcgaaugaaauggggcugcucgagacgaccaaaaaagaccugggcaucgggcauguggccgucgagaaucaccaccacgccgccaugcucgacguagaucuucaccccgccuccgcguggacccucuacgccgucgcgacgacgaucaucaccccgaugaugcggcacaccaucgagaacacgacagccaacaucagccucaccgccaucgccaaccaggccgccauacugaugggccucgacaagggcuggcccaucuccaagauggacauaggcgucccccuccuggcccugggcugcuacagccaggugaacccacucacccugaccgcggccgugcugaugcucgucgcccacuacgccaucauagggccgggccugcaggcgaaggcgacccgcgaggcccagaagcggaccgccgcggggaucaugaagaacccaaccgucgacggcauaguagcaauugaccuggaccccgucguguacgacgcaaaguuugaaaagcagcucggccagauuaugcuuuugauccuuugcacaucccagauccugcugaugcgcaccaccugggcgcucugcgagucgaucacccuggccacugggccccugaccacccucugggaaggcuccccggggaaguucuggaacaccacaauagcagugucgauggcaaacaucuuccggggguccuaccuggccggcgccgggcuggccuucucauugaugaaguccuuaggcgguggccgccgggggaccggcgcccaaggcgaaaccuuaggggagaaguggaagcggcagcucaaccagcuguccaaguccgaguucaacaccuacaagcgguccggaaucauggaggucgaccgcagcgaggcgaaagaaggacucaagcggggggagacgaccaagcacgcugugucccgcgggaccgccaagcuccggugguucguggagagaaacuuagucaagccggagggaaaggugauugaccugggcugugggcggggcggguggaguuacuacugcgccggccugaagaaggugaccgaggucaagggguacacaaaaggcggccccggccacgaagagccgauccccauggcaaccuauggauggaacuuggugaagcugcacucggguaaagacguguucuucaucccgcccgagaaaugcgacacccugcucugcgauaucggugagagcagccccaaccccaccauugaggaggggcgcacgcugaggguccuuaagaugguggagccguggcuccgcggcaaccaguucugcaucaaaauccugaaccccuacaugcccagcgugguagaggcgcuggagcagaugcagcggaagcacggagggaugcucgugcggaacccgcuguccaggaauagcacccacgagauguauuggguguccugcggcaccgggaacaucgucucugcugugaacaugaccucccgcauguugcucaaccgcuuuacaauggcccaccggaagccuacguacgagcgugacguugaucugggcaccggcacgcggcacgucgccguggagcccgagguggccaaucuggacaucauagggcagcgaaucgagaacaucaagcacgagcacaagaguaccuggcauuacgacgaggacaauccguacaagacuugggcguaccauggcaguuacgaggucaagccgagcggauccgccagcagcauggugaacggcgucgugaagcucuuaaccaagccuugggacgugaucccuauggucacccaaaucgccaugacggacacgacccccuucgggcagcaacgggucuucaaggagaagguggacacuaggacccccaaggccaagcggggcacggcccagaucauggaggugaccgcccgcuggcuguggggauuccucucacggaacaagaagccccguaucugcacacgggaggaguucacgcgcaaggugagaagcaaugccgccaucggagcuguguuuguagacgagaaccaauggaacucggcgaaggaagccguggaagaugaacgcuuuugggaccuggugcaccgggagcgcgagcuucacaaacagggcaagugcgccacgugcgucuacaacaugauggggaagcgggagaagaaacuaggugaauucgggaaggccaagggcucacgcgccaucugguacauguggcugggcgcacguuuccuggaguucgaggcccuuggauucaugaaugaggaccacugguucucccgcgagaacagucugagcggcguggaaggggagggacuacacaagcucggguauauccugcgggacaucaguaagauccccgggggcaacauguacgccgaugacacugccgggugggacacccguaucaccgaggacgaccugcagaacgaggccaagaucacggacaucauggagccggagcacgcgcucuuagccaaggccaucuucaagcugaccuaucagaacaaggugguccgcgugcagcggccggccaagaauggcaccgugauggauguaaucucccgccgggaccagcgcgguucaggccaggugggcacguauggacucaacacuuucaccaacauggaagcccagcugauccggcagauggaguccgaaggcaucuucagccccucugaacuggaaacccccaaccucgcggagcgcgcccuugauuggcuggggaaguacggcguggagcggcucaagcgaauggccaucagcggggaugacugcgucgugaagccgaucgaugacagauucgccaccgcucugacagcgcuuaacgacaugggcaaagugcgcaaggacaucccccagugggagcccaguaagggcuggaaugacuggcagcagguccccuucugcucccaccacuuccaccagcucaucaugaaggacgggcgggagaucguggugccaugccguaaucaggacgagcuggucggcagagccagagugucacagggggccggcuggagucugcgugagaccgcgugccucggcaagagcuacgcucaaauguggcagcugauguacuuccaccgccgagaccugcgccuagccgcuaacgccauuuguagugccgugcccguagauugggugcccaccagccgcacgacgugguccauccacgcgcaccaccaguggaugaccaccgaggacaugcugaguguguggaaccgcgucuggauugaggagaaccccuggauggaggacaagacccacaucucuagcugggaggacgugccuuaccugggcaagagggaagaccaauggugcgguucccucaucggguuaacggcccgggccaccugggccaccaauauccaggucgccaucaaucagguccgccggcugaucgggaacgagaacuaccucgacuacaugaucagcaugaagcgcuucaaaaaugaguccgaccccgaaggggcucucugguga

SEQ ID NO: 24101 - RNA, 9879 nt, Artificial Sequence
  derived and/or modified CDS sequence (opt11) from DENV-1__EU677160__SS-prME
agcgucacgaugcuguuaaugcugaugcccacggcccuggccuuccaucucacaacgcggggcggugaaccucacaugaucgugagcaaacaggaacgcgggaagagccucuuguucaagacgucugcaggcgugaacauguguacgcuuauagccauggaucugggcgaauucugugaggacacgaugaccuacaaguguccucgcaucaccgaagccgaaccggacgauguggacugcuggugcaaugcaaccgacacguggguuacauacggaacaugcagucagacgggggaacaccggcgggacaagcgaucaguugcccuagcgccacacgugggccugggguuagaaacgcggacggagaccuggaugagcuccgagggcgcauggaagcagauacagcggguggagaccugggcccugcgccacccuggauucacggucaucgcccucuuccuggcgcacgccaucgggaccagcaucacccaaaaggggaucaucuucauccugcucgugcuggucacccccuccauggccaugcggugugugggcauuggcucgcgcgacuucguggagggucuguccggcgcaacgugggucgacgugguguuagagcacggaaguugcguaacgacaauggcaaaggacaagcccacauuggacaucgaauugcucaagacggaggugaccaaccccgcgguacugcggaagcugugcaucgaggccaagauuuccaauaccaccacagacagccgcuguccgacacagggugaggccacccucgucgaggaacaggacgccaacuucgugugucgucguacguucguggaucggggcuggggaaacggcugcgggcuguuuggcaaaggaucccuaaucacuugugccaaauucaagugcgucaccaaacucgagggcaagaccguacaguacgaaaaccuaaaguacuccguuaucgucacagugcacacaggcgaccagcaucagguaggcaaugaaucuaccgagcacgguaccaccgcgacuauaaccccccaggcccccagcaccgagauccaacuaaccgacuauggugcucucacccuugauugcaguccccggacgggucuggacuucaacgagauggugcugcugaccaugaaggagaaguccuggcuggugcauaagcagugguuccucgaccugcccuugccguggaccagcggggcuuccacaagccaggagacguggaaucggaaggacuuacuggucaccuucaagaccgcucaugcgaagaagcaggagguugugguccucggcucucaagagggugccaugcacaccgcucuuacgggggcaacugagauccagacgucaggcaccaccaccaucuucgccggacauuugaagugucgucucaagauggacaagcucacccugaagggcauguccuacgugaugugcaccgggagcuucaaguuagaaaaggagguggcugagacucagcacgguaccgugcucgugcagaucaaguacgagggcaccgacgcacccugcaaaauccccuucuccacccaggacgagaagggggucacgcagaacggucgucuuaucacugcgaauccaaucgucaccgacaaggaaaaaccaguuaacaucgaggccgagccgcccuucggggagucuuauauagugaucggcgcuggcgaaaaggccuuaaagcucuccugguucaagaaggggagcuccaucggcaaaauguucgaagcaaccgccaggggggcccgccgcauggcgauacucggcgacacggccugggacuucgggucgaucggaggaguauucaccuccguugguaagcuagugcaucagaucuuuggcacagcuuacggugucuuauucagcggaguuuccuggaccaugaagaucgggaucggcgugcucuuaacguggcugggcuugaauagucguucaaccagcuuauccaugaccugcaucgccgucgggcugguaacccuuuaucugggcguuaugguacaagccgacagcggcugugugaucaacuggaagggccgggagcuuaagugugggagcggcauuuucguaacgaacgaaguccacacguggaccgagcaguacaaguuccaggcggacuccccuaagcgucucagcgccgcuaucggcaaggcgugggaggagggggugugcggcauacggagcgccacccgacuggagaauaucauguggaagcagaucucuaaugaguuaaaccauauccucuuggagaacgacaugaaauuuacagucgucgugggugacguggcaggcauacuggcccagggcaagaagaugaucaggccccagcccauggaauacaaguacucguggaaguccuggggcaaggccaaaaucaucggcgccgacguccagaacacgaccuucaucaucgacggacccaacacuccugagugccccgacgaccaacgcgcauggaauaucugggagguggaggacuacggcuuugggaucuucaccaccaacaucuggcucaagcuuagagacuccuacacccaaguuugcgaccaccgccugaugagcgcagccaucaaggacagcaaggccguccaugccgacaugggcuacuggauagagagugagaagaacgagacuuggaaacucgcgcgcgccuccuucauagagguaaagacuugcauuuggccgaagucgcacacgcugugguccaacggcguguuagaguccgagaugaucaucccuaaaaucuaugggggcccgaucucccagcauaacuaccgccccggguacuuuacacagaccgcaggacccuggcaccucggaaaacuagaacuggacuucgaucugugcgagggcaccacggugguaguggacgagcacugcggcaaccgaggcccaagccugcguacgaccaccgucacgggcaaaauaauacacgaauggugcugccgguccugcacccugccgccccugcgauucaagggagaggacggguguugguaugggauggagauucggcccgugaaggagaaggaggagaaccuugugaaaagccuggucuccgccggcuccggcgagguugacagcuuuagcuuggggcugcugugcaucagcauaaugauagaggaaguaaugcgcagccgguggagcagaaagaugcucaugaccggcacccuggccgucuucuuccugcucaucauggggcagcuaacguggaaugacuuaauccggcucugcauuaugguuggcgcgaacgccucagauagaauggggaugggaacgacuuaucuggcccuaauggccacauucaagaugcgcccaauguucgccguggguuuacuguuuagaagacuuacgagccgggagguccuccugcugaccaucgggcucucccugguggcgagcgucgagcugcccaacucgcuggaggaacugggcgacggcuuagccaugggcauuaugauccucaagcugcugaccgacuuccagucucaccagcucugggccacacugcugucccucacuuuuaucaagaccacuuucagccugcacuacgcguggaagaccauggcgaugguccuguccaucguuucacuuuuuccccugugccuguccacgacgagccagaagaccaccugguugccgguacuucugggcucauuaggguguaagccgcuaacgauguuccugaucgccgagaacaagaucuggggccgcaagagcuggccgcugaacgaggguauuauggcugugggaauagugagcauuuugcugucgagccuccugaaaaacgacgucccacuggccgggccccucauugcagggggcaugcugaucgcaugcuacgugaucuccgggagcucagccgaccugagccucgagaaggccgcggagguguccugggaggaggaggccgagcacagcggcgcuucccauaacauucuagucgaggugcaggacgacggcaccaugaagauuaaggacgaggaacgggacgacacacugaccauucuccugaaggccacccugcucgccguaucuggcgucuacccgcuauccauccccgcgacacuguucguuugguacuucuggcagaagaagaaacagcgcagcggggugcucugggacacccccagcccgcccgaaguggaacgcgccguacuggacgauggaaucuaccgcaucaugcagcggggccugcuaggccgcagccaggugggggucgggguguuccaggagaauguguuccacacuauguggcacguaacucggggcgccguacucauguaccaaggcaagcgccuggagcccuccugggcguccgugaagaaggaccugaucucguacggaggcgguuggagguugcaagggagcuggaauacuggcgaggagguccagguuaucgcgguggagcccgguaagaaccccaagaacguccagacugcccccgggacguuuaaaaccucagagggcgaggucggggcuauagcgcuugacuucaagcccgggacaagcgguagccccauugugaaccgcgaggguaagaucguuggacucuacgggaacgggguggugaccacgucaggaacguacgucagcgcuaucgcccaggccaaggcgagucaggaggggccccuaccggagaucgaggaugagguguuucggaaacguaaccugacgauaauggauuuacaccccggcagcggcaagacccgacgcuaccucccggccaucgugcgcgaagcuaucaagcgcaagcugcggacccucauccucgcaccgacacgugucguggcauccgaaauggcggaagccuugaaggguaugccgauacgcuaccagacuacggcugucaagucugagcauaccgguaaggagauugucgaucugaugugccacgccaccuucacgaugcgguugcugucccccgugcgcguacccaacuauaacaugauaaucauggacgaggcccacuuuacggacccuagcucuauagcugcccggggguauaucagcacccgcguugggaugggggaggccgcggccaucuucaugacugcgacgccacccggcuccguugaagccuuuccucagucuaaugccgugauccaggacgaggaacgggacauccccgagcgguccuggaacagcggauacgaguggauuaccgacuucccggguaaaacugucugguuuguuccgagcaucaaaucugguaacgauaucgccaacugucugcggaagaacggaaaacgaguaauccaacucagucggaagaccuucgacacggaguaucagaagacuaagaacaacgacugggacuacguugugacuaccgacauaagcgagaugggcgcgaauuuucgugcggaccgggugauagacccccgccggugccugaagccugucauccugaaagacgggcccgagcguguaauccuugccggccccaugcccgucaccguugccucggcugcgcagcggcgcggccggauaggccgcaaucacaacaaggagggcgaccaguacaucuacauggggcagccgcucaacaacgacgaggaccacgcccacuggacagaggccaagaugcugcucgauaacauuaauacccccgagggcaucauacccgcccuguucgagcccgagagggagaaaucugcggccaucgacggggaauaccgccugcgcggggaggcccggaaaacguucguggagcucaugaggcgcggagaucugccggucuggcuguccuacaagguggccucggagggcuuccaauacagcgaucgccgauggugcuucgacggcgagcgaaacaaccaaguucuggaggagaacauggaugucgagaucuggacgaaagagggggagcggaaaaagcuccggccccgauggcuggacgccaggaccuacucugacccacucgccuuacgagaguucaaggaguuugcagccggccgccggagcguguccggggaccugauccuagagaucggcaaacugccacagcaccugacccagcgcgcacaaaacgcccuagacaaucuggugaugcuacacaauagcgagcagggggggcgggcguaccgccacgcuauggaggaguuaccggacaccauagagacgcugauguugcucgcccugaucgcuguccugaccggaggggugacccucuucuuucucuccggccgcggguuggguaagaccucgaucggccuccugugcgugauggcuuccagcguccugcuuuggauggcgucagucgagccccacuggaucgccgccagcaucauccuggaguucuuccugaugguccucuuaauccccgaacccgaccgccagagaacaccccaagacaaccagcuggccuacgucguaaucggacuccuauucaugauccugacgguugccgcgaacgagaugggccuacucgagaccaccaagaaggaccugggcaucggccacguggccguggagaaccaccaucacgccgcuaugcucgacguagacuugcaccccgccuccgcguggacacuguacgccguugccacaaccaucaucacacccaugaugcgucacaccaucgagaacacgacggccaauauaagccucaccgcaaucgcgaaccaggccgccauccugauggggcuugauaaggguuggcccauauccaagauggacaucggcgugcccuuacuagcccuggggugcuauagccaggugaauccccucacccugaccgcggccguccugaugcuuguggcucacuacgccaucauuggccccgggcugcaggccaaagcgacccgcgaggcccaaaagagaacagcggccgguaucaugaagaauccgacgguggacggaaucgucgcaauagaccuagaccccgugguguacgacgcgaaguucgaaaagcagcuuggccagaucaugcugcugaucuuaugcacgucgcaaauccuucuuaugcgcaccacgugggcccucugugagagcaucacccuggccacgggcccccuaaccacucucugggagggguccccugguaaguuuuggaacaccaccaucgccguaagcauggcaaacauuuuccgggggagcuaccuagcuggcgccggccuagccuucucccuaaugaagucccucgggggugggcgccgggguaccggggcccaaggagaaacccugggcgaaaaguggaagcgccagcuaaaccagcugucaaaaucugaguucaacaccuauaagcggagcgggauuauggagguggacagauccgaggcgaaggagggauugaagcgcggggaaacgaccaagcacgccgugucccgagguaccgcaaagcuccggugguucguggagcgcaaccuuguaaagccugaggggaaagugaucgaccugggcugcggaaggggcggcugguccuacuauugugccggccugaagaagguaaccgaggugaagggguacacgaagggcgggcccggccacgaggagcccauccccauggccaccuauggguggaacuugguuaagcugcauucaggcaaggacgucuucuucauuccgcccgagaagugcgauacgcugcucugugacaucggggagagcucaccuaaccccaccaucgaggagggccgcacgcuucggguguuaaagaugguggagccguggcuccgcggcaaccaauucugcaucaaaauccugaaccccuacaugccuucgguuguagaaacacuggagcagaugcagcggaagcacggcggcaugcuagugcgcaauccgcugagccggaacagcacccacgagauguacugggucucaugugggacuggcaacaucgugucagcagugaacaugaccuccaggauguuacucaaccgguucaccauggcucaccgcaagccuaccuacgagcgcgauguagaccugggggcaggaacccgacauguugccguggagcccgagguugccaaccuggacaucaucggacaacguaucgagaacauuaagcacgagcacaaaagcacguggcauuacgacgaagacaaccccuacaaaacaugggcguaucaugggucuuacgaggucaagcccucagggagcgccuccagcauggugaaugggguugugaaacuccugaccaagccgugggacgucauccccauggugacccaaaucgccaugacugacacgacccccuuuggucagcagcggguguucaaggagaaggucgauacgcgaacccccaaggcgaagcggggaacagcccagaucauggagguaaccgcgaaguggcugugggguuuccuaucccguaacaagaagccccggaucugcacucgugaggaguucacucggaaggugcgcagcaacgccgcaauaggagcggucuucguggacgagaaccaguggaacuccgcgaaagaggcaguggaagacgaacgguucugggaccucguacaucgcgaacgggagcugcacaagcaagggaagugcgccacgugcgucuacaauaugaugggcaagcgcgagaagaagcucggggaauuuggcaaagccaagggcagucgagccauaugguacauguggcugggcgcccgcuuccuggaguucgaggcgcucgguuuuaugaacgaagaccauugguuuucccgagaaaacagccuguccgggguggaaggagaggggcuccacaagcucggcuacaucuuacgcgacaucucgaagauacccgggggcaacauguacgccgacgacacugccggcugggauacccggauuaccgaggacgaccuccagaaugaggcuaagaucacggacaucauggagcccgagcacgcgcuccucgccaaguccauuuucaaacucacuuaccagaacaaaguaguacgcguccaaaggccggccaagaacgggaccgucauggaugugaucucgcgccgagaccagcggggguccggccagguuggcaccuacggccucaacacguucacgaauauggaagcucagcugauccgucaaauggagagcgaagggaucuucucccccagcgagcuggagaccccuaaccucgcccgacgcguccuggacuggcuggagaagcacggcguggaacggcucaagcggauggcuaucucaggggacgacugcguggucaagccaaucgacgaccguuucgccaccgcccugacagcccugaacgacaugggcaaggugcguaaggacaucccacaaugggagcccagcaagggguggaacgauuggcagcaaguccccuuuugcucacaccacuuccaucagcucaucaugaaagacggccgcgaaauagucgugcccugccgaaaucaggacgagcugguuggucgggcccgaguaagucagggggcuggcuggagcuuacgggagacagccugucuggguaaauccuacgcacagauguggcagcugauguacuuccaccgccgggaccugcggcucgccgccaacgccaucugcagcgccgugccggucgacuggguccccaccucccggaccacuuggagcauccacgcccaccaccaguggaugaccaccgaggacaugcuguccguguggaaccgcguguggaucgaggagaaccccuggauggaggacaagacccacauaagcucuuggggcgauguacccuaccuggggaagcgggaggaccaguggugcggcucgcucaucggccugacggcccgcgcgaccugggccacaaacauucaaguggccaucaaccaggugaggcggcucauagggaaugagaauuaccucgacuacaugaccagcaugaagcgcuucaagaacgagucagauccagagggcgcccugugguga

SEQ ID NO: 24102 - RNA, 9879 nt, Artificial Sequence
  derived and/or modified CDS sequence (opt11) from DENV-1__EU677162__SS-prME
ucggugaccauguuacucauguugaugcccaccgcccuggcuuuccacuugacaacgcggggcggggaaccucacaugaucgugagcaagcaagagcggggcaagucucugcuguucaagaccagcgccggugugaacaugugcacccugaucgccauggaccugggggaguucugugaggauaccaugaccuauaagugccccagaaucaccgaggccgagcccgacgacguggacugcuggugcaaugccaccgacacgugggugacguacgguaccugcagccagaccggggagcaccggcgcgacaagcggucagucgcacucgcgccucacgugggccucgggcuggagacccgcaccgagaccuggaugagcuccgagggagccuggaagcaaauccagcgcguggagacaugggcgcuccggcacccuggguuuacggucaucgcucucuucuuggcgcaugcgaucgggacaagcauuacccagaagggaaucaucuucauccuccucaugcucgucacccccuccauggccaugcggugcguaggcauaggcagccgcgacuucguggaggggcuguccggagccacauggguggacgucguucucgagcacggcagcugcgugaccaccauggccaaggacaagccuacucuggacaucgagcuguugaagacggaggucacaaaccccgcggugcuacggaagcuguguaucgaggccaagaucuccaacaccaccacggacagccgcugccccacgcagggagaggccacucuaguagaggagcaggacgcgaacuucgucugcagacguaccuucgucgacagaggcugggggaacggaugcgggcuguucggcaaagggucccugaucacgugcgcuaaguucaagugcgugaccaagcucgaggguaaaaucguacaguaugagaaccugaaguacagugugaucgucaccguccacaccggcgaccagcaccaaguggggaaugaaucaacagaacacggcaccaccgcgaccaucacgccgcaggcucccucaacggagauacagcugaccgacuacggggccuuaacccucgacugcagcccuaggaccgggcuggacuucaacgagaugguccuccugacgaugaaggagaaauccuggcuggugcacaagcagugguuuuuggacuuaccgcugccuuggaccagcggggccuccacgagccaggaaaccuggaaucggaaggacuugcuagucacauucaagaccgcucacgcgaagaagcaagagguuguggucuuaggaucccaggagggugccaugcacaccgcccucaccggggccacggagauccagaccagcggaaccaccacgaucuuugccgggcaccugaagugccggcugaagauggacaagcuuacacuuaagggcaugaguuacguaaugugcaccgggagcuucaagcuggaaaaggagguggcggagacccagcacgguacggugcucguccagauuaaguacgagggaacggaugcccccugcaagaucccguucaguacacaggacgagaagggugugacccagaauggccggcugaucacggccaacccgaucgugaccgacaaggagaagcccgucaacaucgaggccgaaccgccauucggggagagcuacauaguaaucggcgcgggagagaaggcccugaaacuguccugguucaagaaggggagcuccaucggccggauguucgaagccaccgcccgcggggcccgcaggauggcgauucuuggagauacagccugggacuucgggucaaucggaggcguuuucacguccgucggcaaguugguccaccaaauauucggcaccgccuacggcgugcuauuuucgggcgucuccuggaccaugaagaucgggaucggcguauugcugaccuggcugggccucaacagccguuccacaagccuguccaugaccugcaucgccguggggcuggucacccuuuaccugggugugauggugcaggcagacagcgggugcgucaucaacuggaagggccgcgagcugaagugcggaagcggcaucuucgugacuaacgaaguacacacuuggaccgagcaauacaaauuccaggcagacaguccgaaacggcucagcgccgccaucggcaaagccugggaggagggggucugcggcaucaggagcgcgacccguuuggagaacauuauguggaagcagaucucaaacgagcugaaccacauccugcuggaaaacgacaugaaguucaccgugguugucggggacguagcgggcauucuggcacaggggaagaagaugauccgcccgcaacccauggaguacaaauacuccuggaaguccuggggcaaggcgaaaaucauuggcgccgacgugcagaacacuacguucauuauagacgggcccaacaccccggaaugcccugacgaccaacgggcguggaacaucugggaggucgaggacuacggcuucggcaucuucacaaccaacauauggcucaagcucagggacuccuacacccaggugugugaccaccggcugaugucagccgcuaucaaagacuccaaggccgugcacgccgacauggguuacuggaucgagagcgaaaagaacgagacuuggaaacucgcgcgcgcauccuucauagaggucaagacguguaucuggcccaagagucacacccuguggucaaauggcguacucgagagugagaugaucaucccaaagaucuacgggggcccaaucucccaacacaauuaucggccuggauacuucacgcaaaccgccggccccuggcaccucggaaagcuggaacuggacuucgaccugugcgagggcacgaccguuguaguugacgagcacugcgguaacagggggccuagcuuacgcacgaccacugucaccggcaagaucauccaugaguggugcugccggucuugcacgcugccgccccuacgguucaagggugaggacggcugcugguacgguauggagauccgcccgguaaaggagaaggaggagaaccuggucaagaguauggugagcgccggcucuggcgaagucgacagcuucucccuggggcuccugugcaucucaaucaugaucgaggaggucaugcggucccgauggagccggaagaugcuaaugacggggacacuagccguguucuuccuguuaaucaugggccaguugaccuggaacgaccugaucaggcugugcaucaugguaggcgcgaacgccuccgaucgaauggggaugggcacgacuuaccucgcccugauggccaccuucaagaugcggccgauguucgccguaggcuugcuguuccgccggcugaccagccgcgaaguucugcuccugacgaucggguuaucccuggucgcuaguguggaguugcccaacucccuggaggagcucggcgacggguuggccaugggcaucaugauccugaagcuccugaccgacuuucaaagccaccagcuuugggccacccuccuaagucugaccuucauuaagacgaccuucagccuccacuaugcguggaagacaauggcgaugguccuguccaucguaucucuguuuccccucugccuuuccaccacgagccagaagaccaccuggcugcccguucuccugggcucccugggcugcaagccgcugaccauguuucugaucgccgagaacaaaaucuggggucgcaagagcuggccgcugaaugaggggaucauggccgucggcaucgugagcauccuccuuucaagcuuguugaagaacgacguaccccuggccgggccccucaucgccggcggcaugcucaucgccugcuaugucaucuccggaaguagugccgaccugagccuggagaaggccgccgaggugagcugggaggaggaggccgagcacagcggugcuucucacaacauacuaguugaggugcaagacgaugggacgaugaagaucaaagacgaggagagagacgacacccugaccaucuuauugaaagccacccugcuggccguaagcggaguguacccccugucuauccccgcgacgcuguucgugugguacuucuggcagaagaagaagcagcgcagugggguucugugggacacgccgagcccaccggagguugagcgcgcaguacucgaugacggcauauaucggaucaugcagcgcggccuguuggggcggagccaggugggcgugggagucuuccaggagaauguguuccauaccauguggcacguuacgcgcggcgcgguccugauguaccaggggaagcgacucgagccuaguugggccagcguuaaaaaggaccugauauccuacggagguggguggcgccugcagggcaguuggaacacgggggaagaggugcaggugaucgcuguggagccgggaaagaacccgaaaaacguacagacggcccccgggacuuucaagaccucagagggcgaggucggcgcgauagcgcuggacuuuaagccgggcacgagcggcagccccaucgucaaccgggaggggaagauuguggggcucuacggcaauggggucgugacgaccaguggcaccuacgugagcgccauagcccaggccaaagcuucccaagaggggccccuaccggagaucgaggacgagguuuuucggaagcgaaacuuaaccaucauggaucugcaucccggcagcgggaagacgaggcgguaccugcccgcaaucguccgcgaggcaaucaaacggaagcuucggacccugauccuggcccccaccaggguggucgccagugagauggcggaagcucugaaaggcaugcccauuagguaccagaccacggccgugaagagcgaacacaccggaaaggagaucguggaucugaugugccacgccacuuucacgaugagacuacucucccccguccggguacccaacuacaacaugauaauuauggacgaggcccauuucacggacccgagcagcaucgcggcgcgaggauacauaagcaccagaguggggaugggagaggcugccgccaucuucaugaccgcgacgccgcccggcuccgucgaggccuucccucagagcaacgccgugauccaggacgaagaacgcgauauaccggagagguccuggaacagcggguacgaguggaucacagacuuccccggcaagaccgugugguucgucccauccaucaagagcggcaacgacaucgccaacugccuccgcaagaacgggaagcggguuauccagcuuucccgcaagaccuucgauaccgaguaccagaagacgaagaacaaugacugggacuacguggucaccacggauauaagcgagaugggggcgaacuuucgagccgauagggugauugacccucggcgcugccucaagccggugauacugaaggacggccccgaacgggucauucuggcuggccccaugcccguaacagucgccuccgccgcgcagcgccgcgggagaaucggccgaaaccacaacaaggaaggcgaccaauacauuuacaugggccagccgcucaacaacgacgaggaccacgcccacuggacggaggcuaagaugcugcucgacaacaucaauacuccugagggcaucaucccugcacucuuugaaccugagcgcgagaaguccgccgcaaucgacggggaguaucgccuacggggggaggcgcgaaagaccuucguggagcugaugcggcguggggaucucccgguguggcugucuuauaaagucgcuuccgagggcuuccaauacagcgaccgccgcugguguuucgacggcgagcggaauaaccagguacuggaggaaaacauggacguggagaucuggaccaaggagggggagcgaaagaagcuccggccccgcuggcuggacgcgcggacuuacuccgacccccuggcccuacgagaguucaaagaguucgcggcaggccggagaucuguuuccggugaccugauccuggagaucggcaaacucccucaacaccugacccaacgggcccagaacgcccuagacaaccucgugauguuacacaacucggagcagggugggcgugcuuacagacaugccauggaggagcugccggacacgauagagaccuuaaugcuguuggccuuaaucgccgugcugacgggcggggucacccuauucuuccucuccggccgcgggcuggguaagaccuccaucgggcuguugugcgugauggccuccagcgucuuacuguggauggcguccgucgagccccacuggaucgccgccucgaucauacucgaguucuuccugaugguacuccucaucccugaacccgaucggcagcgcacgccucaagacaaccagcuggccuacguuguaaucggcuuacuguucaugauccugaccgucgccgcgaacgagaugggccugcucgaaacgaccaaaaaggaccuggggaucggccacguggccgucgagaaccaccaccaugcugccaugcuggacguggaucuccacccugcauccgcguggacccucuaugccguggcuaccacgauuaucacgcccaugaugcggcacaccaucgagaacaccaccgccaacauuagccuaaccgccauugcgaaccaagccgcuauccucauggggcuggauaagggcuggccgaucucgaagauggacaucggcguccccuuacuugcccuggggugcuauagccaggugaacccucuaacccuaaccgcggccgugcugaugcuggucgcccacuacgcgaucauuggacccgggcuccaagccaaagcuacgcgcgaggcccagaagaggaccgcugcggguaucaugaagaauccgaccguggauggaauaguggccaucgaccuggacccugucguauacgacgcgaaguucgagaagcagcugggccagaucaugcuucugauccugugcaccucccagauccuccugaugcguacgaccugggcucucugcgagagcaucacccucgcgaccgguccccugacgacccugugggagggaucccccggcaaguucuggaacacgaccaucgcagugagcauggccaacaucuuucgugguagcuaccucgcgggcgccggcuuggccuuuucgcugaugaaguccuuagguggggggcggcgcggcacgggggcccagggcgagacccugggcgagaaguggaagcggcagcugaaccagcucucaaaaagcgaguucaacacguauaagcgcucuggaaucauggaggucgaucguagcgaggcgaaggagggcuugaagcgcggggagaccacgaagcacgccguaucccgugguaccgccaaguugcgcugguucguggagcggaaccuagucaaaccggaggggaagguaaucgaccugggcugcggccgagggggauggagcuacuacugcgccgggcugaaaaaaguaaccgaggucaagggcuacaccaagggcgggcccggccaugaggagcccauccccauggccacguacggguggaaccuuguuaagcuccacuccggcaaggacguguucuuuauaccgcccgaaaagugcgacacccugcugugcgacaucggggagagcucaccaaaucccaccaucgaggagggacggacccuccgcguccucaagaugguggagccguggcugcgggguaaccaguucugcaucaagauccucaaccccuacaugcccagcguggucgagacgcuggagcagaugcagcgcaagcacggcggcaugcucgugcggaacccacucucccgcaacagcacccacgagauguacuggguguccugcggcaccggcaacaucguuagcgcggugaauaugaccagccggaugcuacugaaccgcuucaccauggcacaccggaaacccacguacgagcgagacguagaccucggggccggcacccgccacguagccguggagcccgaaguggccaaucuugauaucaucggccaacggaucgagaacaucaaacacgaacacaagagcaccuggcacuacgacgaagacaaucccuacaagacgugggcguaccacggguccuacgagguaaagccuucuggcagcgccucgagcauggucaacggggucgugaagcugcucacgaagcccugggacguaauuccgauggucacccagaucgccaugaccgauaccacgcccuucggccagcagcgcguauuuaaggagaaggucgacacccggacccccaaggccaagcgcggaaccgcccagaucauggaggucacggcgaagugguuguggggauuccucucccggaacaaaaaaccgcguaucugcacccgggaggaguucacgcgcaaggugcggagcaacgccgccaucggggcuguauucguugacgagaaccaguggaauuccgcgaaagaggccguggaggacgagcgcuucugggaucucgugcaccgggagcgcgaacugcacaaacaagggaaaugugccaccugcguauacaacaugaugggcaagcgugagaagaaacugggcgaguucggcaaagccaaggggagccgcgccauaugguacauguggcuaggagcacgguuccuggaguucgaggcccugggcuucaugaacgaggaccacugguucucccgcgagaacucgcuguccgggguggagggcgagggccuccacaagcugggcuacauccuccgggacaucagcaagauucccggaggcaacauguacgccgacgacacggccggcugggauacacgcauaaccgaagaugaccugcagaacgaggcaaagauuaccgacaucauggaaccugagcacgcccuguuagcgaaguccauauucaaacugacguaccaaaacaaggugguccggguacagcgcccggccaagaacggcaccguaauggacgucaucucacgccgggaccagcgcggcuccggccaggugggaacguacggcuugaacaccuucacaaacauggaggcacaauuaauccggcaaauggaaagcgagggcaucuucuccccgagcgagcuggagacccccaacuuagcaggccgcgugcucgacuggcuggagaagcacggggucgagcggcugaagcgaauggcgaucuccggcgaugacugcguggugaagcccaucgacgaccgguucgccacugcccucaccgcccugaacgacauggggaagguccgcaaggauaucccgcagugggagcccagcaaggguuggaacgauuggcaacagguacccuucugcagccaccacuuccaucagcugaucaugaaggauggccgugagaucgugguccccugccgcaaccaggacgaacuugugggccgggcacgcgugagucagggcgcgggcuggagccuacgggaaacggcuugccuuggcaaguccuacgcucaaauguggcagcucauguacuuccaccgccgggacuugcgccuggccgcuaacgccaucugcagcgccgucccgguggacugggugcccaccucccggaccacauggagcauccacgcccaccaccaguggaugacgacagaggacaugcucuccgucuggaaccggguguggauugaggagaaccccuggauggaggacaagacccacauuagcucuuggggcgacgugcccuaccugggaaagcgggaagaccaguggugcggcucucugaucggguuaaccgcccgcgcaacgugggccaccaauauacaggucgccaucaaccaggugcgcaggcugaucggcaaugagaauuaccuggacuacaugacguccaugaagcgcuucaagaacgagagcgacccggagggggcccucugguga

SEQ ID NO: 24103 - RNA, 9879 nt, Artificial Sequence
  derived and/or modified CDS sequence (opt11) from DENV-1__EU677164__SS-prME
agcgugaccaugcugcucaugcugaugcccaccgcucuugcguuccaccucacaacccggggcggggagccccacaugaucgugagcaaacaggagcgggguaaaagccuguuauuuaaaacgucagccggggugaacaugugcaccuuaaucgccauggaccugggcgaguucugcgaggacaccaugacuuacaaaugucccaggaucaccgaggccgagcccgacgacguggacuguugguguaacgccaccgacacgugggugacauacgggaccugcagccagacaggugagcaucggcgggacaaacgguccguggcccuggcgccccacgugggacucgggcucgagacgcggacagagaccuggaugucauccgagggggcauggaagcagauccagcggguggagaccugggcccugcgacaccccggguucacggugaucgcacucuuucuugcgcacgcaaucggcaccucgaucacacagaaggggaucaucuucaucuuacucaugcugguuacaccuuccauggcgaugcggugcgucgguaucggaagcagagacuucguggagggucugucuggcgcaacguggguggacgucguucucgaacacgggagcugcgugaccaccauggccaaggacaagcccacccuggacauagaacuacugaagacggaggucaccaaucccgccgugcugcggaaauuaugcaucgaagccaagaucagcaauaccacaacggauagccgcugcccgacccagggcgaagccaccuugguggaggagcaggacgccaacuucgucugccgucgcaccuucguggaccggggcugggggaaugguugcggacuguucggcaaggggucccugaucaccugcgccaaguucaaaugcguuaccaagcuggagggcaagaccguccaauaugaaaaccugaaguauagcguaaucgugaccguccacacuggcgaccagcaccaaguugggaacgaguccaccgagcacggcaccaccgcaacgaucacuccccaggcccccuccacggaaauacaacuuaccgauuacggcgcucucacucuugauugcagcccccgcacaggccuggacuuuaacgagaugguccuccugaccaugaaggagaagagcuggcuggugcacaagcagugguuccuggaccugccgcuuccauggaccuccggggccuccaccagccaggagacguggaaccggaaagacuugcuggugaccuucaagacagcccacgcgaagaagcaggaagucguggugcugggaucacaggagggcgccaugcacaccgcccucacuggggccaccgaaauacagacgagcggcacgaccacgauuuucgcuggacaccugaagugccgauugaagauggauaaauugacccuuaaggguauguccuacguuaugugcacagggucuuuuaagcuggagaaggagguggcggagacgcagcacggcaccgugcucguccaaaucaaauacgaaggcacagacgcccccugcaagauccccuuuaguacccaagacgagaagggggugacgcagaacgggcggcuaaucaccgcuaaccccaucgugaccgacaaggaaaaacccgucaacaucgaggccgaaccgcccuucggggagagcuacaucgugaucggcgcgggcgaaaaggcccugaagcugucuugguucaaaaaggggagcuccaucggcaaaauguuugaggcaaccgcgcgcggcgcccggcgcaucgcgaucuuaggcgacaccgccugggacuucggcagcaucggcggcguuuucacaucagucggcaagcugguacaccagauuuucggcacugccuacggggugcuguuuucaggcguaaguuggaccaugaagaucgguaucggggugcuccugacauggcugggccucaacagccgcuccacaucccucuccaugacaugcauugccguggggcuggugacccuauaccugggcgugaugguacaggccgauuccggcugcgugaucaacuggaagggucgggagcugaagugcgggagcggcauuuucgugacgaacgaagugcacaccuggaccgagcaguauaaguuccaggcggacuccccgaaacgcuuaucagccgccaucggcaaagccugggaagagggggucugcggcauccguagcgccacccgccuggagaacaucauguggaagcagauaagcaacgaguuaaaccacauauuauuggagaacgacaugaaguucaccgugguggucggcgacguggcgggcauccuggcccaggggaagaagaugauccggccccagcccauggaguacaaguacucguggaagaguuggggcaaggccaaaaucaucggagccgacgugcagaauacgaccuucaucaucgacgggcccaacacaccagaguguccugacgaccagcgagcguggaacaucugggaggucgaggacuacggcuucgggaucuucacgacgaauaucuggcucaagcugcgcgacuccuacacgcaggugugugaccacagacugaugagcgccgccaucaaggacuccaaggccguccaugccgacaugggcuacuggauagaaucagagaaaaacgagaccuggaagcucgcgagggcuuccuucaucgaggucaagacaugcaucuggcccaaaucacacacgcuaugguccaacgggguucuggagagcgagaugaucaucccgaagaacuaugggggcccuaucucccagcacaacuaccgccccggguacuucacccaaaccgccggcccguggcaccucgggaaauuggagcuggacuucgaccucugcgagggcaccacgguaguaguggacgagcacugcggcaaucgggggccgagccugcgcaccaccacggucacgggcaagauuauucaugaguggugcugccguuccugcacccugccgccacuacgcuucaagggagaagacggcugcugguacggaauggagauccggcccgucaaggagaaggaggagaaccuagucaagagcauggugucagcuggcuccggcgaggucgacagcuucucccuggggcuccugugcaucaguaucaugaucgaagaggugaugcgcucuagauggucaagaaagaugcugaugacaggcacacucgccgugcuguucuuacucauuauggggcaacugacauggaacgaucugauccggcucugcaucaugguaggcgcgaacgccuccgaccgcauggggauggggaccaccuaccuggcccugauggccaccuucaagaugcgcccgauguucgccgugggccuacuguuucggcgccugacgucgcgggagguguuacuacugacgaucgggcucucccuggucgcgagcguggagcugcccaacucccucgaggaacugggcgacgggcuggccaugggaaucaugauucucaaauugcugaccgauuuccagucacaucagcucugggccacccugcugucccucacguucauaaagacaaccuucagccugcacuaugccuggaagaccauggcgaugguccuguccauugugagccucuucccccugugccuguccacuacuagccagaaaaccaccuggcuccccguguuacuaggcaguuuagggugcaaaccgcucacgauguuccugauagccgagaacaagauauggggucgaaagucguggccccucaacgaggggaucauggccgucggcauagugagcauccuguugaguagccuccugaagaaugacgugccucuggccggcccccucauagccggcggcaugcugaucgcuugcuacgucaucagugggagcuccgcagaccugagccuugagaaggccgccgaagucuccugggaggaggaggccgagcacagcggcgcgucccacaacauccugguugagguccaggacgaugguaccaugaagaucaaagacgaggaacgggacgacacguugacuacccuacugaaggcaacgcuacucgcggugucgggcguguacccucuguccauacccgcgacccuguucgucugguacuucuggcagaagaaaaagcagcguaguggggugcucugggacaccccgagcccgccggaaguagagcgggccguccuggacgacgguauauaccgcaucaugcagcggggccuucuggggcgcagccaggucggcgugggggucuuccaggagaacguguuccacacgauguggcacgugacgcggggcgccguccucauguaccaagggaagagacucgagccuuccugggccagcgugaagaaagaccuaauauccuauggcggcggcuggcgccuacaggggagcuggaacaccggggaagaggugcaggucaucgccguggagcccgguaagaacccaaagaacguucaaaccgccccggggaccuucaagacguccgagggugagguuggagccaucgcauuggacuucaaacccgggaccagcgggaguccaaucgugaaccgcgagggaaagauugugggacuguacggaaacgggguggugaccaccuccggcaccuacgugagcgccaucgcgcaggccaaagccucacaggaggggccccucccggagaucgaagaugaggucuuucggaagcgcaaccugaccaucauggaccugcaccccgggucagggaagacccggcgcuaccugccugccaucguucgugaggccaucaaacgcaagcugcggacccugauccucgccccgacgaggguagucgccucggagauggcggaggcccugaaaggaaugccuauccguuaccagaccaccgccgucaaaagcgaacacaccggaaaggaaaucguagaccugaugugccacgccacguucaccaugcggcuccugucccccguucgcgugccaaacuacaacaugaucaucauggacgaggcccacuucaccgauccgucauccaucgcggcccgaggguacaucaguacacgcgugggcaugggggaagccgccgcgauauucaugaccgcgacaccccccggcuccgucgaggccuuuccucagucaaacgccgugauacaagaugaggaacgggacaucccggagagguccuggaacagcggguaugaauggaucacagauuuccccggcaagaccguaugguucguuccauccaucaagagcggaaacgacaucgcaaacugccugcggaagaacgggaagcgcgugauccagcucucccggaagacguucgacaccgaguaccagaagaccaagaacaacgacugggauuacgugguaacaacggacauaagcgagaugggagcgaacuuccgcgccgaccgugugauugacccccgccggugccugaagccggucauccugaaggacgggccggagcgcguuauccucgccggcccgaugcccgugacggucgccagugccgcgcagcgaagggggcggauaggccgcaaccauaacaaggagggagaccaguacaucuacaugggacagccguugaacaaugacgaggaccaugcgcacuggacagaagccaagaugcugcucgacaacauuaauacccccgagggcauuauccccgcccuguucgagcccgagcgggaaaaguccgccgcgaucgauggggaauauaggcugcguggcgaggcccggaagacguucguggagcucaugagacggggggaucugccugucuggcuaucauacaagguugccuccgagggcuuccaguauagugaccgccgguggugcuucgacggcgaacgcaacaaccagguacucgaagagaacauggauguggagauuuggacaaaggagggggagcggaagaagcuacgcccgcgguggcuagacgcccgcaccuacuccgacccccucgcccugcgcgaguucaaggaguucgcggccggacgccggagcgucuccggggaccugauccucgaaaucggcaagcugccccagcacuuaacccagcgcgcccagaacgcccuugauaaucuggugaugcugcacaacagcgagcagggagggcgugcguaccgucacgccauggaggagcuaccggauacgaucgagacccugauguugcuagcccugauugccgugcugaccggcggagucaccuuauucuuccugucuggccgaggacugggcaagaccagcaucggccuccuguguguuauggccuccagcgugcugcuauggauggcguccgucgagccccacuggaucgcagccucgaucaucuuagaguucuuucucauggugcuccugauaccagagcccgaucgacaacggacgccgcaggacaaucagcuugccuaugugguuaucggucuccuguucaugauccugaccguggccgcgaaugagaugggccuacuggagacaaccaagaaggaucucgggaucggccacguggccguagagaaccaucaccacgccgcuaugcucgacguggaucugcaccccgccuccgcguggacgcuguacgccguggccacgaccaucaucacccccaugaugcgccacacaauagaaaacaccaccgccaauaucagccucaccgcaaucgccaaccaggccgccauccuuauggggcucgacaagggcuggccgauuuccaagauggauaucggcguaccccuccuggcgcugggguguuacagucagguaaacccccucacccugaccgcggcggugcugaugcucgucgcccacuacgccaucaucggccccgggcuccaggccaaggcaaccagggaggcccaaaagcgcacggccgccggcauuaugaaaaacccgacuguggacggcaucguggccaucgaccucgacccggugguguaugacgcgaaguucgagaagcagcucgggcagauaaugcugcugauccucugcaccucccaaauccuacugaugcgcaccaccugggcacucugcgagagcaucacguuagccacaggcccccugacaacccucugggaggggucccccgggaaguuuuggaauacgaccaucgccgugagcauggccaauaucuuucgggggagcuaccuggcgggcgcaggucuggccuucucccucaugaagucccuaggaggcggcaggcgggggaccggagcccaaggcgagaccuugggcgagaaguggaaacgccaacucaaccaguugagcaagucggaguucaauaccuacaaacggucggggauaauggaggucgaucgcucagaggcgaaggagggcuuaaagcgcggggagaccaccaagcaugccgugucgcgcggcaccgccaagcuccguugguuuguagagcgcaaccucguaaagccggaggggaaggugaucgaccugggcugcggacgcggcggguggagcuacuacugugccggguugaagaagguaacggaaguaaagggguacaccaaggggggccccggccaugaagagccgaucccgauggcuaccuauggguggaaccucgugaagcugcacaguggcaaagacguguucuucaucccgccggagaagugcgacacccugcucugugacaucggggagagcagccccaauccgacgauagaggagggccgcaccuuacggguacucaagaugguggagccaugguuacgcgggaaccaguucugcauaaaaauccugaaccccuacaugcccagcguugucgagaccuuagagcagaugcaacggaagcacggcggcaugcucguucgcaacccacugucccggaacagcacccaugagauguacuggguguccugcggaaccgguaacaucguuagugcggugaacaugacgucccgcauguugcucaaccguuucaccauggcccaccgcaaaccgacuuacgagcgagacguagacuuaggagcgggcacccgccacgucgcaguggagccagagguggcaaaccuggacaucaucggucagcgcaucgagaauaucaagcaugagcacaagucaacguggcacuaugacgaagacaaccccuacaagaccugggcauaucacggguccuacgaggugaaacccaguggcagcgccuccucuaugguaaaugggguagucaagcuccugaccaagccgugggaugugauacccauggucacgcagaucgccaugaccgauacuacccccuucggccagcaacggguuuucaaagagaagguggacacccgcacgcccaaggccaaacgggggaccgcccaaaucauggaggucaccgcgaagugguuauggggcuuccucucacgcaacaagaagccgcggaucugcacccgcgaggaauucacgcggaaggugcguagcaaugccgccaucggcgccguguucgucgacgagaaccaguggaacucagcgaaggaggcaguugaggacgagcguuucugggacuuggugcaccgcgagcgggagcuccauaagcaggggaaaugcgcgacgugcgucuacaacaugaugggcaagcgcgagaagaaacucggggaguucggcaaagccaaggggagccgugccaucugguacauguggcugggcgcucgcuucuuagaguucgaggcucucggauucaugaacgaggaccacugguucucccgugaaaacagccugucugggguggagggcgaggggcuucacaagcugggguacauuuuacgcgacaucucuaagauuccgggggguaacauguacgccgacgacacagccggcugggacacacggaucacggaggacgaccugcagaacgaggccaagaucacagacaucauggagccagagcacgcgcuccuagccaaaucaaucuucaagcugaccuaccaaaauaaggucgucagagugcagagaccggcuaaaaacgguaccguaauggacgucaucagucgccgcgaccagcguggauccggacaagugggcacauacggacucaacacuuuuaccaacauggaggcucagcugauacgccagauggagagcgaggggauuuucucccccagugagcuggagacccccaaccucgccggcagagugcuggacugguuggaaaagcacggggucgagcgccucaagagaauggcaaucuccggggacgacugcguaguuaagccuaucgacgaccgguuugcuacugccuugacugccuuaaacgacauggggaagguccggaaagacaucccccagugggagccgagcaagggauggaacgacuggcagcaggugcccuucugcagccaccacuuccaccaacucaucaugaaggacgggcgcgagaucgucguacccugccgcaaccaggaugaguugguggggcgugcccgggugucccagggugcaggauggagccugcgcgagacugccugccucgguaagucuuaugcccagauguggcagcugauguacuuccaucggcgcgaucugcgguuagccgcaaacgccauauguagcgcggucccgguggacugggugcccaccucccguacgaccuggaguauucacgcccaccaccaguggaugaccaccgaggacaugcuguccgucuggaaccgagucuggaucgaggaaaaccccuggauggaagacaagacacacaucagcucguggggagacgugcccuaccuggggaagcgcgaggaccaguggugcggcagccuaaucgggcuuaccgcgcgggcgacgugggccacuaacauccaagucgccaucaaccaggugcgcaggcugaucggcaacgagaacuaccucgacuacaugaccuccaugaagagauucaagaacgagagcgacccugagggcgcucugugguga

SEQ ID NO: 24104 - RNA, 9879 nt, Artificial Sequence
  derived and/or modified CDS sequence (opt11) from DENV-1__EU677165__SS-prME
agcgugaccaugcugcucaugcuaaugcccaccgcgcuggccuuccaucucacuacccgggguggugagccgcacaugaucguuagcaaacaggagcggggcaagucacugcuguucaagaccucggccggggugaacaugugcacgcucaucgccauggacuuaggcgaacugugcgaggacaccauaaccuacaagugcccacgcaucaccgagaccgaacccgacgacguugacugcugguguaacgccacugacaccugggucaccuacgggacaugcagucaaaccggcgagcaccggcgcgacaagcgguccguggcccucgcgccucacgugggccuggggcuggagacccgcaccgagaccuggaugucgucagagggcgccuggaagcagauccagagaguagagacgugggcuuuacgccaccccggguucaccgugaucgcccuguuccuggcacacgcgaucggcaccagcaucacucagaaagggaucaucuucauccuccuaauguuagccacucccuccauggcgaugaggugcgugggcaucggaagccgcgacuuugucgaggggcucucaggcgccaccuggguggacguggugcuggagcacggaagcugugugaccacaauggccaaggacaaacccacacuggacaucgagcuccugaagaccgagguaaccaaccccgcggucuuacggaaacucugcaucgaggccaagauuuccaacacuacgaccgacuccagaugcccgacgcagggcgaagccacucugguugaagaacaagacgccaacuucgugugcagacggacguucgucgaccgcggcugggggaacggaugcgggcuguucggcaagggcucccucaucacuugcgccaaguucaagugugugacaaaacuggagggcaagaucguacaguaugagaacuugaaguacagcgucaucgugaccgugcauacgggugaccaacaccaggucgggaacgaguccacggagcacggcaccacugcgaccaucacgccccaggcucccaccaccgagauccagcucaccgacuauggagcccuuacccuugacugcuccccucgcaccggguuagacuucaacgagaugguguugcugaccaugaaggagaaauccuggcucguccacaagcagugguuccuggaccugccccuccccuggacuuccggcgccagcacuucccaggaaacguggaaccgacaggacuugcuggucacuuucaagaccgcccacgcgaaaaagcaggaagucgucgugcucggcagccaggagggcgcuaugcacacggcgcugaccggggcgacggagauccagaccuccggcacgaccaccaucuuugccgggcaccugaagugccggcucaagauggacaaacugacccugcguggcaugagcuacgugaugugcacgggaaguuucaagcucgagaaggaggucgcagagacccaacacggcacggugcuggugcagaucaaguaugagggaaccgacgcccccuguaagauccccuucagcacgcaggacgaaaagggggucacccagaacggccgccugaucaccgccaaccccaucgugacugauaaggaaaaacccgugaacauagaggccgagccacccuucggggaauccuauauuguaaucggcgcgggcgagaaggcccugaagcuaagcugguucaagaaggggagcucgaucggcaagauguucgaggccacggccagaggggcacgccguauggcaauucuuggcgacacugcgugggacuucgggucgauuggcgggguguucaccucgguggguaaguugguccaucaaaucuucgggacggcuuauggggugcucuucuccggcguguccuggacgaugaagaucgguauaggcgucuugcugaccuggcugggccuaaacucgcggagcaccucccugucaaugaccugcaucgcggucggacucgugacgcuguaccugggcgucauggugcaggcugauuccgggugugugauaaacuggaagggucgcgagcucaagugcggcucuggcaucuuugucaccaacgagguacacaccuggaccgagcaguauaaguuccaggcggauaguccgaagcggcuguccgccgccaucgguaaggccugggaggagggggucugcggcauccgcagcgccacgcggcuggaaaacaucauguggaaacagauauccaacgagcucaaccacauccugcucgaaaacgacaugaaguuuacggucguggugggggacgucgcgggaauccucgcccaagggaagaagaugauccgcccccagcccauggaacacaaguacucauggaaguccuggggcaaggccaagauuaucggugccgacguucagaauaccaccuucauaauagacgggcccaauaccccggagugccccgacgaccagcgugcauggaacaucugggaaguggaggacuacggcuucgggaucuucacgaccaacaucuggcugaaacugcgcgacagcuacacccaggugugcgaucacaggcucaugagcgccgccaucaaggacagcaaagccgugcacgcagacaugggcuacuggaucgagagugagaagaacgagacuuggaagcuggcgcgcgccaguuucaucgaggugaagacgugcaucuggcccaaaucccacaccuuguggagcaacggaguccuggaguccgaaaugaucauacccaaaaucuacggggggccgaucucgcagcacaacuauagacccgguuacuucacccagaccgccggccccuggcaccuggggaaacuggagcucgacuuugaccuaugcgagggcacuaccgugguggucgaugagcacugcggcaaccgcgggccaucccugcggacuacaacugugaccggcaaaaucauccacgaguggugcugccgcagcugcacccugccgccgcuccgguuccgcggggaggacggcugcugguacgggauggagauccggcccgugaaggagaaagaggagaaccucguaaagucaauggugagcgcaggcuccggugagguggacuccuucucacucggguugcuaugcaucuccaucaugaucgaggaagucaugcgcagccgguggucccggaagauguugaugaccggcacgcuggccguguucuuccugcucaucaugggccaguugaccuggaacgacuuaaucaggcucuguaucauggugggcgcaaacgccagcgaucggaugggaaugggcaccaccuaccuagcccugauggccacuuucaaaaugcggcccauguucgcagucggccuccuauuccggcgacugacaucccgggaggugcuccugcugacaaucgggcucucacugguggcauccgucgagcugcccaauagccucgaagagcugggcgacggucuggccaugggaaucaugaucuugaaacugcugaccgacuuucaaucccaccagcuaugggccacccugcuaagccucaccuucaucaagaccaccuucucccuccauuacgccuggaagacgauggcgaugguucugucaauugucucccucuucccauuaugcuuaagcaccaccucccaaaagaccacguggcuucccgugcugcugggcagccucgggugcaagccgcugaccauguuccugaucgcugagaacaagaucuggggccgcagauccuggccccucaacgaaggaaucauggcagugggcaucgucagcauccugcugagcucccuccugaagaacgacgugccccuggccggcccccugauugcuggcggcauguugauagcgugcuacgugaucagcggaucgagcgccgaucugagccucgagaaagcagccgaggucagcugggaggaggaagccgagcacuccggcgcgucccauaacauacugguggagguccaggaugacgggaccaugaagaucaaggacgaagagcgggacgauaccuuaaccaucuugcugaaggccacgcucuuggcagucuccggcguuuauccgcugagcauaccagccacccuguucgugugguauuucuggcaaaagaagaagcagcgguccgguguccucugggacaccccgagcccgcccgagguggaacgugcaguacuugacgauggcaucuaucggauaaugcagcgcggacuacuugggcgaucacagguuggggugggcguguuccaggagaacgucuuccacaccauguggcacgugacgagaggcgccgugcucauguaccaggggaagagacuggaacccagcugggcauccgucaagaaggaccucauaucuuacggcggcggguggcgccugcaggguucguggaacaccggggaggagguccaggugaucgccgucgagcccggcaagaacccuaagaacgugcaaacugccccggguacuuucaagacucccgagggcgaggugggcgccaucgcguuggacuuuaaacccggaaccuccggcucgcccauuguaaacagagaggguaaaaucguuggccuguacggcaacggaguggucaccaccucaggcacguacgugagcgccauagcgcaggccaaggcgucgcaggaggggccgcuccccgaaaucgaagaugaaguguuccgcaagcguaaucugaccaucauggaccugcaccccggcagcgggaagacgcgucgguacuugccggcuaucguccgcgaggcaaucaagcgcaagcugcgaacgcugauacucgcccccacgcgcgugguugcauccgagauggcugaggcccugaaaggcaugcccauccgguaccagacaacugccgucaagagcgagcacacggguaaggagauaguggaccucaugugccacgcuacguucaccaugcgauugcugucccccgugcgggucccgaacuacaacaugaucaucauggacgaggcucacuucaccgaucccaguucgaucgcagcccgcggguacauaucuacccgcgugggcaugggcgaggccgccgccaucuucaugaccgcgacgccgcccggcuccguggaggccuucccgcaguccaacgcaguuauccaggacgaggagcgcgacaucccggaacggucguggaacucaggguacgaguggaucaccgacuuucccggcaagacaguaugguucgucccaagcaucaagagcggaaacgauaucgccaacugucugcgcaagaacgggaaacgggugauacagcucucacgcaagacguucgauaccgaguaccagaaaaccaagaacaaugauugggacuacguggugacaacggacaucagcgagaugggggcgaacuucagggccgaccgcgugaucgacccgcgucgcugccugaagcccgugauccugaaggacgggccagagcgggugauccucgcuggccccaugccugucaccguggccucggccgcucagcgaagggggcgcaucggaaggaaccacaauaaggaaggagaccaguacauauauauggggcagccccugaacaacgaugaggaccacgcccacuggacagaggccaagaugcuguuggacaacaucaacaccccagagggcaucauucccgcccuguucgagccggagagagaaaaguccgcagccauagacggcgaguaccgccuacggggcgaggcccgcaagacguucguggaacucaugcggcgaggggaccugcccgucugguuaaguuauaagguugccucagagggauuucaauacagcgaccggcgcuggugcuucgacggcgaacggaacaaccagguccuagaggagaacauggacguggagaucuggacaaaagagggagagcguaagaagcugcggccaagauggcuggacgcacggaccuacucggaccccuuagcuuugcgcgaauucaaggaauucgcggcgggcaggcgcagcguguccggggaucugauccucgagaucgguaagcugccgcagcacuugacccaacgggcccagaaugcccuugauaaccuggugaugcugcacaacagcgaacagggagggcgagccuaccggcacgccauggaggagcuacccgauacgauagaaacccugaugcugcucgccuugaucgccgugcugaccggcggggugacccucuucuuucugaguggccgcgggcugggcaaaaccagcaucggccugcuaugugucauggccuccagcgugcugcucuggauggcgagcguggagccccacuggaucgccgccuccaucaucuuagaguuuuuccugaugguccuccugauucccgaaccugaucggcagaggacgccucaggacaaccaguuggccuacguggugaucgggcuguuauucaugauccugacagucgccgcgaacgaaaugggacuccuggagaccaccaagaaggaucuggggaucggccacguggccguggagaaucaccaccacgccgccaugcucgaugucgaucugcaccccgccagugcguggacacuguacgccguagcuaccacgaucaucacaccgaugaugcgccacacgaucgaaaauaccaccgccaauaucagccucaccgccaucgcgaaucaggcagcaauucugauggggcuggauaagggcuggcccaucuccaagauggacaucggcgugcccuuacuggcccugggaugcuacucucaggucaacccccucacccuuaccgcggccgugcugauguugguggcgcacuacgccaucauugguccuggacuacaggccaaggcgacccgggaagcccagaaacgcacagccgccggcaucaugaagaaccccacggucgacggcaucguagcaauagauuuggaccccguaguguacgacgcgaaguucgagaagcagcucggccagaucauguugcugaucuugugcaccucgcagaucuuacuuaugcggaccaccugggcccucugcgaaagcaucacucuggccaccggaccccuuaccacccucugggaaggguccccgggcaaguuuuggaacacaaccaucgccgugagcauggccaauaucuuccguggguccuaccuggcgggcgccggccucgccuucucgcucaugaaguccuugggcggcgggcggagggggaccggagcccagggcgagacccucggcgagaaguggaagcggcagcucaaccagcuauccaagagcgaguucaacacuuauaagcgcuccgguaucauggagguagaccgaagcgaggcaaaagagggccucaaacgcggggagaccaccaagcacgcagucucccggggcaccgccaagcuccgcugguucguggagcggaaccugguuaagcccgaggggaaaguuauugaccuggggugcggccgcgggggauggagcuacuacugcgccggucugaagaaaguaacggaggucaaggguuauaccaagggcgggccaggccaugaagagcccauuccgauggccaccuauggguggaaccucgucaagcugcacagcggcaaggacguguucuucauaccucccgagaagugcgacacccugcuaugcgacauaggggaaagcucccccaacccgacgaucgaagagggccggacccugcgcgugcugaagauggucgagccuuggcuccgggggaaccaguucugcaucaagauccugaaccccuacaugcccagcgugguggagacucuggagcagaugcagcgcaagcaugggggcauguugguucggaacccguugagccgcaacuccacccacgagauguacuggguuuccugcgguaccggcaacaucguaagcgcgguaaacaugacgucccgcaugcuuuugaaucgguucaccauggcucauagaaagccuaccuaugagcgggacguggaccugggggccggcacccgacacguugccgucgagccugagguggccaaucuggacaucaucggccaaaggauagagaacaucaagcacgagcacaagagcacguggcauuaugacgaagauaacccauacaagaccugggcguaccacggguccuacgaggucaagccgagcggcuccgccucaagcauggucaacgggguggucaagcuccugacuaagccuugggaugugaucccgauggucacccagaucgccaugacggacaccacccccuucggacagcagcgcguuuucaaagagaaggucgacacccggacgccgaaagcuaagcgggggaccgcccagaucauggagguuacagcgaaguggcuguggggcuuccuugcccgcaacaagaagccucgaauuugcacccgggaggaguuuacgcgcaagguacgguccaacgccgccaucggcgcgguguucguagacgagaaccaauggaacagugccaaggaagcagucgaagacgaacgcuucugggacuuagugcaccgggaacgcgagcugcacaagcaggggaaaugcgcuaccugcguguauaacaugaugggcaagcgggagaagaagcuuggugaguucggcaaggccaaagggagucgcgcgaucugguauauguggcugggugcccgguucuuggaguucgaggcccuaggcuucaugaacgaggaccacugguucagccgugaaaacucccuguccgguguugagggcgaggggcuacacaagcucggcuacauccuccgggacaucuccaagauccccgggggcaacauguacgccgacgacaccgcaggcugggacacccguaucacggaagacgaccugcagaacgaggcgcgcaucaccgacauuauggaaccggagcacgcccuacuagcuaagagcaucuucaagcuaaccuaccagaacaaaguggugaggguccagcgccccgccaagaacgggaccgugauggacgugauuucccggcgugaccagcggggcagcggacagguuggaaccuacggacucaacacauucaccaacauggaagcccagcugauccgccagauggagagcgagggcauuuucucgccuuccgagcuggaaacccccaaucucgcggagcgcgugcuggacuggcuggagaaguacggcguugagcguuuaaagaggauggcgaucucuggggacgacuguguagugaagccgauagacgaccgcuucgccacggcccugacggcccugaacgacauggggaagguacguaaggauaucccacagugggagcccuccaagggcuggaaugauuggcagcagguacccuuuugcagccaucacuuccaucagcucaucaugaaggacgggagggagaucgugguccccugccgaaaccaagaugagcuggucggccgcgcacgggugucgcagggggcgggcuggucgcugagagagacugcuugccucggcaaguccuacgcccagauguggcagcugauguauuuccaucgccgugacuuacggcucgcggcaaacgccaucugcagcgccguacccgucgacuggauccccaccagccgcacgaccugguccauccaugcccaccaccaauggaugaccaccgaggauaugcugagcguguggaacagaguauggauugaggagaaccccuggauggaggauaagacccacaucuccagcuggggcgauguccccuaccuuggaaagcgggaggaccaguggugcggcuccuugaucgggcugaccgcccgcgccaccugggccaccaacauccagguggcgaucaaccagguucgacgccugaucgggaaugaaaacuaccuggacuacaugacgagcaugaaacgauucaaaaacgaauccgacccugagggcgcccucugguga

SEQ ID NO: 24105 - RNA, 9879 nt, Artificial Sequence
  derived and/or modified CDS sequence (opt11) from DENV-1__EU677140__SS-prME
uccgugacaaugcugcucaugcugaugcccaccgcacuggccuuccaccucaccacccggggcggcgagccacacaugauagugagcaaacaggagcggggcaagagucugcuguucaagaccagcgccggggugaacaugugcacccucaucgccauggaccuaggcgagcugugcgaggacaccaugaccuacaagugcccaagaaucaccgagaccgagcccgaugaugucgacugcuggugcaacgccacggacacaugggugaccuacggcacgugcagucagacaggugagcaucgccgggacaagcgguccguagcccuggcgccgcaugugggauuagggcuggagacccgcaccgagaccuggaugagcuccgagggcgccuggaagcagauccagcgggucgagacgugggcccuccggcauccaggguucaccgugaucgcgcuguuccuggcccaugcgaucggcaccagcaucacccagaaggggauuaucuucauccuccugaugcuggugacaccaucgauggccaugcggugcgucggaaucgggagccgcgauuucguggaggggcuuuccggcgcgacaugggucgacguugugcuggagcacgggagcugcguaaccaccauggccaaggacaagccaacgcuggacaucgaacugcugaagaccgaagucaccaacccugccguuuuacggaagcucugcauagaggcgaagauaucaaacaccacuacggacagccgaugcccuacccagggagaagcuacccugguggaggagcaggacgccaacuucgucugucgacgcacguucguggaccggggcugggggaacggcugcggguuauuuggcaagggguccuuaauaacgugcgcaaaguucaagugcgugaccaaguuggagggaaagaucgugcaguacgagaaccugaaguacagcguuaucguaaccgugcacacaggggaccaacaccagguggggaacgaguccaccgaacacggcaccacagccaccaucaccccgcaggcccccaccacagagauccaacucaccgacuauggggccuuaacgcucgauuguagcccgcgcaccgggcuggacuuuaacgaaaugguccugcugaccaugaaggagaaguccuggcucgugcacaagcagugguuuuuggacuugccccucccuuggacuaguggcgccagcacgucccaggagacguggaaccggcaggaccugcuugugaccuucaaaaccgcccacgccaagaagcaggagguaguuguguuaggcucacaagagggcgcaaugcacacagcgcucaccggggccaccgaaauccagaccuccggcacgaccaccaucuucgccgggcaccugaagugccgccucaagauggacaagcugaccuugaagggcaugagcuacgucaugugcacgggguccuucaagcuugagaaggagguggcggagacccaacacggcaccgugcugguacagaucaaguaugagggcacugacgcgcccugcaaaauccccuuuagcacgcaggacgaaaaggguguaacucagaauggccggcuuaucaccgccaacccgaucgugacggacaaggagaaacccguuaauaucgaggccgagccgcccuucggggaauccuacaucaucauaggcgccggcgagaaagcgcugaaauuaucuugguucaagaaagggucuagcaucgguaagauguucgaggcaaccgcccgcggggcccggcgcauggcuauccugggcgacaccgcgugggacuucggaucuaucggcggcguguucaccagcguggggaagcugguccaccagauauucggcaccgccuaugggguguuguuuuccggugugagcuggacaaugaaaaucgggaucggaguccugcuaaccuggcugggccuaaacucucgcagcacuuccuugagcaugaccugcaucgccgucgggcuugugacgcuguaccugggugucauggugcaagccgacagcgggugugugaucaacuggaagggccgugagcuaaagugcggaagcggcaucuucgucaccaacgagguccacaccuggaccgagcaguacaaguuccaggcugacagcccgaagcgccugucugcagcuaucggaaaggcaugggaggaaggagugugcggcauccggagcgccacccgccuggaaaacauaauguggaagcagaucuccaacgagcucaaccacaucuuguuagagaacgacaugaaguucacggucguggugggggaugucgcaggcauccucgcgcaggggaagaagaugauacgcccucagccuauggaauacaaguauagcuggaaguccuggggcaaagcuaaaaucaucggcgccgacgugcagaauacaaccuucaucauugaugggcccaauaccccggaaugucccgacgaccaaagggcuuggaauaucugggagguggaggacuacggcuucgggaucuucacgaccaacauuuggcucaagcugcgggacucccacacccaggucugcgaccacagacucauguccgcugcuaucaaggacagcaaggccgugcacgccgauaugggcuacuggaucgagucugagaaaaacgagaccuggaagcuggcccgagcuucguucauugaagugaagacgugcaucuggcccaaaucccacacccuguggagcaacgguguucuugagucggagaugaucauacccaagauauacgggggcccuaucagccagcacaacuaccgccccggguacuucacccagaccgccggccccuggcaccuggggaagcuggagcuugacuucgaccugugugagggcacgaccgugguggucgacgaacacugcggcaaccgggggccgucccugaggaccaccacggugaccgggaagaucauccacgaguggugcugccggagcuguacccugcccccccuucgcuuccgcggagaggacggcugcugguaugggauggagauccgucccgugaaggagaaggaggaaaaccugguaaaguccauggucagcgccggcucaggcgaaguggauuccuucucccuggggcugcuuugcaucucaaucaugaucgaggaggucaugcggagccgcuggucccgcaagaugcucaugaccgggacgcuggccgucuucuuccugcugaucauggggcagcucacguggaacgaccugaucagacuguguaucauggugggcgccaacgcuagcgaccggauggggaugggcaccaccuaccuggcccugauggcaacuuucaagaugcggccgauguucgccgucggucuccuguuucgcaggcugacaucucgagaggugcuacugcugaccaucgggcucagccuaguggccuccgucgaacugccgaacagccucgaggagcugggggacgggcuugccaugggcaucaugauccucaagcuacugacagauuuccagucccaccaacucugggcgacccuuuugagccucaccuucaucaaaaccaccuuuucacuccacuacgccuggaaaacgauggccaugguacugagcaucgugucccucuuucccuugugccugagcaccaccucucagaaaacgacguggcuccccguucugcugggcagccucgggugcaagccacugacuauguucuuaauugcggaaaacaagaucuggggacggcgcuccuggccgcucaacgaggggaucauggccguggguauagucagcauccugcugucguccuugcugaagaacgacgugccccuggccgggccccucaucgccgguggcaugcugaucgccugcuacgugaucaguggguccagcgcggaccugucccucgaaaaagccgcggaggucuccugggaagaggaggcugagcacucaggagccagucauaauauucuaguggagguacaagacgacgggaccaugaagaucaaggacgaggaacgggaugacacgcucacuauccugcugaaggcgacgcugcuugccgucuccggcguguacccgcuuagcauccccgcuacccuguucgucugguauuucuggcagaagaagaagcagcgcucaggaguccucugggauaccccgagcccgcccgaaguggaacgggcggugcuggacgacgggaucuaccgcaucaugcagcgggggcugcuggggcgcucucaagucggaguuggaguguuccaggagaacgucuuccauaccauguggcacgugacccggggcgcagugcucauguaucaggggaagcgacuggagcccagcugggcguccguaaagaaggacuuaaucagcuacggcggcggguggcguuugcaaggcuccuggaacacgggugaggagguccaagugaucgccgucgagcccggaaagaaccccaagaacguccagaccgccccagggaccuucaaaacucccgagggugagguaggcgccaucgccuuagacuucaagcccgguaccagcggcucgccaauaguaaaccgcgaagggaagauugucggccuguacggcaacggaguagucaccaccagcggcacguacgugagcgccaucgcucaggccaaggccucacaggaggggccguuacccgagauugaggacgagguguucagaaagcgcaaucuuaccaucauggaccuacaccccgggagcggcaagacccggagauaccuccccgcaauuguacgggaggccaucaaacggaagcuacgcacccugauccucgcgcccacacguguuguggccuccgaaauggccgaagcgcugaagggaaugcccauccgcuaccagaccacggccgucaagagcgagcacacugguaaggagaucguagaccugaugugccacgccacguucaccaugcggcuccugucccccgugcgcgucccgaacuacaacaugaucaucauggacgaggcccauuucaccgauccuuccuccaucgccgcgaggggguacauaagcacccguguaggcaugggggaagcggccgccauauucaugacggccacgccgccuggcuccguugaagcguucccgcaaucgaacgccgucauacaggacgaggagcgcgauauccccgagcgauccuggaacagcggguacgaguggaucaccgauuuuccaggaaagacggugugguucgugccauccauaaaaucgggaaaugacauugccaacugccugcggaaaaacgggaagcgagucauccaacucucccggaagacguuugacacggaguaccagaagaccaagaacaacgacugggacuacguugucaccaccgacaucagcgaaaugggcgcgaauuuccgcgcggaucgugucaucgacccgcgccggugccugaagcccgugauccucaaggacgggcccgagcgcgugauccucgcaggcccaaugccugugacuguggccuccgcggcccagcggcgcgggcggaucggacgcaaccacaacaaggaaggcgaucaguauaucuauauggggcagccacugaacaacgacgaagaccaugcgcacuggacagaggcaaagaugcuucucgacaacaucaacacucccgagggcaucauuccggcccuguucgagccugagcgcgagaagucggccgccauagacggggaguaccgguuacguggcgaggcgcggaagacguucguugaacucaugcgccgcggugaccugccuguguggcuguccuacaagguggcgagcgagggcuuccaguacagcgaccgucgguggugcuucgacggcgagaggaacaaccaggugcucgaggagaacauggacguggagaucuggaccaaggagggggagcggaagaaacugcgcccccgguggcuagacgcccguaccuacagcgacccccucgcccugcgugaauucaaggaguuugcugcaggccgccguaguguguccggggaucugauccucgagaucggcaagcugccgcagcaccugacccaacgcgcacagaacgcgcucgacaaccuggucaugcuacacaacuccgagcaagggggacgggccuaucgccaugccauggaggaacucccugacaccauugagacgcugauguuacucgcccucaucgccguucugacgggcggggugacacuuuucuuccuguccggccggggucuggggaaaacuagcaucggccucuugugcguaauggccuccagcgugcuucucuggauggccuccguggagccucauuggaucgcugcaagcaucauccuggaguucuuccuuaugguccucuugaucccggagcccgaccgccaacgaacgccccaagacaaccagcuugccuauguuguuaucgggcuccuguuuaugauuuuaaccgucgcagcuaacgagaugggccuccucgagacuaccaagaaggaccuggggaucggucacguggcgguggagaaccaccaccacgccgcaaugcucgacgucgaccuacaccccgcauccgccuggacgcuguaugcgguggcuacgaccaucaucaccccgaugaugcgucacacgauugagaacaccacggccaacaucagccucaccgccaucgccaaucaggccgccauccugauggggcuggacaagggcuggcccauauccaagauggacaucggcgugccgcucuuggcgcuggggugcuacagccaagucaacccccucacgcugaccgcggcagugcugaugcucguggcccauuacgcuaucaucggaccggggcuccaggcuaaggcgacccgcgaggcgcagaagaggaccgccgcaggcaucaugaagaaccccacgguugacgggauaguggccaucgaucuggaccccgucgucuacgacgcuaaguuugagaaacaacucggccaaauaauguuacucauccucugcaccucccagauucuguugaugcgcaccaccugggcccucugcgagagcaucacgcuggccaccggcccccugacuacacucugggaggggaguccagggaaguucuggaacacgacuaucgccgugagcauggccaauaucuucaggggguccuaccuagccggcgcuggccuugccuucagccucaugaagucccucggaggcgggcgccgcggcaccggggcacagggcgaaacccugggggagaaguggaagcgccagcuaaaccaauuauccaagucugaauucaacaccuauaaacgcuccgggaucauggagguggaucgcagcgaggccaaggagggccuuaagcgcggagagacgaccaagcacgcggucucccgcggcaccgccaaguugcggugguucguagagcgcaaccuggugaagcccgaagggaaggucaucgaccugggauguggccgggggggcuggucuuacuacugcgccgggcugaagaagguuacugagguaaagggcuacaccaaaggcggccccggccacgaggagcccaucccaauggccaccuacggguggaaccucgucaagcugcacuccgggaaggacguguucuucaucccccccgagaagugcgacacccugcucugcgacaucggggagagcuccccgaacccgacaaucgaggagggccgcacccugcggguucugaagauggucgagcccuggcuccgcggcaaccaguuuugcauaaaaaucuugaaucccuacaugcccagcgugguggagacccuggagcagaugcagcgcaagcauggcggaauguuagugcgcaacccccugucccggaauagcacccacgagauguacugggugagcugcgggaccggcaacaucguaagcgccgucaacaugacgucccgcaugcugcucaaucgcuucacuauggcgcaccguaagcccaccuacgagcgcgacguugaccugggugccggcacccggcacguggcaguugaaccggagguggcgaaccuggauaucaucggacaacgcaucgagaacaucaagcacgagcacaagagcacguggcauuacgaugaggacaacccauacaaaacaugggccuaccacggguccuacgaggugaagccgagcggcucagcgagcagcauggucaacggcguagucaagcuccugacuaagcccugggauguaauccccauggugacccagaucgccaugacagacaccaccccuuucggccagcagcgugucuucaaagagaagguggacacuagaacuccgaaggcgaagcgggggaccgcccagaucauggaggugaccgccaaguggcuguggggcuuccucuccaggaacaagaagccucggaucuguacccgcgaggaguuuacccggaagguucgcagcaacgcugccaucggcgcaguuuucguggacgagaaccaguggaauucugccaaggaggcggucgaggacgagcgguucugggacuuggugcaccgcgagcgggagcugcacaagcaggggaagugcgcgaccugcguguacaacaugaugggcaagcgcgagaagaaacucggggaguucggaaaggccaaagggagcagagcgaucugguacaugugguugggugcccgcuuccuggaguucgaagcgcuaggguucaugaacgaggaccacugguucucccgcgagaacagcuuauccggugucgagggcgaggggcugcacaagcucggcuacauccugcgcgacaucucaaagaucccggguggcaacauguacgcagacgacaccgccgguugggacacucggauaaccgaggacgaccugcagaacgaggcccgcaucacggauaucauggagccugagcacgcccuccuggcgaaguccaucuucaaacuaaccuaccagaacaagguggugagggugcaacggcccgccaagaacgguacuguaauggaugugaucucacgccgggaccagcgcggcuccgggcaggucggcaccuacggccuuaacaccuucaccaauauggaggcucaguugauacggcaaauggaaagcgaagggaucuucucccccucagagcuggagacgcccaaccucgcagagcgcgucuuggacuggcugaagaaguacggcguggagcgucucaaacguauggccaucuccggggacgacugcgucgugaagccuaucgacgaccgguucgcgacagcacugacagcccugaacgacaugggcaaggugcgaaaggacaucccccagugggagccuagcaagggcuggaacgacuggcagcagguccccuucugcucccaucacuuccaccagcuuauaaugaaggacggccgggagaucguggugcccugccgcaaccaggacgaacuagucggccgggcccgcgugucacagggagccggcuggagccuccgggagacggcgugccuugggaagucauaugcccagauguggcaacugauguauuuccauaggcgugaucugcgacucgccgccaacgcaaucuguagcgccgugccugucgauuggaucccgaccucccggacgaccuggagcauccacgcccaucaccaguggaugaccaccgaggacaugcuuuccguguggaaccgcguauggaucgaagaaaacccguggauggaggauaagacucauaucagcuccuggggggacgucccauaccuggggaagcgcgaggaccaguggugcggcagccucaucggucuaaccgcucgggccacaugggcuaccaacauucagguggccauaaaccagguuagaagacugauagggaacgaaaauuaccucgauuacaugaccaguaugaagcguuucaagaacgagggggaccccgagggagcccuaugguga

SEQ ID NO: 24106 - RNA, 9879 nt, Artificial Sequence
  derived and/or modified CDS sequence (opt11) from DENV-1__EU677166__SS-prME
agcguuaccaugcuacuaaugcugaugcccaccgcccuggccuuucaucuaaccaccagaggcggggaaccccacaugaucgugagcaaacaggagcggggcaagagccuucuguuuaagaccagcgcgggggugaauaugugcacccugaucgcgauggaccuuggggagcugugcgaggauaccaugaccuauaaaugcccccgcauaaccgagaccgagccggacgacguggauuguuggugcaacgccacggacacgugggucaccuacgggaccuguucgcaaacgggcgaacaccggcgggacaagagaucuguggcacucgcgccgcacgugggccuggggcuggagacccgcaccgagaccuggaugagcucggagggugcguggaagcaaauccaaagagucgagacgugggcccuucggcaccccggguucaccguaaucgcauuauuccucgcucaugccauaggcaccaguaucacccagaaggggaucaucuucaucuugcugaugcugguuacgcccuccauggccaugcggugcgucgggaucggcagccgcgauuucguggagggccuuuccggcgcaacguggguggauguaguacucgaacacgggagcugcguuaccaccauggcgaaggauaagcccacgcuagacaucgagcuccugaagaccgaagucacgaaccccgcagugcugcguaagcuuugcaucgaggcgaagaucuccaauacgacaacagacucucgcugcccgacccagggagaggccacguuaguggaggaacaggaugccaacuuugucugccgaagaacuuucguugacaggggcugggguaauggcugcgggcuguucgguaaaggaagucucauuacgugcgcaaaauucaagugcgugaccaaguuagagggcaagaucguccaguacgagaaucuuaaguacucuguaauugugaccguacacaccggcgaccagcaccaaguagggaaugaaucuaccgagcacggaaccacggcgaccauuacuccccaggcgcccaccaccgagauccaacucaccgacuacggugcccuuacgcuggacugcagcccccgcaccggccucgacuucaaugagaugguccuguuaaccaugaaagagaagucguggcucguacacaaacagugguuccuggaucugccccuccccuggaccagcggggcauccacgucucaagagaccuggaaucggcaggaccugcuagucacguucaagaccgcccacgccaaaaagcaggaggucguaguauugggcagccaggaaggggcaaugcauacggcacugaccggggccaccgagauccagaccucuggcacgaccaccaucuucgcggggcauuugaagugucgcuugaaaauggacaaacugacucuuaagggcaugagcuaugugaugugcacgggguccuucaagcucgagaaggagguggccgagacccagcacgggaccgugcugguccagaucaaguaugagggaacggacgcgccaugcaaaauccccuucagcacgcaggacgagaagggggugacgcagaacggccgguugaucaccgcuaacccaaucgugaccgacaaggagaagccggucaauaucgaggccgagccgcccuucggggaguccuauauugugaucggcgcaggcgaaaaagcacuuaagcucagcugguucaagaagggaaguucgaucggaaagauguucgaagccacggcccggggggccagacgcauggcuauccugggcgacacugcgugggacuucggguccauaggggggguguucacgagcgucgggaagcuggugcaccagauauucgguacugcauauggggugcuguucuccggcguuagcuggacuaugaagauagggaucgguguuuuacugacguggcugggccugaacucccgcagcaccucucugaguaugaccugcaucgcggucggacucguaacgcuuuacuuaggcgugaugguccaggccgacuccgggugcgucauaaacuggaagggucgggagcuuaaauguggaagcgggaucuucguaacgaacgaaguucauaccuggaccgagcaauacaaguuucaggccgauagcccgaagaggcuguccgcggccaucggcaaggccugggaagagggggucugcggcauccggagcgccacccgucuggagaauaucauguggaagcagaucucgaaugaacucaaucacauccugcuggagaacgacaugaaguuuacggugguggugggggacguggccggaauccucgcgcaggguaagaagaugaucaggccccagcccauggaguacaaguacagcuggaaauccuggggcaaagccaaaauaaucggcgccgacgugcagaacacuaccuucaucaucgacgggcccaacaccccggaaugcccagaugaccaacgcgccuggaacaucugggaagucgaggauuacggcuucgggaucuucacuaccaacauuugguuaaaacuacgggauagcuacacacaggucugcgaccaccgccucaugagcgcggccauuaaagauaguaaggcgguacacgcugacaugggcuacuggauagaguccgagaagaaugagaccuggaagcuggcccgugcuucauucauagaggucaagacgugcauauggcccaagucccacacguugugguccaacggcgugcucgaguccgagaugaucaucccaaagaucuacggggggccuaucucucagcauaacuaccgcccgggguacuucacacagacagccggcccauggcaccucggaaaauuagagcucgacuucgaccugugcgaaggcaccaccguggucguggacgagcacugcggaaaccgggggccaagccugcgcacgaccacggugaccggcaagauaauccacgaguggugcugccggagcugcaccuugccgccacuccgcuuccgcggggaggacggcugcugguacgggauggagauucgccccgucaaggagaaggaggagaaucuggucaagucgauggugagcgccgggagcggcgagguugacuccuucagccuggggcugcugugcaucuccaucaugaucgaggagguuaugcggagccgcuggagcaggaagaugcucaugaccggcacgcuggcaguguucuuccuacucaucauggggcagcugacuuggaacgacuugauucgucucugcauuauggucggcgccaaugcgagcgaccgcauggggaugggcaccaccuaccuggcccuaauggccacuuucaagaugcggcccauguuugcaguuggauuacuguucagacggcugaccucccgcgagguucuccuccuaaccaucggccucucucuggucgccuccguugagcugcccaacucucucgaggagcugggggacggguuagcgauggggauuaugauccucaagcuguugacugacuuccagucucaucagcucugggccacgcugcugagcuugaccuucaucaagaccacguuuucucugcacuacgccuggaagacgauggccauggugcugagcaucguauccuuguucccccugugucugagcaccaccagucagaagaccacguggcuccccguccuguuagguagccugggcugcaagcccuugaccauguuccugaucgcagagaauaaaaucuggggccgccgcuccuggccccucaacgaggggaucauggcugucggcaucgugucuauacugcugagcucccuccugaagaacgacgugccccuugcagggccccucauugccggcggaaugcugaucgccugcuacguaauaagcggguccuccgcggaccugucccucgagaaagccgcugaggugucgugggaagaggaagccgagcacuccggcgccagccauaauauucuuguggagguccaggacgacgggaccaugaagaucaaggaugaggaacgggaugauacccugaccauccuccuaaaggcaacguugcucgccgucuccggcguguauccucuuagcaucccugccaccuuguucguaugguacuucuggcagaaaaagaagcaaagguccggcgugcuaugggauaccccuagcccgccagagguggagcgugcaguacuggaugacggcaucuaccgcauaaugcagaggggcuuauugggccgcucccaggugggcgugggggucuuccaggagaacguuuuucacacgauguggcacgucacccggggcgccguccuuauguaucagggcaagcgcuuagagccaagcugggcgucggugaagaaagaccugauaucuuacggcgggggguggcgacuccaaggguccuggaacaccggagaggagguacagguaaucgccguggagccagguaagaacccgaagaaugugcagaccgcccccgggaccuuuaaaacgcccgagggcgaggucggagccaucgcccuagacuucaagcccgggacauccggcucccccaucguuaaccgcgaggggaagaucguugggcuguaugguaacggggucgugaccaccucaggaacguacgugagcgcuaucgcccaggccaaggcaucccaagaggggccgcuccccgagauugaggacgaaguuuuccggaagcggaaccugaccaucauggaccugcaccccggcagcgggaagacccggagauaucucccggcgauugugagagaggccaucaagcgcaaacugcgcacccugauccucgccccaacgcgcguagucgcuuccgaaauggccgaggcacugaagggcaugcccauccgcuaccagacaaccgccgucaaaagcgagcacacgggcaaggagauuguggacuugaugugccaugccacguuuaccaugcgacuccugagcccggugcgcgugccgaacuacaacaugaucaucauggacgaggcccacuucaccgacccgucaagcauagcugcgcggggguacauuagcacacgugucggcaugggcgaggccgcugccaucuucaugacugcgacgccccccggguccgucgaggcguucccgcaaagcaacgccguuauccaggacgaggaacgggacauccccgagcgcaguuggaauagcggguacgaguggaucacggauuucccgggcaagaccgugugguucgucccauccaucaagagcggcaacgauauugccaacugccugcggaagaacggaaagcgagugauacagcucucccggaagacguucgacaccgaguaucagaagaccaagaacaacgauugggacuacgugguaacaacggacaucagcgagaugggcgccaacuuucgcgcggaccgggugaucgacccacgccggugccugaaacccgugauccugaaggacggaccggagcgcgucauauuggccggccccaugccggugacggucgcguccgccgcgcaacggagggggcggauugggcgcaaucauaauaaggagggagaccaguacaucuauauggggcagccccuaaacaacgacgaggaccaugcgcacuggaccgaggccaagaugcugcuagacaacauaaacacgcccgagggaauuaucccagccuuauucgagccugagcgcgagaaauccgccgccauagacggggaguaccggcugcguggcgaagcgagaaagacguucguggagcucaugagacgcggggaccugcccguguggcuguccuacaagguagccagcgagggcuuccaguauagcgaccgccgguggugcuucgacggcgagcgcaacaaccaagugcuagaggagaacauggacguggagaucuggaccaaggagggggaacgcaagaagcugcgcccccgguggcuggacgcccgcaccuacuccgacccccucgcgcugcgggaguucaaagaguuugcugcggggcgccgcucugucuccggggaccuuauacucgagaucggcaagcugccgcaacaccugacccaacgcgcccaaaaugcacucgacaacuuagugaugcugcacaacagcgagcagggugggcgggccuaucgccaugcgauggaagagcuccccgauacaaucgagacgcugaugcugcucgcccugaucgccguacugaccggcggcguaacauuauucuuccuguccggaagggggcugggcaagacuagcaucgggcuuuugugcgugauggccagcucagugcucuuguggauggccuccguugaaccccacuggaucgcggccagcaucauccuggaguucuuccugauggugcuccugauccccgagccggaccgacagcggaccccccaggacaaccagcuggcauacguggucauaggguugcuguucaugaucuugaccguagccgccaacgagaugggccuccucgagaccacuaagaaggauuuagggaucggccacguggcgguagagaaccaccaccacgccgccaugcucgacguagaccugcaccccgccuccgccuggacacucuacgcaguggccaccaccauaaucaccccgaugaugaggcauacgauugagaacaccacugccaacauuagccucaccgcuaucgccaaccaggcggccauacugaugggucuggauaagggcuggcccaucucuaaaauggacaucggcgucccccuccuugcucuggggugcuacucccaggugaauccccuuacccugacugccgcggugcugaugcucguagcccauuacgccauuauugguccggggcugcaggccaaggccacucgcgaggcgcagaagcgaaccgccgccggcauuaugaagaauccgacgguagacgggaucguggcaauugaccuggacccggucguguacgacgccaaguuugaaaaacagcucggacagaucaugcugcugauucucugcaccucacagauucugcucaugcgcaccacgugggcguuaugcgaaagcaucacgcucgcaaccggcccacugacuacccucugggaagguagcccgggcaaguucuggaauacgacuaucgccguauccauggccaacaucuucagaggcuccuaccuggccggggcgggccuggccuuuagcuugaugaaaucgcucgguggcgggcgccgggguaccggggcccagggcgagacccugggcgagaaguggaaacggcagcugaaucagcugucaaaaucggaauucaacacguacaagcggagcggaaucauggaggucgaccgcagcgaagcgaaggagggacuuaaacgaggcgagaccaccaagcacgcggugagccgaggcaccgccaaacuccgaugguucguggagcgcaaccuggucaagcccgaagggaaggugaucgaucugggcugcggccgcggggguuggagcuacuacugugcggggcugaagaaagugacggaagucaagggcuauaccaagggcggccccggccaugaagagcccaucccgauggccaccuacggauggaaccuggugaagcugcacuccggaaaagacguguucuucauaccgcccgagaaaugugacaccuuacucugcgacauaggggagagcuccccuaacccgacgaucgaggaaggccgcacacuuagggugcugaagauggucgagcccuggcucagagggaaccaguuuugcaucaaaauccugaaccccuacaugcccucaguagucgagacccuggagcaaaugcagcgaaagcacggcggcaugcuagugcgcaacccgcugucccggaauucaacucacgaaauguacuggguuuccugcgggaccgggaacaucguaagcgccgugaacaugacuuccagaaugcugcucaaucgcuucacuauggcgcaccggaagccaacauacgagcgagacguggaucuaggggccggcaccaggcacgucgcuguggagccggagguggccaaccuagauauaaucggucagaggaucgagaacauuaagcacgaacauaaaagcacuuggcacuacgacgaggauaacccguauaagacgugggccuaccacgggucguacgaagucaaaccguccggcuccgccagcucgauggugaacggggucgugaagcuucuaacuaagccaugggaugugauucccauggucacccagaucgccaugacggacaccacccccuucgggcagcaaagaguguuuaaggaaaagguggacacccgcacgccgaaggccaaacgggggaccgcucagauuauggaggugaccgccaaguggcucuggggcuucuuaagucgcaacaagaagccccggaucugcacccgugaggaguucacccggaaggugcgcagcaacgcggccaucggcgccguguucgucgacgagaaccaguggaacuccgcuaaagaggcgguggaggacgagagauucugggaccuggugcaccgcgagagggagcugcauaagcaggguaagugcgcgaccugcgucuacaacaugaugggcaagcgagaaaagaagcucggggaguucggcaaggccaaggggucgcgggcuaucugguacauguggcugggagcacgcuuccuggaauuugaggcgcugggcuucaugaacgaggaccacugguuuagucgugagaacagccucucaggugucgagggcgaggggcugcauaagcucggauauauauugagagacauuucgaagauccccggcgguaacauguacgccgacgacacagccgguugggacacccggaucacggaggacgaccugcagaacgaggcccgcauuacugacaucauggagccggaacacgcccuccuagcgcgcuccaucuucaagcugaccuaccagaacaagguaguccgggugcaacggcccgccaagaacggcacuguaauggacgucaucagccggagggaccagcgggggucaggccagguggggaccuacgggcucaacaccuucacgaacauggaggcccagcucauccgccagauggagagugagggaaucuucagcccuucggagcuggagacccccaaccucgccgagcgggugcuggauuggcuggaaaaguacggaguugagcggcugaagcggauggccaucagcggggaugacugcguggucaaaccaauagacgauagauucgcgacggcccugacugcccugaacgacaugggcaagguccggaaggauauaccccagugggagccgagcaagggcuggaacgacuggcagcagguccccuuuugcucccaccacuuccaccagcucaucaugaaggacggccgcgagaucguugugcccugccggaaccaggaugagcuggugggccgugcccgggugucacagggggccggauggagccugcgcgagaccgcaugucuggggaaguccuacgcacagauguggcagcugauguacuuucaucgccgcgaccugagguuggccgccaaugcgaucugcuccgcagucccagugaacuggauccccaccucacgaacgaccuggagcauccaugcacaccaccaguggaugaccacggaggauaugcuguccguguggaaccgcgucuggauagaggagaaccccuggauggaggacaagacgcacauuagcucauggggcgacguaccguaucuggggaagcgcgaggaccaauggugcggaucccugaucggccugacugcgcgcgccacuugggcaacgaacauccaggucgccaucaaccagguccggcgccugaucgggaaugaaaacuaccucgacuacaugaccucgaugaagcguuucaagaaugaaagcgacccugagggcgcccugugguag

SEQ ID NO: 24107 - RNA, 9879 nt, Artificial Sequence
  derived and/or modified CDS sequence (opt11) from DENV-1__EU677170__SS-prME
agcgugaccaugcugcuuauguugaugccgaccgcacuugcauuccaccucaccacccggggcggggagccccacaugaucguguccaagcaggagagaggcaagagccuguuauucaagaccagcgccgggguuaacaugugcacgcucaucgccauggacuugggcgaguuaugcgaggacaccaugaccuacaagugcccgcggauuaccgagacggagccagaugacguggacugcuggugcaacgccacggauacaugggucacuuacgggaccugcagucaaacaggagagcaccggcgugacaaacggaguguagcucucgcgccccaugugggccuggggcuggagacccgcaccgagaccuggaugagcucagaaggcgccuggaagcaaauccagcggguggagacgugggcccuccggcaccccggguucaccgugauagcacuguuccucgcccacgcgaucgguaccucaaucacacagaaagggaucauauuuaucuuacugaugcuggugacgcccuccauggccaugcggugugugggcaucggcagccgcgacuucguggaagggcuauccggcgccaccuggguggaugucgugcuggaacacgggagcugcgugaccacaauggccaaggacaagccgacgcuggauaucgagcuacugaagaccgaggucaccaacccggccgugcugcggaagcucugcaucgaggcgaagaucuccaacaccacgaccgauagccgcugccccacccagggcgaggccacccugguggaggaacaggacgccaacuucgucugccggcgcacguucguagaccggggcugggggaacggcugugggcuauucggaaagggcucccucaucacaugcgccaaauucaaguguguaaccaaacuggagggcaagaucguccaguacgagaacuuaaaguacagcgugaucguuacaguccacacgggcgaccagcaucagguggggaacgaguccaccgagcauggcaccaccgccaccaucacgccccaggcgcccaccaccgagauccagcucaccgacuacggggcgcugacgcuggacugcagcccgaggaccggccucgacuucaacgagaugguccugcugaccaugaaggagaaguccuggcucgugcacaaacaaugguuccuggaccucccccucccauggacaagcggggcuagcacgucccaggaaaccuggaacagacaggaccugcugguaaccuucaagacugcccaugccaagaagcaggaggucguggugcuugggagccaggaaggcgcgaugcacacggcucugaccggagccacugagauccagaccuccggcacgaccaccaucuucgccgggcaccugaagugccgccucaagauggauaagcugacccuuaaagggaugucauacgucaugugcacggggucauucaagcucgagaaagaaguggccgagacacagcacggcacagugcugguccaaaucaaguacgaaggaaccgacgcgccgugcaagauccccuucuccacgcaggacgagaagggggugacccaaaacggcagacugauuacggccaacccgaucgugacagacaaggagaagccggucaauaucgaggccgaaccgccuuuuggggaguccuauaucgugaucggugccggcgagaaggcccugaaacucagcugguucaagaaggggucuagcaucgguaagauguucgaggcgacagcacgcggggcacggcgcauggccauccuaggcgacaccgcgugggacuucggcucaauuggcggcguauucacaagcguuggcaaguuagugcaccagaucuucggcaccgccuacggaguucuauucuccggcgucagcuggacgaugaagaucgggaucggcgugcugcuuacauggcucggccugaauucgcgcagcacgucauuaagcaugaccugcaucgccgucggguuagucacgcuguacuuaggcgucauggugcaagccgacucugggugcgucaucaacuggaagggccgggagcugaagugcgggagcggcaucuucguuaccaacgagguacacaccuggaccgagcaguauaaguuccaggccgacagcccgaagcgccuguccgcggcuaucggcaaggccugggaggaggggguuugcggcauucggagcgccacucgccucgagaacaucauguggaagcagauaaguaacgaacucaaccacauccugcucgagaacgacaugaaguuuacaguggugguaggggacguggccggcauccucgcgcaagggaagaagaugauccggccacagcccauggaguacaaauacagcuggaagucauggggcaaggccaagaucaucggcgcagacgugcagaauaccaccuucaucaucgaugggcccaacaccccggagugccccgacgaccagcgcgcguggaacaucugggaagucgaggacuacggguucgggaucuucacuaccaacaucuggaugaagcugcgcgacucauacacccaggucugcgaccaucgccugauguccgcggccaucaaggacagcaaggccgugcaugccgacaugggcuauuggauagaguccgagaagaacgaaaccuggaagcucgcccgggcguccuucaucgaggucaaaacgugcauauggccuaagucccacacccuguggagcaacggugugcuggaauccgaaaugauuaucccuaagaucuacgggggcccgaucagccagcacaacuaccgcccuggguacuucacccagaccgccggcccuuggcaccuuggaaagcuggagcuggacuucgaucucugcgaggggacgaccguggucguggacgagcacugcggcaaccgugggccgucccugcgcacuacgacggugaccgggaagauaauccacgaguggugcugucggagcugcacccugccgccgcugcgcuuccgcggggaagacggaugcugguacgggauggagauaagacccguuaaggagaaggaggagaacuuagugaaauccauggugagcgcgggcuccggcgaagucgacaguuucucucuggggcuccugugcaucuccauaaugaucgaggaggugaugcggagccgcuggucgcggaagaugcugaugaccggcacccucgccguauucuuccugcugaucauggggcagcucaccuggaaugaccugauccgccuguguaucauggucggggccaacgcgagcgaccggauggggaugggcaccaccuaccucgcccugauggccacguucaagaugcggccuauguucgcagugggccuccucuuccgccggcugaccucccgugaggugcugcuucugaccaucgggcugucacucguugccuccguagagcugcccaauagccuggaagaguugggcgauggacuggcgaugggcaucaugaucuugaagcuccugaccgacuuucagucccaccaacugugggccacccuccugagccugaccuucaucaagaccaccuucucucuccauuacgccuggaagacgauggcaaugguccugagcaucgugucccuguucccccucugccugagcacuacgucccagaagacgaccuggcugcccgugcugcugggaucgcuggggugcaagccccucaccauguuuuuaaucgccgagaacaaaaucuggggccggcgcuccuggccacugaacgagggaaucauggccgucggcaucgugucaauccucuugaguucccugcucaagaacgacguuccucuggcaggucccuuaaucgccggcggcaugcugaucgccuguuacgucauuagcgggucgagcgcggaccugucccuggagaaagccgccgagguaagcugggaagaggaggccgagcacaguggcgccagccacaacauacucguggaggugcaggacgacgggaccaugaaaaucaaggaugaggagcgggacgacacccugaccauccugcucaaggcuacgcugcuggccguguccggcguguacccgcuaucuauuccugccacccuguucguaugguacuucuggcagaagaagaagcagcgcuccggugugcugugggauacccccagcccgcccgagguggagcgggcgguccuagacgacggcauuuaccgaauuaugcagcggggccugcugggccgaucacagguuggggugggggucuuccaggagaacguauuccacaccauguggcacguuacgcggggugccguccugauguaccaggggaagcgccucgagcccagcugggcauccgugaagaaggaccuaaucucauauggaggaggguggcggcuccagggcuccuggaacaccggggaggaggugcaggucauugccguggagcccggcaagaaccccaaaaacgugcagacggcccccgggaccuuuaagacgcccgagggcgaggucggcgcaaucgcacucgauuucaagccuggcaccagcggcucccccaucgugaaccgcgaggggaaaaucgugggauuguacggcaacggggucgugaccaccagcggcacguaugugagcgcgauugcccaagcgaaggccucccaggaggggccgcugcccgagauagaggaugagguauuccgaaagcgcaaccucacgauaauggaucugcacccaggcuccgggaagaccagacgcuaccuaccggcuaucgugcgggaggccaucaagcgaaagcucagaacccugauccuggcccccacgcgggugguagccagugaaauggccgaggcgcucaagggaaugccuaucagauaccagaccacagccgucaagagcgagcacacgggcaaggagaucguugaucugaugugccacgccacguucacaaugcgauugcucucgccaguccgcguuccaaacuacaacaugaucaucauggacgaggcccauuucaccgaccccagcuccaucgccgcgcggggguacaucucuacucgcgugggcaugggugaggccgccgcaaucuucaugacugccacgccgcccggauccguugaggcauucccgcagagcaacgccgugauacaggacgaggaacgggacauccccgagcgcuccuggaauagcggcuacgaauggaucaccgacuuccccggcaagacugugugguuuguacccuccaucaagagcggaaacgacauugccaacugucugcgaaagaacgggaagcgcguaauccagcugucccgcaagacuuucgacacagaguaccagaagacuaagaacaaugacugggacuacguggucaccacggacaucagcgagaugggcgccaacuuccgcgcggacagagugaucgauccgaggcggugucucaaacccgugauccugaaggaugggcccgagcgcgucauccuggccggacccaugccgguuaccguugcuuccgccgcccagcggcgcgggcggauuggccgcaaccacaacaaggaaggugaccaauauaucuacauggggcagccccuaaacaacgaugaggaccacgcgcacuggacggaggccaagaugcugcuggacaacaucaauacaccugagggcaucaucccggcucucuucgagccagagcgcgagaagucugccgccaucgacggagaguauagacugcgcggcgaggcucgaaagacguucguggagcugaugcgcaggggggaccuccccguauggcuguccuacaaggucgcgucagagggcuuccaguacagcgaccgucggugguguuucgacggggaacgcaauaaccagguguuagaggagaacauggacguugagauauggaccaaggagggggagcggaaaaagcuccgcccucggugguuggacgcgcgcaccuacuccgauccccuggccuuacgggaguucaaggaguucgccgcgggccgccgguccgucuccggggaccucauccuggagaucggaaagcucccgcaacaccuaacccagcgcgcccagaacgcccuggauaaccucguaaugcugcacaacucugagcaggggggacgcgcuuaucgccacgcaauggaggagcugccggacacgauagagacccugaugcugcuggcccucaucgcgguucugaccggcgggguuacacuguuuuucuuguccggccggggacugggaaaaaccagcaucgggcuucucugcgugauggccagcagcgugcugcuguggauggcuuccgucgagccccacuggauugcggccagcaucauccuagaguucuuccugauggugcugcugaucccggagccggaccgccagcggaccccccaggauaaccagcuggccuauguggucaucgggcucuuauucaugauccugacaguggccgccaacgaaaugggccuguuagagaccaccaaaaaggaccuggguaucgggcacguggcggucgagaaucaccaccacgccgccaugcuggacguggaccuacaccccgcaagcgccuggacucuguacgcgguggccacuaccaucaucaccccgaugaugcgccacacgaucgagaacaccaccgccaacaucagcuuaaccgccaucgccaaccaagcggccauccucaugggacuggauaagggcuggcccaucuccaaaauggacaucggcgucccgcuguuagcccuggggugcuacagccaggugaacccccugacguuaaccgcggcgguucugauguuggucgcccacuacgccaucaucgggccggggcuccaggccaaggccacccgcgaggcacagaagagaaccgcugccggcaucaugaagaaccccacgguggacgggaucguggccauugacuuagaccccgucguguacgacgccaaguucgagaagcaacugggccagaucaugcuccugauccuguguaccucccagauucuccuaaugcgcaccaccugggcgcucugugagagcaucacgcucgccaccggcccacucacuacccuuugggaggggucccccgggaaguuuuggaacacgaccaucgccgugagcauggccaacaucuuccggggguccuaccucgccggcgcgggccuggccuucagccugaugaagucccucgguggcgggcguaggggcacgggggcucaaggcgagacauuaggugagaaguggaagcgccagcugaaccaauuauccaagagcgaguucaacacguacaagcgguccgggaucauggagguggaccgcagcgaggccaaggagggccugaagcgcggggagaccaccaagcacgcggugucccgcggcacagcuaagcugcggugguucgucgagcgcaaucucgucaagccggaagggaaggugaucgaucugggcuguggccgcgguggguggagcuacuauugcgccgggcugaagaaggugacggaagucaagggguacaccaaggggggccccggacaugaggagcccaucccuauggccaccuacggguggaaucuggugaaguugcacuccggcaaggacguguuuuucaucccgcccgagaagugcgacacccugcugugcgacaucggggagagcucgccuaacccgacgaucgaggaaggccgcacccugcggguccugaagaugguggagcccuggcugcgcgggaaccaauuuugcaucaaaauccuaaaccccuacaugcccucuguggucgagacauuggaacagaugcagcggaagcacggcggcaugcugguccgcaacccucucuccaggaacagcacccacgaaauguacuggguguccugcgggacugggaacaucguuagugccgugaauaugacgucgcgcaugcuacugaaccgcuucaccauggcucaccggaagcccaccuacgagagagacguggaccucggggccggcacccggcacguagccgucgagcccgagguggcaaaccuggacaucauaggccagcgcaucgagaacaucaagcacgagcauaagagcacguggcacuaugacgaggacaaccccuacaaaaccugggccuaccacggguccuacgaggucaagccgagcgguagcgcauccagcauggucaacgggguagugaaacugcucaccaagcccugggacgugauccccauggucacccagaucgccaugacggacaccaccccguucggccagcagcggguguucaaggagaagguagauacccgcacgccaaaggcuaagcgggggaccgcccaaaucauggaagucaccgccaagugguuguggggauuccugucccgcaacaagaagccucggaucugcacccgcgaagaguucacccgaaaagugcgcagcaacgcggcgaucggcgccguguucgucgacgaaaaccaguggaacuccgccaaagaggcgguggaggacgagcgguucugggaccucgugcacagagagcgggagcugcacaagcaggggaagugcgcuaccugcgucuacaacaugaugggcaagcgcgagaagaagcuuggggaguucggcaaggccaaggggucccgggcgaucugguacauguggcucggggcacgguuccuggaguucgaggcgcugggcuucaugaacgaggaccacugguucucccgggagaauucacucuccggggucgaaggcgaggggcugcacaagcugggcuacauccuccgcgacaucagcaaaauuccagggggcaacauguacgccgaugauacagccggcugggacacccggaucacggaggaugaccuccagaacgaggcgaggaucaccgacaucauggagccggagcaugcccugcuggcucgcaguauuuucaagcugaccuaccagaauaaggugguccgggugcaacgccccgccaagaacggaaccgugauggacgucaucucgcgacgcgaccagcguggcuccggccagguggggacuuacggccuaaacacguucaccaauauggaggcccagcuaauacgccagauggagagcgaggguaucuucucccccagcgagcuagagacccccauccuggccgagcgagugcucgacuggcuggagaaguacggugucgaacgccugaagcggauggcaauuuccggggacgacugcguggugaagccgaucgacgaccgauucgcgaccgcccucaccgcgcugaacgacaugggcaagguccguaaagacaucccccaaugggagcccaguaagggcuggaacgacuggcagcaggucccuuuuugcucccaccacuuccaccagcugaucaugaaggacggacgcgagaucguggucccgugccggaaccaggaugaacuagugggccgcgcccgcguuagccagggggccggcuggagccugcgcgagaccgcgugccuggggaaguccuaugcccagauguggcagcuaauguacuuccaccggcgcgaccugcggcuggccgcaaacgcgaucugcucggcgguccccguggacuggauccccaccucccgcacuaccuggagcauccaugcucaccaccaguggaugaccacugaggacaugcuauccguguggaaccgcgucuggaucgaggagaacccguggauggaggacaagacgcacauuagcuccuggggugacgugccguaccuggggaaacgggaggaccaguggugcggaagccuaaucggccuuaccgcccgggccacaugggcgaccaauauacagguggccaucaaccaaguccggcgccugaucgggaaugaaaacuaccuggacuacaugaccucuaugaagcgguuuaaaaacgagagcgaccccgagggcgcccucugguga

SEQ ID NO: 24108 - RNA, 9879 nt, Artificial Sequence
  derived and/or modified CDS sequence (opt11) from DENV-1__EU677171__SS-prME
agcgugaccaugcugcucaugcugaugcccaccgcucuggcauuccaccucaccacucggggaggugagccccauaugauagugagcaagcaagaacggggcaagucgcugcuguucaagaccagcgccggggucaacauguguacccucaucgccauggaccugggcgaacugugcgaggacacuaugacuuauaagugcccccggaucacagaaaccgaacccgacgacguggauuguugguguaacgcaacggauaccugggucaccuacgggaccugcagccaaacgggcgagcaccggcgggacaagcgguccguggcccuagcgccccacgugggccuggggcuggagaccagaaccgagaccuggaugucauccgagggcgccuggaagcagauccagcgggucgagacgugggcccugcggcaccccggguucaccgugaucgcacuguuccucgcccacgcgaucggaaccucaaucacacaaaaggggaucaucuucauccuccugaugcuggugacuccguccauggccaugcggugcgucggcaucgggagucgcgacuuuguagaggggcucuccggggccaccuggguggacgucgugcuggagcacgggagcugcgugaccacgauggccaaggacaagcccacacuggauaucgaguugcugaaaacagaggucaccaaccccgcaguccugcggaagcucugcaucgaggcgaagaucucaaacaccacgacugauagccgcugcccuacucagggggaggccacccugguggaggagcaggacgcuaacuucgucugccggcguacguucguggaccgaggaugggggaacgggugugguuuguucggcaaggggucccuaaucacgugcgccaaguucaagugcgugaccaagcucgaggguaagaucguccaguaugagaaccugaaguacagcgugaucgugacgguccacacgggcgaccagcaucagguggggaacgaguccacugagcacgguacgacagccaccaucacgccccaagcgcccaccacagagauccagcucaccgacuacggagcucugacccuggacugcucaccccgcaccggccucgacuucaacgagauggucuuacugacaaugaaggagaaguccuggcucgugcacaagcaaugguuccuggacuugccccuccccuggaccagcggcgccagcacaucccaggaaacuuggaaccggcaggacuuacuggugaccuucaaaaccgcccacgccaagaaacaggagguaguggugcucggcagccaggagggcgccaugcacacagcccugaccggggccaccgagauccagaccuccggcacgaccaccaucuucgccgggcacuugaagugccgccucaagauggacaagcugacccuaaagggcaugagcuacguuaugugcaccgggucuuucaagcucgagaaggagguggccgagacccagcacggcaccguucugguucagaucaaauacgagggcaccgacgcgcccugcaagaucccauucucuacgcaggacgagaaaggggugacccagaacggccgacugaucaccgccaauccgaucgugaccgacaaggagaagccgguuaacaucgaggccgagccccccuucggggaguccuacaucgugaucggcgccggcgagaaagcgcugaaguuaagcugguucaagaagggguccagcaucggaaaaauguucgaggccacggcccgcggggcacgucgcauggccauccugggcgacacagcgugggacuucggguccaucggcggaguguuuaccagcgucgggaagcuggugcaccagauuuucggcacagcguacggggugcuguucagcggcgucagcuggacaaugaagaucgggaucggcgugcugcugaccuggcucggccugaacucccgcagcaccuccuugagcaugaccugcauagcugucggauuggucacgcuauaccugggcgugauggugcaggcggacagcgggugcgucaucaacuggaagggccgggagcucaaaugugggagcggcaucuucgugaccaacgaggugcacaccuggacggagcaguacaaguuccaggccgacagcccgaagcgauuguccgcggccaucggcaaagccugggaggagggggugugcggaauccggagcgccacccgccuggaaaacaucauguggaaacagaucuccaacgagcucaaccacauccugcuugagaacgacaugaaguuuacggugguaguuggggacguggccggcauacucgcgcaggggaagaaaaugauccggccccaacccauggaguacaaguacagcuggaaguccuggggcaaagcaaaaaucaucggcgcugauguacagaacaccacauuuauuaucgaugggccaaacacuccggagugccccgacgaccagcgcgccuggaacauaugggaggucgaggacuacggcuucgggaucuucacgaccaacaucugguugaagcugcgggacucauauacccaggugugugaucaccgccugauguccgcggccaucaaggacucuaaggccguucaugccgacaugggcuacuggaucgaguccgaaaagaacgagacguggaaguuagcucgcgccagcuucaucgaggucaagacgugcaucuggcccaagucccacacccuauggaguaacggcguacucgaguccgaaaugaucauccccaagaucuacgggggcccgaucucacagcacaacuaccggcccggguauuucacccaaaccgccggccccuggcaccuggggaagcuggaguuggacuucgaucugugcgagggcacgaccgugguaguggacgagcacugcggcaaccgggguccuucccuccgcaccaccacggugacuggcaagaucauccacgaguggugcugccguaguugcacacugccgccccuccgcuuccgcggggaggacggcuguugguacgggauggagauccgccccguaaaggaaaaggaggagaaucuggucaaguccauggugagcgccggaagcggcgaagucgauuccuucagccucggccugcuuugcauauccaucaugauagaggaagugaugcggagccgcuggucccggaaaaugcuaaugaccggcacguuggccguguucuuccugcuaauaauggggcagcugaccuggaacgacuugauccgccucugcauuauggucggcgccaacgcuagcgauagaauggggaugggcaccaccuaucuggccuuaauggccacguucaagaugcggccgauguuugccguaggccuccuguuccgccggcugaccucccgugaaguucuucuacugaccaucgggcucagccuagucgccuccguggaguugcccaacagcuuagaggaacugggggacgggcuggcgaugggcaucaugauccuuaaacugcuuaccgacuuccagucccaucagcucugggccacgcugcugagccucaccuucaucaagaccacguucucccugcacuacgccuggaagacgauggcgaugguccugagcaucgugucccuuuucccgcugugccuuagcaccaccucccagaagaccacguggcuccccgugcuucuaggcagccucggaugcaagccgcugaccauguuccugaucgcggaaaacaaaaucuggggccggcgcuccuggccccuuaacgaggggaucauggccgucggcauugugagcauucugcugagcucccuauugaagaacgacguaccucuggcggggccccucauugccggcggcaugcugaucgccugcuacgucaucagcggauccagcgcagaccugucccucgaaaaggccgccgaggugagcugggaagaggaagcugagcacuccggcgccagccacaacauccugguggagguacaggacgaugggaccaugaaaaucaaagacgaggaacgggaugacacccugaccauccuccugaaggcgacgcuacucgccguguccggcguguacccgcuaagcaucccagccacgcuguucguaugguacuuuuggcagaagaagaagcagcgauccggggugcucugggacacccccagcccgcccgagguggagcgggccguccuggacgauggcauuuaccguauaaugcagcggggccugcuagggcggucccaggugggcgucgggguguuucaagaaaacguauuccacaccauguggcacgugacgcggggcgcaguccucauguaccaggggaagcgcuuagagccuagcugggcguccgugaagaaggaccuuauuagcuacgggggaggguggcggcuccagggcuccuggaacaccggggaggagguccagguaauagccguggagccuggcaaaaaccccaaaaacgugcagaccgcccccgggaccuucaagacacccgagggggagguaggcgccaucgcccuggacuucaagcccgguaccaguggcucccccaucgugaacagggaggggaagaucgugggccuguacggaaacggugucgugaccacgagcggcacguaugugagcgcgaucgcccaggccaaagccucucaggaggggccgcucccggagaucgaggacgagguuuuccggaagcgcaaccugaccaucauggacuuacaccccgggucggggaagacccggcguuaccucccggcgaucgugcgagaggcaaucaagcgcaagcuccgcacccugauccucgcccccacgcggguggucgccuccgagauggccgaggcgcugaagggcaugcccauccgcuaccagaccaccgccgucaaguccgagcacacaggcaaggaaaucgucgaucugaugugucacgccacguuuaccaugcgucuccugucacccguccgcgucccgaacuacaacaugaucaucauggacgaggcucacuucaccgaccccagcuccaucgcggcgcgcggguacaucagcacacgcgucgguaugggggaggccgcagcuaucuucaugacggccacgccgcccggcuccgucgaggcguucccacagagcaacgccgugauacaggacgaggagcgggacauccccgaacgcuccuggaacagcggguaugaguggaucacggacuucccggguaagacugugugguucguccccagcaucaagagcggcaaugacaucgccaacugccuucggaaaaacgggaagcgcgugauacagcucucccggaagacauucgauacugaguaccagaagaccaagaacaacgacugggacuacguagucacuacggacaucagcgagaugggggccaacuuccgagcggaccgggugauugauccgcgccggugccugaaaccuguaauacugaaagacgggcccgaacgcgucauauuagcugggcccaugccggugaccgucgccuccgccgcgcaacggagggggcggaucggcaggaaucacaacaaagagggcgaucaguacaucuauauggggcagccccugaauaaugaugaggaccacgcgcacuggaccgaggcaaaaaugcugcucgacaacaucaacacccccgagggcaucauacccgcccuguuugagccggagcgcgagaaguccgcugcgaucgacggcgaguaccggcugcgcggcgaggcucggaagacguucguggagcucaugcgcagaggggaccuuccggugugguuguccuacaagguagccagcgagggcuuccaguacagugaccgccgguggugcuucgacggcgagcgcaacaaccagguucucgaggaaaauauggacguggagaucuggaccaaggagggagagaggaagaagcugcgccccagauggcuggaugcacgcaccuauuccgacccccucgccuugagagaguucaaggaauucgccgcgggccggcggucagucaguggggaccugauccuagagaucgggaaacugccgcagcaccugacacagcgagcccagaacgcucuagacaaucuggucaugcugcacaacagcgagcagggcgggagggccuaccgccacgcuauggaggagcucccagacacgaucgagacccugaugcuucucgcccugaucgcuguucucaccggcgggguaacccucuuuuuccuguccggaaggggucuaggcaagaccucuauuggccuccugugcgugauggcuuccagcguccugcuguggauggcuuccgucgaaccccauuggaucgcggcuagcaucaucuuggaguucuuccugaugguucuccucauccccgagccggaccgccagcggaccccccaggacaaucagcuggcauacguggucaucgggcuccuguuuaugauccugaccguggccgccaacgaaaugggccuccuugagaccaccaaaaaggaccuggggaucggccacguggcggucgaaaaccaccaccaugccgccaugcucgacguagaccugcaccccgccuccgccuggacgcuguacgcgguggccaccaccaucaucaccccgaugaugcgccacacgaucgaaaacaccaccgccaacaucagccugaccgccaucgccaaccaggcggccauacugauggggcuggacaagggcuggcccaucagcaagauggacaucggcgucccccuccuggcccuggggugcuacagccagguaaauccccucacgcuaaccgccgcugugcugaugcucgucgcccauuacgccaucaucggcccggggcugcaggccaaggccaccagagaagcgcagaagcggaccgccgccggcauuaugaagaaccccaccguggacgggaucguggcaaucgaccuggacccugucguuuacgacgccaaguucgagaagcagcucgggcagauaaugcugcugauccucugcacgucccagauccuucugaugcguaccaccugggcgcucugcgagagcaucacgcuggcaaccggcccccugaccacccucugggagggguccccgggcaaguucuggaacacgaccauagcggugagcauggccaacauauuccgggggaguuaccucgccggcgcuggccuggccuucagccucaugaaguccuuggggggcgggcgucgugggacuggagcccagggagaaacacugggcgagaaguggaagcggcaguuaaaccagcuguccaagagcgaguucaauacguacaagcguuccggaauaauggaagucgaccgcagcgaggccaaggagggccugaagcggggggagaccaccaagcaugcggugagccgcggcaccgccaagcuccggugguucguggagcgcaaccuggucaaacccgagggaaaggugaucgaccugggcugcggacgcgggggcuggagcuacuauugcgccgggcugaaaaaggugacggaagucaagggcuacaccaagggaggucccggccacgaagaacccaucccgauggcaaccuacggguggaacuuggugaaacugcacuccggcaaagacguauuuuucaucccccccgagaaaugcgacacccugcucugugacauuggggagagcucccccaacccgacgaucgaggagggccgcacccugcgcguucugaagaugguggagcccugguugcgcgggaaccaguucugcaucaagauccugaaucccuauaugcccagcguggucgagacacuugagcagaugcagcggaaacacggcggcaugcucgugcgcaauccgcugagucgaaacagcacccaugagauguacuggguguccugcgguaccggcaacaucgucagcgcugugaacaugacgucccgcaugcugcucaaccgcuucaccauggcccaccgcaagcccaccuacgagcgcgacguggaccucggugcgggcacccggcacgucgccguggagcccgaaguggcgaaccuggacauuaucggccagcgcaucgagaacaucaagcacgagcacaaaagcacguggcauuacgacgaggacaaccccuacaagaccugggccuaccacgguaguuacgaggugaagcccagcggcucggcgagcagcauggucaacggugucgugaagcugcugacgaagcccugggacgugauccccauggucacccagaucgccaugacugacaccaccccguucggccagcagcggguguucaaggagaaggucgauacacgcacgccgaaggcuaaaagagggaccgcccagauaauggagguaacugccaaguggcuguggggcuuccucucacggaacaagaagcccaggaucugcacgcgcgaagaguucacgcggaaggugcgcagcaacgcagccaucggcgccguguuugucgacgagaaccaguggaacuccgccaaggaggcugucgaggacgagcgguucugggaccugguccaccgcgagcgggagcugcacaagcaggggaagugugccaccugcguuuacaauaugaugggcaaacgcgagaagaagcucggggaguuugguaaagcgaaggggagccgggccauaugguacauguggcugggcgcgcgcuuccuggaguucgaggcgcucggcuucaugaacgaagaucacugguucucccgggagaauagcuuguccggcguggagggcgaggggcugcacaagcugggcuauauccugcgcgacauaagcaagauaccagggggcaacauguacgccgacgacaccgccgguugggacacacgaaucacggaggacgaucugcagaaugaggcccgcaucaccgauaucauggagccggagcacgcccuccuggcgcguuccaucuucaaacugaccuaccagaacaaggugguccgcgugcagcgucccgccaagaacgggaccgugauggacgucauuagccggcgcgaucagcggggcuccggccagguagggacauacggucucaacaccuuuacaaacauggaggcccaacugauccgccagauggagagcgaggggaucuucagucccucagaacuggagacccccaaccuagccgagcgggugcuggacuggcuggagaaguauggcguggagcgccucaaacggauggcgaucuccggugaugacugcguggugaagccaaucgacgaccgcuuugcgacggcccugacggcccugaacgacaugggaaagguccggaaggacaucccccagugggagcccagcaagggguggaacgacuggcagcaggucccguucugcucccaccacuuccaccaacucaucaugaaggacggcagagaaaucguggucccgugcaggaaccaggacgagcuggugggccgugcccgggugagccagggggcaggcuggagcuuacgcgaaaccgcgugccucgguaaguccuacgcccagauguggcaguuaauguacuuccaccggcgcgaccugcggcucgcggccaacgcgaucugcagugccguccccguggauuggauucccacgucccgcacgaccuggagcauccacgcccaccaccaguggaugaccaccgaggacaugcuguccguguggaaccgggucuggauagaggaaaaccccuggauggaggauaagacccacauaucauccuggggcgacgugccuuaccuggggaagcgagaggaccagugguguggcagucucaucgggcugaccgcccgcgccaccugggcgaccaacauccagguggccaucaaccagguccggagacucaucgggaacgagaacuaccucgacuacaugacguccaugaagcgguucaagaacgagagcgaccccgagggcgcccugugguga

SEQ ID NO: 24109 - RNA, 9879 nt, Artificial Sequence
  derived and/or modified CDS sequence (opt11) from DENV-1__EU677172__SS-prME
agcgugaccaugcugcugaugcugaugcccaccgcccuggccuuccaccucaccaccaggggcggugagccccauaugaucgugagcaagcaggaacggggcaagagccugcuguucaaaacaagcgccggggucaacauguguacacucaucgccauggaccugggcgagcugugcgaggacacuaugaccuacaagugcccccgaaucaccgagaccgagcccgacgacgucgacugcuggugcaaugcaaccgacaccugggugaccuacgggaccugcagccaaacuggggaacaucgacgggacaagcggucuguggcccucgcgccucacgugggccugggccuggagacccgcaccgaaaccuggaugagcagcgaaggcgcuuggaaacagauacaacgggucgagacgugggcccuccggcaucccggguuuaccgugauagcacuauucuuggcccacgcgaucggcacgucaauaacccaaaaggggauaaucuucauucuccucaugcuggucacgcccuccauggcgaugcggugugucggcaucgggucgcgcgacuuuguggaggggcucuccggcgccacaugggucgacgucgugcuggagcacggcucuugcgugaccacuauggccaaggauaagccaacucuggacaucgaguugcugaaaaccgaggucacuaaucccgcggugcugcgaaaauugugcaucgaggcgaaaaucagcaacacaacgacggacagccgcugccccacccagggcgaggccacccugguggaggaacaggacgccaauuucguuugucggcgcacguucgucgaccggggcuggggcaacggcugugggcuguucggcaaagggucucuuaucacgugugcuaaguucaagugcgugaccaagcuggagggcaagaucguucaguacgagaacuuaaaguauucaguuaucgugaccguccacacgggcgaccagcaccagguagggaacgagucuaccgagcacggcaccaccgccacuaucacgccccaggcgccuaccaccgagauccagcucaccgacuauggcgcccugacacuggauuguagcccgcgcaccggccucgauuucaacgagaugguucugcugacgaugaaggagaaguccuggcucguucacaagcaaugguucuuagaccugccccucccguggacgucgggggcaagcacgucacaggaaaccuggaacaggcaggaccugcuggucaccuucaagaccgcccacgcuaagaagcaagagguugugguguuaggcucucaggagggugcuaugcacacugcguuaaccggggccaccgagauccaaacguccggcacgacuaccaucuucgccgggcaccuuaagugccgucucaagauggacaaacuuacccugaaggguaugagcuaugucaugugcacgggauccuucaaguuagagaaagagcucgccgagacccaacacggcacgguucuggugcagaucaaguacgagggaaccgacgcgcccuguaagauccccuucuccacgcaagacgagaagggggucacccagaacggccggcuaaucacggcuaacccgauugugaccgacaaggagaagccagucaacaucgaggccgagccgccauuuggggaguccuacaucgucaucggggcgggcgagaaggcuuuaaaguugagcugguucaagaaagggucaagcaucggcaagauguucgaggcgacggcccgcggggcccgucgcauggcgauccugggggauacagcaugggacuucgggucaaucggcgguguguucacuagcguggggaaacucguccaccagauuuucgggacugccuacgggguacucuucucuggcgugagcuggacgaugaagaucggcaucggcguccuguugaccuggcugggccugaacucccgcagcacuucccucuccaugaccugcaucgccguaggauuggugacgcuuuaccucggcgucauggugcaagcugauuccggaugcgugauuaacuggaagggccgggagcugaagugcgggagcggcaucuucguuaccaacgaaguacacacauggaccgaacaguacaaguuccaggccgacucuccgaaacgccuauccgcggccaucggcaaggccugggaggagggggugugcgguauccggagcgccacccgacucgaaaauaucauguggaagcaaaucuccaacgaguuaaaucacauccuacucgaaaaugacaugaaguucacggucguggugggggaugucgccggcauucuggcccaagguaagaaaaugauccggccccagccuauggaguacaaguacagcuggaaguccugggggaaggccaagaucaucggcgcagacgcccagaauacgaccuucauuauagacgggcccaacacccccgagugccccgaugaccagcgcgccuggaauaucugggagguugaggacuacggcuuugggaucuucacuaccaacaucuggcuaaagcugcgggacagcuauacccagguaugcgaccaccgccugauguccgccgccaucaaggacagcaaagcuguccacgccgacaugggcuacuggaucgaaucggagaagaacgagacauggaagcucgcgcgggcuuccuucaucgaagugaaaaccugcauauggcccaagucccacacccucuggagcaacggcgugcucgaguccgagaugaucauaccgaaaauauacgguggcccgaucagccagcauaacuaccgccccggguacuucacccaaacagccggccccuggcaucuggggaaauuggagcuggacuucgaccuuugcgaggguacuacgguggugguggacgagcauugcggaaaccgggggccgucccuccgcaccacaacggucaccggcaagaucauucaugaguggugcugcagaagcugcacccugccgcccuugcgcuucagaggggaagauggcugcugguacgggauggagauacgccccguaaaggagaaggaagagaaccuugugaaguccaugguaagcgccggcagcggcgagguggacuccuucucucuggggcugcucugcaucuccauaaugaucgaggaggugaugcgguccagguggucaagaaagaugcugaugaccgggacgcuggccgucuucuucuugcuaacaaugggucaacugaccuggaacgaccucauccgccuguguaucauggugggugcgaacgccagcgaucgcaugggaaugggcaccaccuaccuggcacucauggccaccuucaagaugcggcccauguuugccgugggccuuuuguuccgccggcucaccucccgagagguccuccugcucacgaucggacugagccuggucgcgucuguggagcuccccaacucucuggaggagcugggcgacgggcuggccaugggcaucaugauccugaagcugcucacggacuuccaaucccaccagcugugggccaccuuacucagccugacguucauaaagaccacuuucucccugcacuacgccuggaagacaauggcaaugguccucucaaucguguccuuguuccccuugugccucucgaccaccucacagaaaacgacauggcuuccaguccugcucgguagccuggggugcaaaccgcugacuauguucuugaucgccgagaacaagaucuggggccgucgcucuuggccccugaacgaagggaucauggcaguuggcaucgugucuauccuguuaucuucccuccugaaaaaugacgucccgcucgcugggcccuuaaucgcgggcggcaugcugauugcgugcuacguaaucucagggucgagcgccgaccuuucccuggagaaagccgcagaggugucgugggaggaggaggcugagcauuccggcgcgagucauaacauccuugucgaaguacaggacgaugggaccaugaagaucaaggacgaggagcgggacgacacguuaacgauccugcucaaggccacccucuuagccguguccggcgucuacccgcugagcauccccgccacccuuuucguaugguacuucuggcagaagaagaaacagcgcuccgggguccugugggacacuccgaguccgccugagguggaacgggcggugcuagacgacggcaucuaccgcaucaugcagcgggggcugcuagggcgaucccaggugggcguaggaguguuccaggaaaacguguuccacacgauguggcauguaacucguggcgccguccugauguaccagggcaaacgucuggaacccucaugggcuuccgugaagaaggacuuaauuucguaugggggcggguggcgacuucagggguccuggaacaccggggaggagguccaggugauugcgguggagccaggaaagaacccuaagaacguccagaccgccccggggacuuucaagacuccugagggcgaggugggggccaucgcgcuggacuucaagccagguaccucugguuccccuauagugaaccgcgaaggaaaaaucgucggccucuacgguaaugggguagugacgacgagcggcaccuauguaagugcgauugcccaggccaaggcaucccaagaaggaccccuacccgagaucgaggacgagguguuccguaagcgcaaccugaccaucauggaucuccaccccggaagcgggaaaacccgccgguaccugccagccaucgugcgcgaggccauuaaacgcaagcugcgcacgcucauccuugcccccaccagagucguggccuccgagauggcggaggcccugaagggaaugccaauccgcuaucagacaaccgcugucaagagcgagcacacagguaaggagaucguagaccucaugugccaugcgaccuucacgaugcgccugcugagccccgugcgagugccgaacuacaauaugaucaucauggacgaagcccauuuuacggaccccagcuccaucgcggcacggggcuacaucagcacgcguguuggcaugggagaggccgccgccaucuucaugaccgcgacgccgccaggguccguggaggccuucccgcagagcaaugccguuauccaggacgaggagcgggacauucccgagcgcuccuggaauagcggguaugaguggaucacagacuuccccggcaagacggucugguucgugccauccaucaagagcgggaaugacauagcuaacuguuugagaaagaacgggaagcgcgugauccagcugucccggaagaccuucgacaccgaguaccagaagaccaagaacaacgacugggacuacgucgugacgaccgauaucagcgaaaugggcgcgaacuuccgcgccgaucggguaauugacccgcgccggugucugaagcccgucauccucaaagacgggcccgaaagggugauccuagccggcccaaugccagugacgguugccuccgccgcgcaacggcgcgggcggaucgggaggaaccacaacaaagagggcgaccaguauaucuacauggggcagccccucaauaacgacgaggaccaugcccacuggacagaggcgaagaugcucuuggauaacaucaacacgcccgaaggcaucauccccgcccuguucgagccggagcgcgaaaaauccgccgcgaucgacggugaguaccgccuccguggcgaggcccggaaaacauucguagagcugaugcgccgcggggaccugcccgucuggcucuccuacaagguggccagcgaaggguuccaguacagcgaccgccgguggugcuucgauggcgagcgcaacaaccagguacuggaagagaauauggacgucgagaucuggaccaaggagggggagcggaaaaagcugcgcccgcgguggcuggacgcccgcaccuacuccgacccguuggcccugcgggaguuuaaggaguucgcugccggacgccggagcgugucgggggaccucauacuggagaucggaaagcugccgcaacaccucacgcagcgcgcgcagaacgcccuugacaaucuggugaugcuccacaacuccgagcagggcgggcgggcguaccgccacgccauggaggagcugcccgacaccauugagacuuuaaugcuccuggcccugaucgccguccucaccggagggguuacgcuguucuuucuguccggccgggggcucggcaagacgaguaucggccuucugugcgugauggccucaagcguccuccuauggauggcguccguggagccccacuggaucgccgccagcaucauccuagaguucuucuuaaugguucugcugauccccgagccggaccgucaaagaacgccccaggacaaccagcucgccuauguagugaucgggcugcuguucaugauccucaccguggcagcgaacgagaugggcuugcuggagacgacgaagaaggaccucgggaucggccacguagcuguggagaaccaccaccacgccgcgaugcuggacguggaccugcaccccgccagugcguggacccucuacgccguugccacgacgaucaucacgccgaugaugcgccauaccaucgagaacaccaccgccaacauaagccucacugccauugcgaaccaggccgccauucuuaugggguuggauaagggauggcccaucagcaagauggacauuggcgugccccugcuggccuuggguugcuacagccaagugaacccccugaccuuaaccgccgcgguccucauguuaguggcccacuacgccaucaucggcccggggcugcaggccaaggcgacacgcgaagcccagaagcggacugccgccggcaucaugaagaaccccacaguggacgggaucgucgccaucgaucucgaccccgugguguacgacgcuaaguucgagaagcagcugggccagaucaugcugcuaauacugugcaccucccagauacugcucaugaggaccacgugggcacugugcgaaagcauaacccuggccaccggcccccucaccacgcugugggaagggucaccggggaaguucuggaauaccaccauagccgucucuauggccaacaucuuucggggauccuaccuggcgggcgccggccuggccuucagccugaugaaguccuuagggggcgggcgccguggcaccggggcccagggcgagacgcucggcgagaaguggaagcgccagcugaaccagcuuuccaaaucagaguucaacacguacaagcggucaggaaucauggagguggaccgaagcgaggcgaaggagggccucaagcgcggggagaccacaaaacacgcggugucccggggcacggccaaguuacgcugguuugucgaacgcaaccuggugaaaccagaggggaaggugauugaccugggcugcggccgcgggggcuggaguuauuacugcgccgggcucaagaaaguaaccgagguaaagggcuacacaaagggcggcccaggccacgaggaacccaucccuauggccaccuacggguggaaucuggucaagcugcauuccggcaaggaugucuucuucaucccgcccgagaaaugcgacacccuccugugugacaucggggagaguucucccaacccgaccaucgaagagggucgcacccugcggguacuaaagaugguagagccguggcugagagggaaccaguucuguaucaagauccugaaccccuacaugccgagcguaguggagacccuggagcagaugcagcggaagcacggcggaaugcugguacgcaacccgcugucccggaacaguacacacgagauguacugggugucgugcgggacgggcaauaucgucagcgcggugaacaugaccucccggaugcuacugaaccgcuucaccauggcgcaccggaagcccacguacgagcgcgacgucgaccugggcgcaggcacgcggcacguggcagucgagcccgaggucgccaaccucgauaucaucggccagcgcauugagaacauaaagcacgagcauaaaagcaccuggcacuacgacgaggacaaccccuacaagaccugggcuuaccauggcuccuacgaggugaaaccgucagggucagccagcagcauggugaauggagucgucaagcuguuaaccaaacccugggacguuauaccuauggucacgcagaucgccaugaccgacacuaccccuuucggccagcagcggguguucaaggagaaggucgacacacgcaccccgaaagccaagcgggggaccgcgcagaucauggaggugaccgcgaaguggcucuggggcuuccugucccguaacaagaagccccggaucugcaccagagaagaguucacacgcaaggugcgcagcaacgcggcuauuggcgccguauucguagacgagaaucaguggaacuccgcgaaggaggccguggaggaugaacgguucugggaccuuguccaccgcgagcgcgagcuccacaagcaaggcaagugugcgacuugcguguacaacaugaugggcaagcgcgagaagaagcugggggaguucggcaaggccaaggggagccgggccauuugguacauguggcugggcgcgcgcuuucucgaguuugaagccuuaggguucaugaaugaggaucacugguucucccgcgagaauagcuuguccgggguggagggugaggggcuccacaaacugggcuacauccuccgcgacaucucgaagaucccuggagggaauauguacgcugacgacaccgccggcugggacacgcgaauaaccgaggacgaccuccagaacgaggcccgaaucaccgauaucauggagcccgagcacgcgcugcuggccaagucgaucuucaagcugaccuaucaaaauaagguugugcgcgugcaacggcccgcaaagaacgggacugugauggacgugaucagccgccgggaccagcgcggguccggccagguggggacguacggucugaauaccuucaccaacauggaggcccaauugauccggcagauggaaagcgaaggaaucuucagccccagugagcuagagacgcccaaccucgcggagaggguccuggauuggcuagaaaaguacggcguagagcggcucaagcggauggcaaucuccggggacgacugcguggucaaaccgaucgacgaucgguucgccaccgcccugacagcccucaaugacaugggcaaggugcgcaaggacauaccacagugggagccaaguaagggguggaacgauuggcagcaaguuccuuucugcagccaccacuuccaccaacugauuaugaaggacggacgagagauagucgugccgugucgcaaccaggacgagcuagugggccgggcgcgcgucagccagggggccggcuggagccuccgggagaccgccugccuggggaaauccuaugcccagauguggcagcugauguacuuccaucgccgggaucuccgucuugccgcgaaugcuaucugcagugccgugccgguggauuggauccccacgagccguaccaccuggagcauccaugcccaccaucaguggaugaccaccgaggauaugcucucugucuggaaccgcguguggauugaggagaaccccuggauggaggacaagacccauaucagcuccuggggcgacguuccguaccucgggaagcgagaggaccaguggugcggcagccugaucggacugaccgcccgcgcgaccugggccacgaacauccaagucgccaucaaucaggugagacggcucaucgggaacgagaacuaccuggacuacaugacauccaugaagcgauuuaagaaugagagcgaucccgaaggcgcccugugguga

SEQ ID NO: 24110 - RNA, 9879 nt, Artificial Sequence
  derived and/or modified CDS sequence (opt11) from DENV-1__EU677173__SS-prME
agcgugaccaugcugcucaugcuaaugcccaccgcccuugccuuccaccucaccacacggggcggggagccccacaugaucgucaccaagcaagagcggggcaaaagccugcuguuuaagaccagcgcgggaguaaacaugugcacccucauugccauggaccugggggaguugugcgaagauaccaugaccuacaagugcccccggaucaccgaagccgagcccgacgacguugacugcuggugcaacgccaccgacaccugggugacauacgggaccugcucccaaacgggcgagcaccggcgcgacaagagaagcgucgcccucgccccucacgugggccuggggcuggaaacgcgcacggagaccuggauguccagcgagggcgccuggaaacagauccagcgcguugagacaugggcccuccggcaccccggguucaccgugaucgcccuauuccuugcgcacgccaucggcaccuccaucacucagaaagggaucauauucauucuccugaugcuggugacgccaucaauggccaugaggugugucgguaucggcucacgcgacuucguggaggggcucagcggcgccacauggguggacgucgugcuggagcacgggagcugcgugaccacgauggccaaagacaagccuacgcuggacaucgagcucuugaagaccgaaguaaccaaccccgcuguucugcgaaagcugugcaucgaagcuaaaaucagcaacacuacgacagauucacgcugucccacccaaggcgaggccacccugauggaggagcaggaugccaacuucguaugccggcgcacguucguugaccggggcugggggaacggcugcggucuauuuggcaaggggagccuuaucacgugcgcuaaguucaagugcguuacgaagcuggagggcaagaucgugcaguacgagaaccugaaguacuccgucaucgugaccgugcacacuggcgaccagcaccaggucgggaacgagagcaccgaacacgggaccaccgcaaccauuacgccccaggcgcccaccuccgagauccagcucaccgacuacggggcccugacacuggacuguagcccccgcacgggccucgacuuuaacgagauggugcugcugacuaugaaggagaaguccuggcucguccacaagcagugguuucuggaccugccgcucccuuggaccagcggggccaccacaagccaggagaccuggaaccggcaggacuuacugguuaccuucaagaccgcccacgcgaagaagcaagagguagucgugcucggcucccaggagggcgcaaugcacaccgcgcugaccggggcuacugagauccagaccagcggaacuaccaccaucuuugccgggcaucugaagugccgccucaagauggacaagcugacccugaagggcauguccuacgucauguguacggguagcuucaagcucgagaaggagguagcggaaacccaacacggaacgguacugguacagaucaaguacgaagguaccgacgcuccguguaagauaccguucuccacgcaggacgaaaagggggucacccagaauggccggcugauuaccgccaacccgaucgugacagacaaggagaagccugugaacaucgaggccgagccgcccuucggggagagcuacaucgugaucggcgcgggggagaaggcacugaaguuauccugguucaagaaggggagcuccaucggcaagauguucgaggccacggcccggggggcgcgucgcauggcgauccucggcgacacugccugggacuucggcagcaucggcggcgucuucacguccguggggaagcugguccaccagaucuuuggcaccgccuaugggguccuguuuagcggcguguccuggacaaugaagaucgggaucggcgucuuacuuaccuggcucggccugaauagccgcuccaccagccuguccaugaccuguaucgccguggggcucgugacgcuguaccugggugucaugguccaggccgauagcggaugcguuauaaacuggaagggccgggagcucaagugcgggagcggcaucuucgucaccaaugaggugcacaccuggaccgagcaauacaaguuccaggcggacagcccgaagcgauugucggccgccauugguaaggccugggaggagggugugugcggcauccgauccgccacucgccuggagaauauaauguggaagcagauuagcaacgagcucaaccacauccugcuggagaacgacaugaaguucacgguaguggugggcgacgucgugggaauccucgcucaagggaagaagaugauccgaccucagccaauggaacacaaauacuccuggaaguccuggggcaaggccaagaucaucggcgccgacgugcagaauaccaccuucauuauugaugggcccaacaccccggagugcccggacgaccagcgcgccuggaacaucugggaggucgaggauuacggguucgggauauuuacgaccaacauuuggcuuaagcuccgggacuccuacacccaaaugugcgaccaccgccucaugagcgcggcuaucaaagacuccaaggcgguacacgccgacaugggcuacuggauagagagcgaaaagaacgagaccuggaaguuagcccgugcgagcuucaucgaggugaagacgugcaucuggcccaagagccacacccuguggucaaacggcguccucgagagcgagaugaucauacccaagaucuacgggggcccgaucucccagcacaauuacaggcccggguacuucacccagacggccggccccuggcacuugggaaagcuggagcucgacuucgaucugugcgagggcacgaccguugugguggaugagcauuguggcaaccggggcccgagccugcgcaccaccacggucaccggcaagaucauccacgaguggugcugucggucaugcacccugccgccccuccgguuuaagggggaggacgguugcugguaugggauggagauucggcccgugaaggagaaggaggagaaccuggucaagagcaugguguccgccgggagcggcgagguggacucuuucuccuuaggucuguuaugcaucagcaucaugauagaggaggucaugagauccagauggagccgcaaaaugcucaugaccgguacucuggccguguuccuccuccugauuauggggcagcuaaccuggaacgaccucauccggcugugcaucauggugggggccaacgccuccgaccgcauggggauggggaccaccuaccuggcccucauggcgaccuuuaagaugcgcccuauguucgccgucggccugcuguuccggcgccucaccagccgggagguccugcugcucaccaucggccugucccugguugccuccgucgaguugccaaacagucuggaagagcugggcgacgggcucgcuauggguaucaugaucuuaaagcugcucaccgacuuccagagccaucagcugugggcaacacuccucucacugaccuuuauuaagaccaccuuaagccuccauuacgccuggaagacuauggccauggugcuguccaucgucagccuguucccccucugccuguccacuacgagccagaagaccacguggcugcccguacuccugggcucccuggggugcaagccacucaccauguuccugaucaccgagaacaagauuuggggccgaaagagcuggccccugaaugaggggaucauggcggugggcgucguguccauccuccugagcucuuugcucaagaaugaugugcccuuggcugggccccugaucgccggcggcaugcucaucgccugcuacgucaucuccggcagcuccgccgaucugagccuggaaaaggcggccgaggucuccugggaggaggaagccgagcacagcggcgccucccacaacauacucguggagguucaagacgacgggaccaugaaaauaaaggacgaagaacgggacgacacccucacgauccugcucaaagccacccuguuggcgguuagcggcguguacccgcucuccauccccgccacccuuuuuguuugguauuuuuggcagaagaagaaacagcgcucuggggugcuuugggacacucccagcccccccgagguggagcgggccguccuggaugacggcaucuacaggaucaugcagagagggcuccucgggcgcagccaggugggcgugggaguuuuccaggagaacguauuccacacgauguggcaugugacccggggcgcuguccugauguaucaggggaagcgccucgagcccuccugggccagcgugaagaaggaccugauauccuacggcggcggguggagguugcagggcagcuggaaugcgggggaggaggugcaggucaucgcgguggagcccggcaagaaccccaagaacgugcagaccgccccgggcaccuucaagacgcccgagggcgaggucggcgcaaucgcccucgacuucaagccgggaacuuccggcucucccaucguaaaucgcgaggggaagaucguggggcuguacggcaacggggucgugaccacuuccggaacguacguaagcgcgaucgcccaggccaaggcuagccaggaggggccccugcccgaaaucgaggacgaggucuuccggaagcgcaacuugacaauuauggaccugcacccuggcucagggaagacacgccgcuaucugccggcgauagugagagaggccaucaaacgcaaguuacggaccuugauauuggccccuacgcgcguggucgccagcgagauggccgaggcccucaagggcaugcccauccgauaccagaccaccgccgugaaguccgagcacaccggcaaggagaucguggaccugaugugccaugccacguucacgaugcggcuucugagccccguucgcgugccgaacuacaauaugaucaucauggacgaggcccacuucaccgacccauccagcauagccgcgcguggguacaucucgacgcgcgugggcaugggagaggccgccgccaucuucaugacggccacgccgcccggaucggucgaggcguucccacagagcaacgccgugauccaggacgaagagcgagacauccccgagcgcagcuggaauagcggguaugaguggaucaccgacuuucccggaaaaacagugugguuugucccgagcaucaagagcggcaacgauaucgcuaauugccuucggaagaacgggaagcgcgucauccagcugagccgcaagacguucgacaccgaguaccagaagacaaaaaacaacgacugggacuacguggucaccacggacauauccgagaugggcgccaacuuccgagcggacagagugauugacccgcgcagaugccuuaagcccgugauccugaaggacgggccagagcgggucauccuggccggccccaugcccgugaccgucgccagcgcggcccagcggcgcgggaggauaggcaggaaccauaauaaggagggcgaccaguacauauacauggggcagccgcucaacaacgacgaggaccaugcgcacuggaccgaggccaagaugcuacuugacaacaucaacaccccggaggguaucaucccugcucucuucgagccggagcgggagaaguccgccgccaucgauggggaguacagauugcgcggcgaggcgcggaagacuuucguggagcuaaugcgccgcggugaccugcccguguggcucagcuacaagguggccuccgaggguuuccaguacagcgaccgccggugguguuucgacggcgagcgcaacaaccagguguuggaggagaacauggauguggagaucuggacaaaggagggggagcggaagaaguugaggccccgauggcuggacgcccgcaccuacagcgacccccuggcccuccgggaguucaaggaauucgccgcggguagacgguccguuaguggggaucugauuuuggagaucggcaaacucccucagcaccugacccagcgcgcccagaacgcccuggauaaccuggugaugcugcacaauuccgagcagggcggucgggccuaccgccacgcgauggaagagcuacccgacacaaucgagacccucaugcugcuggcccugaucgccgugcugaccggcggggucacccuguucuuccucagcgggcgggggcugggcaaaaccucuaucggccuccucugcgugauggccagcuccguacugcuauggauggccagcgucgagccccacuggaucgcugccuccaucauccuagaguucuuccugauggugcuguugauccccgagccggaccgccagcggacgccccaggacaaccagcuggccuacgugguaaucgggcuccucuucaugauccugaccguggccgccaacgaaauggggcugcucgagaccaccaagaaggaccuggggaucggucacguggcggucgagaaccaccaccacgcgacgaugcuggacguggaccuccacccggccucugcauggacccuguacgcaguggcgacuaccaucaucacgccaaugaugcgccacacgaucgagaacacgaccgccaacauuuccuuaacggccaucgccaaccaggccgcgauccucauggggcucgauaagggguggcccauaagcaagauggacaucggcgucccccugcucgcucuugggugcuacagccaggugaacccucuaacucuaaccgccgcagugcugaugcugguggcacacuacgccaucauugguccggggcuccaggccaaggccacgcgggaggcccagaagcgcacagcagccggcaucaugaagaaccccaccguggacgggauuguggcuaucgaccuggaucccguaguguacgacgccaaguuugagaagcaacugggccagaucaugcuccuaauccugugcacgagucaaauccuccuaaugcgcacuacgugggcauuaugcgaguccaucacgcucgcgaccggcccacuaaccacucugugggaggggagcccgggcaaguucuggaacaccaccaucgccgucucgauggccaacaucuuucggggcuccuaccucgcuggcgccggguuggcuuucagccuuaugaaauccuuggggggcgggcgccgggggaccggagcccagggcgagacgcugggcgagaaguggaaacgccagcugaaccagcucagcaaauccgaauucaacaucuauaagcggagcgggauaauggagguggaccgcucugaggccaaggagggccugaagaggggcgagaccacccggcacgccgugucacgcggcaccgcgaagcuucgcugguucguggaacguaaccuggucaagcccgaggggaaggugaucgaccucgguuguggccggggaggcugguccuacuauugugccggguuaaagaaagugacggaggucaagggguacaccaaaggcgggcccgggcacgaggagcccaucccgauggccacuuacggguggaaccuggugaagcuucacuccggcaaagacguguucuuuacuccccccgagaagugugacacgcugcugugugacaucggagaguccagccccaacccgaccaucgaagagggccggacccuccgcguccugaagaugguggagcccuggcugcggggcaaucaauucuguaucaagauccucaaccccuauaugcccuccgugguagagacacuggaacagaugcagaggaaguacggcggcaugcugguuagaaacccgcucagccgcaacucgacccaugagauguacuggguuagcugcgggaccggcaacaucgucucggccguaaauaugacuucccggaugcuguuaaaccguuucaccauggcccaccgcaagcccacuuacgaacgggacguggaccucggggcgggcaccaggcacgucgccguggagcccgagguugccaaccuggacaucaucgggcaacggauugagaacaucaagcacgagcacaaguccacuuggcacuacgacgaggacaaccccuacaaaaccugggccuaccacgggagcuaugaaguuaagccgagugggagcgccuccuccauggugaacggggucgugaaacuguuaaccaagccuugggacgugauccccauggucacccagauagcgaugaccgacaccacucccuuuggccagcaacgcgucuucaaggagaaagucgauacgcggaccccgaaggcgaaacgcgggaccgcccaaaucauggaggucaccgccagguggcuguggggcuuccugagccgcaacaagaagccccggaucugcacucgcgaggaguuuacgcggaaggugagguccaaugccgcgauuggcgcaguguucgucgacgagaaccaguggaacagcgcuaaggaagccguggaggacgaacgguucugggaccucgugcagaaggagcgcgagcugcauaagcaggggaaaugcgcgaccugcguguacaacaugaugggcaagcgggagaagaagcugggggaauucggcaaggccaagggcucccgcgccaucugguacauguggcucggggcccgguuccuggaguucgaggcccugggcuucaugaacgaggaccacugguucagccgcgagaacucccugagcggaguggaaggcgaggggcugcacaaacugggcuacauucuccgggacauauccaagauccccgggggcaauauguacgcggacgacaccgccgguugggacacgcgcaucaccgaggaugaccugcaaaacgaggccaagauuacagacaucauggaaccggagcacgcccuucucgccaccagcaucuucaagcugacguaccagaacaaggugguacgggugcagcgaccagcgaaaaacgggaccgugauggacgucaucucucgccgggaccaacgcggcagcggucaagugggcaccuacggccugaacaccuucacgaacauggaggcccagcucauccgucagauggaguccgaagggaucuucuuacccagcgaacuggagaccccgaaccucgccgaacgcgugcuugacuggcuggagaaguacggcgucgagcgacucaagcgcauggccaucuccggggacgacugcgugguaaagccgaucgacgaucgguucgccaccgcacugaccgccuuaaacgacaugggcaaaguccgcaaagacaucccccaaugggagcccucaaagggguggaaugacuggcaacagguccccuucugcucccaccacuuccaccaguuaaucaugaaagacggccgagagauuguggucccgugccguaaccaggacgaguuaguaggccgggcccgggugagccagggcgccggcuggucccuucgggagacggccugccuuggcaagagcuaugcgcagauguggcaacugauguacuuccaccgccgggaccugcgccucgccgcgaacgccaucugcucggccguccccguggauugggugcccaccucccggaccaccuggagcauccacgcacaucaccaguggaugacgaccgaggacaugcuguccgucuggaaccgcguguggauugaggagaaccccuggauggaagacaagacccacgugagcucuuggggcgauguacccuacuuaggaaaacgggaggaccaguggugcggcagccuuaucggucugacagcgcgagcaaccugggccuccaacauccagguggcgaucaaccaggugcgccggcugaucgggaacgagaacuaccucgacuacaugacgagcaugaagcgcuucaaaaacgagggugaccccgagggcgcccugugguga

SEQ ID NO: 24111 - RNA, 9879 nt, Artificial Sequence
  derived and/or modified CDS sequence (opt11) from DENV-1__EU726779__SS-prME
uccgugaccaugcuucucauguuaaugccuaccgcccuggcuuuccaucucaccaccagggguggggaaccccacaugaucguaagcaagcaggaacggggcaagucucugcuguucaagaccagcgcuggggugaacaugugcacucugaucgccauggauuugggggaacucugcgaagacacgaugaccuacaaaugcccacggaucaccgagacugaacccgacgacguugauugcuggugcaacgccaccgacaccuggguaaccuacgggaccugcucccaaacgggugagcacaggcgcgacaagagguccguagcccuagcgccccacgugggccucggguuagagacccgcaccgagacguggaugagcuccgagggggccuggaagcagauacagcggguagagaccugggcccuucgccaccccggcuucaccgugauugcccucuuccuggcgcacgcaaucgguaccagcaucacacagaaggggaucauuuucauccuccugaugcugguuacucccuccauggccaugcgguguguggguauuggcagccgugacuucguugaggggcucuccggcgcaaccuggguggacguaguacuggagcacggguccugcguuaccaccauggccaaggacaaaccaacgcucgauaucgagcuccucaagaccgagguaaccaaccccgccgugcuucguaagcucugcauagaagcgaaaauuuccaauaccacgacggacagccgcugcccaacccaaggcgaggcaacccuggucgaggagcaggacgccaacuucgugugccggaggacguuugucgaccgcggcugggggaacggcugcgggcucuuugggaaggggucccucaucacgugcgccaaguucaaaugcguuaccaagcuggagggcaaaaucguacaguacgagaacuugaaauacagcgucauugugaccguccacacgggcgaucagcaccaaguggggaacgaauccacagagcacggcaccacugccaccaucacgccccaggcgcccaccaccgagauccaauugaccgacuacggagcccuuacucuggauuguagcccccguacgggccucgacuuuaacgaaaugguccugcugaccaugaaggagaaaucguggcuugugcacaaacaaugguuccucgaccugccccucccuuggaccucaggggcguccacgucccaggagaccuggaaccgucaagaccugcuugugaccuuuaagaccgcgcaugccaagaaacaagaggucguggugcucggaagccaggagggugccaugcauacggcccugacgggcgcuaccgagauccaaaccucuggcacgaccaccauauucgcagggcaucugaagugccgguugaagauggacaagcugacucugaagggcaugagcuacgugaugugcacugggucuuucaaacuugagaaggaaguggccgaaacccagcacggcaccgugcugguucagaucaaguacgaggggacugaugcaccuugcaagaucccauucagcacgcaggacgaaaaggggguaacccagaacggacgcuugaucaccgcuaacccaauaguaaccgauaaagagaagcccgucaauaucgaggccgaaccgccuuucggcgaaucguacaucgugauuggugcgggagagaaggcucugaagcucagcugguuuaagaaagggagcagcaucggcaagauguucgaggcuacagccagaggggcucggcgcauggcaauacugggagacacugcaugggacuucgggucuaucggcggaguguucaccucggucgggaaacugguccaccaaauauuugggacagcuuacggagucuuauucuccggcguuagcuggacgaugaagaucgggaucggugugcugcugacauggcucggccugaacucacgaagcaccuccuucagcaugaccugcaucgccgugggccuuguaacgcucuaccugggagugauggugcaagccgacucugguugcgucaucaacuggaagggccgggaauugaagugcgggucggggaucuucgugacaaaugaggugcacacguggacugagcaguauaaguuucaggcugacaguccgaagaggcuauccgcagccaucggcaaagccugggaggaaggagucugcgguauccggagcgccacacgucuagagaauaucauguggaagcagauuaguaacgaguugaaucacauccuccuggaaaacgacaugaaauucacggugguggugggagacguggcaggcauccuugcgcaggggaagaagaugauucggccacagccuauggaguacaaguacuccuggaaguccuggggcaaggcgaaaauaauaggcgccgacguccaaaacaccacuuuuaucaucgacgggccaaacacgccugaaugcccagacgaccaacgugcguggaacauaugggagguugaggacuacgguuuugggauuuucacgaccaacauuuggcuuaaacuucgggauagcuacacccaggugugugaccaccgccuaauguccgcggcgaucaaagauuccaaagccgugcacgccgacaugggguacuggaucgaguccgaaaagaaugagaccuggaaguuggcucgggccagcuucaucgaggucaagacgugcaucuggccaaagucacacacccuguggucuaauggggugcuggagagcgagaugauaauaccaaagaucuacgggggcccuauaagccaacacaacuaucgccccggauauuuuacccagacggcaggaccauggcaccuggggaaacuugaacucgacuucgaucucugcgagggcacgacgguaguaguugaugagcauugcggcaacaggggcccgucccuacgcacgacuaccgugacuggcaaaauuauccacgaguggugcuguagaucuugcacccucccgccucuccgauucagaggggaggacggcuguugguauggcauggagaucagacccgugaaggagaaggaggagaaucuggugaagucgaugguaagcgccggcagcggggaggucgacuccuuuagccuggggcuccugugcauuuccaucaugaucgaagagguaaugcggagccgcuggucccggaagaugcugaugaccgguacgcucgccgucuucuuccugcugauuaugggacaacuuaccuggaaugaccugauacgccuuugcauaauggucggcgcuaacgcuucagaccggauggggauggggaccaccuaccuugcacugauggccacguuuaagaugagaccgauguucgccguaggccuccucuuccgccgacuaacaagucgugaggugcugcucuuaaccaucgggcugucccuagucgcaucagucgaguugccuaacagccuggaggaacuuggcgacgggcuagcgauggggauaaugauccuuaagcuccucaccgauuuucagucucaccagcugugggccacgcuccuuagucugaccuucauuaagaccacguucucccuccacuaugccuggaagaccauggcuaugguccuaagcaucguuucucuguucccccuuugucugagcaccacgagucagaagaccacguggcugcccguucuccugggaucucuggggugcaagccgcucacaauguuccugaucgcggaaaacaagauaugggggagacgcuccuggccccucaacgaggggaucauggcagucgguaucgugaguauucuccuguccucacuccucaaaaacgaugugccccuggccgggccccuuauagccggcgggaugcuuaucgccugcuauguaaucucggggagcucugcggaccuuucccucgagaaagcggcagagguaagcugggaggaggaggcggagcacucuggcgccucccacaacauccuaguagagguacaggaugacgggaccaugaagauuaaggaugaggagcgggacgacacccugacuauccugcucaaagcgacgcugcucgcgguuuccggcguguauccucucucaauccccgcaacucuguuugucugguacuucuggcagaagaagaagcagcguuccgggguccugugggacacccccucgcccccugagguuggccgugccguacuugaugacggaaucuaccggaucaugcagcgcggguugcuaggccgcagucaaguuggcguuggagucuuucaggaaaacguauuucauaccauguggcacgucacgagaggggccguccugauguaccaggggaagcgacucgagccuagcugggcauccgucaaaaaggaccugaucuccuacggagggggcuggcgacugcaggguucauggaacacuggggaggaagugcaggucauugcaguggagccugggaaaaaucccaagaaugugcaaaccgcgcccgguaccuuuaaaacgccagaaggcgaggucggggccaucgcccuggacuucaaacccgggacaagugggucccccauagugaaccgcgagggcaagaucguuggacuguacgggaacggaguaguaacgaccucagggaccuacguauccgcgauugcucaggccaaagcgucccaggagggaccgcugccugaaaucgaggacgaaguguuuagaaaacgaaaccugacuaucauggaccuucaccccgggagcgggaagacccgccgcuaccugccggcgaucgugcgcgaagccaucaaacgcaagcucagaacgcugauccuagcacccacucgcguagucgccuccgagauggccgaagcguugaagggcaugcccauccgauaucagacaaccgcugucaaguccgagcacacagggaaagagauaguggacuuaaugugccacgccacguucacaaugagguugcucuccccuguccgcgugccaaacuacaacaugauaaucauggacgaggcucauuuuaccgaccccuccaguaucgcagcacggggguacauaucaacgcgcgucgggaugggcgaggccgccgccaucuuuaugacagcgaccccgccuggguccguagaagcguuuccccagaguaacgcugucauacaggacgaggaacgggacaucccggagcgaucuuggaacagcggcuaugaauggaucaccgacuuucccggcaagacagugugguucguccccuccaucaagucagggaacgauaucgcgaauugucugcggaagaacggcaagcgcguaauccaacucucccggaagacauucgacaccgaauaccagaaaaccaagaacaacgauugggacuacgucgucaccacggacaucagcgagaugggggcaaacuuccgcgccgacagagugauagacccgcgccggugccuuaagccggugauccugaaggacggccccgagcgggugauucuggccgggcccaugcccguuacuguagccuccgccgcccagcgucgcggacggaucggucgcaaucauaauaaggaaggagaucaguauaucuacaugggccaaccccucaauaacgaugaggaccacgcgcacuggaccgaggccaaaaugcuguuagacaacaucaacaccccggaggggaucauccccgcccucuucgagccagaacgcgagaaguccgccgcaaucgacggugaguaccgacugagaggggaagcgagaaagacguucguggagcugaugcgcaggggcgaccuccccguguggcuguccuacaaagucgcgagcgagggguuccaguauagcgacaggcgguggugcuucgacggggagaggaacaaucagguccuggaagagaacauggacgucgagaucuggacuaaggaaggcgagcgcaagaaacuacgcccgagaugguuagaugcacggaccuacuccgacccacucgcacuccgggaguuuaaggaguucgccgcgggccggcgaagcgugucgggcgaccugauucuggagaucgguaagcucccgcagcaucugacacagcgcgcacagaacgcacuggacaaucuugugauguuacacaacagcgaacagggcggccgggccuacaggcacgcuauggaggagcuuccugacacgaucgaaacccucaugcugcuggcccugauugccgugcucaccgggggcgugacuuuauucuuucucuccgggcggggacucggcaagaccuccauaggccugcugugcgugauggccuccucagugcuucuguggauggccuccgucgagccgcauuggauugcggcgaguaucauccuggaguucuuccugauggugcuguuaaucccggagccggaccgccagcggacgccccaagacaaucagcucgccuacguggucaucggccuccuguucaugaucuuaaccguggcagccaacgagaugggguuacucgagacuacuaagaaggaccugggcaucgggcauguugcugucgagaaccaucaccacgccgcaaugcuagacgucgaccuccaccccgccuccgccuggacucuuuacgcaguagccaccacuaucaucacuccgaugaugcgccauacaauugagaacaccacggcgaacaucucgcugacggccauugccaaccaggcggccauuuuaaugggucuggacaagggcuggcccaucucuaagauggauaucggcgugccacugcuagccuuaggcugcuacucucaaguuaacccccuuacgcuaaccgccgcugugcugaugcuggucgcccacuacgccauaaucggccccggcuuacaggcuaaagccacacgcgaggcucagaagcgcaccgcagccgggaucaugaagaaucccacgguggauggcauuguggccaucgaccucgaccccgucguguacgaugccaaguucgagaaacagcuagggcagauuaugcuucucauucugugcacgucccaaauucuccugaugcgcacaacaugggcucuaugugagagcauuacacuagccacagggccucugacgacacugugggagggcuccccggggaaguuuuggaauacaaccauugcagugagcauggccaacaucuucagaggcuccuaccucgccggagccgggcuggcuuuuagccugaugaaguccuuagggggcgggcgccgggggacuggggcacagggagagacgcugggggagaaguggaagcgccaguuaaaucagcucaguaagagcgaguucaauaccuacaagcgguccggcauaauggaggucgacaggucggaagccaaggaggggcugaagcggggcgagaccaccaagcacgcggugucacgcgggacugccaaguugcgaugguucguggaaaggaacuugguuaagcccgagggaaaggugaucgaccugggaugugggcgcgguggguggagcuacuauugcgccggccugaagaaggugacagaggucaaaggguacaccaaagggggacccgggcaugaggaacccaucccgauggccaccuacggcuggaaccugguuaaacuccauuccgggaaggauguguucuucaucccaccugaaaagugugacacacuguugugugacaucggcgaguccucucccaacccuaccaucgaggaggggcgcacccuccggguccuaaagaugguagagccguggcugcgcggcaaccaguucugcaucaagauucucaacccauacaugcccagcgugguagaaacucucgagcagaugcagcguaaacacggaggaaugcuuguaaggaacccgcucucgaggaacagcacccacgagauguacuggguuucuugcgggacggggaacaucgucagugcagugaacaugaccucccgcauguuauuaaacagguuuaccauggcgcaccggaaaccgacguacgagcgggacguggaccucggugccggcacgcggcauguagccguagagcccgagguggccaauuuggacaucauaggacaacguaucgaaaauaucaaacacgaacacaagagcacguggcauuacgacgaggauaauccauauaaaaccugggccuaccacggauccuacgaggugaaaccguccggcuccgcaagcagcauggugaacggaguaguaaaacugcucacuaagcccugggacgugaucccaauggugacccagauagcgaugacagauaccacgccguucggucaacagcggguguucaaagagaaaguggauacaaggacgccgaaggccaagcggggcaccgcccaaaucauggaggugaccgccaaguggcuguggggauuccuuucccgcaacaagaaaccccggaucugcacccgugaggaguucacacgcaaagugcguuccaacgcggccaucggcgccguguucgucgacgaaaaccaauggaacucggccaaggaggcaguggaagacgagagguucugggaccugguacacagagagagggagcugcauaagcaagggaagugcgcgacgugcguguacaauaugauggguaagcgcgaaaagaaacugggcgaguucgggaaggcgaaggguucacgcgcuaucugguauauguggcuuggggcccgcuuucuggaguucgaagcgcuaggauucaugaacgaggaccacugguucucccgggaaaauagcuuguccggcguagagggggagggccugcauaagcucggauauauucuucgcgacaucagcaauaucccgggaggcaacauguacgcugacgauaccgccggcugggacacccggaucacggaggacgaucugcagaacgaagcucguauuaccgauaucauggagccggagcacgcccugcucgcaaagucaaucuuuaagcugaccuaucagaauaagguagugcgugugcagcggccggccaagaacggcaccguuauggacguuaucagcagacgugaccagcgcggguccggacaggugggaacguacggacucaauaccuucacuaacauggaggcccagcucaucagacagauggagagcgagggcauauucucuccuagcgagcuggagacccccaaccuggcggagagagugcucgacuggcuggaaaaguacggggucgagagacucaagcguauggccaucuccggcgacgacugcguggucaagcccaucgacgacagguuugccacggcccucacggcucugaacgacauggggaagguuagaaaggacauuccccagugggagcccuccaaaggauggaaugauuggcagcaggucccauucugcucccaccacuuccaccaacugaucaugaaggacggcagggagaucguugucccguguaggaaucaggacgagcugguggggcgggcccgcgugagccaaggcgcaggcuggagccugagagagaccgcgugccugggcaaaucuuacgcgcagauguggcagcucauguauuuucaucggcgugaccugcgccuugccgcaaacgcgauaugcuccgcagugccaguagacuggaucccgacuucucguacaaccuggucaauccacgcccaucaucaauggaugaccaccgaggacaugcucucaguuuggaauagggucuggaucgaggaaaaccccuggauggaggacaagacgcacaucagcucuuggggcgaugugccuuaucuggggaaacgcgaagaccagugguguggcagccugaucggccucaccgccagggccaccugggcgacuaauauacagguagccaucaaccaggugcgccggcugauugguaaugagaacuaccuggacuacaugaccucgaugaagcgcuucaagaacgaguccgacccagagggggcccugugguag

SEQ ID NO: 24112 - RNA, 9879 nt, Artificial Sequence
  derived and/or modified CDS sequence (opt11) from DENV-1__EU677176__SS-prME
uccgugacuaugcugcuuaugcuuaugcccaccgccuuggccuuccaucucacuacccgaggcggggagccccacaugaucgucagcaagcaggagagaggcaagucauuacuguuuaaaaccagugccggugugaacaugugcacccugaucgcuauggaccugggggagcugugcgaggacaccaugacauacaagugcccccgcaucacggaggucgagcccgacgacguggacugcuggugcaacaccaccgacacuugggugaccuacgggacgugcagccagacgggcgagcaucggagagacaagcgguccguggcccucgcgccgcacgucgggcucgggcuggagacccgcgcagagacuuggaugucguccgagggcgccuggaagcaaauccagaagguggaaacuugggcacuccggcaccccggguucacugugaucgcccuguuccuagcucacgcgaucggcacaagcaucacucaaaagggaaucauauuuauacucuuaaugcugguaacccccuccauggcgaugcgcugcguaggcaucggcagccgggacuuuguugaaggcuugucuggcgccacgugggucgacguggugcuagagcacggaagcugcgucaccaccauggccaaagacaagccuacccuagacaucgagcugcugaagacggaggugacuaaccccgcaguucuucgcaagcucugcaucgaagcgaagaucuccaacaccaccacggacagcaggugcccgacccaaggcgaggccacccuagucgaggagcaggacgcuaacuucgugugucgcagaaccuucguggaccgcggcugggggaacggcugcgggcuguucgggaagggcagucuuaucaccugcgccaaguucaaguguguaacgaagcuggagggaaagaucguucaauaugaaaaucugaaguacucgguaaucguuaccgugcacaccggcgaccagcaucaagucgggaacgaguccacggagcacggcaccaccgcaaccaucacgccccaggcgcccacguccgagauacagcucaccgacuacggggcccuaacccuagacugcagcccucggaccggucuggauuucaacgagaugguucuguugacgaugaaggagaagucauggcucguacacaagcagugguuuuuagaucuuccccuccccuggaccucuggggccaguacgucccaggagacguggaaccgccaggaccugcuggucaccuuuaagaccgcccaugccaagaagcaggagguagugguccucggcucucaggagggggcgaugcacaccgcccugaccggggccacggagauucagaccagcgguaccaccacaauuuucgccgggcaucugaagugcagguugaagauggauaaacugaccuugaagggcauguccuacgugaugugcaccgggcuguucaagcuggagaaagagguggcagaaacucagcacggcacgguccuggugcagauuaaguaugaagggaccgaugcacccugcaagaucccuuucagcacccaggacgagaagggagugacccagaacggccgccugaucacggccaauccgaucgugacggacaaggagaagcccgugaacaucgaagccgagccccccuuuggggaguccuacaucguuaucggcgcuggggagaaagcgcucaagcuuagcugguucaaaaaggguuccaguaucggcaagauguucgaagccaccgcccguggcgcccgacgaauggccauccugggcgacaccgcgugggauuucgggucuauagggggcgucuucacgucuguggggaagcucguacaccagaucuucggcaccgccuacgggguucuguucuccggcgugagcuggacgaugaagauagggaucggcgugcugcuuacauggcugggcuuaaacucccgcaguacgucccucaguaugaccuguauagccgucgggcuggugacccuauaccucggcgugaugguccaggccgacuccgggugcgugauaaacuggaaaggucgagagcuaaagugcggaagcggcaucuuuguaacgaacgaaguccacacguggacagagcaguacaaguuccaggccgacucuccuaagcggcuauccgcggcuaucggcaaggccugggaggaaggcgugugcgguauccgcuccgcaacccgucucgagaauaucauguggcgccagaucuccaacgagcugaaucacauccugcucgagaacgauaugaaguucaccguggucguuggggacguggucggcauccuggcucaagggaagaaaaugauccggccgcagcccauggagcauaaguauuccuggaaguccuggggcaaggcaaagaucaucggcgccgacgugcagaacaccacguucauuauugacggacccaauaccccagagugccccgaugaccaacgcgcuuggaacaucugggaggucgaggauuacggcuuugggaucuuuacuaccaacaucuggcugaaacuccgggacagcuacacgcagguaugcgaccaccgucugaugagcgccgcaaucaaggacaguaaggcagugcacgcagacauggguuacuggaucgaauccgagaaaaacgagaccuggaaacuggcucgggccaguuuuauugaggugaagaccugcaucuggccgaagucccacacccucuggagcaacggcguacuagaguccgagaugaucauuccuaagaucuacggggguccgaucagccagcacaacuaccgccccggguacuuuacgcagaccgcuggccccuggcaccuugggaagcucgagcuggacuucgaccugugugagggcacuaccgugguuguggacgagcacugcggcaaccggggccccucccuccgcacgaccaccguaaccggcaagauaauccacgaguggugcugucggucaugcacgcucccuccccugcguuucaaaggggaggauggcugcugguacgggauggagauccgccccgugaaggagaaggaggaaaaccuagugaaguccauggugagcgcgggcucgggcgagguggacuccuuuagucuggggcugcucugcaucuccaucaugaucgaggaagucaugagaagccgguggucccgcaagaugcugaugaccgggacccuggccguguucuuucuacugaucauggggcaguugaccuggaacgaccucauucggagcugcaucauggugggugccaacgccuccgaccgcaugggaaugggcacaacauaccuugcgcugauggccaccuucaagaugcgcccgauguuugccgucggguugcuguuccggcggcugacuagucgggagguguuacuccugacgaucgguuuaucccugguugcaagcguggaguugcccaacucccuagaggagcugggagacgggcuggccaugggcaucaugauccucaaacuguugacagauuuccagagcuaccagcuuugggcuacccucuuauccuuaaccuuuauuaagacuaccuucagccugcauuacgccuggaagaccauggccauggugcuguccaucgucagccuccuaccccuuugucucuccacaacgagccagaagaccaccugguuaccaguccugcucggcagcuuaggaugcaagccguuaaccauguuucucaucgccgagaacaagaucugggggcgcaagucauggccccucaaugaggggauuauggcggugggcaucgucagcauucuguuguccagccugcugaagaacgacgugccccucgccgggccccugaucgccggcggcaugcugaucgccuguuaugugaucucagguagcuccgccgaccucagccuggagaaagcggcugaggucuccugggaagaagaggccgagcacagcggcgccucccacaauauacugguugaaguccaagaugacgggacaaugaagaucaaggacgaggagcgugacgauacccucaccauccugcuuaaggcgacccuccuggccgucagcggcguguacccgcugucgaucccagcaacucucuucgugugguauuucuggcagaagaaaaagcagcggaguggcguccugugggacacgcccucaccgcccgagguggaacgggccgugcuggacgacggaaucuaccgcaucaugcagcgagggcugcuagggcgcucgcagguaggcguagggguguuccaggagaacguauuccauacaauguggcacgucacccggggugcagugcugauguaucaagguaagcgccuugagcccuccugggccagcgucaagaaggaccucaucaguuacggcggaggauggcggcugcaaggcagcuggaauacgggagaggaaguacaagucaucgcggucgagccuggaaagaaccccaagaacgugcagacagcccccgguaccuucaagacgcccgagggcgagguaggagccaucgcccuggacuucaagcccggaaccuccggcagccccauagugaaccgcgaggggaagaucgugggauuauacggcaacggggucgucacgaccagcggaacguacguguccgccauugcgcaggccaaggcgagccaggaggggccgcugcccgagaucgaagacgagguguuccggaagcguaaccuuaccaucauggaucuccaccccgggucugggaaaacaaagcgguaccugccugcgaucguccgcgaggcgaucaagcggaaguugcgcacgcugauccuugcccccacucgggugguggccucagagauggccgaagcauuaaaaggaaugccgauccgauaucagaccacggcggucaagucugagcacacugggcgcgagaucguggaccucaugugccaugcgacauucacaaugcgccuauuaagucccgugcgugucccaaacuacaacaugaucaucauggacgaggcccacuucacggaccccuccagcaucgccgcccggggguauaucuccaccaggguggguaugggggaagcggccgcaauuuucaugacggccacgccgccgggcuccguggaagccuucccgcaguccaacgccgucauccaggacgaggagcgggacauccccgagcgcucguggaacuccggguacgaguggaucacggacuuccccggcaagaccgugugguucgugcccagcaucaaauccggcaacgacauagccaacugccuucggaagaaugggaagcgcgucauccagcugagccguaaaaccuucgacaccgaguaccagaagacgaagaacaacgacugggauuacguggugaccaccgacaucuccgagaugggcgccaauuucagagccgaccgggucaucgacccgcggcggugccugaagcccgugauccucaaggacggucccgagcgcgucauauuagcgggcccgaugccgguuaccguggccucagcggcccagcgccgugggcgcaucggcaggaaccacaauaaggagggcgaccaguacaucuacauggggcagccccuuaacaaugacgaggaccaugcgcacuggacagaggcgaagauguuguuagauaauaucaacacgcccgagggcaucaucccagcauuguuugagccugagagggagaagagugccgccaucgacggugaguaccgcuugcggggcgaggcgcggaagacuuucgucgaacugaugagacgcggggaccugccagucuggcuuaguuauaaggucgccagcgagggcuuccaguacuccgaccgccggugguguuucgauggcgagcgcaacaaccagguccuugaggagaacauggacguggagaucuggaccaaggagggugagcggaagaagcugcgaccccggugguuggacgcccgcacguacagcgacccacuagcccugcgggaguucaaggaguucgcugcugggcgcagguccgucagcggggaccucauucuggagaucggcaagcugccucagcaccucacccagcgcgcgcagaacgcccuggacaaccuggucaugcugcacaacuccgagcagggcgggagggccuaucgccacgccauggaggagcugcccgacacuaucgagacucugaugcuccuggcguuaaucgcggugcuaacaggaggggugacccuguucuuccugucugggcgggggcucggcaagaccuccauugggcuguugugcgucauggcaucguccgcccuccuguggauggccucuguggaaccccauuggaucgcggcgaguaucauccuggaguucuuucucauggugcugcugauccccgagccagaccggcagcggacgccccaggacaaccagcucgccuacgucgugaucgggcuguuguucaugauccuaaccguggccgccaacgagaugggccugcucgagacgaccaagaaagaccucggaaucgggcacguugcaguugagaaccaccaccacgcuaccaugcuugauguggaccugcacccagccagcgccuggacccucuacgccguugcgacaaccaucaucaccccgaugaugcgccacacaaucgagaacacgaccgcgaacauuucucugaccgccaucgccaaccaggccgcgauccuaauggggcucgauaagggcuggcccaucagcaagauggacaucggcgugccccugcuggcgcucgggugcuacucccaggugaacccccugacccugacggccgccgugcucaugcuuguggcgcacuacgccaucauuggcccgggccugcaggccaaggcaacccgggaggcccagaagcgcaccgcggccgggaucaugaaaaaccccacgguggacgguauugucgccaucgaccuggacccggugguguacgaugccaaguucgagaaacagcucggccagauuaugcuccugauccugugcacgagucaaaucuuacucaugcgcaccaccugggcccugugugaaagcaucaccuuggcgacgggcccacucaccacccugugggaggggagcccuggcaaguuuuggaacacaacgauugcuguaucuauggccaacaucuuccgggggagcuaucuggccggcgcgggucuggcguucagccugaugaagucccuugggggcggccgacgagggaccggggcccagggggagacccucggcgagaaguggaagcgccagcugaaccagcugagcaagucagaguucaauacguauaagcgaagcgguaucauggagguagaccgcuccgaggccaaggaaggcuuacggcgcggggagacgaccaagcacgcuguuagccggggcacggccaagcugcgcugguuugucgaacggaaccuggugaagccggaggggaagguuaucgaccuggguugcggacgaggaggcuggagcuacuauugcgccgggcucaagaagguuaccgaggugaaggguuacaccaagggcgggcccggacacgaggagcccauaccgauggcaaccuauggguggaaccuggugaagcugcacuccgguaaggacgucuucuucaucccgccugagaagugugacacccugcugugcgacaucggggagucuagccccaauccgaccaucgaagagggccggacgcuccgcguguuaaagaugguggagcccuggcugagggggaaccaguucugcaucaagauccugaaucccuauaugcccagugucguggagacccuugagcagaugcagcgcaagcacggcggcaugcuggugcggaacccacugagccguaacuccacucacgagauguacugggucagcuguggcaccggcaacaucguauccgccgugaauaugaccagccggaugcucuuaaaucgcuucacgauggcccacagaaagccaaccuacgaacgggacgucgaccugggggcgggcacccgccacguggccguggagccugagguugccaaccuggacaucaucggccagcggauagagaauaucaagcacgaacacaaauccaccuggcauuaugacgaagacaaucccuacaagacgugggccuaccacgggagcuacgaggugaaaccuaguggcagcgcgagcucaaugguaaacggaguugugaagcuacugaccaagcccugggacgucauacccauggugacccagaucgcgaugaccgacacgacccccuucggucagcagcgagucuucaaggagaagguagacacccggaccccgaaggcuaaacgcgggacggcccagaucauggaagugaccgcccgguggcuguggggcuuccugucacguaacaagaagccucggaucuguacccgcgaggaguuuacucggaaaguacgauccaacgcagcgaucggcgccgucuuuguggacgagaaccaguggaacucggccaaggaggccguggaggacgagcgguucugggaccuagugcaccgcgagcgggagcuccauaagcagggcaaaugcgcgacgugcguguauaacaugaugggaaagcgcgagaaaaagcugggagaguuuggcaaggccaaagggucccgggccaucugguauauguggcugggcgcccgcuuccucgaguucgaggcgcugggcuuuaugaacgaggaccacugguucagccgagagaacagccugagcgggguggagggcgaggggcuccacaagcuaggcuacauccugcgugacaucuccaagaucccgggcggcaacauguaugccgacgauaccgcuggcugggacaccagaaucaccgaggacgacuugcagaaugaggccaagaucacggacaucauggagccggagcacgccuugcuggccaccagcaucuucaagcucaccuaccaaaauaagguggugcgcguucagcgccccgcgcggaacgggaccgucauggacgugauuucacgacgggaucagaggggcagcggucaagucggcacguacggccuuaacaccuucaccaacauggaggcccaguuaaucagacagauggaguccgagcgcaucuucagcccgagcgagcucgaaacacccaaccuggccgagcggguccuggacuggcucgagaagcacgggguggaacgccuaaagaggauggccauuagcggcgacgacugcguggucaagccgaucgacgaccgauucgccacggcgcuuagugcccucaacgauaugggaaaggugcgcaaggacauaccccaaugggaacccagcaagggcuggaacgacuggcagcaaguuccuuucuguagccaucacuuucaccagcugaucaugaaagacgggagagaaaucgucgugccgugccgcaaccaggacgaacuggugggcagagcccggguaucccaaggcgccggauggucacuccgcgagaccgccugccuggguaaguccuacgcgcagauguggcaacugauguacuuccaccgccgcgacuugcgucuggccgcgaacgccaucuguagcgcagugcccguggacugggugcccaccucccgcaccacguggagcauccacgcucaucaucaguggaugacaaccgaggauaugcugucaguguggaaccgcguuuggaucgaggagaaccccuggauggaggacaagacccacaucagcagcuggggcgacgucccuuaccugggcaagcgggaagaccaguggugcgggagccugaucggacugacggcccgcgccacgugggccaccaacauucaagucgcuauuaaccaggugcggcggcucaucggcaacgagaacuaucuggacuacaugaccuccaugaagcgauucaagaacgacagcgaucccgaaggggcccugugguaa

SEQ ID NO: 24113 - RNA, 9879 nt, Artificial Sequence
  derived and/or modified CDS sequence (opt11) from DENV-1__EU726780__SS-prME
ucugugaccaugcuguuaaugcuuaugcccaccgcccuggccuuccauuugaccacacgugguggggaaccccacaugaucguaagcaaacaagaacgcgggaaaagccugcucuuuaagaccuccgcugggguuaacauguguacucucauagcuauggaccugggcgaacugugugaggacaccaugacguacaaaugcccgcggauaaccgagacggaaccagacgauguggacugcuggugcaacgccacggacaccugggucaccuaugggacgugcagccagacgggcgagcaucggcgagacaagcggaguguggcguuagcgccccacgugggccugggucuggaaaccaggacugagacuuggaugagcuccgagggugccuggaagcagauccagcggguagaaaccugggcccugagacaccccggguucacugugaucgccuuguuccuggcgcaugcgaucgggaccagcaucacccaaaagggcauaaucuucauacuccugaugcuagucacgcccucgauggccaugcgaugugugggcaucgggagcagggauuuuguugaggggcucuccggugccaccuggguggacgucguucuugagcacgguagcugcguuaccaccauggcgaaagacaagcccacgcuggacauugagcuucugaagaccgaagucaccaaccccgccguccuccggaagcuauguauagaggcaaagaucagcaacaccacgaccgauucacgcugcccaacccagggcgaagccacccugguggaggagcaagaugccaauuucguguguaggcgcaccuucguggaccgaggcugggggaacgggugcggacuauuuggcaaggggucccucauuacgugugcaaaguucaaaugcgugacgaagcucgagggcaagauagugcaguacgaaaacuugaaguacucuguaaucguaaccguucacacgggcgaccagcaccagguugggaacgagucuaccgaacacggcacgacagcaacgaucacaccccaggcgcccacuacggaaauucagcucaccgauuacggggcucugacgcuugauugcuccccacggacaggccuggauuucaacgagaugguccuauugaccaugaaggagaaauccuggcuagugcauaagcagugguuucuagacuuaccucugcccuggacaagcggggcauccacaucucaggaaacauggaaucggcaggaccuguuggugaccuucaagaccgcacacgccaagaaacaagagguaguugugcucggcagccaagaaggcgcaaugcauacggcccugaccggcgcuacagagauccaaaccuccggcacuaccaccaucuucgcuggccacuuaaagugccgucugaagauggacaaacugacccugaagggcaugucuuacgucaugugcacgggauccuucaaguuagaaaaagagguagcagaaacgcagcacgguacagugcucguccagaucaaguacgagggcacggacgcgcccugcaagaucccauucuccacgcaggacgagaagggcgucacucaaaacggacgguugaucaccgcgaaucccaucgucaccgauaaggaaaagccugucaacauagaggccgaaccgccauucggggaauccuacaucgugaucggcgcaggggagaaaacgcuaaaguugagcugguucaagaaaggcaguagcauuggcaagauguucgaggcaacggcucgcggggcgcggcgcauggccauccugggcgacaccgccugggacuucgggucgaucggcggcguguucaccucaguagggaagcuggugcaccagauuuucggcacugcauacggggucuuauucucgggugucagcuggacuaugaagaucggaaucggagugcuccucaccuggcucggacugaacucccgaagcaccucucugucgaugaccugcaucgccguuggacuugucacccuguaccuaggggugauggugcaagcugauaguggguguguaaucaacuggaagggacgggagcucaagugcgguagcgggaucuucguaaccaacgagguccacacauggaccgagcaguauaaguuccaagcagacucaccgaagagacuguccgccgcgaucggcaaggccugggaggaagggguuugcgggauucgaagcgccacgcgccuagagaacaucauguggaagcagaucucuaacgaguuaaaccacauccugcuggagaacgacaugaaguucaccgucguuguaggggacguggccggcauucucgcccaggggaagaaaaugauucggccucaaccgauggaguacaaguacagcuggaaauccuggggcaaagcgaagauuauuggggccgaugugcagaacaccaccuucauuaucgacgggcccaacacgccggagugucccgacgaccaacgcgccuggaacaucugggaggucgaggauuacggcuucggaaucuucacuaccaacaucuggcugaagcuccgggacucuuauacccaggugugcgaccaucgccugaugucagcugcgaucaaggacagcaaagccguccacgccgacauggguuacuggauagagagugagaagaacgagacguggaaacuagcgagagccucuuuuaucgaggucaagacaugcauauggcccaagucccauaccuuguggagcaauggcguacuugaguccgagaugaucauccccaagaucuacggaggaccgaucucgcagcauaauuaccgcccuggguacuucacacagacggcgggcccguggcaccuagggaagcuggagcuagacuuugaucucugcgaaggcaccaccguggucguggacgagcacugcgggaaccggggucccucccuacgcaccacgacugugacgggcaagaucauacaugaguggugcugcaggucuugcacccugccgcccuugagguuccgaggugaagacggcugcugguacgggauggagauccgcccagucaaggaaaaagaggagaaccuggucaaauccauggugucggcaggcagcggcgagguugacaguuucucgcuugggcuguugugcauuagcauaaugauagaggaggucaugcggagccgguggucccggaagaugcugaugacagggacauuagccguguucuuucugcucaucauggggcagcugaccuggaacgaucugauacgguuaugcaucaugguaggagcgaacgccagugauaggauggggauggguaccacguaccucgcucucauggccacauuuaagaugcggcccauguucgccgucggacuccuuuuucgacgccucacaucccgcgagguguugcuacuaaccauugggcugagccugguagcuucaguggaacugcccaacagccucgaggagcucggggauggccuagccaugggcaucaugaucuugaagcugcucacggacuuccagagccaucaacuuugggucaccuuauugagccucacuuucaucaagacaacguucucccuccauuaugcguggaaaaccauggcuauggucuugucgauugugucccucuuuccccugugccucagcacuacaagucaaaagacaacauggcucccaguucuucugggaucgcuuggauguaaaccucugaccauguuccugauugccgaaaauaagauuuggggccgacgauccuggccccucaacgaaggaauaauggccgucggaaucgugucaauccugcuuagcucgcuccugaaaaacgacgugccgcuggcggggccccucaucgcuggcgguauguugauagccuguuacgugaucagcgggagcucggccgaucugucccucgagaaggcagcggaggugucgugggaggaggaagcugagcacuccggcgcgagccacaacauccugguagaggugcaggacgacgguacuaugaagaucaaggacgaggagcgcgaugacacgcugacgauccuccuuaaggcgaccuuauuggccgugaguggcgucuacccccuuagcaucccugcgacccucuucguaugguacuuuuggcagaagaagaaacagcguuccggaguucucugggauacgcccagcccgcccgaagucgagcgggccguauuggacgauggcaucuaccgcaucaugcagcgaggccugcuuggccgcucccaggugggcgucggggucuuccaggagaacguauuccacacgauguggcacgucacacgaggcgcagugcucauguaccaggggaaaaggcucgagcccagcugggccucggugaaaaaggacuugaucagcuauggcggcggauggcgccuacaagguagcuggaacacaggggaggagguccagguuaucgccguggagccaggcaagaaccccaaaaacgugcagaccgcgcccgggacauucaaaacgcccgagggagaggugggugccauagcccuggacuucaagcccggcaccagcgggucucccaucguaaaucgcgagggcaagauugucggucucuacgguaacggggugguuaccacgagcggaacguacgucagcgccauagcacaggcaaaggcuucacaggaagggccgcucccggagaucgaggacgaaguguuccgcaagcgcaaccugaccaucauggaucuccaccccggcagugggaagacgaggcgcuaccucccggccauaguacgagaggcaauuaagcguaagcugcgcacgcugaucuuggcgcccacccgggucguggcuuccgaaauggccgaggcacugaaggguaugccuauccgauaccagacaacugccgucaagucugagcacacggguaaggagauagucgaccugaugugucacgcuacguuuacaaugagacuucucucccccgugcgggugcccaacuacaacaugauaaucauggaugaggcacacuuuaccgacccuagcuccaucgccgcacggggauauaucagcacgcgcgucggcaugggggaagccgcggccauauucaugaccgcuacgccuccuggaagcguggaagccuucccccagagcaacgccgugauccaggacgaggagcgugauaucccugagagauccuggaacagcggauacgaguggauaaccgacuuccccggcaagaccguuugguucguaccuuccauaaagagcgguaacgauauagcgaacugucucaggaagaacgguaaacgagucauucaguuaucccggaagaccuuugacacugaauaccagaagaccaaaaauaacgauugggauuacgucgugacgacggacaucucggagaugggcgccaauuuccgcgccgaucgggugauugacccccgucggugccugaagccggugauccuaaaagacggcccggagcgcgugauuuuagcagggccgaugccgguuaccguugcguccgccgcgcagaggagaggacggaucgggcgcaaccacaacaaagaaggcgaucaguauaucuacaugggacaaccccugaacaacgacgaagaucacgcccauuggaccgaggcaaagaugcugcuugacaacaucaauacgcccgagggcaucauucccgcacuguucgagccggagcgcgaaaaauccgcagcuaucgacggugaguacaggcuccgcggcgaagcucgcaagaccuucguggagcucaugcgcagaggggaccugcccgucuggcugucauauaagguugcuuccgagggauuccaguacagcgaucgacgguggugcuuugacggcgagcgcaacaaccaggugcuagaagaaaacauggacguggagauauggacuaaggaaggggagcgaaagaagcugcguccucgguggcuggacgcccgcacguacucagacccucuagcucugagagaauuuaaggaguucgccgcuggccgccgguccguguccggagaccugaucucagagaucggcaagcucccgcaacaucugacgcagcgcgcgcagaaugcgcuggacaacuuggugauguuacauaauuccgagcagggcgggcgggccuaucgccacgccauggaggaacugcccgacaccaucgagacccucauguuacuggcacucauugcggucuugaccggaggggugacccuguucuuccucagcggccgcgggcugggcaaaacauccaucggccugcugugcguuauggcuagcucggugcuguuguggauggccagcguggaaccacacuggaucgccgcuuccaucauccucgaguuuuuccuuauggugcugcuuauccccgagccggaccgacaacggacgccucaagauaaucagcuugcguacgugguaauugggcuucuuuucaugauacugaccguggccgccaacgagaugggcuuguuggaaaccaccaagaaagaccuggggaucggccacgucgccguggagaaccaccaccacgccgcgaugcucgacguggacuuacaccccgcaagcgcauggacccuguaugcuguggcgaccacaauuauaacgccgaugaugcgccacaccaucgagaauaccacugccaacaucucccugacggccaucgccaaccaggccgcgauccucauggggcuggacaaaggcuggcccaucagcaagauggacaucggggugccccuccuugcgcucggauguuacagucagguaaacccccugacacucaccgccgccguccugaugcugguugcccacuacgcuaucaucggcccggggcuccaagccaaagcuacccgggaagcacagaaacguaccgccgcugggaucaugaagaaccccaccgucgacggaauagucgcuaucgaccuggaccccguuguguacgaugcaaaguucgagaagcagcugggccagaucaugcucuugauccuguguaccucucagauccuccucaugcgcacuacgugggcacugugugaauccaucacucucgcgaccggcccgcugaccacucugugggaagggucgccgggcaaguucuggaauaccaccaucgccgucuccauggccaauaucuuccgagggagcuaccucgccggcgcagggcuggcauucucgcucaugaaaucucuuggcgggggacgcagaggcaccggugcgcagggcgagaccuugggcgagaaguggaaacgucaacucaaccaacucuccaaauccgaguuuaauaccuacaagcggagcgggaucauggagguggaucgcucagaggccaaggagggccugaagcgcggggagacgacuaaacacgcugugucacgagggaccgcaaagcuacggugguucgucgagcguaaccuagugaagccugaagggaagguuaucgaccugggaugcggccgcggagggugguccuacuacugugcuggguuaaagaaggucaccgaggugaagggguacacgaagggcgggcccgggcacgaagaacccauuccgauggccacguacggguggaaccugguaaagcuccacucaggaaaggacguauucuuuauuccgcccgagaagugcgacacgcuccugugcgacaucggggaauccagcccuaacccgaccaucgaggaaggccgaacccuccgggugcuuaaaaugguagagccauggcuccgcgggaaccaguucuguauuaagauacucaaccccuacaugccauccgucguagagacccuggagcagaugcaacggaagcaugguggcaugcugguuagaaacccacucagccggaacuccacccacgagauguacugggucucuugcgggacgggaaacaucguaagugccgugaacaugaccagcaggauguuacugaaucgcuucaccauggcacaccggaaaccuaccuacgagagagacgucgaccuaggugcaggcacgcggcacguggcuguugaaccggaagucgcuaauuuagacauaauaggccagcgcauagagaacaucaagcaugagcacaaguccaccuggcacuacgaugaggauaacccguacaagaccugggcuuaccacgggucguacgaggugaagccauccggcagcgccuccagcauggucaaugggguggugaaguuauugaccaagcccugggaugucauccccauggugacgcagauugccaugaccgauaccacacccuucggccaacaacggguguuuaaagaaaaaguggauacucgcaccccuaaggcgaagcgggguaccgcccaaaucauggaggugaccgcuaaguggcugugggguuuccuaagccggaacaagaagccccggaucuguacgcgagaagaguucacccggaagguuagaagcaacgccgcuaucggcgcggucuucguggacgagaaccaguggaacucugcaaaagaggccguggaagacgagagguucugggaccugguccaccgcgaacgggagcuacauaagcaagggaagugcgcgacuugcgucuacaacaugaugggcaaacgugagaagaaacuuggugaguucggaaaggcaaaagggagccgggcuaucugguacaugugguuaggagcucgcuuccuggaguucgaggcccugggcuuuaugaacgaggaucacugguucagccgagagaacucccuaagcggggucgagggagaggggcugcacaaacugggcuacauacuacgagauaucuccaagauucccggagggaacauguacgcggaugauaccgcggguugggacacgcgaauaacugaagaugauuuacagaacgaagcccgcaucaccgacaucauggagccggagcacgcccuacuugcuaagagcaucuucaaguugaccuaccagaauaaggucgugcgcguacagcggcccgcuaagaacgguacgguuauggacgugaucucacgccgggaucagcgaggcucgggucaaguugggaccuacggccugaauaccuucacgaacauggaggcacagcucauccgacaaauggaauccgaggggaucuucucacccucggagcucgagacgcccaaccuggccgagcgggucuuggacuggcuugagaaauacggcaucgagcgguugaagagaauggcaaucagcggggacgacugcguggugaaaccuaucgacgaccgauuugcuaccgcucucaccgcgcucaacgacaugggcaagguacgaaaagauaucccucagugggagccuuccaaggguuggaaugacuggcagcaaguccccuucugcagucaccauuuccaccaguuaaucaugaaggauggucgggaaauuguggucccgugcaggaaccaggacgaguuggugggcagagcccgagucagccagggggcgggcuggagucugcgggaaaccgccuguuuaggcaaaagcuaugcccagauguggcagcucauguacuuccaccgccgggaccugcgcuuagccgccaaugcgaucugcucugccguccccgucgacuggauccccacaagccggaccacguggucuauucaugcgcaccaucaguggaugaccacggaggacauguuaucgguguggaaccgcguauggaucgaggagaaucccuggauggaggacaagacucacaucuccuccuggggcgacgugccauaccugggcaagcgcgaagaccaauggugcgggaguuuaaucggccuuacagcccgugccaccugggccaccaacauccagguggcgauuaaccagguccgccggcuaaucggaaaugagaacuaucuugacuacaugacaagcaugaaacgcuucaagaacgaguccgacccugaaggggcgcucugguaa

SEQ ID NO: 24114 - RNA, 9879 nt, Artificial Sequence
  derived and/or modified CDS sequence (opt11) from DENV-1__EU726781__SS-prME
agcgugaccaugcugcuuaugcugaugccgacggcccuagcuuuccauuugacgacccgggguggugaaccccacaugaucgugaguaagcaggaacggggcaagagccugcuuuucaagaccagcgcagggguaaauaugugcacccucaucgccauggacuuaggggaauuuugcgaggacacgaugaccuacaaguguccacgaaucaccgaggccgagcccgaugacguagacuguuggugcaacgcaaccgacacgugggugaccuacgggaccugcagccagacaggcgagcaccggcgagauaagcggucaguagcgcuggcgccccacgugggccuuggucuagagacacgaaccgagaccuggaugagcucagaaggagcuuggaagcagauccagcgaguggagacaugggcccugcgucaucccggauucacgguaauugccuuguuccuggcgcacgcuauagggaccucgaucacgcagaaggggaucaucuucauccuacucaugcuggugacacccuccauggcaaugcggugugucggcaucggcucucgcgacuucguggaggggcuguccggggcuaccuggguugacgucguacuagagcaugggucgugcgucacgacuauggcaaaggacaagcccacccuggacauugagcuccuuaaaacggaagucaccaacccagcugugcugcgaaaacuuuguauagaggcuaagaucuccaacaccacaacggacagccggugcccgacccagggcgaggcuacccuuguggaagaacaggacgccaacuuugucugccggcgcacauucgucgaccgcggcugggggaacggcugcgggcuguucggcaaggggaguuuaauaacgugcgcaaaguuuaagugcgugaccaagcucgaaggcaagacgguacaauaugagaaccucaaguacagugugauagugaccguucacaccggcgaucaacaucagguggggaaugaaaguacggagcauggcaccaccgcgaccaucacuccccaggcgcccagcaccgagauccagcuuaccgacuacggggcauugacccuggacugcagcccccggacgggccuggauuucaacgagaugguccuccugaccaugaaggagaaguccuggcuggugcacaaacagugguuccucgaucuuccgcuccccuggaccagcggggccucaacaucucaggagacauggaaccgcaaggacuugcuggugaccuucaagacugcccacgcgaagaaacaagagguggugguacugggcucccaagagggggcgaugcacaccgcccuuacaggugcaaccgagauccagaccuccggcacgacgaccauauucgccgggcaccugaaaugccgccuuaaaauggacaaacucacacugaaaggcauguccuacgucaugugcaccgggagcuucaagcuggagaaagagguggcggagacucagcacggaaccguguugguccagauaaaguaugagggaacugacgccccguguaagauccccuuuagcacccaggacgaaaaaggggugacgcagaacggcaggcugaucaccgccaacccgaucgugaccgauaaggagaagcccguaaacaucgaggcagagccgcccuucggggaaagcuacaucgugaucggugcgggagaaaaggcccucaagcuguccugguucaagaaaggguccuccaucgggaagauguucgaagccaccgcccggggugcccgccggauggcgauucucggcgacacggccugggacuucgggagcaucgguggcguguucaccucggucggcaaguuagugcaccagaucuucggcaccgcuuacgggguccuguuuucgggcguauccuggaccaugaagauugggaucggagugcuccucacuuggcuaggacucaacagccgaucaaccucacuguccaugaccugcaucgugguaggacuggugacacucuaccugggggucaugguccaggccgacagcggcugcguaaucaacuggaagggccgggagcugaaaugcgguagcggcauuuuugugacgaacgagguccacacuuggaccgagcaauacaaguuccaggcugacuccccuaagcgccucuccgcggccauaggcaaagccugggaggaggggguguguggcauccggucugccacucgcuuagagaacauaauguggaagcagauuagcaacgaacugaaccacauccuucuggagaacgacaugaaauucaccgugguugugggggauguggcuggcauccuggcgcaggggaagaagaugauccggccacaacccauggaguacaaguacagcuggaaguccuggggcaaggccaagauaaucggugccgacguccagaacacaacauucaucaucgauggccccaacaccccggaaugccccgacgaccagcgcgccuggaacauaugggagguagaggauuacggcuucgggaucuucaccacgaacaucugguugaagcugagggacagcuacacccaggugugcgaccacagacuaaugagcgcggcgauaaaagacucuaaggccguucaugcggauaugggauacuggaucgagagcgagaagaacgagacuuggaagcucgcccgagcguccuucaucgaagugaagaccugcaucuggccaaagagccacacgcucugguccaacggaguacuggaaagcgagaugaucaucccuaaaaacuaugggggcccgauuucccagcauaacuaccgcccuggauacuucacacaaaccgccggaccauggcaccucgggaagcuggagcuggacuuugaccucugcgagggcaccacgguugugguggacgagcacugcggcaauagggggccgagccugcggaccacgacugucacagggaagaucauccacgaguggugcugcagauccuguacccugccgccgcuccguuucaagggggaggacggcugcugguacgggauggaaauuaggcccgugaaggagaaggaggaaaaucucgucaagagcauggucucagccggcuccggcgagguggacagcuucucacugggacuccugugcaucuccauuaugaucgaagaggugaugcgcucucgguggagcaggaaaaugcugaugaccgguacacuggccguccuguuccuccucaucauggggcagcuuacguggaaugaccuaauucggcucugcaucauggucggcgccaaugcguccgaucgcauggggauggguacuacguaucucgcccugauggccacguuuaagaugcgaccgauguucgccguaggucuacuguuucguagacugacgucgcgggagguucuccugcugacaaucggccucagucugguagccucaguggagcuacccaacucccuagaggaguuaggcgacgggcuggccaugggcaucaugauccucaagcugcugaccgauuuccagagccaccaguuaugggccacccugcugucccucacguucaucaaaaccaccuucagccugcacuacgccuggaagacgauggcgaugguccuguccauagugagccucuucccauuaugccucuccacgaccagucagaaaacuaccuggcuacccgucuuguuaggcucccucgggugcaagccgcugacgauguuccugaucgcugagaauaagaucuggggccgcaagaguuggccccucaacgagggcauaauggccgugggcaucgugagcauacuacugucgagccugcugaagaaugaugucccccuggccgggccccucauagccggaggaaugcugaucgccugcuacguaaucuccgggagcagcgcggaccugagccucgaaaaggccgccgaggugagcugggaggaggaggccgagcauagcggagccucccauaacauucuggucgaggugcaagacgacgggaccaugaaaaucaaggaugaggagcgggacgacacccugaccauccuccugaaggcuacccugcuggcgguaucuggcguguacccgcuauccauucccgcuacacucuucgugugguacuucuggcagaagaagaagcagcgcagcgguguguugugggauacacccaguccucccgaggucgagagagcaguuuuggacgacggcauauaccgcaucaugcaacgagggcugcugggccgcagccaggucggcgucggaguauuccaggagaacguguuucauaccauguggcacgucacccggggcgcggugcuuauguaucaggggaagcgcuuggagccuuccugggcguccgucaagaaggaccuaaucucguacggcggcggguggcggcuccagggcagcuggaauacgggggaggaaguccaggugaucgcgguagaacccggcaagaaccccaagaauguccagaccgccccggggaccuuuaagacuuccgaaggagaggugggcgccauugcacuagacuucaagcccggcacaagcggcagccccaucgugaaccgcgaggggaagauugucggccuguacggcaacggggugguaaccacuuccggcacauaugucucggcgauagcccaggccaaggccucacaggaaggccccuuaccggagauagaggacgagguguuccggaagcgcaaccugacgauuauggaccuacaucccggcagcgggaagacccgucgcuaccuuccggcuaucgugcgggaggccauuaagcggaaguuacggacccugauccuugccccgacgcgggucguugcguccgagauggccgaggcguugaagggcaugcccaucagguaccaaacgaccgcggucaagagcgagcacaccgggaaggaaaucgucgaccugaugugccacgccaccuuuacuaugcggcuccugucccccguacgcguucccaacuacaauaugaucaucauggacgaggcccacuucaccgaccccagcuccaucgccgcucggggguauaucagcacucgugucggaaugggggaggcugccgccaucuuuaugacggccacuccgccugguuccguggaggcuuucccccaaucaaacgccguaauucaggacgaggaacgggacaucccagagcgcucguggaauagcggguacgaguggauaacggacuucccugguaagaccguaugguucguccccagcauuaaaucaggcaacgacaucgccaacugcuuacggaagaacgggaagcgcgugauccagcucucccggaagaccuucgacacggaauaccagaagacgaagaauaacgacugggacuacgucgugacaaccgacaucagcgagaugggcgccaacuuccgcgcagaccgcgugaucgauccccgccggugucugaaaccggucauccugaaggacgggcccgagcguguuaucuuggccggccccaugcccgucacgguggcaucggcagcccagcggcguggaagaaucggccgcaaucacaauaaggagggcgaucaauacauuuacauggggcagccucugaacaacgacgaggaucacgcgcacuggaccgaagccaagaugcugcuugacaacaucaacaccccugagggcaucaucccggcucuuuuugagccugagcgggaaaaguccgccgccaucgauggggaguaccgucugcgcggcgaagcgcggaaaaccuucguggagcuaaugcgaagaggggaucuacccgucugguugagcuacaagguggccuccgagggcuuccaguauucggaccgaagauggugcuucgacggcgagcggaacaaccaggugcucgaagagaauauggacguagagaucuggacgaaagagggggagaggaagaagcugcgcccccguuggcuggaugcccguacuuauucugauccgcucgcccugcgggaguucaaggaguucgccgcuggccgucggagcguguccggggaccuuauccucgaaaucggaaaacuuccgcagcaccuaacccaacgugcccagaaugcccucgauaaccuggucaugcugcacaauagcgaacaaggagggcgcgcguauagacacgccauggaggagcuccccgacaccaucgagacgcucaugcugcucgcccugauagccguccugacaggcgggguaacccuguucuuccugagcggcagaggacugggcaaaaccaguauaggccuccugugcguuauggccuccagcguccuacucuggauggcuuccgucgagccccauuggaucgcggccaguaucauccuggaguucuuccugaugguccucuuaauccccgagcccgaucgucagcggacgccccaggacaaccagcuggccuacguuguaaucggguuguuauucaugauccugacgguugccgccaacgaaaugggccuccuggaaaccacuaagaaggaccucggaauaggccacgucgcgguggagaaccaccaucacgccgccaugcucgacguugaccugcaucccgccucagccuggacgcuguacgcggucgcuacgaccaucaucaccccgaugaugcgacacaccaucgaaaacacgacugcgaacaucagccucacagccauagccaaccaagccgccaucuuaaugggacuugacaagggcuggccgauuucgaagauggauaucggcgugccucuucuggcccuggggugcuacucccaggugaacccccucacccugacggccgcgguccugaugcugguggcccacuaugccaucaucggccccgggcugcaggccaaggcgacccgggaagcgcagaagcgcaccgccgccggcauuaugaagaacccgaccguggaugggaucgucgcaaucgaccuggaccccguuguguacgacgccaaguucgagaagcagcucgggcagauuaugcugcugauccucugcacgucucaaauccugcucaugcgcacgaccugggcgcucugcgagagcaucacccuggccacaggcccccugaccacccuaugggaagggucccccggcaaguucuggaacaccacgaucgccgucagcauggccaauauauucagggguucauaucuggccggcgcgggccuggccuuuucucucaugaagucccuagggggcgggcggcgggggaccggggcccaaggcgagacucugggcgagaaguggaaacggcagcucaaccaguuguccaagagcgaguucaacaccuauaagcggucagggauaauggagguagaccgcagcgaggccaaggagggccugaaacgcggcgagacgaccaagcacgcggugagucgcggcaccgccaagcuccggugguucgucgagcgcaaucugguuaagccagagggaaaggugaucgaccuuggcugcggccgcggcggguggagcuacuacugcgccgggcugaagaaggucaccgagguuaagggguacacgaagggcgguccuggccacgaagaacccauacccauggcaaccuacgguuggaaccucgucaagcugcacaguggcaaggacguguucuucauaccucccgagaagugcgacacucugcuuugugacaucggggagagcuccccuaauccgaccaucgaggagggccgcacguuaaggguguuaaaaaugguggagccuuggcucagggggaaucaguucugcaucaagauucugaacccguauaugcccagcgugguggagacccuugagcagaugcagcggaaacacggaggcauguuagugcgcaaccccuuaagucggaacagcacccacgagauguauuggguauccugcgggaccggcaacauugugagcgcggugaacaugacuucacgcaugcuccucaaccgguuuaccauggcccaccgcaaaccgacuuacgaacgcgacgucgaccugggggccgguacccggcacguggccguugagcccgagguugcaaaccuggacauuauuggccagcguauagagaacauaaagcacgaacauaagagcaccuggcacuacgaugaggacaaucccuauaaaacaugggccuaccacggguccuacgaggugaagcccagcggcagcgcgucgagcauggucaacggaguggugaaacuccugaccaagccuugggacgucaucccuauggugacccagaucgcgaugaccgauacgacgcccuucggccagcagcgaguguucaaggaaaaggucgauaccaggaccccuaaggccaagcgggggacggcucagaucauggaggugaccgccaaauggcuguggggguucuuaucccgcaacaaaaagccgcggaucugcacccgcgaggaguucacucggaaggugcgaagcaacgcggcaaucggcgccgucuucguggacgagaaccaguggaacucugcuaaggaggcgguggaggacgagcgguuuugggaccugguccaccgcgagcgcgagcuacacaagcaggggaaaugcgccacgugcguguauaacaugauggguaagcgggagaagaagcucggggaguucggcaaggccaaagggagccgugccauaugguauauguggcugggcgcgcgcuuccuggaguuugaggcgcugggcuucaugaacgaggaccauugguucucccgagaaaauagccucucugguguggagggcgagggccugcacaagcuggguuauauccuucgcgacaucucgaagauccccgggggcaacauguacgcugacgacacggcaggcugggacacccgaauuaccgaagacgaccugcagaaugaggcaaagaucacggacaucauggagcccgagcacgcgcucuuagcgaaguccaucuucaaacuuaccuaccaaaacaaggucguccgagugcagcggccugcuaagaacgggacggucauggacgucaucuccagacgcgaccagcgggguuccggacaggugggcaccuacgggcucaacacguucacgaacauggaggcccaguuaauccgccagauggagucugagggaaucuucagcccaagcgagcuggagaccccaaaucucgccggcagagugcuggacuggcuggagaagcauggaguggagcgccugaagcggauggcuaucuccggggacgacugcguggucaaacccaucgaugaccgcuucgcgaccgcccugacagcccugaacgacauggggaagguccguaaggauaucccucagugggagccuagcaaaggauggaacgacuggcagcaggucccuuucugcagccaccauuuccaccagcucauuaugaaagacggccgcgagauugucgugcccugccguaaccaggacgaguugguggggcgcgcccgagucagccagggcgccggauggagccugagagagacggcguguuugggcaaguccuacgcgcagauguggcagcuuauguacuuccaccggcgcgaccuacgguuggcagccaacgcgaucugcagcgccgugccgguggauuggguaccaacgucccgcacuacuuggagcauccaugcgcaccaccaauggaugaccaccgaagauaugcuuuccguguggaaccggguauggaucgaggagaaccccuggauggaggauaagacacacaucucuuccuggggcgauguccccuaccugggcaagcgcgaagaccaguggugcgguucacucaucgggcugacugcuagggccaccugggccaccaauauccaggucgccaucaaccagguccgccgcuugaucggcaaugaaaacuaucucgacuacaugaccagcaugaagcgcuucaagaacgagagcgacccugagggggcucugugguga

SEQ ID NO: 24115 - RNA, 9879 nt, Artificial Sequence
  derived and/or modified CDS sequence (opt11) from DENV-1__EU726782__SS-prME
agcguuaccaugcugcugaugcuuaugcccacugcccuggccuuccaccucacgacucggggcggggagccgcacaugaucgugagcaaacaggaaaggggcaagagccugcuguucaagaccuccgcaggggugaauauguguacccucaucgcuauggaccugggggagcugugugaggauacgaugaccuacaaaugcccacggaucacggaaaccgagcccgaugacguggacugcuggugcaacgccaccgacaccugggucaccuaugggacgugcagccagaccggcgagcaccggcgggacaagcgguccguugccuuagcgccucacguaggcuuaggguuagaaacgcggaccgagaccuggaugagcuccgagggcgccuggaagcagauccagcggguagaaacgugggcccuccggcaccccggcuucaccgugaucgccuuguucuuggcccacgcgaucgggaccucgaucacccagaaggggaucauauucauccuucugaugcuggugacgcccucaauggcgaugcggugcgucggcauaggcagccgcgacuuuguugaggggcucuccggcgcgaccuggguagaugucgugcuagagcacgggagcugcgugacaaccauggccaaagacaagcccacgcuagacauugaauugcugaaaaccgagguaacaaacccagcggugcugcggaaacucugcaucgaggcgaaaaucuccaauacuacgacagacuccaggugccccacccagggcgaggccacccugguagaggagcaggaugccaacuucgucugccgucgaaccuuuguggaucggggcugggggaacgggugcggacucuucggcaaggggagccucaucacgugcgccaaauucaagugcgugaccaagcuagaaggcaagaucgugcaguacgagaaucugaaguacagcguuauugugaccguccacacgggcgaccagcaccagguggggaacgaauccaccgagcacggcaccacugccaccaucacgccucaggcucccacaacagagauucagcucacggacuacggggcuuuaacacuggacugcagcccccgcaccggucucgacuuuaacgagaugguccugcugaccaugaaggagaaaaguugguuagugcacaagcagugguuucuggaccugccuuuaccauggaccucgggugccuccaccagucaagagacauggaaucggcaggacuugcugguuaccuucaaaacggcccacgcgaagaagcaggaggucguggugcucgguucgcaggagggcgcgaugcacacggcucugacaggagccaccgaaauccaaaccucuggcacgaccaccauuuuugccgggcaccugaagugucgcuuaaagauggacaaacuuacgcugaagggcaugagcuacgucaugugcacggggagcuucaaacucgagaaggagguggcugagacccagcacggaacgguucugguccagaucaaguaugagggcaccgaugcgccuugcaaaauacccuuccuuacccaggacgaaaagggggucacccagaacggccgucuaaucaccgccaacccgauugugaccgacaaggagaagcccgucaacaucgaggccgagccgcccuucggggagucguacaucauaauuggcgcuggugaaaaggcgcugaagcucuccugguucaagaaggggucuuccaucggaaagauguucgaggccacugcccgcggggcucggcgcauggccauccuaggggacaccgcgugggacuucggaagcaucggaggcguuuucacgaguguggggaagcucguccaccagauuuucgguaccgcguacggggugcuguuuaguggcgugucauggacgaugaagauaggcaucgguguccuacugacguggcugggucugaacagccgcaguacaagccucuccaugacgugcaucgcggugggccuggugacauuauaccucggcgucaugguacaggccgacagcggauguguuaucaacuggaagggcagggaacugaagugcggauccgguauuuucguuacgaacgaggugcacaccuggaccgagcaguacaaguuccaggccgacagcccaaagcgccucagcgcggccauaggcaaagccugggaggaaggaguaugcggcauccgguccgccacccgccucgagaacauaauguggaagcagaucagcaacgagcugaaucacauccugcuugagaacgacaugaaguucacgguagucgugggggacgucgccggaaucuuagcgcagggcaagaaaaugaucagaccacagcccauggaguacaaguacuccuggaaguccuggggcaaggcuaagaucaucggcgccgacgugcagaacaccaccuuuaucauagaugggcccaacaccccggaaugccccgaugaucagagagccuggaacauuugggagguugaagacuacggcuucggcaucuucacgaccaacaucuggcugaaacucagagacuccuacacccaggucugcgaccaccgccuuaugucugcggcaauaaaagacagcaaggccguacacgccgauaugggcuacuggaucgagagcgagaaaaacgagacguggaagcuggcccgagcuuccuucaucgaggugaagacgugcauauggcccaaaagccacacccucuggaguaacgggguccucgagucagagaugauuaucccuaaaaucuaugggggaccgauaucccaacacaacuaucggcccggguacuucacccagacggccggccccuggcaccugggcaagcuggagcucgacuuugaccugugcgaaggcaccaccguaguugucgacgaacacugcggaaacagggggcccagccuacgcaccaccacggucaccggcaagaucauccacgaguggugcugcagauccugcacgcuaccuccccugcguuuccgcggagaggacggcugcugguacgggauggagauccgcccugugaaggaaaaagaggaaaacuuggucaagagcaugguuuccgccggcagcggggagguggacagcuuuucgcuggggcugcuuugcauaagcauaaucaucgaggaagucaugcggucccgcuggagccggaagauguugaugaccggcacccuggccgucuucuuucugcucauaauggggcagcugaccuggaacgaccucauccgcuugugcauaauggugggagccaacgcgucggaccguauggggaugggcacgacauaccuggcucugauggccacauucaaaaugagaccgauguucgccgucggccugcuguuccgccggcugaccagcagggaggugcugcugcucaccaucggccucagccucguggccaguguagaacuaccuaacucgcuugaggagcugggcgacggguuggcgaugggcaucaugauccugaagcugcucacugauuuccagagucaccagcugugggccacgcuccucucucugaccuucaucaagaccaccuucucacugcacuaugccuggaagacuauggccauggugcucuccauugucucgcuauucccccugugccuguccaccacaagccagaaaaccacguggcugcccguacuccucggcucccuggggugcaagccgcucacaauguuucuaaucgcagagaauaagauauggggacgucgcucuuggccccuuaacgaggggaucauggccguggggaucgucucuauccugcucuccagcuuacugaagaacgaugugccacuagccgggccccucaucgccggcgggaugcuuaucgccugcuaugugauuuccgggagcagugcggaccucagccuggaaaaggcagcagagguaagcugggaggaggaggcugagcacagcggagcgucccauaauauccuaguugaggugcaagacgacggaaccaugaagaucaaagacgaagaacgggacgauacgcucaccauccuguugaaggcgacgcuacuggcggucagcggaguguacccgcugaguaucccggccacccucuucgugugguauuucuggcagaaaaagaagcaacgcagugguguccugugggacacccccuccccgccagagguugagcgggccguucuggacgacggcauuuaccgaaucaugcagcguggccuacucggcagaucucaggucggugugggaguuuuccaagagaacgucuuccacaccauguggcacgugacacggggagccgugcugauguaccaggguaagcgccuggagccguccugggcaagcgugaagaaagaucucauuagcuacgguggcggauggcgguugcaggggucguggaauaccggggaggagguccaggugaucgccguagagcccggcaaaaaccccaagaacguccaaacagccccggggacauucaagacgcccgagggcgaggugggcgccaucgccuuggacuucaagcccgguaccuccggcucccccaucgucaaccgggaaggcaaaaucguuggccucuacggcaacggcguggucaccaccucuggcacguacguguccgccauugcccaggccaaggccagccaggaaggaccccugcccgagaucgaggaugaaguuuucaggaagaggaaucuaaccaucauggaucuccaccccggcucggggaagaccagacgcuauuugcccgccaucgugagggaggccaucaagcgcaagcugcgcaccuuaauccuggcccccacucggguaguggccagcgagauggccgaggcgcugaagggcaugcccauccgcuaucagaccacagcagucaaguccgagcacaccgguaaggagauuguggaucucaugugccaugcaacguucaccaugcgucuguuaagcccagugcgcgucccgaauuacaacaugaucaucauggacgaggcccauuucacugacccauccucaaucgccgcgcggggguacaucuccacccgcgugggcaugggggaagcggcggccaucuucaugaccgccacgccucccgggaguguggaggcguucccacaguccaacgcggucauccaggacgaggaaagagacauacccgagcgaagcuggaacuccggguacgaguggaucacagauuuccccggcaagaccgugugguuugugcccagcaucaaauccggcaacgacauugccaauugcuuaaggaagaacgggaagcgcgucauccagcugagccggaagaccuucgacacagaguaccagaagaccaagaacaacgacugggauuacgugguuaccacggacauuucggagaugggcgcaaacuuucgugcggaucgagucaucgauccgcgacggugccugaagccagugauccucaaggacgggcccgagcgcgucauccuggcgggaccgaugccggucaccguggcuagcgccgcacagaggcgcggccggaucggccgcaaccacaacaaagagggugaccaguacaucuacauggggcagccccuaaacaaugacgaggaccacgcgcacuggaccgaagccaagaugcuccuggacaacauuaauacccccgagggcaucauccccgccuuguucgaaccggagcgcgagaagucggccgccauugacggggaguaucggcucagaggcgaggcacgcaaaacguucgucgagcugaugcgccgcggggaccugcccguguggcucucuuacaagguggccagcgagggcuuccaauauagcgaccgccgguggugcuucgacggggaacgcaacaaucagguguuggaagaaaacauggacguagaaaucuggaccaaggaaggggagaggaagaaacuaagaccucgauggcucgaugcacgcacuuacagugacccccuggcccugcgggaguucaaggaguucgccgcgggcaggcggucgguaagcggggaccucauccuggagauugguaaacuaccccagcauuugacccagcgggcccagaaugcccuggacaaccuggucaugcuacacaacuccgagcagggcgggcgggcauaucgccacgcgauggaggagcuacccgacacgaucgagacccugaugcuacuggcucugaucgcagugcucaccggcggggugacuuuauucuuucugagcgggcgcggacuaggcaaaacauccaucggccugcuguguguuauggcuagcucaguccuccuuuggauggccucaguggagccccacuggaucgcggccuccaucauccuggaguucuuccucauggucuugcugauccccgaaccugacagacagagaacgccucaggacaaccagcucgccuacgucgugaucgggcugcuuuucaugaucuugaccguggccgccaacgagaugggccugcuggagacgaccaagaaggaccucgguaucggucacgucgcgguggagaaccaccaccacgccgcuauguuggaugucgaccuucaccccgcaagcgcguggacacucuacgcuguggcaaccacuaucauuaccccgaugaugcgucacacgaucgagaacaccaccgcuaauaucucauuaaccgcuaucgccaaucaggcggccauucugauggggcucgacaagggcuggccaaucagcaagauggauauuggggugccccugcucgcgcucggcugcuauucgcaagucaauccccugacacugaccgccgcggugcucauguuaguugcccacuacgcuaucauuggcccuggccuacaagccaaggccacccgcgaggcgcagaagaggaccgcagcagggaucaugaagaaccccacggucgacgguaucguagccaucgaccuagaccccguuguguacgacgcaaaauucgaaaaacaacucggccagaucaugcugcuuauucugugcaccagccagauccuccucaugcguaccaccugggcucugugcgaguccauaacgcuugccaccgggccccucacuaccuugugggaggggagcccggguaaguuuuggaauaccaccaucgccgucucuauggccaacauuuuccggggcagcuauuuagccggugcgggucucgccuucucccugaugaaaucacucggagggggucgccgcgggacgggggcacaaggggagacacucggcgagaaguggaagcgccaguugaaccaacuuagcaaaucggaguucaauacguacaaaagauccgggauaauggagguggaccgcuccgaggccaaggagggccuuaagagaggggaaaccaccaagcacgcgguuagccgcggaacugccaaacugcgaugguucguggagcguaaccuggugaaacccgaggggaaggucaucgaccuuggcugcggccgcggcgggugguccuacuacugcgccgggcuuaagaaagugacggaggucaagggauacaccaagggcggucccgggcacgaggagcccaucccaauggccaccuauggauggaacuuggugaagcugcauagcggcaaggacguguucuucaucccgcccgagaagugcgacacucuccugugcgacauuggagaguccagcccgaacccgacgaucgaggagggcagaacccugcgcguacucaagauggucgagccuuggcugcgcggaaaccaguucugcauaaagauucugaaccccuacaugccguccgugguggagaccuuggagcaaaugcaacggaagcacggcgggauguuaguccgcaauccgcugagccgaaacucaacccacgagauguacugggugagcugcgggaccggcaacaucguaagugccgucaacaugacuagccgcaugcuccugaaccgauucaccauggcgcaucggaagcccaccuaugagcgcgacguagacuugggggccggcacccgccacguggccgucgaacccgaggucgccaaucucgacaucauaggucagcguaucgagaacaucaagcaugagcacaaguccacauggcacuacgacgaggacaaccccuauaagaccugggcuuaccacgggagcuacgaggugaagccgagugggagcgcguccucuauggucaauggaguagucaaacugcucaccaagcccugggauguuauacccauggugacacagaucgccaugacagacaccacucccuucggccagcagcgggucuucaaggagaaggucgacacccgcacgccaaaggccaaacgagggaccgcccagauuauggaagugaccgccaaguggcuauggggcuucuuaucgcgaaacaagaagccccggaucugcacccgcgaggaguucacgcggaagguccgcucaaacgcggccaucggagccguguucguagaugaaaaccaauggaauagcgcuaaggaggcggucgaggacgagcguuucugggaccuggugcaucgggagcgagaacuccauaagcaagggaagugcgcgaccugcguuuacaauaugaugggcaagcgcgagaaaaagcuaggggaguucggcaaggccaaggggucccgggcaauaugguacauguggcugggggcccgcuuccucgaguucgaagcgcugggguucaugaacgaggaccacugguucagccgcgagaacagccugagcgggguggagggagaagggcuucacaagcugggcuacauccugcgcgacauauccaagauccccgggggcaacauguacgccgaugacaccgccggcugggacaccagaaucacggaggacgaccuccagaacgaagcgcgcaucacugacaucauggagccggaacacgcccugcuugccaagaguaucuucaagcuaaccuaccagaacaaggugguacguguccagcguccagccaagaacgggaccguuauggacgugauuucccgccgggaucagcgcggcagcgggcaggucggcaccuacggcuuaaauacuuucaccaacauggaagcccagcugauccggcagauggagucagaagggaucuucagccccucggagcucgagauccccaacuuggccgaacgggugcuggacuggcuggagaaguaugggguggagcggcugaagcgcauggcgauuagcggggacgacugcgucgucaaaccgauugacgaccgguuugcgacugcccugacggcccucaaugacauggggaagguccguaaggacaucccacaaugggaaccauccaagggcuggaacgacuggcaacagguacccuucugcagccaccacuuccaccaacugaucaugaaggacggccgggagaucguggugccgugcagaaaccaagacgagcugguaggccgggcaagaguuagucaaggcgccggcuggucgcuucgugagacggcgugccuuggcaagucguacgcucagauguggcagcugauguacuuucaucgccgagaccuccgccuggccgccaacgcgaucugcucugccguccccgucgacuggaucccuacgucgcgcaccacaugguccauccacgcccaccaccaauggaugaccaccgaggacaugcuuuccguguggaaucgaguguggaucgaggagaacccauggauggaggauaagacccacaucucaucuuggggcgacgucccguaccucgggaagcgcgaggaccaguggugcggcucccugaucggccugacugcccgcgcgaccugggcgacgaacauccagguggccaucaaucaggugcggcggcucaucgggaacgagaacuaccuggauuacaugaccagcaugaagcgcuucaaaaaugaaggggaccccgagggagcccugugguga

SEQ ID NO: 24116 - RNA, 9879 nt, Artificial Sequence
  derived and/or modified CDS sequence (opt11) from DENV-1__EU677178__SS-prME
agcgugaccauguugcugaugcuuaugccgaccgcccuggcguuccaucucaccacacggggcggugaaccucacaugaucgucucaaagcaggaacgggggaaauccuuacuguucaagacaagcgccggugugaauaugugcacccucaucgccauggaccugggagaacugugugaggacaccaugaccuacaagugcccccgcaucaccgagaccgagcccgacgacguggacuguuggugcaaugccaccgacaccugggugacuuacggaaccugcucacagacgggagagcaucggcgggacaagcggucuguagcccuggcuccccacgucggacugggucucgaaacgcgcaccgagaccuggaugagcuccgagggcgcguggaaacagauacagcgagucgagacgugggcccuccggcaccccggcuucaccgugaucgccuuguuccuggcgcacgcgaucggaaccucaauuacccagaaggggaucaucuucauccuccuuaugcugguuacgcccucgauggcgaugcggugcguuggcauuggcagccgcgacuuugucgagggccucucaggugccaccuggguggacgugguucuugagcacgggagcugugugaccacgauggccaaagauaaacccacguuggacaucgagcuuuugaagaccgaggugacgaacccagccgugcugcguaaacucugcaucgaggcgaaaauuuccaacacuacgacagauagccgcuguccaacacagggagaagcaacgcuaguugaagaacaagacgcgaauuucgucugccggcgcacuuuuguggaucggggcuggggaaacggcugcgggcuguucggcaaggggucacucauaacgugugccaaauucaagugcgugacgaaauuagaaggcaagaucguucaguacgagaaccuaaaguacagcguaaucgugaccguucacaccggcgaccagcaccaaguugggaaugaaagcaccgaacauggaaccaccgccaccaucacgccccaggcgcccacgacagagauccaacucaccgacuacggggcucugacucuggacugcuccccucgcacaggcuuggauuucaaugagaugguccuccugaccaugaaggagaaguccuggcucgugcacaagcaaugguuucuggaccugccccuccccuggaccagcggggccagcaccagucaggagacuuggaaccggcaagaccugcuggugaccuuuaagacggcucaugccaagaagcaggagguuguggugcucggcagccaggagggcgcgaugcauacagcccugaccggugccacugaaauccaaaccucuggcacaaccaccaucuucgcaggccaccuuaaaugccgauuaaaaauggauaagcugacccuaaaagggaugagcuacgucauguguacgggguccuucaagcucgagaaagagguggcagagacccagcacggcacggugcucguccagaucaaguacgagggcacagacgcgcccugcaagauacccuuucucacgcaggacgagaagggggucacccaaaaugggcgauugauaacagccaacccgauagugacggauaaggaaaaacccgucaacaucgaggccgagccgcccuucggggagagcuacauuauaaucggcgccggugagaaggcucucaaauugucuugguucaagaagggcucgagcaucggcaagauguuugaggcaacugccagaggggcacggcgcauggccauacugggcgacaccgcgugggacuucgggucuaucggcggcguguucaccagcguugggaagcugguccaccagauauuuggaacugccuaugggguacucuucucugguguguccuggacgaugaagaucgggaucggcguacuccucaccuggcuaggccuaaacagccgauccaccagccucucaaugaccugcauugccguugggcuaguuacgcuguaccuuggcgucaugguacaagccgauuccgggugugucaucaacuggaagggcagggaacuaaaguguggguccgguaucuucguuaccaacgaggugcacaccuggaccgagcaauauaaauuucaggcugacucucccaagcgucugagcgcggccaucgggaaagccugggaggagggggucugcggcauccguuccgccacaaggcuagagaacaucauguggaagcagauuuccaacgagcugaaccauauauuacucgagaaugacaugaaguuuacggucgugguaggggacguugcgggcauccuggcgcaggggaagaagaugauccggccccagcccauggaauacaaguacucauggaagucuuggggcaaggccaagaucaucggcgccgacgugcaaaacacaaccuucaucaucgacgggcccaauaccccggaaugccccgacgaccagcgcgcguggaacaucugggagguggaggacuacggauucgggaucuucacgacaaacaucuggcugaagcucagagauucacauacccaagucugcgaccaccgccugaugagcgcggccaucaaggacuccaaggcugugcacgcagauaugggcuacuggaucgagagcgaaaagaacgagaccuggaagcuagcucgggcgucauuuauugagguaaaaacguguaucuggcccaagagccauaccuuauggucgaacggcguccuggaaagcgagaugaucauccccaagauuuacggaggcccgaucucccaacacaacuaucgccccggauacuucacccagacagccggccccuggcaccugggcaagcucgagcuggacuucgauuugugcgaaggcacgacggugguggucgaugagcacuguggcaaccgggggccgagccuccgcacuaccacugugacaggcaaaaucauccacgaguggugcugcagguccugcacacuaccaccccuucgcuuccgcggggaagacggcugcugguacggaauggagauccgcccggugaaggagaaagaggagaaccuggucaagagcauggugucagcggguagcggcgaaguggacuccuucucuuuagggcuuuuguguaucagcaucaugaucgaggaagucaugcggucccgcuggagccggaagaugcuuaugaccggcacgcuagcuguguucuuccuccugaucauggggcagcugacauggaaugaccuaauccgcuuauguaucaugguaggcgccaacacuuccgaucggauggggaugggcaccacauaccuggcgcucauggccaccuucaagaugcgucccauguuugccguaggccugcuguuccgcaggcucacuagccgcgaggugcuguugcugaccaucggacugucccuggucgcaagcgucgagcuucccaacucccuggaggagcugggcgacgggcucgcgaugggcauaaugauccuaaagcugcucacggacuuccagagucaccaacugugggcgacccuacuaucccucaccuucaucaagaccacguucucacugcauuacgccuggaagacgauggccauggugcucuccaucgucucacuguucccgcugugccucuccaccacaagccaaaagacaacaugguuaccagugcugcuuggcucccugggguguaagccccucacaauguuccucaucgcggagaacaagaucugggguagaagaagcuggcccuugaacgaggggaucauggcggugggcaucgucucuauacugcucagcagucuacugaagaaugacgugccccucgccgggccccuuauagccggaggaaugcucaucgcaugcuaugugaucuccgguagcuccgcugaccuuucacuugagaaggcugcagagguguccugggaggaggaagccgagcacagcggggcaucccacaauaucuuaguggaaguucaggacgauggcaccaugaagauuaaggacgaagaacgggacgacaccuugaccauacugcugaaggccacccugcuggcggucagcgggguguauccgcugucaauucccgccacccucuucgucugguacuucuggcagaagaagaagcaacgcagugggguccucugggacacccccaguccgcccgaggucgaacgggccguucuggacgacgguaucuaccgcaucaugcagcgaggccugcucgggcgcucgcaagucggggugggaguauuccaggagaauguauuccacacgauguggcacgugacucggggcgccgugcugauguaccagggaaagagauuggagcccuccugggcgagcgucaagaaggaucucaucuccuacgguggcggguggaggcuccagggaagcuggaacaccggggaggagguccaggugaucgcaguagagccaggcaagaaccccaagaaugugcaaacggcccccgguacuuucaagacgcccgagggcgaggugggugccauugcccuugacuucaagcccgggaccagugguagcccaauagucaaccgcgaggggaagaucguggggcuuuacggcaauggggugguuaccacguccggcaccuacgugucugcgauugcgcaggcgaaggcuagccaagaggggccgcugcccgagaucgaagacgaggucuuccggaagcgcaaucugaccaucauggaucuacaccccggcuccggcaaaacccgucgguacuugccggcaaucguccgcgaggcgauuaagagaaaacugcggacgcucaucuuagcccccacccgggugguggccagcgagauggccgaggccuugaaggguaugcccauccgcuaccagaccacugcugucaagucagaacauacgggcaaagagaucguggaccucaugugccacgccaccuuuaccaugcggcugcugagccccgugcgaguaccaaacuauaacaugauuaucauggacgaggcucacuucaccgaccccuccaguaucgcggccagaggguacaucaguacgcgcgugggcaugggggaggcggcugccauauucaugaccgccacgccucccggcagcguggaggcuuucccgcaguccaacgcgguuauccaagacgaggagcgggauaucccggagcgcagcuggaacucgggguacgaauggaucacggauuucccugguaaaacggugugguucgugcccucaauuaaguccggcaacgacaucgccaauugucuccgcaagaacggaaagcgcguaauacagcugucgcggaaaaccuucgacaccgaguaccagaagaccaagaacaacgacugggacuacguggucacgaccgacaucagugaaaugggcgccaacuuccgcgccgaccgggucauugacccucgucggugccugaaaccagugauccugaaggaugggcccgaacgagucauccuggcaggcccuaugccggucacaguggcuuccgccgcccagcggcgcgggcgaauagguaggaaucacaauaaggaaggugaccaguacauauacauggggcagccccugaacaaugacgaggaccacgcacauuggaccgaggcaaagauguugcuggacaacauaaacacgcccgaagguaucauucccgcacuuuucgagccggagcgcgagaaguccgccgccaucgacggggaguaucgacugcgcggggaggcccggaaaacuuuugucgagcucaugagacgaggggaccugcccguuuggcucucguacaagguggcguccgaggguuuccaauacucggaccgccgguggugcuucgauggagaaagaaacaaucagguccuggaggagaacauggauguggagauauggaccaaggagggagagcggaagaaacugcgcccccgaugguuggacgcccgcaccuacagugacccacuggcgcuacgggaguucaaggaguuugccgccggcaggcggucugugagcggggacuuaauccuggagaucgggaaacuuccccagcaccucacucagcgcgcucagaaugcccuggacaaccuggugaugcuccacaacagugagcaaggcggccgugccuaccgccacgcgauggaggaguuacccgacaccauagagaccuugaugcuccuggcgcugaucgccguuuugacuggcggggucacucuauucuuccugaguggccggggacuggguaagacguccaucggccuucugugcgugauggccagcuccgugcuccuauggauggccuccguggagccccacuggaucgccgccaguaucaucuuagaguucuuccucaugguccugcuaauccccgaaccugaccgccagcgcacgccccaggacaaccagcucgccuacguugugaucggucugcuguucaugauacucaccgucgccgccaacgagaugggucuguuggagacgacgaagaaggacuuggggaucggacacguugcuguugagaaucaccaccacgcggccaugcuggaugucgaccugcaccccgccagcgccuggacucucuacgccguggccaccaccauuauuacaccgaugaugaggcacaccaucgagaacaccaccgccaacaucagccugacggcaaucgccaaccaggccgcgauacugaugggguuggacaagggauggcccaucuccaagauggauaucggggugcccuugcuggcgcucggguguuacucccagguuaaccccuuaacucugacugcggcagugcuuaugcugguggcgcacuacgccauaaucggcccagggcugcaggccaaggcaaccagagaggcucagaagcggacggcggcgggcaucaugaagaacccuaccguugacgggauaguggccaucgaccucgaccccgugguuuacgacgccaaguucgagaagcagcugggccagaucaugcuccuaauucugugcaccucucagauucugcucaugcgcacuacgugggcucugugugagucgauaacccuggcaacaggcccccucaccacgcugugggaggggagcccgggcaaguuuuggaacacuacuauugccgugucgauggcaaacaucuuccgggggucauaccuggccggcgccggccuagcguucuccuuaaugaagucccucgggggcggacgccgggggaccggagcccagggcgagaccuugggugagaaguggaaacgacagcugaaccaguuaucgaaauccgaguucaacacuuacaaacggagcggaauaauggaaguggaccgguccgaagccaaggagggccucaagcgcggcgagaccacuaagcaugccgucagccgaggcacggcgaagcugcggugguucguggagcgcaaccuggugaagcccgaggggaaggucauugacuugggcugcggucgcggcggcugguccuacuauugcgccgggcuuaagaaggucaccgagguuaaggguuacacuaaagggggcccgggccacgaggagcccaucccaauggccacguacggcuggaaccuuguaaaauuacauagcggcaaggacgucuucuucaucccucccgagaagugcgacacucuccucugcgacaucggggaguccagccccaacccgacaaucgaggagggccgcacccugcgugugcuaaagauggucgagcccugguugcgcgguaaccaguucugcauaaagaucuugaaucccuauaugccguccgugguggagacccucgaacagaugcaacggaagcacggcggaaugcugguccgcaacccgcuuucgcggaacaguacccacgagauguauuggguuagcugcggaacgggcaacaucguguccgcaguaaacaugacgucgcgcaugcucuugaaccgcuucaccauggcucaccggaagcccaccuaugagcgugacguugaccugggggcagguacgcggcacguggcugucgagcccgagaucgcaaacuuagacaucaucggccagcgcaucgagaacaucaagcacgaacacaagucuaccuggcacuaugacgaggacaauccauacaaaacgugggccuaccacggaagcuacgaagugaagccguccgguagcgccucaagcauggugaacggugucguuaagcugcuaacaaaaccgugggacgugauccccauggugacgcagaucgcgaugacggacaccacgcccuucggccaacagcggguguucaaggagaaggucgauacgcgcacaccaaaggccaaaagagggaccgcucaaauuauggaggugaccgccaaguggcucuggggcuuccugagccgcaauaagaagccccgaaucugcacucgcgaggaguuuacccguaaagugagguccaacgccgcgaucggcgccgucuuuguggaugagaaccaguggaacucugcgaaagaggcuguggaggaugaacgguucugggaccugguccaucgcgagagggagcuccacaagcaaggaaaaugcgcgaccugcguguauaacaugaugggcaaacgcgagaagaagcugggggaguucggcaaggccaaggggucgcgugcaaucugguacauguggcugggcgcucgcuuccucgaguucgaggcccugggauucaugaacgaggaccacugguuuagccgggagaacagccugagcggggucgagggcgagggucuacacaaacuuggauacauccugcgcgauaucuccaagauuccugggggcaauauguacgcggacgacacagcagguugggacacccggaucaccgaggacgaccuucagaacgaagcccgcaucaccgacaucauggagccggagcacgcccuccuggccaagagcaucuuuaaguuaaccuaucagaacaaggucgugcgcgugcagcggcccgccaaaaacgguacugucauggacgucaucucacgccgggaccaacgcggcaguggacagguagggaccuacggccugaacaccuucacaaacauggaggcccagcugauccggcagauggagucagaggggaucuucagccccucggagcucgagacucccaaucuggcagagcgggugcuggacuggcucgagaaauacggcguagagcggcugaaacgcauggccaucagcggcgaugacuguguggugaagccaaucgacgaccgguucgccaccgcgcugaccgcgcucaaugacaugggcaaggugcgcaaggacaucccccagugggagcccuccaagggauggaacgacuggcagcagguacccuuuugcagccaccacuuccaccagcugaucaugaaggacggcagagagaucgucgugccgugucgcaaccaagaugagcugguuggaagggcccgcgucucccagggggcgggcuggagccuccgggagacagccugcuugggcaagucauacgcgcaaauguggcagcugauguacuuccaccgccgggaucuccgcuuggcugccaacgccaucugcuccgcggugcccguggacuggauacccacgagcaggaccaccugguccauacaugcccaccaccaguggaugaccacagaggacaugcuaagcguguggaaucgcguguggaucgaggagaaccccuggauggaggacaagacccacauauccuccuggggcgacgucccguaucuugggaagcgcgaagaccaguggugcggaucccugaucggccuuaccgccagggcaaccugggccaccaacauccaagucgcgaucaaccaggucaggagauuaauagggaacgagaauuaccuagacuacaugaccucuaugaaacgcuucaaaaacgagggcgaccccgagggcgcccugugguga

SEQ ID NO: 24117 - RNA, 9879 nt, Artificial Sequence
  derived and/or modified CDS sequence (opt11) from DENV-1__EU687251__SS-prME
agcgucaccaugcucuuaaugcugaugcccaccgcccuggccuuccaccucaccacccgcggcggugagccccacaugauugugagcaaacaggagcgaggcaaaagccuccuauucaagaccagcgccggggugaacaugugcacccucaucgccauggaccugggcgagcugugcgaagauaccaugacguacaagugcccccggaucaccgagaccgagcccgaugauguggacugcuggugcaaugccacggacaccugggucaccuacgggaccugcagccagacgggugagcaccggagggacaagagaaguguggcccucgcgccccacguaggccuggggcuggagacccgcaccgagacuuggaugagcucugagggcgccuggaagcagauccagcgcgucgagacaugggccuugcggcaccccggguucaccgugaucgcgcuguuccuggcccacgcgaucggaaccagcaucacgcaaaagggcaucaucuucauccucuugaugcugguuacacccuccauggccaugaggugcguuggcaucggcagccgcgacuucguugagggucucuccggcgccacuuggguggacgucguacuggagcauggaucuugcgugaccacuauggccaaggauaagcccacucuggacaucgaguugcugaagaccgagguuacgaaccccgcugugcugcggaagcucugcauagaggcgaagaucuccaacaccacgaccgacagccgcugcccgacacagggggaggccacccugguagaggaacaggacgccaacuucgucugccggcgcacguucguagaccgggggugggguaacggcugcgggcuguucgguaaagguucccucaucacgugcgccaaguucaagugcgugaccaagcuggaggggaagaucguccaguacgagaaccucaaguauagcgugaucgucaccguccacacgggcgaccaacaccagguggggaaugaguccaccgagcacggcaccaccgccacgaucacgccacaggcgcccacuaccgaaauccaacucaccgacuacggggcccugacgcuggauugcagcccccguaccggccucgacuucaacgagaugguccugcuaacaaugaaggagaagaguuggcucgugcacaagcagugguuccuggacuuaccucucccuuggaccucuggggccagcacgucgcaggagaccuggaacaggcaagaccuucuggugaccuucaagacggcccacgcgaaaaagcaggaggucguggugcucgggagccaagagggagcgaugcacaccgcccugaccggggccaccgaaauucagaccuccggcacgaccacuaucuucgccgggcaccuaaaaugccgguuaaagauggacaagcugacccugaaaggcaugagcuacgucaugugcaccggguccuucaagcucgagaaggaggucgccgagacccagcacggcaccgugcugguccagaucaaguacgagggcaccgacgcgcccugcaaaauccccuucagcacgcaggacgaaaagggggucacccagaacggccgacugaucaccgccaauccgaucgugacggacaaggagaagccaguaaacauugaggccgagccgccuuucggggaaucuuacaucaucaucggggcaggcgagaaggcacugaagcucucgugguucaagaaagggagcucaaucggcaagauguucgaagccacggcccgcggagcccgccgcauggccauccugggggacaccgcgugggacuucggguccaucggcggcguguucaccagcguggguaaguuaguacaccagaucuucggcaccgccuacggggugcuguucucaggcgugucauggaccaugaagaucgggaucggcguacugcugaccuggcucggccuaaacucccgcagcaccagucugucuaugaccugcaucgccguugggcucguuacgcuguaccugggcgucaugguccaggcagacucggggugcgugaucaacuggaagggcagggagcucaagugcggcagcggcaucuuugugaccaacgaggugcauaccuggaccgagcaguacaaguuucaggccgacagcccgaagcgccuguccgcugccaucggcaaggccugggaggagggggugugcggcauccggagcgccacccgccuugaaaacaucauguggaagcagaucuccaacgaacucaaucacauccugcuggagaacgauaugaaguucacggucguggugggggacgucgccggcauccucgcgcaggggaagaagaugauccgaccccagcccauggaguauaaguauagcuggaagagcuggggcaaggcaaagaucaucggcgccgacgugcaaaacaccaccuucaucaucgacgggcccaacaccccggagugucccgaugaucagcgcgccuggaacauaugggagguggaggacuacggcuucgggaucuucaccaccaacauauggcugaagcugcgggacagccacacacaagucugcgaccaccgucucauguccgcggcuaucaaggacucgaaggccgugcacgcggacaugggcuacuggaucgaguccgaaaagaacgagaccuggaagcuggcuagggcgagcuucauugaggugaagacgugcaucuggcccaagucgcauacccuguggagcaacggcgucuuggaguccgagaugaucaucccaaagaucuacggcggccccaucagccagcauaacuaucgccccggguacuuuacccagaccgccggccccuggcaccuggggaagcuugagcucgauuucgaccugugcgagggaacgacuguaguggucgacgagcacugcggcaaccggggcccuuccuuacguacaaccacagugaccggcaagauaauucacgagugguguugucggagcuguacacugccuccccuccgcuuccguggggaagauggguguugguacggaauggagauccgccccgugaaggagaaggaggagaacuuagucaaguccauggugagcgccgggucaggcgagguggacuccuucagccucggccugcugugcaucuccaucaugaucgaggaggucaugcggagccgcuggucacggaagaugcucaugacaggcaccuuagccguguucuuccugcuaaucauggggcagcugaccuggaacgacuuaauccgccucugcaucaugguuggcgccaacgccucggaccgcauggggaugggcaccaccuaccuggccuuaauggccacauucaagaugcgaccgauguuugccgucggucuccuguuccgccgccugaccuccagagaggugcuccugcugaccaucggacucagccugguugccuccguugagcugccaaacucacuagaggagcugggcgacgggcuggcgaugggcauaaugauccuuaaguugcuuacggauuuccaaucccaccagcucugggcuacgcugcugagccucaccuucauuaagaccaccuucucacugcacuacgccuggaagacgauggccauggugcugucaaucgucucccuuuucccauuaugucugagcaccacuagccagaaaaccacguggcuuccagugcugcuuggcucuuuggguuguaagccgcugaccauguuccugaucgcggaaaacaagaucuggggccggcgcuccuggccccucaacgaggggauuauggcugugggcaucgucuccauccugcugagcucccuccugaagaacgacgugccguuagcggggccccucaucgccggcggcaugcugaucgccugcuacguuaucucagguucgagcgcugaccuaucccucgagaaggccgcugaggucagcugggaagaggaagccgaacacuccggcgccagccacaacauccugguggagguccaagacgacgggaccaugaaaaucaaggacgaggagcgggacgacacccugaccauccuccugaaggcgacgcugcucgccgucucgggcguguacccguugagcauccccgccacccuguucgugugguauuuuuggcagaagaagaagcaacgcuccgggguucucugggauacccccucgccucccgaaguggaacgggccguacucgacgacggcaucuaucgcauuaugcagcggggccugcuggggcgcucccaggugggcgugggcguuuuucaggagaacgucuuccacaccauguggcacgugacgcggggcgccgugcucauguaucaggggaagcgccuggagcccagcugggcguccgucaagaaggaccugaucagcuacggcggcggguggcggcuccagggcuccuggaacacgggggaggaaguccaggucauagcggucgagccgggcaagaaccccaagaacgugcagaccgcccccgggaccuucaagacgcccgagggcgaggugggggcaaucgcccuggacuucaagcccgggaccucuggcucccccaucgucaaucgcgagggcaagaucgugggccuguacggcaacggcguggucacaaccagcggcaccuacgucagcgcaauagcccaggccaaggcuucccaggagggcccgcuccccgagaucgaggacgagguguuucggaaacgcaaccuaaccaucauggaccugcacccgggaagugggaaaacacggcgcuaccuuccggcgauaguccgggaggccaucaagcgcaagcugcgcacccugauccucgcgcccacccgggugguggccucugagauggccgaggcccugaagggaaugcccauuagguaccagaccaccgccgucaagucggaacacaccggcaaggagauuguggaccugaugugccacgccacguucaccaugcggcuacugucccccgugcgcgucccgaacuauaacaugauaaucauggacgaggcacacuucacggaucccagcuccaucgcugcucggggguacaucagcacccgcgugggcaugggugaggccgccgcuaucuucaugacggccaccccacccggcucuguggaggccuucccgcagaguaacgccgucauccaggacgaggagcgcgacauccccgagcgcagcuggaacagcggguacgaguggaucaccgacuuccccggcaagacagugugguucgugcccuccaucaagagcggcaacgacauagcgaacugccuacggaagaacgggaagcgcgucauccagcucucccggaagacguuugacaccgaguaccagaagacgaagaauaaugacugggacuacguggugaccaccgacaucagcgagaugggcgcgaacuuccgcgcggaccgggucaucgacccucgucggugccugaagcccgugauccugaaagacgggcccgagcgcguuauccucgccggccccaugccugucaccguggccuccgccgcccagagacgaggccggaucggccggaaccacaacaaggaaggcgaccaguacaucuacauggggcaaccccugaacaacgacgaggaccaugcgcacuggaccgaggcuaaaaugcugcucgacaauauaaacacccccgagggcaucaucccggcccuguucgaaccggagcgagagaagucagccgccauagacggggaguaccggcugcgcggcgaagcccguaagacguuugucgaacucaugcgccgaggggaccugcccguguggcucuccuacaagguggccagcgagggcuuccaauacagcgaccgccgguggugcuucgacggcgagcgcaauaaucaaguccucgaggagaacauggacguggagaucuggaccaaggagggagagcggaagaagcugcgcccccgguggcuggacgcccgcaccuacuccgacccccucgcccugcgagaguucaaggaguucgccgcgggccgcaggagcguguccggggaucucauccucgagaucggcaagcugccgcagcaccugacccagcgcgcccaaaaugcccuugacaacuuagucaugcugcacaacagcgagcagggcgggcgggccuaccgccacgcgauggaagagcucccugacacgaucgaaacccugaugcugcucgccuugaucgccgugcuaaccggcggggugaccuuguucuuccuauccggccgggggcugggcaaaaccagcaucggccuccugugcgucauggcuuccagcgugcugcucuggauggccuccguggagccccacuggaucgcggcgucgaucauccuagaauucuuccucaugguucuacuaauccccgagccggaccgucaacggacgccccaggauaaccagcuggccuacguaguuaucgggcuccuguucaugaucuugacaguagccgcaaacgagaugggccuacuggagacaaccaagaaggaccuggguaucggccacguugcaguggaaaaccaucaccacgccgcuaugcuagacgucgaccugcaccccgccuccgccuggacacuguacgccguggccaccacaaucaucacgccgaugaugcgucacacgaucgaaaacacuacugccaauaucagccuuacugccaucgccaaucaggccgccauccugauggggcuggacaaaggcuggccgaucucuaagauggauaucggcgugccccucuuggcccuggggugcuacagccaggucaacccccucacguugaccgccgcugugcugaugcuuguggcccacuaugcuaucaucggcccggggcuucaggccaaggccacccgcgaggcgcagaagcggaccgccgccggcaucaugaaaaaccccacggucgacgguaucguggccaucgaccuggaccccguggucuacgacgccaaguucgagaagcagcucggccagaucaugcugcugauccucugcaccucccagauccugcugaugcgcaccacaugggcgcucugcgagucaaucacgcuugccaccggcccccugacgacccucugggaaggaagcccgggcaaguuuuggaauacuacuauagcggugucaauggccaauaucuuccggggcuccuaccuagccggcgcgggcuuggccuucagccucaugaagucccucgggggcgggaggaggggaaccggggcccagggcgagacccugggugaaaaguggaagcgccaacucaaccagcuguccaaaagcgaguucaacacguacaagcggagugggaucauggagguggaccgcagcgaggccaaggaggggcucaagcgcggggagaccaccaagcacgcagucucccgcggcaccgccaagcuccggugguucgucgagcgcaaucuggugaaaccagaggggaaagucaucgaccugggcugcggccgggggggcugguccuacuacugcgccgggcugaagaaagucacggaagugaagggcuacacuaagggcggcccuggccacgaggagcccaucccgauggccacuuacggguggaaccuuguuaagcugcauuccggcaaggacguuuucuuuauaccgcccgaaaagugcgacacccuguugugcgacaucggggagucaagcccgaaccccacgaucgaggagggccgcacccugcgugugcugaagaugguggagcccuggcucaggggcaaucaauuuugcaucaagauccugaaccccuacaugcccuccgugguggagacccuggagcagaugcagcggaaacauggcggcaugcucguccgcaacccgcugucccgcaacucuacccacgagauguacugggugucgugcgggacaggcaacaucguguccgccgucaacaugacgucccgcaugcugcugaaccgcuucacgauggcgcaccggaagcccacauacgagcgcgauguugaccugggggccggcacccggcacguggcugucgagcccgagguagccaaccuggacaucaucggccaacgcaucgagaauaucaagcacgagcacaagagcaccuggcacuacgacgaggacaaccccuacaaaaccugggccuaccacggguccuaugaggugaagccgagcggcuccgcgucgucuauggucaacgggguggucaagcuccugaccaagcccugggacgugauccccauggugacucagaucgccaugacggacaccacccccuucgggcagcagcggguauucaaggagaagguggacacgcgcacgccgaaggcgaagcggggaaccgcccagaucauggaggugaccgccaaguggcuguggggcuuucucucccgcaacaagaaaccccggauuugcacccgcgaggaauucacgcggaagguucgaagcaacgcggccaucggcgccguguucguggacgagaaccaguggaacuccgccaaggaggccgucgaggaugagcgguuuugggaccuagugcaccgcgagcgggagcugcauaagcagggaaagugcgcgaccugcguguauaacaugauggggaagcgagagaagaaacucggggaguucgguaaggcaaaggggagccgcgcaaucugguacauguggcugggcgcccgcuuccuggaguucgaggcacucggguucaugaaugaggaccacugguucucccgggagaacagcuuauccggggucgagggcgaggguuuacacaagcugggcuacauauuaagagacauaagcaagauacccggcgggaacauguacgcugacgacaccgccgggugggacacccgcaucaccgaggacgaccugcaaaacgaggcccgcauaaccgacauaauggagccggagcacgcccuccuggcaaagucuaucuucaagcugaccuaccagaacaagguggugcgcguccagcgacccgccaagaacgggaccguaauggaugugaucagccgccgggaccagaggggcuccggucaggugggcaccuacggccucaacaccuucaccaacauggaagcccagcugauccggcaaauggaaagcgaggggaucuuuuccccaagcgagcuggagacccccaaccucgccgagagagugcuggacuggcugaaaaaguacggcguggaacgccucaagcggauggccaucuccggggacgauugcgucguaaagcccaucgacgaccgguuugcgacggcccugaccgcgcucaacgacaugggcaaggugcgcaaggauaucccccagugggagcccaguaagggcuggaacgacuggcagcaggucccauucugcucucaccacuuccaccaguuaaucaugaaggacgggcgggagaucguagugccaugcaggaaccaagacgagcuggucggccgagcccgcgugucucagggggcuggcuggucgcuccgggagaccgcuugcuuggggaagagcuaugcccaaauguggcagcugauguacuuccaucgccgggaccuccgccucgccgccaaugcgaucugcagcgccgugcccguggauuggauccccaccucccggacgaccuggagcauacacgcccaccaccaguggaugaccacggaagacaugcugucgguguggaaccgcgucuggaucgaggaaaaccccuggauggaggacaagacucacaucagcaguuggggcgauguaccguaccuggggaagcgggaggaccaguggugcggcagccucaucggccugaccgccagagcaaccugggcgaccaacauacaggucgccaucaaucaggugaggcggcugauagggaacgagaauuacuuggacuacaugaccuccaugaaacgcuucaagaacgaaagcgaccccgagggcgcccugugguag

SEQ ID NO: 24118 - RNA, 9879 nt, Artificial Sequence
  derived and/or modified CDS sequence (opt11) from DENV-1__FJ024427__SS-prME
ucaguaacaaugcugcugaugcugaugcccaccgcccuggccuuccaccucacaacccgcggaggggaaccgcacaugaucguaagcaagcaggagcggggcaagucacuguuauucaagaccagugccggagugaacaugugcacgcucauugccauggaccugggcgaacugugcgaggacaccaugaccuacaagugcccccggaucaccgagaccgagccagacgacguggacugcuggugcaacgccacggacaccugggugaccuacgggaccuguagccagaccggcgagcaccggcgcgauaagcgguccguggcccucgcuccccacgugggccuggggcuggagacgcgcaccgagacauggaugagcuccgagggcgcguggaagcaaauccagcgggucgagacuugggcccuucgccaucccggguucacagugaucgcccuguuccuggcccacgcgauuggcaccucaauaacccagaaggggaucaucuucauccuccugaugcucgucacgcccuccauggcuaugcggugugucggcaucggcagcagagacuucguggagggacuauccggcgcgacuugggucgacgucgugcuggagcacgguuccugcgugaccacgauggccaaggacaagcccacgcuggacauugagcuccugaagacugaggucacgaaccccgccguguuacgcaaguuaugcauagaggcgaagaucaguaauaccacgaccgacucccgcugucccacucagggcgaggccacccucguggaggagcaagacgccaacuucgucugccggcgcacauucguggaucggggcugggggaacgguugcggauuauucggcaagggguccuugaucacaugcgcuaaguucaagugcgugaccaaacuggaaggcaagaucguccaguaugagaaucucaaguacagcgugauaguuaccguccacacgggugaucagcaccaggugggaaacgaguccacggaacacggcaccaccgccacuaucacgccgcaggcgccgaccaccgagauccagcucaccggcuacggcgcacugacgcuagacugcagcccccgcacaggguuggacuucaacgagaugguccugcugacuaugaaggagaaguccuggcucgugcacaaacagugguuccuggaccucccccuccccuggacgagcggcgcgagcacaagucaggaaacguggaaccggcaggaccuguuagugacguucaagaccgcccaugccaagaagcaggagguagugguccucggcucucaggagggggcgaugcacacggcccugaccggcgccaccgagauccaaacuucagggacgaccaccaucuuugcaggccaccugaagugcagacucaagauggauaaacugacccucaaggggaugucauaugugaugugcacuggcucguuuaagcucgaaaaagaaguggccgaaacccagcacggcaccgugcugguccagaucaaguacgagggagcggacgcacccugcaagauccccuucagcacacaagacgaaaagggcauaacgcagaacgggcggcugaucaccgccaauccgauagugaccgacaaggaaaagcccguuaauaucgaggccgaaccgcccuucggagaguccuauaucgucauaggagccggggagaaggcucuaaaacucagcugguucaagaagggguccagcaucggcaagauguucgaggcuaccgccaggggcgccagacggauggcgauucugggugacacggccugggacuucggcuccaucggaggaguguucaccagcgugggcaagcugguccaccagaucuucggcaccgccuaugguguccucuucucagggguaucauggaccaugaagaucgguaucggcguccuacugacuuggcucggacugaacucccgcucgaccucccugagcaugaccugcaucgcugugggccuagugacccuguaccuuggugucauggugcaggccgacuccggaugcgucaucaacuggaaaggacgggaauugaagugcggaagcggaaucuucgucacgaacgagguacacaccuggaccgagcaguauaaguuccaggcggacagcccgaaacgccugagcgccgccaucggaaaggccugggaagagggcgugugcgggaucagaagcgccacacgccuggagaacaucauguggaagcagaucucuaaugagcucaaccacauacugcuggagaacgacaugaaauucacggugguggugggcgacgucgccggaauccucgcgcagggcaagaagaugauccggccacagcccauggaguacaaguacagcuggaaguccuggggcaaggccaagauuauaggcgccgacguacagaacacgaccuuuaucaucgauggcccgaacacucccgagugccccgacgaucagcgcgcguggaacaucugggagguggaggacuacggguucgggaucuucaccacgaacaucuggcugaaacugcgggacucguacacccaggucugugaccaccggcucaugucggccgccaucaaggacagcaaggccguccacgccgacaugggcuacuggauugagagcgagaagaaugaaacguggaagcuggcgcgagccagcuucaucgaggugaaaaccugcauuuggcccaagucccacacucuguggagcaacgggguucucgaguccgagaugaucaucccaaagaucuacggcgguccgaucucucagcacaacuauagacccgguuacuucacccagaccgccgggcccuggcaccugggaaagcuggagcuggacuucgaccugugcgagggcacaacggucguggucgacgagcacugcggaaaccgggggccgucccucagaacaaccaccgugacgggaaaaaucauccacgaauggugcugccgaucuugcacgcuuccgccccugagguuccggggugaagaugggugcugguacggcauggagauucgccccgugaaggagaaggaagagaaccuaguaaaguccauggugagcgccggcagcggggagguggacuccuuuucauuaggucugcucugcaucucuaucaugaucgaggaggucaugcgcucacgcuggucccggaagaugcucaugaccgggacccuggccguguucuuucuccucaucaugggccagcugacuuggaacgaucugauccggcucugcaucauggugggggcuaacgcgagcgaccgcaugggcaugggaaccaccuaccuggcccugauggccaccuuuaagaugcggccgauguucgccgucggccucuuguuccgccgacugacgucccgcgaaguccuccugcugaccaucggccucagccugguagcguccgucgaacugcccaacucgcucgaggaacugggggacggccuggcuauggggaucaugaucuuaaaacuucugacggacuuucagucccaccagcuaugggccacuuuacuaagccuuacuuuuaucaagacgaccuuuagccugcacuacgccuggaagaccauggcgaugguucugaguauugucucccucuucccccugugccugucaacuacuucccagaagaccaccuggcuuccuguacugcuggggucccucggcugcaaaccccuaacgauguuucugaucgccgagaauaagaucuggggaagacgcuccuggccucuuaacgaagguauuauggccgucgggauugucuccauccugcugaguuccuuacugaaaaacgauguaccccuggccggcccccucauagccggcgggauguugaucgccugcuacgugauaagcggcuccagcgccgaccugucccuagagaaggccgccgagguaucaugggaagaggaagccgagcacaguggggcuagccauaacauccugguggaggugcaggaugacggcaccaugaagaucaaggacgaggagcgggacgacacccugaccaucuugcugaaggccaccuugcucgcagucuccgggguguacccgcugucgauacccgccacguuauucgugugguacuucuggcagaagaagaaacagcgcuccggcguucugugggauacccccuccccgcccgagguggagcgggccguucuggaugacggaaucuauaggaucaugcagcgggggcugcugggucgcucccaggucggagugggcguuuuccaggagaacgucuuccacaccauguggcauguaacccgaggggcagugcuuauguaccagggcaaacggcuggagccgagcugggccuccgucaagaaagaccuuauaagcuacggcgggggcuggcggcuacagggguccuggaauacgggcgaggagguccaggugauagcagucgaaccgggaaagaaccccaagaaugugcaaaccgcccccggcaccuucaagaccccagagggagaggugggggccaucgcgcuggacuucaagcccggcacgucggguucccccauagugaaccgcgagggcaagauugugggccuguauggcaacggcguggucaccaccagcgggaccuaugugagcgccaucgcgcaagcgaaagcgucgcaggaaggcccacuaccugagaucgaagacgagguguuccgcaagcgcaaccugacgaucauggauuugcaccccgggagcggcaagacccggcgcuaccugccagccaucgucagagaggccaucaagcggaagcugcgaacccugauucuugcuccaacucgggugguggccuccgagauggcggaggcccugaagggcaugccgauucgcuaccagacaaccgccgugaaaagcgagcacaccgggaaggaaaucguggaucucaugugucacgccacguucacgaugcggcuccugucccccguucgcguuccgaacuacaacaugaucaucauggaugaagcccacuucaccgaccccagcuccaucgcggcccguggcuacaucagcacgcgcgucgggaugggcgaggccgccgccaucuuuaugacggcgacuccgcccggaagcguggaggccuucccgcagagcaacgccguuauccaggacgaggaacgggacauccccgagcgcuccuggaauagcggcuacgaauggaucaccgacuuccccggcaagaccgugugguucguccccuccaucaagucgggaaacgacauugccaacugucuacggaagaacgggaagcgcgucauacagcucucccggaagaccuucgacaccgaauaccagaaaaccaagaacaacgacugggacuacguggugacgaccgauaucagcgagaugggcgcaaacuuccgcgccgaccgcgucauagauccgcgccgaugccuuaagcccgugauccugaaggauggccccgagaggguuauacucgccgggcccaugccggucacgguugccuccgccgcucagcggcgcggccggaucggccgaaaccacaacaaggagggcgaccaguacaucuacaugggccagccccugaacaacgacgaagaccacgcacacuggaccgaggcuaaaaugcugcucgacaacaucaacacccccgaggguaucauccccgcccuauucgagcccgagcgcgaaaaguccgcugcuaucgacggcgaguaccggcugagaggggaagcccggaagaccuucgucgaacucaugaggcggggcgaccugcccguauggcuuuccuacaagguggccagcgagggguuccaguacagcgaucgccgguggugcuuugacggggagagaaacaaccaggucuuggaagagaauauggacguggagaucuggacaaaggagggcgagaggaagaaacugaggccccgaugguuagacgcccgcaccuacuccgaccccuuggcacuucgggaguucaaggaauuugcggccggucgccgcucaguuuccggcgaccugauccucgagaucggcaagcuaccgcagcaccuuacccagcgcgcccagaacgcucucgacaaccuggucauguuacacaacucagagcaaggugggcgggcguaccgccacgcaauggaggagcuccccgacaccauugaaacguuaaugcuguuggcccugauugcagugcugacagguggcgugacccucuucuuuuuaagugggaggggccugggcaagaccagcaucgggcuccugugcguuauggccuccagcgugcuccucuggauggcaaguguagagccccacuggaucgccgccuccauaauccuggaguuuuuccugaugguccuccuaauccccgagccggaccgccagagaacuccccaggacaaccaacuggccuacguggugaucggccuccuguucaugauucugacgguggccgcgaaugagaugggccuccuagagaccaccaagaaggaucucggcauugggcauguugccguggagaaccaccaucacgccgccaugcucgacguugaccuacaucccgcuucggcguggacccucuaugccguggccacgaccaucaucacaccgaugaugcgccacaccauagagaauacgacugcuaacauuagccucaccgcuaucgcgaaccaggccgccauccuaaugggccuggacaaaggguggccaaucuccaagauggauaucggcguuccccuccuggcgcuggguugcuacagccaggucaacccccucacgcugacggcggcaguucucaugcucgucgcccacuacgccaucauagggccggggcugcaggccaaggcgacccgugaggcucagaagcggaccgccgcagggauaaugaagaaccccaccguugacggcaucguggccaucgaccuugaccccgucgucuacgaugcuaaguucgagaagcagcuaggccagaucaugcuguugauccucugcacaucccagauccugcugaugcgaaccacgugggcucucugcgagagcaucacccuagccacgggaccgcuuacgacacucugggaggguuccccgggaaaguucuggaauacaacgauagccguguccauggccaacaucuuucggggcucuuaccuggcgggcgcuggucuggccuucagccucaugaagucacugggcgggggccgccgugggacaggcgcccagggcgagacacugggugaaaaguggaagcgacagcucaaccaacucuccaagagcgaauuuaacaccuacaagcgcuccgggaucauggagguggaccgcagcgaggcaaaggaggggcugaagcggggcgaaacgaccaagcacgcugugucucgaggaaccgccaaguugcgaugguuuguggagaggaaccugguaaagcccgaaggcaaggucaucgaucugggcugcggucggggcggguggagcuacuacugcgccggucuuaagaaggugaccgaggugaagggguauacgaagggcggacccgggcaugaggaacccaucccaauggccaccuauggcuggaaccucguuaaguuacacuccgggaaggacguguucuucauuccgccggagaagugcgacacccugcucugugacaucggcgagagcucccccaacccgaccauagaagaagggcgaacucugcgcgucuugaagauggucgagcccuggcuccgcggcaaccaguucugcaucaagauccugaauccuuauaugcccagcguuguggagacccuugagcagaugcagcggaagcacggagggaugcucgugcgcaacccgcugucgcggaacagcacgcacgaaauguacuggguguccugcggcaccgggaacaucguguccgccgucaacaugacuucccgcaugcugcucaaccgcuuuacgauggcccaccggaaacccacguaugagcgcgacguggaccugggcgccggcacccgccacguggccguggaacccgagguggcgaaccuggacauuaucgggcagcgcaucgaaaacaucaagcacgagcauaagagcaccuggcauuaugacgaagacaauccuuacaagacgugggcguaccacggcuccuacgaggugaagccgagcgggucagccagcagcauggucaauggaguugucaaacugcugaccaagcccugggacgugauccccauggugacccagaucgccaugaccgacacgacacccuuugggcagcaacgggucuucaaggaaaaaguggacacccggaccccgaaagccaaacggggcacugcccaaaucauggaagugaccgcgaaguggcuguggggguuccucucgaggaacaagaaacccaggaucugcacgcgcgaggaguucacuaggaagguccgcagcaacgccgccaucggggccgucuuuguggacgaaaaucaguggaacuccgcgaaggaggccgucgaagaugagcgguucugggaccugguccaucgagagcgggagcugcacaagcagggcaagugcgccacgugcguuuauaacaugauggggaagagggagaagaagcucggcgaguuugggaaggccaaaggcagccgggccauuugguacauguggcuuggcgcgcgcuuucuggaguucgaggcccucggauucaugaacgaagaucacugguucaaccgggaaaacucccugagcggaguugagggggaaggcuugcacaagcucggguacauauuacgcgacauuuccaagauccccggcggcaauauguacgccgacgauacugcugggugggauacucggaucaccgaggacgacuuacagaacgaggcacgcaucacggacaucauggagccggagcaugcguugcuggcuaggagcaucuucaagcugaccuaccagaacaaagugguccggguccagcgccccgccaagaacggcacggugauggacgugaucucccgacgggaccagcgugggagcggccaggucggcaccuacggguugaacacguucacuaacauggaggcacagcugauccgccagauggaguccgagggcauuuucucccccuccgagcuggagacccccaaccucgccgagcgggugcuggacuggcuggagaaguacgggguggaacgccucaagcggauggcgaucagcggcgacgacugugucgugaagccgaucgacgaucgcuucgccaccgcccugacagcucugaacgacauggggaaggugcggaaggacaucccccagugggagcccuccaaagguuggaacgacuggcagcagguucccuuuugcagccaucauuuccaucagcucaucaugaaggacggccgcgagaucguggugccuugccggaaccaggacgaacuugucgggcgcgcucggguaucccagggugccggguggagcuuacgugaaaccgccugccucggaaagaguuaugcccagauguggcagcuuauguacuuccaccggcgcgaucuucgguuggccgccaacgccauuugcucagccguucccgucgauuggauccccaccagccgcacuacgugguccauucaugcacaccaccaguggaugaccaccgaggauauguuguccguuuggaaccgcguguggauugaggagaauccguggauggaggacaagacccacaucucaagcuggggcgacgucccguaucuaggcaaacgggaggaccagugguguggcuccuugaucgggcugacggccagggcgaccugggccaccaacauccaaguagccaucaaucaggucaggcgccuaaucggcaacgagaacuaccuagacuauaugacgagcaugaagcgguucaaaaacgaaucggaucccgaaggggcccugugguga

SEQ ID NO: 24119 - RNA, 9879 nt, Artificial Sequence
  derived and/or modified CDS sequence (opt11) from DENV-1__FJ024428__SS-prME
agcgugaccaugcuuuugaugcuuaugcccacugcccuugcauuccaccucacaacccgugguggggaaccccacaugaucgugucgaagcaagagcgagggaagagccugcuguucaaaaccucggcaggggugaacaugugcacccucaucgcaauggaccugggcgagcuuugcgaggacaccaugaccuacaagugcccccguauaaccgaaaccgagccagacgacguagacugcuggugcaacgccaccgacaccugggugaccuacggaacguguagccagacgggcgagcauagaagagacaaacgauccguagcgcucgcgccucaugugggccuggggcuggagacccgcaccgagaccuggaugagcuccgagggcgccuggaaacagauccagagaguggagacgugggcccuccggcacccgggguucacggugacggcauuguuccuagcccacgcgauuggaaccagcaucacucaaaaggggauaaucuuuauacuccugaugcugguaaccccuuccauggccaugcgguguguagguaucgguagccgcgacuuuguggaggggcucucgggcgccacguggguggacguugugcuugagcacgggagcugcgucaccacgauggccaaagauaagccgacccuggacaucgaacuccugaagacugaggucacgaaucccgccgugcugcggaagcucugcauugaagcgaagaucuccaacacgaccaccgacucgcgcuguccaacccaaggcgaagccacgcugguggaggagcaagacgccaacuucgucugucgccggacguucguagaccggggcugggggaacggaugcggguuauucggcaagggcucccuuaucacgugcgccaaguucaaaugugugacaaagcuggaagguaagaucguccaguacgagaaccugaaauacagcgugaucgucacuguccacaccggcgaccagcaccagguugggaacgaguccacagagcauggcaccaccgcgacgaucaccccccaggcgccgaccaccgaaauacagcucacggacuacggggcccugacacuggacugcagcccucgcaccggccucgauuucaacgagaugguccugcucaccaugaaagaaaagagcuggcucguccacaaacagugguucuuggacuugccccuacccuggaccagcggggcgaguacaucccaggagaccuggaaucggcaggaccugcuugugaccuucaagacggcccacgcuaaaaagcaggaagucguggugcugggcagccaggagggcgcgaugcauaccgcccucacuggugccaccgagauccagacgagugguaccacuaccaucuucgccgggcacuugaaaugccgccucaaaauggacaagcugacgcugaaaggcaugagcuauguuaugugcaccggguccuucaagcucgagaaggagcuggcagagacccagcacgggaccguguuagugcagaucaaguacgagggcacggaugcgccuugcaagaucccuuucaguacccaggacgagaagggugucacccagaacggacgguugauaaccgcuaacccaauagugacggauaaggagaagcccgugaauaucgaggcugagccaccguucggggaguccuacaucgucaucggugccggcgagaaagcucugaagcugucaugguucaagaaggggucuagcauaggcaaaauguucgaagccacagcacgcggggccagaaggauggccauucuaggcgauacugcgugggacuucgguuccauuggcggcguguucaccucaguggggaaguuaguccaccagaucuucgggacggcguacgggguacuguucuccggcgugagcuggaccaugaaaauugggaucggcguccuacucaccuggcuggggcuuaacucccggagcacaagccucucaaugacgugcaucgccguggggcugguaacacuguaccucggcgucauggugcaggccgacuccgggugcguuaucaacuggaagggccgagaacuuaagugcgggucgggcauauucguaaccaacgaagugcauaccuggaccgaacaauacaaguuccaggccgacucgccgaagcgccuguccgcggccaucgguaaggcuugggaggaggggguaugcggcauccgguccgccacacgcuuagagaacauuauguggaagcagauaaguaacgagcugaaccacauccugcuagagaacgacaugaaguucaccgucguggugggggacgucgccggcauccuugcucaagggaagaagaugauacggccgcaacccauggaacauaaauacagcuggaaguccuggggcaaggcuaagaucaucggcgccgaugugcaaaauacgaccuucaucauugacgggcccaauacgccggagugccccgacgaccagagggccuggaacaucugggagguugaggauuacgguuucgggaucuuuaccaccaauaucugguugaagcuccgggacagcuacacccaggucugugaucaucgccugauguccgcugccaucaaagacagcaaggccgugcacgccgacaugggcuauuggauagaguccgagaagaacgagacguggaaacuggcccgggcgucuuucaucgaggucaaaaccugcauauggccaaagucccauacccucugguccaacggcguccuggaguccgagaugaucaucccgaagauuuacgggggcccgaucagccagcacaacuaccgccccggguacuucacccagacggccgguccuuggcaucuggggaagcucgagcuggacuucgaccugugugagggcaccaccguggugguggacgagcacuguggcaaccgggguccgucccuccgcacuacgaccgugaccggcaagaucauccaugaguggugcugccggagcugcacacugccgccacugcgauuccgaggggaggacggcugcugguaugggauggagauccgucccgugaaagagaaagaggagaaccucgucaaguccauggugagcgcaggcagcggcgaaguggacuccuucagucuggggcugcucugcaucuccaucaugaucgaggaagucaugcgcagccguuggucccggaagaugcugaugacaggaacucuggcuguguucuuccucuuaauaguggggcagcugaccuggaaugaucuaauccgccugugcaucauggucggugccaacgccagcgaccgaauggggaugggaacgacguacuuggcucucauggccaccuucaagaugaggccgauguucgcgguggggcugcucuuccgccggcucaccucacgcgagguacugcuacucacuaucgggcugagccucguugcuuccguggaguuacccaacucgcuggaggagcugggugacgggcucgccaugggcaucaugauccugaagcugcucacggacuuccagucccaucagcugugggccacccugcuuagccucaccuucaucaagaccacguucucccugcacuacgcguggaaaaccauggcgaugguccucaguguggugagccuauuuccccugugccucagcaccaccagucagaagacuaccugguugcccguccugcucggcucacugggcugcaagccacugaccauguuccucaucgcggagaauaagaucuggggccggcgauccuggccccugaacgaggggaucauggcaguagggauuguuagcauccugcugagcucgcugcugaagaacgacgucccccucgccgggccucugaucgccggcggcaugcugaucgccugcuauguaaucucaggguccagcgcagaccuuucucuggagaaggccgccgaggugucgugggaagaagaggccgaacacuccggcgccucgcauaacaucuuggucgagguucaggacgacggcaccaugaagauaaaagacgaggagcgggacgacacccucacgauccugcugaaggcgacccucuuagccguguccggcgucuacccgcugagcauacccgccacacuuuuugugugguacuucuggcaaaagaagaagcagcgcucggggguccugugggacacccccagcccgcccgaggucgagcgagcggugcuggacgacggaaucuaccguaucaugcagcgggggcuucucgggcgcucccaggugggggucggaguauuccaggagaacguguuccacacgauguggcacgucacccggggcgcaguuuuaauguaccaggggaagcgccuggagcccucgugggcguccgugaaaaaggaccucauuagcuacgguggcgguuggcggcugcagggcuccuggaauacaggggaagagguccaggugaucgccguggagcccggcaagaaccccaaaaacguccaaaccgccccggguacuuuuaaaacccccgagggcgaggucggcgccaucgcccuagacuucaagcccgggaccagcggcucccccauugucaaucgcgaggggaaaaucgucggauuguacgggaacggggucgugacaacgucaggcaccuacgugagcgcgaucgcucaggcaaaggccucccaggaggggccgcugcccgagaucgaggacgagguuuuccggaagcguaaccugaccaucauggaccuccaccccggcagcgggaagacgagacgauaccugccggcgauuguacgggaggcgaucaagagaaagcugcgaacgcucauccuggcccccaccagaguuguggcauccgagauggcagaggcacugaagggcaugcccauuagguaccagaccacugccgucaagagcgagcacacgggaaaggagaucgucgaucucaugugccacgcuaccuuuaccaugcgucugcuuucgcccguccgcgugccuaacuauaacaugauaaucauggaugaggcacacuucacugauccuucguccaucgccgcgagagguuauaucuccacgcgcgucggcaugggggaggccgccgccaucuucaugacggccaccccgcccggcaguguggaggcguucccucagucaaacgccgugauccaggaugaggaacgggacaucccggaaagguccuggaacagcggguaugaguggauaaccgacuuccccgggaagacggucugguucgugcccuccaucaaauccggaaacgacaucgcgaacugucuccggaaaaacgggaagcgcgugauccagcugucccggaaaaccuucgauaccgaguaccagaaaacuaagaacaacgacugggauuaugucgugacuaccgacauaagcgagaugggcgccaacuuccgcgcggacagagugaucgauccgcgccggugccugaaacccgucaucuugaaagauggcccugagaggguuauccuggccgggcccaugccugucaccguggcuuccgccgcccagcggcgagggcggauaggcagaaaccacaacaaggagggcgaccaguacaucuacauggggcagccucugaauaaugacgaagaccacgcgcacuggaccgaggccaagaugcuacuugacaacaucaacacgccggaggguaucauccccgcgcuguucgagccggagcgcgagaaguccgcggccaucgacggggaguaucgacuccgaggggaagcgcggaagaccuucguggagcugaugcgcagaggggaccucccaguauggcucaguuacaagguggccuccgagggcuuccaauacagcgacaggcgguggugcuucgacggcgagcguaacaaccaggugcuggaggagaacauggaugucgagaucuggacgaaggagggggagcgaaagaaguugcgcccccgguggcucgacgcgcgaaccuacuccgacccacucgcccugcgcgaguucaaggaguucgcugcgggccgccggagcguguccggggaccucaucuuagagauaggaaaguugccucagcaccuaacgcagcgcgcccagaacgcacucgauaacuuggugaugcugcacaacagcgagcagggcgggcgggccuaccgccacgcgauggaggagcuacccgacacgaucgagacccugaugcucuuagcccugaucgccguauugaccggaggggugacacuguucuuccuguccggccgggggcuagguaagacuagcaucggucuccugugcgugauggccucaagcguacuccuuuggauggccuccguggaaccgcacuggaucgcggccagcauaauccucgaguucuucuuaauggugcuacugauccccgaaccggaccgucagcggacgccucaggauaaccagcuagccuaugucguuaucggacuucucuucaugauccucaccguggcggcgaacgagaugggcuuacuggagaccacgaagaaggaucucgggaucggccacguggcagucgagaaccaccaucacgcggccaugcuggacguggaucugcacccggccagugcauggacgcuauacgcugucgccaccaccaucaucacgccgaugaugcgccacacgaucgagaacaccaccgccaacaucagccugacggcuaucgccaaccaggcggccauccugaugggauuggacaaaggcuggcccaucuccaagauggacauaggcgugccccuucuggcccucggguguuauagccaggugaacccccugacccucaccgccgcgguccuuaugcugguggcccacuacgccaucauagguccgggucugcaggcuaaggcaacccgcgaagcgcagaagcggacugccgccggcauaaugaaaaacccaacuguggacgggaucgucgccaucgaccucgaccccgugguguacgaugcaaaguuugagaaacagcugggacagaucaugcuccugauccugugcaccagccagauccugcucaugaggacgacgugggcgcugugcgagagcaucacccuggccaccggcccccucacuacgcugugggaggggucccccggcaaguucuggaauacaacuauagccgucagcauggccaacaucuuccggggguccuaccuggccggcgcgggccucgcauuuagccugaugaagucucuugggggaggucgccgggggaccggcgcccagggcgagacguugggugagaaauggaaacgacagcugaaucagcuauccaagagcgaguucaacaccuauaagcgguccgggaucauggagguggaucgcagcgaggcuaaggagggcuugaagcgcggggagaccaccaagcaugcggugucccgcggcacggcgaagcucagaugguucgucgagcgcaaucuggugaagcccgaggggaaggugaucgaucuggggugcggccgggggggcuggagcuauuacugugcugggcugaaaaaggucacggaggugaagggcuacaccaagggcggccccggccacgaggaacccaucccgauggccaccuacggguggaaccuggugaaguuacacuccggcaaggacguuuucuuuaucccgcccgaaaaaugcgacacgcuccugugugacaucggggagaguagcccaaacccgacuaucgaggagggccgcacacugcggguucucaagaugguggagcccuggcugcgagggaaccaguucugcauuaagaucuugaacccuuacaugcccagcgucguggaaacccuggagcagaugcagcggaagcacggcgggaugcuggugcgcaacccucugucccggaacagcacccaugagauguauugggucuccugcggcacaggcaauaucgugucugccgucaacaugaccucccgcaugcuccugaaccgcuucacgauggcacacagaaaacccaccuacgagcgcgacgucgaccugggggccggcacccggcauguggccguggagcccgaagucgccaaccucgauaucaucgggcaacgcaucgagaacauuaagcacgagcacaagagcaccuggcacuacgacgaggauaaucccuacaagaccugggccuaccacggauccuacgaggugaagccuagcggcuccgcgagcagcauggucaaugggguagugaagcugcugaccaaacccugggacgucauccccauggugacgcagaucgcaaugaccgauaccacgcccuucggccagcagcggguauuuaaagagaaggucgacacacgcacccccaaagccaaacgggggacggcucagaucauggaggugaccgccaaguggcucuggggguucuuaucccgcaauaagaaaccccgcauaugcacgcgcgaggaguucacacggaagguacgaagcaacgcagccaucggugccgucuucguugacgagaaccaguggaauuccgccaaggaggcgguggaagacgagagauucugggaucugguccaccgugagcgagagcuccacaagcaggggaagugcgcgaccuguguauacaacaugaugggcaagcgugaaaagaagcugggggaguucggcaaggcaaaggggagccgggccauuugguacauguggcucggcgccagguuccucgaauucgaggcgcugggcuucaugaacgaggaccacugguuuucccgggagaacagccuguccggcguggagggcgaggggcuccacaaacugggcuauauacugcgcgacaucucuaagauccccgggggcaacauguacgccgacgacacagcaggcugggacacgcggaucaccgaggacgaccuccagaacgaggcccgcaucaccgacaucauggagccggagcacgcccugcucgcgaagucgaucuuuaagcucaccuaccaaaacaaagucguccgcgugcagcggcccgccaagaacgggacugugauggacgucauuagccgccgggaccagaggggcuccggacaggugggaaccuauggccugaacaccuucaccaacauggaggcucaacugauccggcagauggagagugaggggaucuuuucucccagcgaguuggagacuccgaaccucgccgagcggguccuggauuggcucgaaaaguacggcguggagcgcuuaaaacgaauggccaucucuggggacgacuguguggucaagccgaucgacgaccgguucgcgaccgcccugacggcccucaacgacauggguaagguacguaaggacaucccccaaugggagcccagcaagggguggaacgacuggcaacagguccccuucuguucccaucacuuccaccagcucaucaugaaggacggcagggagaucgucgugccgugcaggaaccaggacgagcuggugggccgugcacgggucagccaaggcgccggauggagucuucgggagaccgcgugccugggcaagaguuacgcccagauguggcagcugauguacuuccaccgccgggaccuaagacuggcugccaaugcgaucuguucagccgugcccguggauuggauccccacgagucggacuacauggagcauccacgcccaucaucaguggaugaccacggaggacaugcugagugucuggaaccgcguguggaucgaggaaaaccccuggauggaggacaagacccacaucagcuccuggggcgacgugccguaucuagggaagcgcgaggaccaguggugcggcagccuaaucggccugacagcccgggccaccugggcgacaaacauccaggucgccaucaaccaggugcggcggcucauugggaacgagaacuaucuggacuacaugacguccaugaagcgcuucaagaacgagagcgauccggagggcgcccugugguaa

SEQ ID NO: 24120 - RNA, 9879 nt, Artificial Sequence
  derived and/or modified CDS sequence (opt11) from DENV-1__FJ024429__SS-prME
agcgucaccaugcugcucaugcugaugcccaccgcccuggccuuucaccucaccacccggggcggcgagccccacaugaucgucagcaaacaggagcgggggaagagccugcuguuuaagaccagcgccggggugaacauguguacccugaucgccauggacuugggcgaacugugcgaggauaccaugaccuauaaguguccacggauaaccgaaaccgagcccgaugauguggacugcugguguaaugcgacggacaccugggugaccuaugggaccugcagccagacgggagagcaccgccgcgacaagcggagcguggcccucgcgccgcacgugggccuugggcuggaaacccgaacggagaccuggaugagcuccgagggcgcguggaagcaaauacaacgggucgagacgugggcccugcgccaccccggguucaccgugaucgccuuauuucuggcccaugccaucggcacgagcaucacccagaaggggaucaucuucauacucuuaauguuaguaacacccuccauggcaaugcggugcgugggcaucgguagccgcgacuucguagagggguuguccggagcgaccuggguggaugucgugcuggagcacgggagcuguguuaccaccauggccaaggauaaacccacgcuggacaucgagcuccugaagaccgaggucaccaaucccgccgugcugcggaagcucugcaucgaagcaaagaucagcaacaccacgacagacagccgcugcccgacccaaggcgaggccacccugguggaggagcaggacgccaauuuugucugccggcgcacguucgucgaucggggcugggggaacgguugcgggcuguucggaaaggguucccuaaucacgugcgccaaauucaagugcguaaccaaacuggagggaaaaaucguccaguacgagaaccugaaguacucugucaucgugacuguccacacgggcgaccagcaccagguggggaacgagucgaccgagcacggcaccaccgccaccaucacgccgcaggcccccaccaccgagauucaacucacugacuauggggcccugaccuuagacugcagcccccgcaccggucucgacuucaaugagaugguccugcugaccaugaaggagaaaucuuggcucgugcacaagcagugguuccuggaccugcccuuacccuggaccuccggggccagcacgucccaggaaaccuggaaucggcaggacuuacuggugaccuuuaagacggcccacgccaagaagcaagagguaguggugcucggcagccaggaaggcgcgaugcacacggcccugaccggggccaccgagauccagaccucggguaccaccaccaucuucgccgggcaccugaagugucgccucaagauggacaaacugacccugaagggcaugagcuacguaaugugcacgggaucguuuaagcucgagaaggagcuggcggagacccagcacggaaccguguuggugcagauuaaguacgagggcaccgacgcgcccugcaagauccccuucaguacgcaggacgagaagggagugacacagaacggccgccucaucaccgcgaacccgaucgugaccgauaaggagaagcccgugaacaucgaggccgagccgcccuucggggagagcuacauagucaucggcgccggagaaaaggcgcucaagcuguccugguucaagaaggguuccagcaucggcaagauguucgaggcgacagcccgcggggccagacgcauggcuauccuuggagacacagcuugggacuucggguccaucggaggcguguucaccagcguggggaagcucguucaccagaucuucggcaccgcauacgggguguuguucagcggcgugagcuggacgaugaaaaucgggaucggcguccucaugacuuggcugggccugaacuccagaaguaccucccuguccaugaccugcaucgccguggggcuggugacucuguaccugggagucauggugcaggcagacuccgggugugugauuaacuggaaaggacgggagcucaaaugcggaagcggcaucuucgucaccaacgaggugcacaccuggaccgaacaguacaaguuccaggccgacagcccuaagcgccuguccgcggccaucggcaaggccugggaggaaggagugugcggcauccggagcgccacccgccuggagaacaucauguggaagcagaucuccaaugagcucaaccacauccuccuggagaacgauaugaaauucacgguaguggugggggaugucgccggcauccucgcucaggggaagaagaugauccggccccagcccauggagcacaaauacagcuggaagaguuggggcaaggccaagauuaucggcgccgacgugcagaacaccacauucaucaucgacgggcccaauaccccggagugccccgacgaccagagagccuggaacaucugggagguggaggacuacggauucgggaucuuuacgaccaacaucuggcugaagcugcgggacagcuacacccaggucugugaccaccgcuuaauguccgcggccauuaaggacagcaaggccgugcacgccgauaugggcuacuggauugaauccgagaagaacgagaccuggaagcuggcccgagccucuuucaucgaggugaagacaugcaucuggccuaagucacacacccuuuggagcaacggcguccucgaguccgagaugauuauucccaaaaucuacgggggcccgaucagccagcacaauuaccgcccggguuacuucacccagauugccggccccuggcaccuggggaagcuggagcucgacuucgaccugugcgaggguaccacggugguggucgacgaacacugcggcaaccgggggcccuccuuaagaaccaccacugugacgggcaagaucauccacgaguggugcugccggucgugcacccucccgccccuccgcuuccgcggggaggacggcugcugguacggaauggagauccgacccgugaaggagaaggaagaaaaucuugucaaguccauggugucagcagguucgggcgagguggacuccuuuagccucggguuacugugcauauccaucaugaucgaggaggucaugcggagccgcuggucccggaagaugcucaugacgggcacccuagccgucuucuuccugcucaucguggggcaacugacguggaacgaccugauccgccucugcauuauggucggugccaacgcgagcgaccggauggggauggggaccaccuaccuggcccugauggcaaccuucaagaugcggccaauguucgccguugggcuccuguuucgaaggcugacgucgcgcgaggugcuccugcugaccaucgggcucagccuaguugccuccguagagcugcccaacagccucgaggaguuaggcgacgggcuggcgaugggcaucaugauccucaagcuccugaccgacuuccagucccaccagcucugggcaacccugcugagucuaacuuucauaaagacaaccuucucucuccacuacgccuggaagaccauggccaugguccugagcguggugucccucuucccucugugucugucaacgaccucccagaagaccaccuggcuccccgugcugcugggcagccucgggugcaagccgcugacgauguucuuaauugcggaaaacaagaucuggggccggcgcuccuggccccucaacgaaggaaucauggcugugggaauuguaagcauccugcucagcucccuccugaagaacgacguccccuuagcagggccccucaucgccggcggcaugcuuaucgccuguuacgugaucagcggguccagcgcggacuuaucccucgagaaggccgcugaggugagcugggaggaggaggccgagcacuccggcgccucucacaacauccugguggagguucaagaugacgggaccaugaagaucaaggaugaggagcgggacgacacccugacgauccuccugaaggcgacacugcucgccguguccggcgucuacccgcucagcaucccugccacacuauuuguuugguauuucuggcagaagaagaagcagcgcuccggggugcucugggacaccccuagcccgcccgaggucgagcgggccguccuggacgacggcauauaccgcaucaugcagcggggucugcugggccgcucucaagugggggucgggguguuucaagagaacguguuccacaccauguggcacgucacccgaggcgccgugcucauguaccaaggaaagcgccuggaacccagcugggcguccgugaagaaggaccugauuagcuacggagguggguggcggcuacaggguuccuggaacacuggggaggaaguccagguuaucgcaguagagcccgguaaaaaccccaagaacguccagaccgcucccggcacauucaagaccccagagggcgaagugggcgcuaucgcccuggauuucaagccugggacgagcggcucuccgaucgugaaccgagagcggaagaucgucgggcuguacggcaacggcguggugaccacaagcgggaccuacgucagcgcgaucgcccaagccaaagccucucaggagggcccccuccccgaaaucgaggacgagguguuccgcaaaaggaaccucacgaucauggaccugcacccagggucuggcaagacccgccgcuaccucccggcgaucgugcgcgaggccaucaagcgcaagcuucgaacccugauccucgcccccacccgcgucguggccuccgagauggccgaagcgcugaaggggaugccgauucgguaccagacgaccgccgugaaaagugagcacacuggcaaggaaaucguugaccugaugugccacgccacuuucacgaugcggcuccugucccccgugcgggugccuaacuacaacaugaucauuauggacgaggcccacuucaccgacccuagcuccauugccgcgcgcggguacaucucaacccgcgucgggaugggcgaggccgcggccaucuucaugacagcgacgccgccgggguccguggaggccuucccgcagaguaaugccgugauccaggacgaggagcgcgacauccccgagcggagcuggaacagcggcuacgaauggaucacugacuuccccgggaaaaccgucugguucgugccuuccaucaaaagcggcaacgacauugccaacugccugcgcaaaaacgguaagcgggucauccagcuuucccgcaagaccuucgauacggaguaccagaagaccaagaacaacgauugggauuaugucgugaccacugacaucagcgagaugggcgccaauuuccgggcggaccgcgugaucgacccgcggcgcugccugaagcccgucauccugaaggacggccccgagcgggugauccucgccgggccgaugccggucacaguggccuccgccgcccaacgacggggccgcaucggccgaaaccauaauaaggagggcgaccaauacaucuacaugggccagccccugaacaacgacgaggaccaugcucacuggacagaggccaaaaugcugcuggacaauaucaacacccccgaggguaucauccccgcccuuuucgagcccgagcgggagaaguccgccgccaucgauggggaguaccgccugcgaggggaggcccgcaagaccuucguggagcucaugcggcgcggcgaccugccgguauggcuguccuacaagguggccagcgagggguuccaauacagcgaucggcgcuggugcuucgauggcgagcggaacaaccaggugcuggaggagaacauggacgucgagaucuggacgaaggagggugagcgcaagaagcugcggccccguuggcuggacgcccggaccuacucggauccccucgcccugcgcgaguucaaggaguucgcggcggggcggcgcagcgucucgggcgaccugauccucgagauagggaaacugccucagcacuugacccaacgcgcccagaacgcccucgacaauuuggugaugcugcacaacagcgagcagggcggacgcgccuaccggcaugcgauggaggagcuacccgacaccaucgagacguugaugcugcucgcgcugaucgcaguccugaccgggggggugacccuguucuuucuauccgggcgcggccuggggaagaccucaauuggccuccugugcgugauggccaguagcguccuacuauggauggccuccguggagccccacuggaucgcggccagcaucauccuggaguucuuccugauggugcuccugaucccggagccggaccggcagcgcaccccccaggauaaccagcuggccuacgucgugaucggccuccuguucaugauccugacgguugccgcaaacgagauggggcuccuggaaacaaccaagaaggaccugggcaucggucacgucgcgguggagaaccaccaucacgcugccaugcucgacguggaccugcaccccgccuccgccuggaccuuauacgcggucgccaccaccauuaucaccccuaugaugagacacaccaucgagaacacgacugccaacauaagccucaccgccaucgcaaaucaggcggccauccucaugggccuggacaagggguggcccaucuccaagauggauauaggcgugccccuccuugcccugggcugcuacagccaggugaacccccucacccugacggcagcggugcugaugcucguggcccacuacgcaauaaucgggccgggacugcaagcaaaggccacccgcgaggcgcagaagagaaccgccgccgggauuaugaagaaucccaccguagauggcaucgucgcgaucgaccuggaccccgucgucuacgacgccaaguucgaaaagcagcuagggcagaucauguuacugauccucugcacgucccagauccuccugaugcggaccacaugggcgcucugcgagagcaucacccucgccacgggaccccugaccacuuugugggagggguccccggggaaguucuggaacacgacgauugcggucaguauggccaacaucuuccgcggcuccuaccucgccggggcgggccuggccuucagucucaugaaguccuugggcgggggccggagggggacaggcgcccagggcgagacccuuggcgagaaguggaagcggcagcucaaccagcuguccaagagcgaguucaauaccuacaagagauccggcaucauggagguggacagaagcgaggccaaggaaggucuuaaaagaggcgagacgaccaaacacgcggugagucgugggaccgccaaacucaggugguucgucgagcggaaccuggugaaacccgagggcaaggugaucgaccugggaugcggccgcggcggguggagcuacuacugugcuggccuuaagaagguaaccgaggucaaggguuacacuaagggcgggccaggccaugaggagccgaucccgauggccaccuauggcuggaaucucguuaagcugcacuccgggaaggacgucuucuuuaucccuccggagaaaugcgacacccugcucugcgacaucggcgaaagcucccccaacccgaccaucgaggaagggcggacgcuucgcgugcugaagaugguggagcccuggcuucgggguaaccaguucugcaucaagauccugaaccccuacaugcccucagucguggagacccuggagcagaugcagcgcaagcacgggggcaugcuagugcggaacccgcugucccgcaacagcacccacgagauguacugggucuccugcggcacugggaacaucgugucugccguuaacaugaccucaaggaugcuguugaaccgguucacaauggcgcaccgcaagcccacuuaugagcgggacgucgaccugggcgccgggacgcgccauguggccguggagcccgaggucgccaaccucgacaucaucgggcaacggaucgagaacaucaagcacgagcacaagagcaccuggcacuacgacgaggacaacccuuacaagacgugggccuaccacggcagcuacgagguuaaaccgagcgguuccgcgagcuccaugguaaacgguguggugaaacuccugacaaagcccugggacgucauacccauggugacacaaaucgccaugaccgacacgacgcccuucgggcagcagcguguguuuaaggagaaagucgacacccggacaccuaaggccaagcgcggcacggcccagauaauggagguaaccgcaaaguggcuguggggauuccucucccggaacaaaaagccccgcaucugcaccagggaagaguucacucgcaaagugcggaguaacgcugccaucggcgccgucuucguugacgagaaccaguggaacuccgccaaggaggcgguggaggacgagcgcuucugggaccugguccaccgggagcgcgaguugcacaagcaaggcaagugugccacgugcguguauaacaugauggguaagcgggagaagaagcucggggaguucggaaaagccaagggcucucgcgccaucugguacauguggcugggggcccguuuucuggaguucgaggcgcucggcuucaugaacgaggaccacugguucucccgcgagaacagccugucaggcgucgagggggaggggcugcacaaacucggguauauccugcgcgacaucuccaagauacccggcgggaauauguaugccgacgacaccgcaggcugggacacccgcaucacggaggacgacuugcagaaugaggcccguauaacggacaucauggaaccggagcaugcccuccuggcgaaauccaucuucaaacugacauaucagaacaaagucgugagagugcagcgccccgccaagaacggcaccguaauggacguaauuagccggcgcgaccagcggggcuccggacagguggggaccuacggcuuaaauaccuucaccaacauggaggcccagcugauacgacagauggagagcgaagguaucuucagccccagcgagcuggagacccccaaccucgccgagcgggugcuugacugguuggagaaguacgggguugagcgccuaaagcggauggcgaucucuggcgacgauugcgucgucaagccgaucgacgaccgcuucgcgaccgcacugacggcccuaaaugacaugggcaaggugcgcaaagacaucccccagugggagcccagcaagggauggaacgauuggcagcagguccccuucugcucccaccacuuccaucaguuaaucaugaaggacggacgcgagaucguagugccaugccggaaccaggacgaacugguuggucgcgcccgggucagucaaggcgccggguggagccugcgugagaccgccugccucggcaagucauacgcccaaauguggcagcugauguacuuccaccgccgcgaccugcggcuagccgccaacgcgaucugcagcgccgugcccguggacuggaucccgaccucuaggaccacguggagcauccacgcccaccaccaauggaugaccaccgaggacaugcugucggucuggaaccgcguguggaucgaggaaaacccuuggauggaagacaagacccacauaucgucuuggggcgaugugccguaucugggcaagcgggaggaccagugguguggguccuuaauuggccugacggcccgcgccaccugggcgaccaauauccagguggccaucaaccaggugcgcagauuaaucggcaaugagaacuacuuagacuacaugaccucaaugaaacgguucaagaacgagucagacccggagggggcccugugguaa

SEQ ID NO: 24121 - RNA, 9879 nt, Artificial Sequence
  derived and/or modified CDS sequence (opt11) from DENV-1__FJ024430__SS-prME
agcgugaccaugcugcucaugcugaugcccaccgccuuggccuuccaccucaccacgcgugguggugagccucacaugaucgugucaaagcaagaacgggguaagagccugcuguucaaaaccagcgcaggggugaacaugugcacccugaucgcaauggaccucggcgaguuaugugaggacaccaugaccuacaaguguccacgcaucaccgaaaccgagccugacgacguggacugcugguguaacgccacggacacaugggugacauacgggaccuguucacagacgggggagcaccgucgcgauaagcgguccguggcccucgcgccccacgugggucuuggccuggagacacgcaccgagaccuggauguccagugagggugcguggaagcagauccagcggguugagacgugggcauugcgccaccccggguucaccguuauugcacuuuuccuggcccacgcgaucggcacaagcaucacucaaaaggggauuaucuucauccuccugaugcucgugacgcccagcauggccaugcggugcgugggaauaggcagccgcgacuucguugaagggcuuaguggcgccaccugggucgacgucguguuagagcacggcagcugcguuaccaccauggccaaggacaagcccacgcuggacaucgaguuacugaagaccgaggugaccaaccccgcggugcugcggaagcuguguauugaggccaagaucucaaacaccacgacugauagccgcuguccgacccagggggaggcuacacugguggaggaacaggacgcgaacuuuguaugccggcgcacguucguggaccggggcugggggaacggcugcggucuuuucggcaaggggucccucauaaccugcgcaaaguuuaaaugcgugaccaagcucgaggggaagaucguacaauacgagaaccugaaguauagcguuaucguuaccguccauacgggcgaccaacaccaggugggaaacgaguccaccgagcacggcaccacggccacgaucacgccccaggcgccgaccacagagauccaacucaccgacuacggggccuugacgcuggauugcagcccccgcaccggcuuggacuucaacgagaugguguuacuuaccaugaaggagaaaagcuggcucgugcacaagcaaugguuuuuagauuuaccccuacccuggaccagcggcgccuccacuucccaggaaaccuggaaucggcaggacuuacucgucaccuucaagaccgcucacgccaaaaagcaggaggugguugugcucggcagccaggagggcgcgaugcacacggccuuaaccggggccaccgagauccagaccuccggcacgaccaccaucuucgcagggcaccucaagugccgucucaaaauggacaagcugacgcugaagggcaugucuuacguaaugugcacagggucguucaaacucgaaaaggagguggcagaaacccagcacgggaccgugcuaguccagaucaaguacgagggcaccgacgcgccauguaagauuccguucagcacgcaggaugagaaggggguuacccagaacggacggcugaucaccgcaaacccgaucgucaccgacaaggagaagcccgucaacaucgaagccgaaccgccuuucggagagaguuacauuguuaucggcgccggcgagaaggcgcuuaagcucuccugguucaagaaggguuccagcaucggcaagauguucgaggccacggcacgcggggcucggcgcauggccauccugggggacaccgcgugggacuucggguccaucggcggcguguucaccagcgucgggaaacuggugcaccaaaucuuuggcaccgccuacgggguccucuuuuccggcgucucguggacgaugaagaucggaaucggcgugcugcugacguggcuuggucuaaauucacgaagcaccucccuguccaugaccugcaucgccguggggcuugucacgcuauaccuggggguaauggugcaggccgacuccgggugcguaaucaacuggaaaggccgggagcucaagugcggaagcggcaucuucgugaccaacgaggugcacacuuggacggagcaguacaaguuccaggccgacagcccaaaacgacuauccgcggccaucggcaaggccugggaggagggggucugcggcauucggagcgccacccgccuggagaacaucauguggaagcagaucuccaacgagcucaaccacauccugcuggaaaacgacaugaaguucacggugguggucggggacguggcaggcauccucgcgcaggggaagaagaugauacggccucagcccauggaguauaaguacagcuggaaauccuggggcaaggcaaaaaucaucggagccgacgugcagaauaccaccuucauaauugacgggcccaauaccccggaaugcccagacgaccagagagcauggaacauuugggaggucgaggacuacggcuucgguauuuucacgaccaauaucuggcugaaguugcgggacagcuauacccaggugugcgaucaccgucugauguccgcggccauaaaggacucaaaggcuguucaugccgacaugggcuacuggaucgaguccgagaagaacgagacauggaagcuggcccgggcguccuucaucgaggucaagacgugcaucuggccaaagagccacacguuguggagcaacggcgugcuagaguccgagaugauuauacccaaaaucuacgggggcccgaucagccagcacaauuaccgucccggguacuucacccagaccgcgggccccuggcaccuggguaagcuggagcucgacuucgaucuaugcgagggcacgaccguggugguggacgagcacugcggcaaccgggggccgucacugcgcaccacuacggugacaggcaagaucauccacgaauggugcugccggagcugcacccugccgccccuccguuuccgcggagaggauggcugcugguaugggauggaaauccgucccgucaaggagaaggaggagaaccuggugaaguccauggugagcgccggcagcggggaggucgacuccuucagccucgggcugcucugcaucuccaucaugaucgaggagguuaugaggagccgcuggucgcggaaaauguuaaugaccgggacgcuggccguguucuuucugcucaucaugggacaacuaaccuggaacgaccucaucagacugugcauuaugguuggcgccaacgcguccgaccgcauggggaugggcacgaccuaccuggcauugauggccacguucaaaaugcggccgauguucgccguggggcugcuguuccgccgcuuaaccucacgggaggucuugcuccugacuaucgggcucagccuggucgcuagugucgagcuccccaauagccucgaggagcugggcgaugggcuggcaauggguaucaugaucuugaagcugcugaccgacuuccaaucccaccaguuaugggccacucuguuaagucucacguucaucaagaccaccuucucacugcacuacgccuggaaaacgauggccauggucuuaagcaucgugucccucuucccccugugccucucgaccaccucccagaagaccacguggcuccccguacuguugggcucacucgggugcaagccgcugaccaugcugcuuauagcagagaacaagaucuggggucggcgcuccuggccccugaacgaggguaucauggccgucggcauagugaguauccugcuuagcuccuuacugaaaaacgacguuccccuugccgggcccuuaauagccggcggaaugcugaucgccugcuacgucaucaguggguccagcgcugcccucuccuuagagaaggccgcugaggugucuugggaggaggaggccgagcacucuggcgcgagccacaacauccugguggagguccaggacgacgggacgaugaaaaucaaagacgaggagcgcgacgacacccucaccauccugcugaaggccacguugcuggcuguguccggcguguacccgcugagcauccccgccacccuguucgucugguacuuuuggcagaagaagaaacagcgcagcggagugcuaugggacacaccgagcccgccugagguggguagagccguucuggaugacgguaucuaccgaaucaugcaaagagggcugcucggccgcucccaggugggggugggcguuuuccaagagaacguguuccauaccauguggcacgugacgcgcggggccguccuuauguaccagggcaagaggcuggagcccagcugggccuccguuaagaaagaccucaucagcuacggagggggcuggcggcugcagggguccuggaacaccggcgaggagguacaggugaucgccguggagcccgggaagaaucccaagaacgugcagaccgcgcccggcaccuucaaaacgccugagggcgagguuggggcuaucgcgcuggacuucaagccuggcacaucggggucccccaucgugaaccgcgagggaaagaucgugggccucuacgggaacggcgucguuaccaccagcgggacguacgugagcgccaucgcccaggccaaggcgucccaggagggcccgcugcccgagauagaggacgagguuuucagaaagcgcaaccuaaccaucauggaucuccacccugggagcggcaagacccguagauaccugccggcaaucgucagggaggccaucaagcgcaaacugcgcacccucauccuggcccccacgcggguggucgcguccgaaauggcggaagcacugaagggcaugcccauacgcuaccagaccacagccguaaagagugagcacaccgggaaggagaucguggaccugaugugccaugccaccuucaccaugcgacugcugucccccguccgaguaccgaacuacaauaugaucaucauggacgaggcucacuucaccgaucccagcuccaucgcggcccggggcuacauaucuacccgaguagggaugggcgaggccgccgccaucuucaugacugcgacgccgcccggauccgucgaggccuucccgcagaguaaugccgugauccaggacgaagaacgggacauccccgagcgcaguuggaacagcggcuacgaguggaucacggacuuccccggcaagaccgugugguucgucccauccaucaagagcgggaacgacaucgcaaacugccugcggaagaacgguaagcgcgugauccagcugucacggaagacguucgauaccgaauaccagaagaccaaaaacaacgacugggacuacguugucacgacagacaucagcgagaugggggcgaacuuccgcgcggaucgugugaucgacccgcgccggugccugaagcccguaauccucaaagacggcccugagcgcgucauccuggcugggcccaugccggugacugucgcuuccgccgcgcagcggcgcggccggaucggcaggaaccauaacaaggagggggaccaguauaucuacaugggacagccacugaacaacgacgaggaccaugcccacuggaccgaggccaaaauguugcuggauaacauaaacacccccgagggcaucauccccgcucuguucgagccggagagagagaaguccgccgcgauagacggcgaguaccggcuccggggcgaggcccgaaagacguucguggagcugaugcgcagaggggaccugcccguguggcuaaguuacaaaguugccucggaggguuuucaguacagcgacaggcgcuggugcuucgauggggagaggaacaaccaagugcucgaggagaauauggacguggagaucuggacgaaggagggcgaaaggaagaagcugaggccccgguggcuugacgcacgcacguacuccgacccgcuggcccugcgggaguuuaaggaguucgcggccgggcgccggagcgucuccggcgacuuaauccucgagauaggcaagcugccgcagcaucucacccaacgcgcccagaaugcccuggauaaccugguuaugcuccauaacagcgaacagggcgggcgggcuuauagacacgccauggaggagcugcccgacacuaucgagacccugaugcucuuagcucugaucgccgugcucaccgggggcguaacccuguuuuuccugucagggcggggccucggcaagaccagcaucgggcuguugugugugauggccucaagcgugcuccuguggauggcguccgucgagccucacuggaucgccgccagcauaauccucgaguucuucuugauggugcuguugauccccgagccggaucgucaacggacuccucaggacaaccagcucgccuacguggucauaggacugcuguucaugauucucacaguggcugccaacgaaaugggccugcuugagaccaccaagaaggacuugggcauugggcacguugcuguugagaaccaccaccacgccgcaaugcuggacgucgaccugcaccccgccucggcguggacacucuacgcgguugccaccacgaucauuacaccgaugaugcgccacaccaucgagaacaccaccgccaacauuucucuaaccgccaucgcgaaccaggccgccauccugaugggcuuggauaagggcuggcccaucaguaaaauggacaucggugucccccuucuggcccucggcuguuacagccaggugaacccucugacgcugacagcggccgugcucaugcuagucgcccauuacgccaucaucgggccgggccugcaagcaaaggcgaccagggaggcccagaaaagaaccgccgccgggaucaugaagaaucccacggucgacggcaucguagccaucgaccucgacccggucguguaugacgcaaaguucgagaagcaguugggccagaucaugcuccucauccugugcaccucccagauccugcucaugcgcaccaccugggcccugugcgagucgauaacgcuggcaaccgggccccucaccacccugugggagggcucgccagggaaguuuuggaacacgaccaucgccguuuccauggccaacaucuuccgcggcucguaucuggcuggcgccgggcucgccuuuagucuaaugaagagucugggcgggggccgccgagggacaggcgcgcaaggcgaaacccucggggagaaguggaagcgccaauuaaaccagcuguccaagucugaguucaauacguacaagcgguccgggauaauggaggucgaccgcucugaggcuaaggaggggcucaagcggggcgagaccacaaagcaugcugugucccgcgggaccgccaaauugcggugguuuguggagcgcaaccuggucaagcccgagggaaagguuauugaccugggcugcgggcggggcggguggagcuauuauugcgccggccugaagaagguuacggaggucaagggcuacacuaagggcggccccggucacgaggagcccaucccgauggccacuuauggcuggaaccuggugaagcugcauaguggcaaagacguguucuucaucccaccagagaagugcgacacccuccugugcgauauuggcgagagcucccccaaccccacgaucgaggaggggaggacccugcgggugcucaaaaugguggaacccuggcuaagaggcaaccaauucuguauaaaaauccugaacccauauaugcccagcguggucgagaccuuggaacagaugcagcgcaagcacggaggcaugcuggugcgcaacccucucucccggaacagcacacacgagauguacuggguauccuguggcaccggaaacaucgucagcgcgguaaauaugacgucccgcaugcuccugaaccgcuucaccauggcccaccggaagcccaccuacgagcgcgacguggaccugggcgcagggacccggcacgucgcuguggagcccgaaguggccaaucucgacauuaucggacagcgcauagaaaacaucaagcacgaacacaagucgacguggcacuacgacgaggacaaccccuauaagacaugggcguaccacggcuccuacgaggucaagccgagcggguccgcaucuagcauggucaacggaguagugaagcuguuaaccaagccgugggacgugauccccaugguaacccagaucgccaugacggacaccacccccuucgggcaacagaggguguucaaggagaaaguggacacccgcacgccgaaggccaagcggggcaccgcccagaucauggaaguuaccgcgaaauggcuguggggcuuccugucucgcaauaagaagccccguaucugcacgcgcgaggaguucacgcggaagguacgcagcaacgccgccaucggggcgguguucgucgaugagaaccaguggaacuccgcgaaggaggccguggaggacgagcgguucugggaucugguucaccgcgagcgggaacuccacaagcagggcaaaugcgcgacgugcgucuacaacaugauggggaagcgcgagaaaaagcugggcgaguucgggaaggccaagggcagccgugccaucugguauaugugguugggagcucgcuuccucgaguucgaagcccucggguucaugaacgaggaccauugguucucgcgagagaacucucuuucaggcguugagggugagggccuccacaagcuggguuacauucugcgcgacauaagcaacauuccgggcggcaacauguacgcugacgacacugcagggugggacacccgaaucacugaagacgaccuucagaacgaggcccgcaucaccgauaucauggagccugagcaugcgcugcuggcgaagucuaucuucaagcuaaccuaccagaacaagguuguccgcguccagcggcccaccaagaauggaaccgugauggacgucauaagccggcgggaccagcgcgggucuggacaggugggcaccuacgggcugaacacuuucaccaauauggaagcccaguuaauccggcagauggagagcgaaggcaucuuuucgccuagcgagcucgagacgcccaacuuggccgagcgagugcuagacuggcucgagaaguacgggguggagcggcugaaacgcauggccaucuccggcgacgacugcguggugaagccggucgacgaccgguucgcgacggcccucaccgcccucaacgauaugggaaaggugaggaaggacaucccccagugggagccuucgaagggcuggaacgauuggcagcagguccccuucuguucccaccacuuccaccagcugaucaugaaggacggcagggagaucguggugcccugccgcaaccaggacgagcuggucgggcgggcccgcgucagccagggugccggauggagccuccgggagaccgcgugccugggcaaguccuacgcccagauguggcagcuaauguacuuccaccgacgggaccuccgccuggccgcuaacgcgauaugcagcgcggucccaguggauuggauccccacgagccggaccacgugguccauucacgcucaccaccaauggaugaccacugaggacaugcuguccgucuggaaucgaguguggauagaggagaacccguggauggaggacaagacacacaucucuuccuggggcgacgugccguaccucggcaaacgcgaggaccaguggugcggaagccugaucgggcugaccgcccgggccaccugggcgacuaacauacagguggccaucaaccagguucgccgguugaucgggaaugagaacuaccuggacuauaugacgucuaugaagcgcuucaagaacgagagcgacccggagggggcccugugguaa

SEQ ID NO: 24122 - RNA, 9879 nt, Artificial Sequence
  derived and/or modified CDS sequence (opt11) from DENV-1__FJ024433__SS-prME
ucggugacgaugcuacucaugcugaugccgaccgcccuggcguuucaccucacuacccggggcggagagccccacaugaucgugagcaagcaggagcguggcaagagccugcuguucaagaccagcgccggggugaauaugugcacccuuaucgccauggaccugggcgaacugugcgaggacaccaugaccuauaagugcccucgcaucacagagacggagccggacgacguugacugcugguguaacgcgacggacaccugggugaccuacgguacuugcucacagacgggcgagcaccggcgugacaagcgguccguggcacucgcaccccacgugggccuggggcuggaaacucguaccgagaccuggaugagcucagagggugcguggaagcagauacagcgggucgagacgugggcacuccgccaucccggguucaccgugaucgcccuguuccuggcccacgcgaucgguaccagcaucacccagaaggggauaaucuucauccuccugauguuagugacgcccuccauggccaugcgaugcgucggcaucggcagccgcgacuucgucgaggggcucuccggcgcaacuuggguggacgucguccuggaacacgggucuugcguuacgacuauggccaaggauaagcccacacuggauaucgagcucuuaaagaccgagguuacgaaccccgccgugcugcggaaacucugcaucgaggcuaagaucuccaacaccacgacggacagccgcugcccaacccaaggcgaggccacgcugguugaggagcaggacgcaaacuuugugugccggcgcacguucguggaucggggcugggggaacggcugugggcuauucggcaaagggucccucaucacgugcgccaaauucaaaugcgugacaaagcuagagggcaagaucguccaguacgagaaccuaaaauacagcgugauugugaccguucacacaggcgaccagcaccaggucgggaacgaguccaccgaacacgguaccaccgccaccauaacgccacaagcgcccaccaccgagauacagcucaccgacuacggggcccugacgcuagacugcagcccccgcaccgguuuggacuucaaugagaugguacuacugaccaugaaggaaaaguccuggcucguccacaagcagugguuccuggacuuaccgcucccauggacuaguggggccagcaucucccaggagacguggaaccggcaggaccugcuggugaccuucaaaaccgcgcacgcuaagaagcaggaagucgugguccucgggagccaggagggcgcaaugcacaccgcccuaacgggggccacagaaauccagaccagcggcaccacgacaauuuucgccggucaccugaagugccggcuuaagauggacaagcugacccuccggggcaugagcuacguuauguguaccggguccuucaagcuugagaaggagguggcugagacgcagcacgguacuguguugguccaaaucaaguacgaaggaaccgacgcgcccugcaagaucccguucuccacgcaggaugagaaggggguuacgcagaacggccgacuuaucaccgccaacccgaucgugacggacaaggagaagcccgucaauaucgaggccgaaccgcccuuuggggaguccuacaucgugaucggugccggcgagaaggcgcugaagcucagcugguucaaaaaggguaguaguaucggcaagauguucgaggcgaccgcacgcggggcccggcgcauggccauccugggcgauaccgcgugggacuucggguccaucggcggcguguucaccucugucgggaagcuggugcaccagaucuucggcaccgccuacgggguccuguucuccggcgucagcuggaccaugaaaauaggcaucggcguccuccugacguggcucggccugaacagccggucuacuucccugagcaugaccugcaucgccguuggccuugucacguuauaccugggagucaugguacaagcagauuccgggugcgucauuaacuggaagggccgcgagcucaagugcgggagcggcaucuuugugacgaacgaggugcacacauggaccgagcaguacaaguuucaggccgacagcccgaagcggcucagcgcggccaucgguaaggccugggaggaggggguuugcggcaucagaagugccacccggcuggagaacaucauguggaagcagauauccaaugaauugaaccacauccugcuggagaaugacaugaaguucaccguugugguaggggacguugccggaaucuuagcgcaggggaaaaagaugauccguccccagcccauggagcacaaauacagcuggaaguccuggggaaaggcgaagaucaucggggccgacgugcagaacacgacauucaucauugacgggccgaacaccccggagugccccgacgaucagcgggccuggaacaucugggaggucgaggacuauggauucgggauauucaccacgaacaucuggcugaagcugcgcgacagcuacacccaggugugcgaccaccgguuaauguccgccgccauaaaggauagcaaggccguccacgccgacauggguuauuggaucgagagcgagaagaacgaaaccuggaagcuugcgcgcgcgagcuuuauugaggucaagacuuguaucuggcccaaaucccacacgcuguggagcaauggcgugcucgagucagagaugauuauucccaagauuuacgggggcccgauuagccagcacaacuaccggccgggauacuucacccagaccgccggccccuggcaccugggcaaacuggagcucgacuuugaccugugcgaaggcaccacuguggucguugacgagcauugcggcaaccgcgggccgucccugcgcaccaccaccgugacggggaagaucauccacgaguggugcugccgcagcugcacucugccgccccugcgguucagaggggaggacggcugcugguacgggauggagauccggccuguuaaggaaaaggaagagaaccuugugaagucuauggugagcgccggcagcggcgagguggauuccuucagccucgggcugcugugcaucuccaucaugaucgaggaggugaugcgcagccgguggagccggaagaugcuuaugaccggcacgcuggccguguucuuucugcuaauaaugggacagcugacguggaaugaccugauccgccuaugcauaaugguaggcgccaacgcgagcgaccggauggggaugggcaccacguaccuggcccugauggccaccuucaagaugcgcccgauguucgccguagggcuccuguuccggcgccugacgucccgagagguacucuugcugacgaucgggcucucacuugucgcauccguggagcugcccaacagccucgaggagcugggcgacgggcuagcgaugggcaucaugauccucaagcuucugaccgacuuccagagccaccaacucugggccacccuuuuaagccucacguucauuaagaccaccuucuccuuacacuacgccuggaagacuauggccauggugcugucuaucgugucccucuucccgcuaugccugaguacgaccucccagaagaccaccuggcuccccgugcugcuuggcagcuugggaugcaagccguugacuauguuccuuaucgcggagaacaagaucuggggucgccguagcuggccacucaaugaggggauaauggcugucggcaucguuucaauucuucugucgucacuccugaaaaacgacgugcccuuggccgguccccuuaucgccggcggcauguugaucgcaugcuacgucaucagcgggucaagcgcggaccugucccucgagaaggccgccgagguguccugggaggaagaggccgagcacuccggggccagccacaacauccugguggagguccaggacgacgggacgaugaagaucaaagacgaggagcgcgacgauacccugacgauccuccugaaggcgacccugcucgccgucuccggcgucuacccgcugagcauccccgccacgcuguucgucugguauuucuggcaaaagaaaaagcagcggucgggggugcucugggacacccccagcccgcccgagguggagcgcgccguccuggacgacggcaucuaccggaucaugcagcgcggccugcuggggcggucacaggugggcgugggcguauuccaggaaaacguguuccacaccauguggcacgugacccgcggagccguacucauguaccaggguaagcggcuggagcccagcugggcguccgugaaaaaagaccugaucucuuacggaggcggauggcgccuccagggauccuggaauaccggggaggaggugcagguuaucgccguagagcccggcaagaaccccaagaacgugcaaaccgcccccgggaccuucaagacccccgagggcgagguuggugcaauagccuuagacuucaagcccgggacgagcgggucccccaucgugaaccgggaggggaagaucgugggccuguacggcaauggggucgugacuaccagcggcaccuaugugagcgcgaucgcccaggccaaggccucccaagaggggccgcuccccgagaucgaagaugaagucuuccgcaaaaggaaccugacgaucauggaccugcaccccggcucugggaagacccgccgguaucugccggcgauagugcgggaggcuaucaagaggaaacugcgcacccuaauccucgccccaacccgcguggucgccuccgagauggccgaggcccucaagggcaugcccauacgguaccagacgaccgccgucaaaagcgagcacaccggcaaggagaucgucgaccugaugugccaugccaccuucacgaugcgccuccugagucccguccggguucccaacuacaacaugauaaucauggacgaggcacauuucaccgacccuagcuccaucgccgcgagaggguacaucuccacccggguggggaugggagaggccgccgccauauucaugaccgccacuccgcccgguuccgucgaggcguucccgcagagcaacgccgugauccaagacgaggagcgcgacaucccggagcgaucauggaacucaggguacgaguggaucaccgauuuccccggcaagaccgugugguucguccccuccaucaaguccgguaacgacaucgccaacugccuucgaaagaacgguaagcgggugauccagcucucgcgcaagaccuucgacacggaguaccagaagaccaagaacaacgacugggacuacguggucaccaccgacaucagugagaugggcgcgaacuucagggcagaccgcguaaucgacccgcgucgcugucugaagcccgugauccugaaggaugggcccgagagagucaucuuagccggccccaugcccgugaccgucgccuccgccgcccagcgucguggacgcaucggacgcaaccacaacaaagagggcgaccaguacaucuacaugggccagccccugaacaacgacgaggaccacgcacacuggaccgaggccaagaugcugcucgacaacaucaauaccccggaaggcaucauccccgcccuguucgagccugagcgggagaagagcgccgccaucgacggggaguaccgccugcggggcgaggcgcgcaagacauuuguggagcuaaugcggagaggggaucugcccgucugguuguccuacaaggucgccagcgagggauuucaguacagcgacagacgcuggugcuucgacggcgaacggaauaaccaggugcucgaggaaaacauggacguggagaucuggacgaaggagggggagcggaagaagcugcggccacgcuggcuugacgcccggaccuacucggacccccucgcccugcgcgaguuuaaggaguucgccgcgggccggcgaagcgucuccggugaccugauccucgagaucggcaagcugccgcagcaccugacccagcgggcccagaacgccuuggauaacuugguaaugcugcacaacagcgagcagggcgggcgcgccuaucggcacgcgauggaggagcucccugauaccaucgagacgcuaauguugcuggcccugauugccguguuaaccggcggggucaccuuauucuucuuauccggccguggccugggcaagacaaguaucggcuugcugugcguuauggccucaagcgugcuccucuggauggccuccgucgagccccacuggauagcggcaucgaucauccuggaauucuuccugauggugcuccugauccccgagccggacagacagcguacgccccaggauaaucaacuggccuacguggucaucgggcuccuauucaugauccugacgguggccgccaacgagaugggccucuuagaaaccaccaagaaggaucuugggaucggccacguugcagucgaaaaucaccaccacgccgccaugcucgauguggaucugcacccagccuccgcuuggacccuuuacgcgguagccacgaccaucaucaccccaaugaugcggcacaccaucgaaaacacgaccgccaacaucagccucacugccaucgccaaccaggcagccauccugauggggcuggauaagggcuggcccaucuccaagauggacaucggcgucccccuccuggcccuggggugcuacagucaagugaauccacucacccugacggccgcggugcugaugcucgucgcgcacuacgcuauaaucggcccggggcugcaggcgaaggccacacgggaggcgcagaaacgcaccgcagccggcaucaugaagaacccgacuguggacgggaucguggccauagaccuggaccccgucguguacgacgccaaguucgagaagcaguugggccagaucaugcugcugauccucuguacgagccagauacugcuuaugagaaccacgugggcgcucugcgaaagcaucacgcucgccacggggcccuuaaccacccucugggagggguccccggguaaguucuggaacaccacuauagccgugagcauggccaacaucuuccgcggguccuaucuggcuggcgccggcuuagccuucagccucaugaaaucccucgguggcggacggcgagggaccggggcacagggcgagacccugggcgagaaguggaagcggcagcucaaccagcuguccaagagugaguuuaacaccuauaagcguuccgggaucauggaggucgacagaagcgaggccaaggagggccugaagcgcggugaaacgacgaagcacgcgguuucgcggggcaccgcaaaguuacgaugguuuguggaacggaauuuagucaagcccgaggggaaggugaucgaccugggcugcggccgcggcggcuggagcuacuacugugccgggcugaagaaggugaccgaagucaagggguacacgaagggcgggcccggccacgaggagcccaucccuauggccaccuacggguggaaccucgugaagcuucacuccgguaaggauguguucuucaucccacccgagaagugcgacacucuguuaugcgacaucggggaaucuucgcccaauccgaccauugaggaggggcggacgcugcguguccugaagaugguggagccgugguugcgggggaaccaguucugcaucaagauucugaaccccuacaugcccucgguggucgagacccuggagcagaugcaacgcaagcacggcgguaugcucguucggaauccguuaucccgcaacagcacccacgagauguacuggguuuccugcgggaccgguaacauagucagcgcuguaaacaugaccucccgaaugcugcuuaacagguucacgauggcgcaccgcaagcccaccuacgagcgggauguggaccuuggggccggcacccgccacgucgccguggagcccgagguggcuaaccuggacaucaucggccagcggaucgagaauaucaagcaugagcacaaaagcacuuggcacuacgacgaggacaaccccuacaagaccugggccuaccacgggucauacgaggucaagccgucuggcuccgcgagcagcaugguaaacggaguuguaaagcuccugacaaagccuugggauguaauccccauggucacccagaucgccaugacggacacuaccccguucggccaacagcgcguguuuaaagagaagguggacaccagaaccccgaaggccaagcgcgggacggcccaaaucauggaggucaccgccaaauggcuguggggcuuccucucccggaacaagaagccccgcaucugcaccagggaggaguucaccaggaaggugcgaagcaacgcggcaaucggcgcaguguucgucgacgagaaccaguggaacucugccaaggaggcgguggaagacgaacgcuucugggaccuggugcaucgggagcgugagcugcauaagcaagggaagugcgccacaugcgucuacaacaugaugggcaagagagagaagaaacugggggaguucggcaaggcgaaggggagccgcgccaucugguacauguggcugggcgcgcgguucuuagaguucgaggcgcucggcuucaugaacgaggaucacugguuuucccgcgaaaacagccuauccggaguggagggcgaggggcuccauaagcucggauauauccuccgugacaucagcaagauucccggaggcaacauguacgccgacgacaccgccggcugggacaccaggaucaccgaggacgaccugcagaacgaggcccgcaucacagacauuauggagccggaacaugcccuccuggcgaaguccaucuuuaaacugacauaccagaacaaggugguccgcgugcagcgcccugccaagaacgggaccgugauggacgucaucagccggcgcgaccagcguggauccggccaggugggcaccuacggucucaacacguucaccaacauggaggcccaacugauacggcagauggagagcgaggggaucuucucuccaagcgagcuagagacccccaaccuggccgagcggguguuggauuggcuggagaaguauggcgucgagcgucucaagaggauggccaucuccggggacgacuguguggugaagccgaucgaugaccgcuucgcgacugcccuuacagcccugaacgacauggggaagguccguaaggacaucccgcagugggagccuagcaagggguggaacgacuggcagcagguccccuucugcucccaccacuuccaccagcucaucaugaaagauggccgcgagauaguggucccgugccggaaccaggacgagcuggugggccgcgcccggguaagccagggggccggcuggaaccugagggagaccgcgugcuuaggcaagagcuacgcccagauguggcagcugauguauuuccaccggcgcgaccugcggcucgcggccaaugcgaucugcuccgccguccccguggauuggauacccaccucacgcacgacuugguccauccacgcccaccaccaauggaugaccaccgaggacaugcugagcguauggaaccgcgucuggaucgaagagaaccccuggauggaagacaagacccauaucuccagcugggaggaugugccguaucugggcaagcgggaagaucaguggugcggaucacucaucggcuuaacggcccgcgcuaccugggcaaccaacauacagguggccaucaaccagguccggcgccucauuggcaacgagaacuaccucgacuacaugacuagcaugaaacgguucaagaacgagucggaccccgagggugcccugugguga

SEQ ID NO: 24123 - RNA, 9879 nt, Artificial Sequence
  derived and/or modified CDS sequence (opt11) from DENV-1__FJ024434__SS-prME
agcgugacgaugcugcucaugcucaugcccaccgcacuggcuuuccacuugaccacccgaggcggggagccucacaugauuguaucuaagcaggagcgagguaagagcuuguuauucaaaaccucggccggggucaacauguguacccucaucgcaauggaccuaggcgagcugugcgaggacacaaugacuuacaagugcccgagaaucaccgaagccgagcccgaugauguagauugcuggugcaacgcuaccgauacaugggugacguacggaacauguagccagaccggcgagcaccggcgcgacaagcgguccguagcccucgcgccccacguuggucuaggucuggagacucgcaccgagaccuggaugagcagugaaggcgcauggaagcagauacagagagucgagaccugggccuuacgccaucccggcuucacggucaucgcccuguuccuggcccacgccaucggcaccagcauuacccagaaggggaucaucuucauccuccugauguuggugacccccuccauggccaugcggugugucgggauuggcagccgugacuucguggagggucucuccggcgcuacguggguagacgucguacuggagcaugggagcugcgugaccaccauggccaaggauaagccuaccuuggacaucgaauuacugaaaacggaggucaccaaucccgccgugcugcggaagcucuguaucgaggcuaagauuuccaauaccaccacagacucgcgcugcccaacccagggcgaggccaccuuaguggaagagcaggacgccaacuucgucugcagacgcaccuucguugaucgggguugggggaacggcugcgggcuguucgguaaggggucccucaucacgugcgccaaguucaagugugugaccaagcuggagggcaagauaguccaguaugagaacuuaaaguacagcgucaucguaacgguccauaccggcgaccagcaccaagucggaaacgagucaacggagcacggcaccaccgcuaccauuacgccucaggcccccacgaccgaaauacagcucaccgacuacggggcccugacccuggacugcagcccccgcacgggccucgacuucaacgagaugguccuucucaccaugaaagagaaguccuggcuggugcacaaacaaugguuccuggaucugccuuuacccuggacaaguggagccagcaccucgcaagaaacauggaaccgucaagaucugcuggugaccuucaagaccgcccacgcgaaaaagcaggaggucgucgugcucggcagccaggagggcgccaugcacacagcgcugacgggggccacugagauucagaccuccggcaccacgaccaucuucgcugggcaccuuaagugccgccucaagauggacaagcugacccuaaaaggcaugagcuacgucaugugcacgggcuccuucaagcucgagaaagagguagcggagacgcagcacgguacaguacuaguccagaucaaguacgagggcaccgaugcccccugcaagauaccuuucagcacucaggaugagaagggugugacgcagaacggccggcugaucaccgcgaacccuauagugacagacaaggaaaagcccgucaacaucgaggccgaaccgccauucggggaauccuacaucgugauaggugcgggcgagaaggcccuaaagcucucgugguucaagaagggguccagcaucgguaagauguucgaggcaacugcucgcggggcccggaggauggcgauacuuggcgacacggcgugggacuuugggucuaucggcggagucuuuaccucggucgggaagcuggugcaccagaucuucggcaccgccuaugggguccucuucucuggcguuagcuggaccaugaagaucgggaucggcgugcugcuuacauggcucggccugaacucucgcagcaccuccuugagcaugacaugcaucgccguagggcucguuacguuauaccugggcgugauggugcaggccgacuccgggugcgucauaaacuggaagggucgggagcugaagugcgggagcgguaucuucguaacgaacgaggugcacaccuggaccgagcaguacaaguuccaggcggacagcccaaagcgcuugagugccgccaucggcaaggccugggaggagggggucugcggcauccggagcgccacccgccuggagaacauaauguggaagcagaucuccaacgaauuaaaccacauccuccuggagaacgacaugaaguugacagugguggucggggacguggcgggcauacuggggcagggcaagaagaugauacggccccagccaauggaguacaaguauagcuggaaguccuggggcaaagcaaagaucauaggggccgacgcccaaaacacgaccuucaucaucgacgggcccaacacucccgaaugcccugacgaccagcgagcguggaacaucugggaaguggaagacuacgguuuuggcauauuuacuacgaacaucuggcugaagcuacgggacaguuacacccaggucugcgaucaccgccugauguccgccgcgauuaaggacagcaaggccguucacgccgauaugggcuacuggaucgagucagagaagaacgagacuuggaagcuggcgcgcgccagcuuuaucgaagugaagaccugcauuuggccgaagucccacacguuauggagcaauggagucuuggagagugagaugaucauccccaagaucuacggcgggccaaucagccagcacaacuaccgccccggcuacuucacgcagaccgccgggcccuggcaccuugggaagcucgagcuggacuucgacuuaugcgagggaaccacggucgugguugacgagcacugcgggaaccgggguccgucccuccgcaccaccaccgugacgggcaagaucauccaugagugguguugccggagcugcacacugccgccccuucgguucaggggcgaggacggcugcugguacggcauggagauccgccccgugaaggagaaggaggagaacuuagucaaguccaugguguccgccggcagcggggaaguugacuccuucagcuuaggacugcucugcaucuccauaaugauugaggaggucaugcggagccgcuggucccgaaaaaugcugaugacugggacgcuagcuguauucuucuuacugaucaugggccagcugacauggaacgaccugaucaggcuuugcaucauggugggggcgaacgccagcgaucgcaugggcaugggcaccaccuaucuagcccucauggccaccuucaaaaugcggccuauguucgcggucggacuacuuuuccgccgguuaacgucaagagaggugcugcugcucaccaucggccugagccugguggccuccgucgagcucccgaacagccuagaggagcugggagacggccucgcaaugggaaucaugauccuuaagcuacucaccgacuuccagucccaccagcucugggccacccugcucagcuuaacguucaucaagaccaccuuuagccugcacuacgccuggaaaaccauggcgauggugcucagcaucgucucccuguuuccccugugccucucaacgaccucccagaagaccaccuggcugccaguccugcuugggagccugggcugcaagccgcucacgauguuucucauugccgagaacaaaaucuggggucggaaguccuggccccuaaacgagggcaucauggccguggggaucgucucaauccuucucucuucauugcugaagaacgaugugccccucgccggcccccugaucgccggcgggaugcugaucgccugcuacgugaucucuggauccagcgccgaucuaucccuggaaaaggcugccgaggucucuugggaggaagaagcagagcacuccggcgcgagccacaacauccugguggaggugcaggaugacggcaccaugaagaucaaggacgaggagagggacgacacccugaccauccuucugaaagccacccuccuggccgucagugguguguacccgcucucaauccccgcaacucucuucgugugguacuuuuggcaaaagaagaaacaacggucaggcguccugugggacacccccagcccuccggagguggagcgcgccgugcucgacgacgguaucuaccggaucaugcagcgcgggcugcucggccggucccaggucggcgugggcguguuucaggaaaacgucuuccacacuauguggcacguuacccgcggugcggugcuuauguaccagggcaagcggcuagaacccaguugggcuuccgucaagaaggaccucaucaguuacggugggggcuggagacugcgggggagcuggaacacgggcgaggaggugcaaguuauugccgucgagcccgggaaaaacccgaaaaacguacagaccgcucccggcaccuucaagacucccgagggcgaggugggugccaucgccuuggacuucaagcccggcacgagcgggucccccauagucaaccgcgagggaaaaaucgugggcuuguacggcaauggcgucgucaccaccagcggaaccuaugucagcgccaucgcccaggccaaagcgucccaagaggguccgcugcccgagaucgaggaugagguauuccggaagcgcaaucugacgaucauggaccuccaucccgguagcggcaaaacccggcgcuacuugccggccaucguccgggaggccaucaagcgcaagcuaagaacccucauccuggcacccacccgggugguugcauccgaaauggcugaggcccugaagggaaugcccauccgcuaccagacgaccgccguuaaaagcgaacacaccggaaaggaaaucguggaucucaugugccacgccaccuuuacgaugcgucuacugucccccgugcgcgucccgaacuacaacaugauaaucauggacgaggcucacuucaccgaccccaguuccaucgcggcgcggggauauauaagcaccagaguggggaugggagaggcagccgccaucuucaugaccgcgacgccgcccgguuccguagaggcauuuccgcagagcaacgccguuauccaggacgaggaacgggacaucccagagcgcuccuggaacagcggguacgaguggauaaccgacuucccgggcaaaaccgugugguucgugccuuccaucaagucugggaacgacaucgccaacugccuccgcaagaacggcaagcguguuauacaacugagccggaagaccuucgacacggaguaccagaagaccaagaacaacgauugggacuacguggugaccacggacauuucggagaugggggcgaacuuccgcgcugaucgcgucaucgacccgcgccggugccugaagcccgugauccuuaaggacggccccgagcguguaauccucgcaggucccaugccggucacggucgcaucggccgcacaacggcgcggccggaucggccgcaaccacaauaaggagggggaccaguacaucuauaugggacaaccccugaacaacgacgaggaccacgcucauuggaccgaagccaagauguugcuggacaacaucaacaccccggagggaaucaucccagcucuguucgagccggagcgcgaaaaguccgcagcggucgacggagaguacaggcuaagaggggaggcacggaagaccuucguggagcugaugcgccggggggaucugcccguguggcuuucguacaaggucgccagcgagggcuuccaauacucggaccgccgguggugcuucgacggggagcgcaacaaccaggugcuggaggagaacauggacguagagauuuggacgaaggagggcgagcguaaaaaacuccgcccacgguggcucgacgcacgcacauacuccgacccccuggcccugcgggaguacaaggaauuugcggccgggcgccggucagucuccggcgaccucauccuggagauaggcaagcugccgcagcaccucacccaacgggcccagaacgccuuggacaaccuggugaugcuccacaacagcgagcagggugggcgagcguaccgccacgccauggaggaacugccggacacaaucgagacucugaugcuccuggcccuaaucgccgugcugaccgguggcgucacccuguuuuuccucucggggcggggccucggcaagaccagcauaggacuguuaugugugauggccuccagcgugcuccuguggauggcguccguggagccucacuggaucgcugccuccaucaucuuggaguucuuccucauggugcugcugauccccgagccggaccgccaacguacgccccaggacaaccaguuggccuacguagucaucggucugcuguuuaugauccucacgguggccgcgaacgaaauggggcuccuggaaaccaccaagaaggaccucggcauaggucacguggcugucgaaaaucaucaucacgcggccaugcuggacguggaccuccaccccgcuucugccuggacccucuacgccguggccaccaccaucauaaccccgaugaugaggcauacgaucgagaacacgaccgccaacauuagccuuaccgcgaucgcgaaccaggccgcgauucuuauggggcucgauaagggauggcccaucuccaaaauggacaucggagucccccugcuggcccucggcugcuacagccaagugaacccccuuacccugacagcagccgugcucaugcuugucgcacacuacgccaucaucggcccgggucuccaggcaaaggcgacccgcgaggcccagaagcggaccgcagccgggaucaugaagaacccuaccguggacggcaucguggcaauugaccucgacccugucguuuaugacgcgaaguucgaaaagcaacucggccagaucaugcuacucauacugugcacuucccagauucugcucaugagaaccaccugggcucugugcgagagcaucacccuggcagcggggccgcucaccacccugugggagggcuccccgggcaaguucuggaacacuaccaucgccgugagcauggcuaacaucuuccggggcuccuaccucgccggugcgggguuagcauucagccugaugaagucccucggcggaggccgccgggggacuggcgcgcagggcgagaccuugggggagaaguggaagcgccagcugaaccaacuguccaagagcgaguuuaauaccuacaagcgauccgggaucauggaggucgacaggagcgaggccaaggagggcuugaagcggggcgaaaccacgaaacacgccgugucacgcgggaccgccaaacugcggugguucguggagcgcaaucuggucaagccggaaggcaaggugaucgaucugggcugcgggcgugggggguggucguacuacugcgccggacucaagaaagugaccgaagucaaaggguacaccaagggcggccccgggcacgaggagcccaucccgauggcgacguacggcuggaaccuggugaagcugcacagcgggaaggacguguucuucaucccgccugagaagugcgauaccuuauuaugugacauaggugagaguucccccaacccgaccaucgaggaggggcgcacccuccguguccucaagaugguggaacccuggcugcgcggcaaccaguuuugcaucaagauuuugaauccuuauaugcccagcguggucgaggcccucgagcagaugcagcggaaacacggcgggaugcugguucguaacccguugucucgaaacagcacgcaugagauguacugggugucaugcggcaccggcaauaucgucagcgccguaaauaugaccagucgcaugcuccucaaccgcuuuaccauggcccaucgaaagccuaccuacgaacgcgacguggaccugggcaccggcacccggcacgucgcagucgaaccagagguggccaaccuggacaucaucgggcagaggaucgaaaauaucaagcacgagcacaaguccaccuggcacuacgacgaggacaacccguauaagaccugggcguaccaugguuccuacgaagucaagccgagcgggagugcaagcaguauggugaacggcguuguuaaacuguugacgaagcccugggacguuauccccauggucacccagaucgcaaugacggacaccacgcccuucgggcagcagcggguuuucaaggagaagguggacaccaggacccccaaagcuaaacggggaaccgcgcagaucauggaagucacggcccguugguuauggggcuuccugucccggaacaagaagccacgcaucugcaccagggaggaguuuacacguaaggugcggagcaacgcggccauaggcgcgguguuugucgacgagaaccaguggaacucggcgaaggaggcaguggaggacgagcgcuucugggaccuggugcaccgggagcgcgaacuccacaaacagggcaagugcgcgacaugcguuuacaacaugauggggaagcgggagaagaagcucggggaguucgggaaggcuaaggggagccgcgcaauuugguacauguggcugggcgcccguuuccucgaauucgaagccuugggguucaugaacgaggaccauugguuuucccgcgagaacagucugaguggcguggagggggagggccuccacaagcuaggguacauccugcgggacaucagcaagauccccggcggcaacauguacgccgacgacacggccgggugggacacccgcaucaccgaggacgacuugcagaacgaggcgaagaucaccgacaucauggagcccgaacacgcccugcuggccaaggccauauucaagcucacauaucagaauaaggugguccgcgugcagcgacccgcgaagaacgggaccgugauggacgucaucucgcgccgggaccaacgcggguccggccaggugggcacauacgggcugaacaccuucacgaauauggaggcccaguuaauucggcagauggaguccgagggcaucuucagccccagugagcuugagacccccaaccuggcagagcgcgcccuggacuggcucgagaaguacgggguggagcgacucaagcguauggccaucaguggcgaugacugcguggucaagccgaucgacgaccgguucgcgaccgcgcugaccgcccuaaacgacauggggaaggugcgcaaggacauuccucagugggaacccucgaagggcuggaacgacuggcagcaagucccguuuuguagccaccacuuccaccagcugauaaugaaggacggccgggagauuguggugccuugccguaaccaagaugagcugguggggcgggccagggugucccagggcgccggcuggagccuccgggagacagcgugcuuggguaagagcuacgcccagauguggcaacugauguacuuccaccgacgggauuuacgccuggccgccaaugccauaugcucugcaguucccgucgacugggucccaaccagccguaccacgugguccauucacgcccaccaucaauggaugacgacggaggacaugcugucaguguggaaccgcgucuggaucgaagagaacccauggauggaggauaaaacgcacaucuccaguugggaggacgucccguaccucgggaagcgcgaggaucaguggugcgggaguuuaaucggccucaccgcuagggccacgugggccaccaauauucagguggcgaucaaccagguccgccgacucauagggaacgaaaacuaccuugacuacaugaucagcaugaagcgcuuuaagaacgaguccgacccggagggcgcccugugguag

SEQ ID NO: 24124 - RNA, 9879 nt, Artificial Sequence
  derived and/or modified CDS sequence (opt11) from DENV-1__FJ024435__SS-prME
agcgugaccaugcugcugaugcugaugcccacugcccuggcauuccaccucaccacccguggaggugagccccacaugaucgugucuaagcaagagcggggcaaaagccugcuguucaagaccagcgcgggggugaacaugugcacgcucauugcgauggaccugggggagcugugcgaggauaccaugaccuacaaaugucccagaaucaccgaaacagagcccgacgacguggauugcuggugcaaugcaaccgacaccugggugaccuauggaaccugcagccaaaccggcgagcaccggcgggacaagcggucgguugcccucgcgccccacgugggccugggucucgagacacggaccgaaacguggaugucauccgagggcgccuggaagcagauacagcgcgucgagacgugggccuugcgacaucccggguucacagugaccgcacuguuccuggcccaugcgauuggcaccuccaucacacagaaggguaucaucuucauucuccugaugcugguuacaccaaguauggccaugagaugcgucggcaucgguagccgggacuuuguggaggggcucuccggcgcaaccuggguggacgucguacuggagcacgggagcugcgugaccaccauggccaaggacaagcccacucucgauauagagcuccugaagaccgaggugaccaaccccgccgugcugcggaaacucugcauagaggcuaagaucuccaacacuaccaccgacagccgaugcccgacacagggcgaggcaacgcugguggaagaacaggacgcaaacuucgucugccggaggaccuuuguggaucggggcugggguaacggcugcgggcuguucggcaaggggucccucaucacgugcgccaaauucaagugcgugacuaaacuggagggcaagauuguccaguacgaaaaucugaaguacucugugaucgugacgguccauaccggcgaccagcaccagguggggaacgaauccaccgagcauggaacaaccgccacgaucaccccccaggcgcccaccacggagauccagcucacggacuauggggcccuaacccuggacugcagcccccggacugggcucgacuuuaacgagauggucuuguugaccaugaaggaaaaguccuggcuagugcauaagcagugguuccuggaccugccacuaccguggacgagcggggcgagcacgucccaggagacuuggaaccggcaggaccugcugguaaccuucaagacggcccaugccaagaagcaggaggucguggugcucggcagccaggaaggcgcgaugcacaccgcccugaccggggccaccgagauacagacauccggaaccaccaccauuuucgccggucaccugaaaugccgccuaaaaauggacaagcugacacugaaaggcaugucuuacgugaugugcaccgguuccuucaaguuagagaaggaacuggcggaaacccagcauggcacuguucugguacagaucaaguaugagggcacggacgcgcccugcaagaucccguucuccacccaagacgaaaaaggugugacccagaacggccggcugaucaccgccaauccaaucguuacggacaaggagaaacccgugaauaucgaggccgagccgcccuucggugagucauacaucgucaucggggccggagagaaggcgcucaaacuuaguugguucaagaaggggagcagcaucggcaaaauguucgaggccaccgcccgcggggcccgccgcauggccauccuuggcgacaccgcgugggacuucggguccaucggcggcguguucaccagcguggggaagcucguccaccaaaucuucggcacggcauacgggguguuguucuccggcguuagcuggaccaugaaaaucggcaucggcguccugcuaaccuggcugggccuaaacucccgcagcaccucccucagcaugacguguaucgccgugggguuagugacacuguaccucggcgucauggugcaggcugacuccgggugcguaaucaauuggaagggucgggagcugaagugcgggucaggcaucuucgucaccaacgaggugcacacauggaccgaacaguacaaguuucaggcggacagcccgaaacgccuguccgcugccaucggaaaggccugggaggagggggucugcgguauccggagcgccacgcggcucgagaauaucauguggaagcagaucagcaaugaguugaaccacauucugcuagagaacgacaugaaguucaccgucguggugggggaugucgccgguauccuggcgcaggggaagaagaugauccggccccaacccauggaacacaaauacagcuggaagaguuggggcaaggcgaaaauaaucggcgccgacgugcagaacacaaccuuuaucaucgacgggcccaauaccccggagugucccgacgaucagcgcgccuggaacaucugggagguggaggacuauggcuucgggaucuucaccaccaacaucugguugaagcuccgggacucuuauacccaagucugcgaucaccgucugauguccgcggccaucaaggacagcaaagcagugcacgccgacaugggguacuggaucgaguccgagaagaaugagaccuggaagcuggcacgggcgagcuucaucgaggucaagacguguaucuggcccaagucccacacucucuggucaaacggcguccuggaguccgagaugaucauccccaaaauauacggcgggccgaucagccagcacaacuaccgccccggguacuucacccagacggccggccccuggcaccuggggaagcucgagcuggacuuugacuuaugcgaaggcacaaccgucguugucgacgagcauugcggcaaccgagggccgucccuccgcacuacgacugugaccggcaagaucauauacgaguggugcugccggagcugcacgcugccucccuugcgcuuccggggggaggaugguuguugguacggcauggagauccgccccgugaaggagaaggaggagaaccucguaaaguccauggucagcgccggcaguggcgaaguggacaguuucagccuggggcuguugugcaucuccaucaugaucgaggaggucaugcggagccgcugguccaggaaaauguuaaugacgggcaccuuagccguauucuuccuccuaauaguggggcagcucaccuggaaugaccuuaucagguuaugcaucauggucggcgcuaacgccucggaccgcauggggaugggcacgacguaccuggcccuaauggccaccuucaagaugcggccuauguucgcgguaggccugcucuuccggagacucacaucccgcgaggugcugcuguuaaccaucgggcugucgcuggucgcuucgguggagcuccccaacagccuggaggagcugggcgaugggcucgcgauggggaucaugauccugaaguuacucacggacuuccagucccaccagcugugggccacacugcuuagccugaccuucaucaagaccacguucucccugcacuacgcuuggaagaccauggccaugguccuaagcgugguuucccuguucccccugugccucagcaccaccucccagaagacgacuuggcuucccguccugcucgggagccuggguugcaagccguuaaccauguucuugaucgcagagaacaaaaucuggggcagaagauccuggccacugaacgaggggaucauggccgugggcaucgugagcauccugcucagcucccugcugaagaacgaugugccccuugcagggccccugaucgccggcgggaugcugauugcuugcuacguaaucagcggguccuccgcggaucucucccuggaaaaagccgccgaagugagcugggaggaggaggccgagcacaguggcgccagccacaauauccuggucgaggugcaagaugaugggaccaugaagauaaaagacgaggagcgggacgacacgcucacuauccugcugaaagcaacccucuuggcuguguccggggucuacccucugucuaucccggccacauuguucgucugguauuucuggcagaagaagaagcagcgcagcggcguccugugggacacccccucgccgccagagguugagcgggcagucuuagacgacgguauuuacagaaucaugcagcguggcuugcucgggcgcucccaggugggcgucggaguguuucaggaaaacguuuuccacacgauguggcaugucacccguggcgccgugcugauguaucaggggaagcgccucgagcccagcugggcauccgugaagaaagaccucaucagcuauggcgguggguggcgccuacagggcuccuggaacaccggggaagaaguccaggugaucgccguggaacccggcaagaaccccaagaacgugcagacugcccccgggacguuuaaaacccccgaaggcgaggugggcgcaaucgcucucgauuucaaacccgggaccagcggcucccccauugugaaccgcgaggggaagaucgugggccuuuacggcaacgggguggucaccacgagcgguaccuacgucagcgcgaucgcccaggccaaagcgucccaggagggcccgcugcccgaaauagaagacgagguguuccggaagcgcaaccugaccaucauggaccuccaucccggaagcgggaaaacccgucgcuaccugccggcgaucgugcgugaggccaucaagcgcaagcugcgcacacucauccuggcccccacccgggucguggccuccgagauggcugaggcgcugaaagguaugcccauacgguaucagaccacggcugugaagagcgagcacacgggaaaagagaucgucgaccucaugugccacgccaccuucaccaugagacuucuguccccugugcgugugccgaacuacaacaugaucaucauggacgaggcucacuuuaccgacccuuccuccaucgcagcucguggguacauuagcacacgcguaggcaugggcgaggccgcggccaucuucaugaccgccaccccgccaggcuccguggaggcguucccacagagcaaugcggugauccaggacgaggaacgggacauucccgaaagaucuuggaauucaggauacgaguggaucacugacuuccccggcaaaacaguuugguuuguacccagcaucaagagcggcaaugacaucgcaaacugcuugcggaaaaacgggaagagagugauacagcugucccgcaagaccuuugauaccgaauaucagaagacuaaaaauaacgacugggacuaugucgugacgaccgacaucagcgagaugggagcaaacuuccgcgcggaccgggugauugacccgcgccggugccugaagcccgucauccucaaggaugggcccgagcgcgugauccuggccggccccaugccggucacgguggccuccgccgcgcagcgucgcgggcggaucggccgcaaccacaacaaagagggugaccaguacauuuacaugggucagccccugaacaaugacgaagaucacgcgcacuggacggaggccaagauguuacuggacaacauaaacacgccagagggcaucauccccgcacuguuugagccggagcgcgagaagagugccgccaucgacggcgaguaccgguuacgcggcgaggcacggaaaaccuucgucgagcugaugcgcagaggggaccugcccgucuggcucuccuacaagguggccucggagggauuucaguacagcgaccggcggugguguuucgauggcgaacgcaacaaccagguucuggaagagaacauggacgucgagauauggaccaaggagggggaacggaagaagcugcgcccccgguggcucgacgcacgcaccuacuccgacccccuggcccugcgggaguucaaggaguucgccgccggacgcaggucgguuuccggggaccucauccuggaaaucgggaagcucccgcagcacuuaacgcagagagcccagaacgcccuggacaacuuagucauguugcauaacagcgagcagggcgggcgugcauaccgccacgcgauggaggagcugccggacacuaucgagacgcugaugcucuuggcccugauagccguccucaccggcggggugacucuguuuuuucuguccggaagagguuugggcaagacgagcaucggccuacugugugugauggccucuuccguuuuacuguggauggccuccguggagccccacuggaucgcggcaagcaucauccuggaguucuuccucaugguucugcugauucccgagccggaccgccagcguacuccucaggauaaccagcucgcuuacgugguaauugggcugcuguucaugaucuugaccguugcggccaaugaaaugggccugcucgagaccacaaagaaagaucucgggauuggccacgucgcggucgaaaaccaccaucacgcugccaugcuggauguggaccuacaccccgccuccgccuggacccuuuacgcggucgccacaaccauaauuacgccaaugaugcgccacaccaucgagaacaccaccgccaacaucucccugacggccaucgccaaucaggcggccauccucauggggcuggauaaaggcuggcccauauccaagauggacaucggcguacccuugcuggcccucgguugcuacucucaagugaauccccugaccuuaaccgccgcgguccucaugcugguggcucacuacgccaucaucggcccggggcugcaggccaaggccacccgggaggcccagaagcggacggccgcuggcaucaugaagaaucccacaguggacgggauugucgccauugaccuagaccccgugguguaugacgccaaguucgagaagcagcugggccaaaucauguuacucauccugugcaccucacagauccugcucaugcgcaccacgugggcgcuuugcgagucuaucacucuggccacuggcccccucaccacgcucugggagggcucgccgggcaaguucuggaacaccaccaucgcugucagcauggccaacauuuuccggggguccuacuuggccggcgcgggucucgccuucagccugaugaagucccucggcggcgggcgccgggguaccggggcccagggggagacgcucggcgagaaauggaagcgccagcugaaccaguuauccaagucagaauuuaacaccuacaagcgcuccgggaucauggagguggaccguucugaagccaaggagggccucaagcgcggggaaaccaccaaacaugcagugucccgcggcacggccaaacugcggugguucguagaacgcaaccuaguaaagcccgaggggaaggugaucgaccuggguugcggccgcgggggcuggagcuacuacugcgccggucugaagaaggucaccgaagugaagggcuacaccaagggcggcccuggccacgaggagcccauccccauggcaaccuacggguggaaccuggugaagcugcacuccggcaaggauguauucuucaucccgcccgagaagugcgauacgcuccugugugacaucggcgagagcuccccuaacccaaccaucgaggaggggcgcacccuucgggugcuuaagaugguggagcccuggcugcguggcaaccaguucugcaucaaaauccugaaccccuacaugcccucugucguggagacacucgagcaaaugcagcggaagcauggcggcaugcucgugcgcaacccgcucucacggaacagcacccacgagauguacugggucuccugcgggacgggcaacaucguauccgccgugaacaugaccucccguauguugcugaacagguucaccauggcucaccggaaaccgaccuacgaacgcgacguagaccugggagccgguacgcggcacguggccgucgagcccgaaguugccaaucucgacaucauuggccaacgcauugagaacauaaaacaugagcauaaguccaccuggcacuaugacgaggauaaccccuacaaaaccugggccuaccacgggucauacgaagugaagccgagcgguuccgcauccagcauggucaacgggguggugaaguuacugaccaagcccugggaugucauccccauggugacgcagaucgccaugaccgacacaacccccuucggccagcagcggguauuuaaggagaaggucgacacccggacccccaaagccaagcgagggaccgcccaaaucauggaagugaccgccaagugguuauggggcuuucuuucgcgcaacaagaagccuaggauauguacgcgcgaagaguucacgcggaaggugcgcagcaacgcggccaucggugccguuuucguugaugaaaaccaguggaacuccgcuaaggaggcugucgaagaugaacgguucugggaccuaguccaccgggagcgggagcuacacaaacaagggaagugcgcgaccugcguguacaacaugaugggcaagagggagaagaagcuaggggaguucggcaaggcuaaggguagccgggccauuugguacauguggcugggcgcgcgcuuccucgaguucgaggcccugggcuucaugaacgaggaccacugguucucccgggagaacuccuuauccgggguggagggagaggggcuccauaaguugggauacauccugcgcgacaucucgaagauccccgggggcaacauguaugccgacgauaccgccggcugggacacgagaaucaccgaggacgaccuccagaacgaagcucgcaucaccgauaucauggagccggagcacgcccuucuggcgaaguccaucuucaagcucacuuaccagaauaaggucguucgcgugcaacggcccgccaaaaacgggacggucauggacgucaucagcaggcgagaccagcgcgguuccggacaaguugggaccuacggccugaacaccuucacuaacauggaggcucagcugauccggcaaauggagagcgaagggaucuucucccccagcgagcucgagacucccaaccuggccgaacgcguccuggacuggcucgaaaaguacggcgucgagcggcugaagcguauggccaucuccggggaugacugcguagucaagccgaucgaugaccgauucgcgaccgcacugaccgcccucaacgacaugggcaaggugcggaaggacaucccccagugggagcccucuaagggguggaacgacuggcagcagguccccuucugcucccaccauuuccaccagcugaucaugaaggauggcagagagaucgucgugccguguagaaaccaggaugaguugguuggccgggcccgcgucagccagggcgccggguggucucucagagagaccgcgugccuugggaagucuuacgcccagauguggcagcugauguacuuucaucgccgagaccuccgccuggccgccaacgcgaucuguagcgcagugcccguggacuggauaccgacgucccgcacuacuuggagcauccacgcucaccaccaguggaugaccacggaggacaugcuguccgucuggaaucgagucuggaucgaagagaaccccuggauggaggacaaaacccacaucagcaguuggggcgacguaccguacuuggggaagcgcgaggaccaauggugcggcagucugaucggccuuaccgcccgugccaccugggcgacuaauauacaggucgcuauuaaccaggugcgccgauugaucgggaacgagaacuaccuugacuacaugacguccaugaagcgcuucaagaacgagagcgaccccgaaggcgcguugugguga

SEQ ID NO: 24125 - RNA, 9879 nt, Artificial Sequence
  derived and/or modified CDS sequence (opt11) from DENV-1__FJ024436__SS-prME
ucagugacgauguuacucaugcugaugcccaccgcccuggccuuccaccuuacaaccagggggggggagccccauaugaucguguccaagcaggagcggggcaaaagccuauuguucaagaccagcgcuggggucaauaugugcaccuuaaucgccauggaccugggggagcugugcgaggacaccaugacguacaaaugcccccgcauuaccgaagccgagccggacgacguagacugcugguguaacgccaccgauacgugggugaccuacgggaccugcagccagacuggcgagcacaggcgcgacaaacgguccguggcccucgcgccccacguaggcuuagguuuagagacgcgcaccgaaacauggauguccuccgagggcgccuggaagcaaauccagcgcguugagaccugggcgcugcgccacccgggguucacuguaauagcccuguuccuggcgcaugccaucggcacuaguaucacacaaaaggggauuaucuucauccugcugaugcugguaaccccgucaauggcgaugcggugcgucggcaucggcagccgcgauuucguagagggguuguccggcgccacauggguggaugucgugcuggagcaugggagcugcgugaccaccauggccaaagacaagccaacccucgauaucgagcuccucaagaccgaagugaccaacccagcuguacugcgaaaacucugcauugaagcgaagauaucuaacacgaccacggacagccgcugcccaacccagggggaggcaacacugguggaggagcaagacgccaauuucgucugccgccgcaccuuuguugacaggggaugggggaacggaugcgggcuguucgguaaggggucccugaucacgugcgccaaauuuaagugcgugacuaagcuggaaggaaaaaucguucaauacgagaaccugaaguacagcguuaucguuaccguccacacuggcgaucagcaccagguugggaacgaguccacggaauacggcaccacagcgacuaucacgccgcaggcccccagcacggagauccagcuaacugacuacggcgcucugacacuggacugcagcccacguacuggccuugacuucaacgagaugguacugcugacaaugaaggagaaguccuggcucgugcauaaacagugguuccuagaucuuccucuucccuggaccucaggggcauccaccagccaggagacguggaaccgucaggaccugcugguaacguucaagaccgcccacgccaagaaacaggaggucgugguacucggcucacaggagggggccaugcacaccgccuugaccggugccacggagauccaaacuagcggcaccaccacgaucuucgccggacaccugaaguguagacucaaaauggacaagcugaccuugaaaggcaugucguacgucaugugcaccgggagcuucaagcucgaaaaggaaguggcggagacccaacacggcaccgugcuuguccaaauuaaguacgagggcacugacgcacccugcaagauccccuuuagcacgcaggacgaaaaggggguuacccagaacggccgucugaucacugccaacccgaucgugaccgacaaggagaagcccgucaauaucgaggccgaaccgccauucggggagagcuacaucguaaucggcgcgggcgagaaggcccugaagcucuccugguucaagaaggggucgagcaucggcaagauguucgaagcgaccgcccgcggugcgcggcgcauggcgauacugggggacacggcuugggauuucgguaguaucggcgguguauuuaccuccgucgggaagcucgugcaccaaaucuucgggacggccuacggggugcucuucagcggcgucuccuggaccaugaagauugggaucggcgugcugcugaccuggcucggccugaacucccgguccacgucucugucaaugaccugcaucgccguggggcucgucacccuguacuuaggcgugauggugcaggccgacuccgggugcgucauuaacuggaagggccgggagcucaagugcgggagcggcaucuucgugaccaacgaggugcacaccuggaccgagcaguacaaguuucaggcagauuccccgaagaggcuuagcgccgccaucggcaaggccugggacgagggggugugugguauacgguccgccacgcgccuagagaacaucauguggaaacaaaucucuaaugaguuaaaccacauccugcuggagaaugacaugaaguucaccgugguggucggggacgucgcagguauccucgcccaagguaagaagaugauuagaccccaaccgauggaguacaaguacuccuggaaguccuggggcaaggccaagaucaucggcgccgacgugcagaacacgacguuuaucauagaugggcccaauacccccgagugccccgaugaccagcgcgcguggaacaucugggagguggaggacuacggcuucgggaucuuuaccacaaacauuuggcugaagcugcgggauucguacacacaggugugcgaccaucggcuaaugagcgcagccauuaaagauuccaaggccguacaugccgacauggguuacuggaucgagagcgagaagaacgagaccuggaagcuggcgcgagcauccuucaucgaggucaaaaccugcauauggcccaagagucauacccuauggucuaauggcguacucgagucggaaaugaucauccccaagauuuacggcggcccgaucucgcagcacaauuaccggcccggguauuucacgcagaccgccggcccguggcaucuggggaagcuggagcuagacuucaacuugugcgaaggcacaaccguggucguagacgaacacuguggcaaccgggguccgucguuacgcacgaccacugucaccgggaaaaucauccacgaauggugcugucgauccugcacucugccaccacuccgcuucaagggcgaagacggcugcugguacgggauggagauccgcccugucaaggagaaggaggagaaccuagucaagagcaugguaagugccggaucgggcgaggucgacucauucucccucgggcugcuuuguaucagcaucaugauagaggaggugaugcggagucgguggagcagaaagaugcuaaugaccggcacucuggccguguuuuuccugcucaucauggggcagcugaccuggaacgaucugauccgacucuguauuauggucggcgcgaaugcguccgaucgcauggggaugggcaccaccuaccuggcccugauggccaccuucaagaugcgcccgauguuagcggugggccugcuguuccggcggcucaccagccgggaggugcuacugcucacgauugggcugucccugguggccucugucgagcuccccaauagccuagaagagcugggggacggucuugccaugggcaucaugaucuugaagcuucucaccgacuuccagagccaucaacugugggccacauugcucucccugacuuuuauuaaaacgaccuacuccuuacacuacgccuggaagaccauggcaaugguauugucuaucgugucgcuuuucccccugugccucuccacaacgagccagaagacuaccuggcugccgguguugcucggcucccucgggugcaagccgcugacgauguucuuaaucgcagagaacaagaucuggggacgcaagagcuggccccugaacgaggggauuauggccguugguaucgugagcauccugcuuuccaguuuacugaagaacgacgugccccucgcggggccccugaucgcagggggaaugcugauugcgugcuacgucaucucaggaaguuccgccgaccucucacuggagaaggccgccgaaguguccugggaagaggaggccgaacauucgggcgcaucccacaacauccucguggagguccaagacgaugggacgaugaaaauuaaggaugaagagcgggacgacacgcucacuauccuguuaaaggccaccuuacuggccgugagcggagucuacccguuaucgaucccugccacccucuuugucugguauuucuggcagaaaaagaagcagagaucagguguucugugggauacgccuucaccgcccgagguggagcgggccguccuggacgacggcaucuacaggauaaugcagcguggccuacucggccgcagccaggugggcguggggguauuucaggagaacguguuucacacaauguggcacgugacccgcggggccguccugauguaccagggcaagcgccuggagcccucgugggccagcgugaagaaggauuuaaucuccuacggcggcggguggagacugcagggcagcuggaauaccggggaggaggugcaagugaucgcuguggaaccuggcaaaaaccccaagaacgugcagacggcgcccggcaccuuuaagaccucagagggcgaagucggcgccaucgcguuagacuucaagcccggcaccagcggcagccccauugugaaccgcgaggggaagaucgugggucucuacggaaauggggucgugacaaccucgggcaccuacgucucagccauugcccaggcgaaagcaucgcaggaggggccccugccggaaaucgagaacgaggucuuucgcaagcgcaaccucaccaucauggacuugcaccccggcuccgggaagacaaggcgcuaccugcccgccauugugcgggaggcuaucaagcgcaaacugcggacucuaauacuggcaccgacccgugugguagcguccgagauggcggaggcucuaaagggcaugccaauccgcuaucaaaccacggccgucaagucggagcacacagggaaggagaucguggaccucaugugccaugcgaccuucaccaugaggcuccugucucccguccgcgugcccaacuauaacaugauuaucauggaugaggcccauuucaccgacccgagcuccaucgcggcacgggguuacauuucgacccgcgugggcaugggggaggccgccgccaucuucaugacugcgacgccgcccggauccgucgaggccuuuccccagagcaacgccgugauccaggacgaggagcgugauaucccggagcgcagcuggaauagcggguacgaguggaucaccgacuuuccuggaaagaccgugugguucgucccauccaucaagucgggcaacgacaucgcaaacugccucaggaagaaugggaagagaguuauucagcucuccaggaaaaccuucgacaccgaguaccagaagacgaaaaacaacgauugggacuauguggucaccacagacauaucugagaugggcgccaacuuccgcgccgaccgcgugaucgaccccagacgaugccugaaaccggugauccucaaggacgggcccgagcgagucauccuggccggccccaugcccgugaccgucgccuccgcggcgcagagacgaggccggaucgguagaaaccauaacaaagagggugaccaguacaucuacaugggccagcccuuaaacaacgacgaggaccacgcccacuggacugaggcuaagauguugcuggauaacaucaacaccccagagggcauuauccccgcucuguuugagcccgagcgggaaaaauccgcagcuauagacggagaguaccgucugagaggcgaggcccggaagaccuucguggaguugaugcgccgcggggauuugccgguguggcuaagcuacaaggucgccucggaggguuuucaauacagcgaccgccgguggugcuucgauggcgagcgcaacaaccaagugcuggaggagaacauggacguggagaucuggacuaaggaaggagagcgaaagaaacugcgcccccgguggcuagacgcccgaacguacucagacccgcuggcguuacgggaguucaaggaauucgcggcuggccggaagagcgucuccggggaccucauccuggaaaucggaaagcugccccagcaccucacccagcgggcccagaacgcccuggacaaccuugugaugcuccacaacucagaacagggcgggagggcguaccggcacgccauggaagagcuuccggacaccaucgagacccuaaugcuccuggcccugaucgccguauugacgggcggugucacccuguucuuccuauccggccgcggucucggcaagacaagcauaggccuucuguguguuauggccuccucugugcuccuauggauggcguccgucgagccccacuggaucgccgccuccaucauccuggaguucuuccucauggugcuucucaucccggagcccgaccggcagcgcaccccgcaggauaaucagcucgccuaugucgucaucgguuuguuguucaugauacucaccguggccgccaacgagaugggccugcuggagacuacuaagaaggaucuugggauaggccacguugccgucgaaaaccaccaucaugcugcaaugcuagacguggaccuucaccccgccuccgccuggacccucuaugccguggccaccacgaucaucaccccuaugaugcggcacacgauugagaacacuacugcgaacaucagccuaacugcgauugcgaaucaggccgccauccugauggguuuggacaagggcuggccgauuuccaagauggauaucggcgucccccuccuggcucucggguguuacagccaggugaauccguuaacauugaccgcugcaguguuaaugcuugucgcgcacuacgccauaauuggcccugggcuccaggccaaggcgacccgcgaggcccagaagcggacugccgccggcaucaugaagaauccgacugucgacgggauagucgcuaucgaccucgauccagucguguacgaugcaaaguucgaaaaacagcugggccaaaucaugcugcucaucuugugcacgagccaaauccugcucaugcgcacuacaugggcccucugcgagagcauuacucuggccaccggcccccucacgacacugugggagggcagucccggcaaguucuggaacaccaccaucgccguuagcauggcaaacauuuuccggggaagcuacuuggcgggcgccgguuuagccuucucccugaugaagucacuugggggagggcgccguggcacgggggcccaaggcgaaaccuugggcgagaaauggaagcgacagcugaaccaauuaaguaagucugaauucaacaccuacaagcgaagugggauuauggagguagauagaagcgaagcuaaggagggccucaagcggggggaaaccacgaagcacgccgugucacggggcacggccaaguugcguugguucgucgagcggaaucuggucaagccggaggggaaggugaucgauuugggcugcggacgaggaggcugguccuacuacugcgccgggcucaaaaaggugaccgagguaaagggcuacaccaagggcgggccgggccacgaggagcccauccccauggcuacguacggguggaacuuagugaaacuccacaguggcaaggacguguucuucaucccgcccgaaaagugcgacacucuucugugcgacauuggggagagcuccccaaaccccacaaucgaagagggccggacccuucgcguccucaagaugguugaacccuggcuucgugggaaccaguucugcaucaaaauacugaaucccuacaugcccagcguagucgagacgcucgagcaaaugcagcgcaagcacggcgggaugcuugugcggaacccacugucacgaaacagcacucacgagauguacuggguguccugugggaccggcaacaucgucagugcggugaauaugaccuccagaaugcuccugaacagauucaccauggcccaccggaagccgacguacgaacgcgacgucgaccucggggccggcacccgccacgucgccguugagcccgaagucgcgaaccuugacaucaucggucagcggauugagaacaucaaacacgagcacaagucuaccuggcacuaugacgaagacaacccauacaaaaccugggcguaccacgggucauacgagguaaagccuucagggagcgccucgagcauggugaacggcgucguuaaguuacugacgaagccgugggacguuaucccaauggucacacaaaucgccaugaccgacaccacucccuucggccagcagcguguguucaaggagaagguggacacccggaccccuaaagcaaagagggggacugcccagaucauggaagucacugcuaaguggcucuggggauuccuuucccgaaacaagaagccgcgcaucugcacaagggaggaauuuaccagaaaagucagaagcaacgcugcaaucggcgccguguucgucgacgaaaaccaguggaauuccgcgaaggaggccguugaggacgagagauucugggaccuggugcaccgggagcgcgagcuccauaagcaggggaaaugcgcgaccugugucuacaauaugauggggaagcgugagaagaagcugggggaguuuggcaaggcuaaaggcagccgcgcuaucugguacauguggcugggagcgcgguucuuagaguucgaagccuugggcuucaugaacgaggaccacugguuuucacgcgagaacagccuguccgggguggagggcgagggguugcauaagcucggcuacauccugcgggauaucagcaagauccccgggggcaacauguacgcggacgacacggcgggcugggauacccgcauaacagaggacgacuugcagaacgaggcaaagaucacggacaucauggagccagagcacgcguugcuagccaaguccaucuucaaguugacguaucagaacaaggucguccggguucagcgcccugcgaagaacgggacagugauggaugucaucagccggagagaccagcgaggcucgggccaaguugggacuuacggccuuaauaccuuuacgaauauggaagcccagcugauucgucagauggagagcgaaggcauauuuuccccuagugaacucgagacccccaaccuggcagguagagugcuggacuggcucgaaaaacacggcgucgaaagacuaaagcgcauggcaauauccggggacgacuguguagugaagcccaucgacgaucgauucgccaccgcccugaccgcucucaacgacaugggaaagguucgcaaggacauuccccagugggagcccucaaagggcuggaacgacuggcagcaggucccguuuugcagccaccauuuccaccaacugaucaugaaagacggccgggagaucguaguccccugccgcaaucaggacgaacuggugggucgggcccgcguuucucaaggcgcgggguggucucuccgcgaaacagcaugcuuaggcaagucguacgcacaaauguggcaauuaauguacuuccacagaagggaucuuagacuggccgcgaacgccaucuguagugccguccccguagauugggugcccacguccaggaccacuuggagcauucacgcccaccaucaguggaugaccaccgaagacaugcugucugucuggaaccgcguguggaucgaagaaaaucccuggauggaggauaagacgcacauuagcuccuggggggacgugccauaccucggaaagcgagaggaccaguggugcggcagccugaucgggcugaccgcccgagcgacgugggccacaaacauccaggucgccaucaaccaaguucggcgccuaauaggcaaugagaacuaccuggacuacaugacuuccaugaagcgcuucaagaaugaaagcgaccccgaaggggcacugugguga

SEQ ID NO: 24126 - RNA, 9879 nt, Artificial Sequence
  derived and/or modified CDS sequence (opt11) from DENV-1__FJ024472__SS-prME
ucggugaccauguugcuuauguuaaugcccacagcccuugccuuccaccucaccacccggggcggggaaccucacaugaucgugucgaaacaggagcggggcaagagucuguuguucaagacauccgccgggguuaacaugugcacucucaucgccauggacuugggcgaacucugcgaggacaccaugaccuacaagugcccccggaucaccgaaacagagccggacgacguagauugcuggugcaacgccacggacaccugggugaccuacgggacgugcagccagaccggcgaacaccggcgagacaagcgcucaguggcucuugcgccccacguuggccugggccucgagacccgcaccgaaacguggaugagcucagaaggcgccuggaagcaaauccagcgaguggagacgugggcccuucggcaccccggguucaccguuaucgcccuauuccuagcccacgcgaucgggacaagcaucacccagaaggguaucauuuucauucuccuaaugcuggugacgccguccauggccaugcgguguguugggaucggcucgcgcgacuucguggaggggcucuccggcgccaccugggucgauguggugcuggagcacgggagcugcguuaccaccauggccaaggacaaacccacguuggauaucgagcuccugaagaccgaggucaccaacccagccgugcugcggaaguugugcaucgaagcaaagaucuccaacaccacgaccgacucacgcugcccgacccagggcgaggccacccugguugaggaacaagaugccaacuucguuugccggcgcacauucguugaucggggcugggggaacgguuguggguuguucggcaaggggucccugauaaccugcgccaaauuuaagugugugaccaagcuggagggcaagauuguccaguacgagaaccugaaguacagcgugaucgugacuguccacacgggugaccagcaccaggucgggaacgagucgacugagcacgggacuacugccaccaucacgccccaggcgcccacgaccgagauccaauugacagacuacggagcccuaacguuggacugcagcccccgcaccgggcucgauuuuaacgaaauggucuuguuaacuaugaaggagaaguccuggcuggugcacaagcaaugguuccuggaccuuccccuccccuggaccagcggugcaucaacuucccaggaaacguggaacagacaggaucuguuagugaccuucaagaccgcgcaugcgaagaaacaggaaguaguggugcuaggcagccaggagggcgcuaugcacacagccuuaacaggagcuaccgagauccagacauccgggaccacuaccaucuucgccgggcaucugaaguguagacucaagauggacaaacugacccuaaagggcaugucuuacgucaugugcacugguucauucaaacucgagaaagagcuugcggaaacccaacacggcaccguucuggugcagaucaaguacgagggcaccgacgcgcccuguaagaucccuuuuucgacacaggaugagaagggggucacgcaaaacggcagacugauaaccgccaauccgaucgugaccgacaaagagaagcccgugaacaucgaggcagagccacccuuuggggaguccuacauagucaucggcgccggcgagaaagcgcucaagcuaagcugguucaaaaagggcaguagcaucgguaagauguuugaggcaacggcccgcggggccagaaggauggccauauuaggcgacaccgcgugggacuucggguccauaggugggguguucaccucugugggaaagcucguccaucagaucuucggcaccgccuacggaguacuguucuccggaguaagcuggacgaugaagaucggaaucggcguacugcucacguggcuaggacugaacucccguucgaccucccucagcaugaccugcaucgccgugggacucguuacgcuguaccucggugucaugguucaggcggacagugggugcgugauuaauuggaaaggcagggaacugaagugugguagcggaaucuucgugacgaacgaagugcacacuuggacggaacaguauaaguuccaagccgacagcccaaagcggcuauccgcggccgucggcaaagccugggaggaaggcgucuguggcauccggagcgccacucgacucgaaaacaucauguggaagcaaauuuccaacgagcugaaccacauccugcuggagaacgacaugaaguucacggugguaguaggcgauguggccggcauacuggcgcaggggaaaaagaugauccgaccccagcccauggaguauaaauacucauggaaguccuggggcaaggcuaagauaaucggcgccgacgugcagaacaccaccuuuaucaucgacgggcccaacacgccggagugccccgacgaccaacgcgccuggaacaucugggagguugaggacuacggcuucgggaucuuuacuaccaacaucuggcuuaaguuacgggacucuuacacccaagugugcgaccaucgcuuaauguccgcggcuaucaaagacagcaaggcaguccacgccgacaugggcuacuggauugaguccgagaagaaugaaaccuggaagcuggcucgggcgagcuuuauagaagucaagacuugcauuuggcccaagucucacacccucuggagcaacggcgugcuggaguccgagaugauaauuccuaaaaucuacgggggaccgauuagccagcacaacuaccgcccuggguacuuuacccaaacugccggccccuggcaccuggggaagcucgaacuggacuucgaccugugugaggggacaaccguggugguggacgagcacugcggcaaccgcgggccgucccuccgcacuacaacgguuaccgggaagauaauccacgaguggugcugucggagcugcacccugccgccgcugcgcuuccgcggggaggauggcugcugguacggaauggagauccgaccugucaaggagaaggaggagaaccucgucaaguccauggugagcgccggcucgggggaggucgacuccuucagccuagggcugcucuguaucucaaucaugaucgaggaggugaugagaagccgcuggucccggaagaugcuuaugaccggcacgcuggccgugaucuuccuccucaucaugggccagcugaccuggaacgaccucaucaggcugugcaucauggucggcgccaacgcauccgaucgcauggggaugggcacuaccuaccuagcccucauggcuacguuuaagaugcggccuauguucgcugugggccugcuguuccgccgccucaccucccgcgaagugcugcuguugaccauagggcugagccuggucgccuccguggaauuacccaacucgcuagaagaacuuggagaugggcuggcaaugggcaucaugauccugaagcugcucacugacuuccagucccaccaacugugggccacgcuucuuagccugaccuucaucaagaccacuuucuccuuacauuacgccuggaagacgauggccaugguacucagcauuguuucacuauucccccugugccucagcaccaccucccagaagaccacguggcugcccguguuacucggcagccuugggugcaagccgcuaacgauguuccucaucgcggagaacaagaucuggggccggcgcuccuggccccugaacgaaggcauuauggcggucgggaucgugagcauucuguuaagcuccuuacugaagaaugacgugccgcucgccgggccccugaucgccgggggcaugcugaucgcguguuacgucaucucaggguccucggcagaucucucccuggagaaggccgccgaagugagcugggaggaggaggcagagcacucuggcgccagccauaacauccucguugagguccaagacgacggaaccaugaagaucaaggacgaagaacgggacgauacccucacaauccuccugaaggcuacguugcuggccguguccggcguguauccuuuaagcauuccugccacccuuuucguuugguacuucuggcagaagaagaagcagcgcuccggggugcugugggacaccccuagcccgcccgaaguggagcgggccguccuggacgacggcaucuaccgaaucaugcaacggggccugcucgggcgcucacaaguaggcgugggggucuuucaggagaacguguuccacaccauguggcacgugacgaggggcgccguccugauguaucaggggaagcggcuggagcccuccugggcgucggugaagaaggaccucaucagcuacggaggcgguuggagauuacagggguccuggaacaccggagaggagguucaggucaucgccguggagcccggcaagaaccccaagaacgugcagacggcccccgggaccuucaagacgcccgagggggaggucggcgcgaucgcccuggauuucaagcccgggaccagcggcucaccaauugugaaccgcgaggggaagaucgucggucuguauggcaacggcguuguaacuaccagcggcacguaugugagugcgaucgcucaggcaaaggccagccaagaaggaccgcugcccgagaucgaggaugagguguuucgcaagcgaaaccugaccaucauggaucuacaccccggaagcggcaagacccgacgguaccugccggccaucguccgggaggccaucaaacguaaacuacgcacgcucauacuggcccccacgcgggugguggcuucagagauggcugaggcacugaaagguaugcccauacgcuaccaaaccacggccgucaaaagcgagcacaccggcaaggagaucguggaucucaugugucacgcgaccuucaccaugcggcugcugucccccguccgggucccgaauuacaacaugaucaucauggacgaggcucacuucaccgacccaagcuccaucgccgcacggggguacaucagcacgagaguugggaugggugaggcugcagccaucuucaugacggccaccccgcccggcuccguagaggcguucccacagagcaacgccgugauccaggacgaggagcgagacauccccgagcguuccuggaauagcggguacgaguggaucaccgauuuccccggcaagacggugugguuuguccccagcaucaaguccgguaacgacaucgcaaacugccuucggaagaaugggaagcgcgugauacagcuguccagaaagacguucgacacugaguaccaaaagaccaagaauaacgacugggacuacguagucaccaccgacaucagcgagaugggcgccaauuuccgcgcggacaggguaauugacccucgccggugcuugaagccugugauccucaaggacggacccgagcgugucauuuuagccggcccuaugccggugaccguggccuccgcggcccaacggcgcgggcggaucggccgcaaucacaauaaggagggugaccaauauaucuacauggggcagccccugaacaacgacgaggaccacgcucacuggaccgaggccaaaauguugcucgacaacaucaacacccccgaaggcaucaucccagcccuguuugagcccgagcgcgagaaaucagccgccauugauggcgaguaccggcuucgcggcgaggcgcggaagacauucguggagcuuaugcgcagaggggaccugcccguguggcucuccuauaaggucgccagcgagggcuuccaauacagcgaucggcgguggugcuucgacggcgagcguaacaaccaggugcuggaggagaacauggacguggaaaucuggacuaaggagggugagcggaagaagcugaggccgcgguggcucgacgcccgcacguacuccgacccccuggcccugcgggaguucaaagaguucgccgcgggcaggcggagcguauccggcgaccucauccuugagaucgggaaguugccccagcaccucacucagcgcgcccagaacgcccuagacaaccugguaaugcuccacaacagcgaacaaggcgggcgggccuaccgccacgcaauggaggagcugcccgacaccaucgagacucugaugcuccuggcccuaaucgccguccuaaccgguggagugacccuguucuuucuaucgggucggggguuaggcaaaaccucgaucggucugcuuugcgugauggcgaguagugugcuccuuuggauggcuucagucgagccgcacuggaucgccgccagcaucauccuugaguucuuccucaugguucugcugauccccgagccggacagacagcgaacaccgcaggacaaucaacucgcauacguggucaucggccugcuguucaugauccucaccguugccgcuaacgagaugggccugcuggagaccacaaagaaagaucucgggaucggccacguugcagucgagaaccaccaucacgccgcaaugcuggacguggacuugcaucccgcauccgccuggacgcucuacgcgguggccaccaccaucauuaccccuaugaugcgccacacaaucgaaaacacuacugccaacauaagccuuaccgcgaucgccaaccaggcggccauccugauggggcucgacaaaggcuggccgaucuccaagauggacaucggcguuccccugcuugcguuggggugcuacagccaggugaauccucuaacucugaccgccgcagucuuaaugcugguagcucacuacgcgaucaucggcccggggcugcaggccaaggcaacgcgcgaagcccagaaacggaccgccgccggaaucaugaagaaucccacuguagacgggaucguggccauagacuuggaucccguuguauaugacgcuaaguucgaaaagcaacugggccagauuaugcugcucauccuguguaccagccaaaucuugcugaugcgcacgacaugggcacugugcgaaaguaucacgcuagccaccggcccgcucaccacccugugggaggguuccccgggcaaguuuuggaacacgaccaucgccguaucgauggcaaacaucuuccggggcuccuaccuggccggagcaggccucgccuucagccugaugaaaucucucgggggcggacgacggggaaccggggcgcagggcgaaacgcucggcgagaaguggaaaagacagcugaaccaacuguccaagucugaguucaauacuuacaaacgguccgggaucauggagguugaucgcagcgaggccaaggagggucucaagcguggagaaaccaccaagcaugcggugagccgcggcacggccaagcugcguugguucguggagcggaauuugguaaagcccgaggggaaggucaucgacuuaggcugcgggcgcgggggcuggagcuauuacugcgccggacucaagaaggugacggaggucaaggguuacacuaagggcggacccggacacgaggagcccauuccuauggccaccuauggcuggaaccugguaaaacugcauuccggcaaagacgucuucuucauuccacccgagaagugcgauaccuugcugugcgacauaggggagagcucccccaauccaacgaucgaggagggccgcacgcugcggguccucaagaugguggagcccuggcuuagagggaaccaauucugcaucaagauccugaaccccuacaugccuagcguggucgaaacccucgaacagaugcagcggaagcacggcggcaugcugguccgcaacccgcugucccggaacagcacacacgaaauguacugggugaguugcgggaccggcaauauuguaagcgccgugaacaugacgucccgcaugcuccuaaaccguuucaccauggcccacaggaaacccacguacgagcgcgauguggaccugggagcaggcacccggcacgucgccguggagcccgagguggcaaaucucgauaucaucggacaacgcaucgagaauaucaaacacgagcacaagagcacguggcacuaugaugaggauaacccuuacaagacaugggcuuaucacggauccuacgaggugaagccaucaggcuccgccagcagcauggugaacggugucguaaagcugcuaaccaagcccugggaugugauccccauggucacccagauugccaugaccgauaccacccccuuuggccagcagaggguguuuaaagagaagguggacacccgcaccccuaaagcaaagcgggguaccgcccagauuauggaggucaccgccaaguggcucuggggcuuccucagccgcaacaagaagccgagaaucugcacgcgcgaagaguuuacgcggaagguucgaaguaaugccgcaauuggcgccguauucgucgacgagaaccaauggaacucugcgaaagaggccguggaggacgagcgguuuugggaccuggugcaucgggagcgagagcuacacaagcaagggaaaugugcgaccuguguuuauaacaugaugggcaagagggagaagaagcugggugaguucggaaaagcgaaggggagcagggcuaucugguauauguggcucggugcccgcuuccuugaguucgaagcgcuugguuucaugaacgaggaccacugguucagucgggagaauagccuguccgggguggagggcgagggccuccauaagcugggcuacauucugcgcgacaucucuaagauucccgggggcaacauguacgccgacgauacggcgggcugggauacccggauaacggaggacgaccuccaaaacgaagcccggaucaccgauaucauggaacccgagcaugcgcugcuggcgaaguccaucuucaagcugaccuaccaaaacaaggugguucgugugcagcggccggccaagaacgggaccguaauggacguaaucagccgacgggaccagcgcggcuccggucaggugggcacguacggccugaauacuuucaccaauauggaggcccaacugauccggcagauggaauccgagggcaucuuuucgcccagugagcucgagacccccaaccuggcggagcgcgugcuggacuggcucgagaaguauggcgucgagaggcugaagcgcauggccaucuccggggacgauugcguggugaagccuaucgacgaucgguuugcgaccgccuugaccgcccucaaugacaugggcaaaguucgcaaagauaucccucaaugggagcccagcaagggguggaaugacuggcaacagguccccuuuugcucccaucacuuccaccagcugaucaugaaggaugggcgugagauaguggucccuugccgaaaccaggaugaacucgugggcagggcccgcgugucucaaggggccgguuggagccuccgagaaaccgcgugcuugggaaagucuuacgcucagauguggcagcugauguacuuccaccgccgggaccuucgcuuggccgccaacgccaucugcagcgcaguccccguggauuggauccccaccuccaggacaaccuggucaauacaugcccaccaccaguggaugaccaccgaggacauguugucaguguggaaccgugucuggaucgaggagaaccccuggauggaagacaaaacgcacaucagcuccuggggagacgucccguauuuagggaagcgggaggaccaguggugcgggagcuugaucggacugacagcgcgggccaccugggcgaccaacauccaaguagcaauaaaccagguucgcaggcucaucggaaacgagaauuaucuggacuacaugacaagcaugaagcguuucaaaaacgaaagcgaccccgagggagccuuaugguga

SEQ ID NO: 24127 - RNA, 9879 nt, Artificial Sequence
  derived and/or modified CDS sequence (opt11) from DENV-1__FJ024439__SS-prME
agcgugaccaugcuguuaaugcugaugcccaccgcuuuggcguuucacuuaacaacccggggcggggagccccacaugaucguguccaagcaggaaagagggaagucacuacuguucaagacuucugcaggcgugaacaugugcacccuaauagccauggaccugggcgagcucugcgaagacaccaugaccuacaaguguccccggaucaccgagaccgagccagacgacguggacuguuggugcaacgcuacagauaccugggucaccuaugguaccugcucccaaacgggugagcaucggcgcgacaagcgguccguugcccucgcgccacacgugggccuagggcuggagacacgcaccgaaacauggaugucguccgagggggccuggaagcagauucagcgggucgagacgugggcccucagacaucccggcuucacugugaucgcgcuauuccuggcccacgcgauuggcacgagcaucacccaaaaggggauuaucuucauucuccugaugcucguuacacccuccauggcuaugcggugcguuggcaucggcagucgcgacuuuguagagggguuguccggcgccaccuggguggacgucguucuggagcaugggagcugcgugacuaccauggccaaggacaagcccacgcuggacauugaacuccuuaagaccgaagucaccaacccugccguucuucguaagcucugcauagaagcgaagaucaguaacacaacgacugauucacgcugcccgacccagggcgaggcaacgcugguggaggagcaggaugccaacuucgucugccggcgcacguuuguggaccggggguggggcaacgguugcggccuguuuggcaaggggucccuaaucacgugcgccaaguucaagugugucacaaaacuggagggaaagauaguccaauacgaaaaccuuaaguacucugugaucguuacuguccacacgggugaccagcaccagguagguaaugagucaaccgagcacggcaccaccgcgaccaucaccccgcaggccccuaccacugagauccaacucaccgacuacggggcccugacgcuugacuguagcccacguaccggacucgauuucaacgagaugguucugcugaccaugaaagagaaguccuggcucguacacaagcagugguuccucgaucugccucucccauggaccagcggggccagcacgucgcaagagaccuggaaucggcaggaucugcuagugacuuuuaagaccgcccacgcuaaaaagcaagagguugugguacucggcagucaggagggcgcgaugcacacggcacugacgggggccacagagauacagaccucgggcacgacgaccaucuuugccgggcaucugaagugucgccugaaaauggacaaguuaacguuaaagggcaugucauacgucaugugcacgggcucguucaagcuagagaaggagguggcggaaacucagcacgguaccgugcuaguacaaauuaaauaugaggggaccgacgcgcccugcaagauccccuuuagcacacaagaugagaagggaguuacgcagaacggccggcugaucaccgccaacccaaucgugacggacaaggagaaaccagucaacaucgaggccgaaccgcccuucggagaauccuacauaauaauaggugccggcgagaaggcgcuaaaguugucaugguucaagaaggguuccucuaucggaaagauguuugaggccacggcccguggggcccggcgcauggccauccuuggcgauaccgcgugggacuucggguccaucggaggaguguucacaagcguggggaagcugguccaccagaucuucggcacagcuuacgggguccuguucuccgguguguccuggacgaugaagauagggaucggaguucuauuaaccuggcucggccugaacucgcgcagcaccaguuucagcaugaccugcaucgccgugggacuggucacuuuauaccuaggagucauggugcaggccgacuccggaugcgugauaaauuggaagggacgggaguuaaagugcgggagcggcaucuucguaaccaacgaagugcacaccuggaccgagcaguacaaguuccaggccgauucaccuaagcggcucuccgccgccaucggcaaggcuugggaggaaggggugugcggcauccggagcgcaacccgcuuagagaacaucauguggaagcagaucucaaacgagcugaaccacauccucuuggaaaacgacaugaaguucaccgugguugugggggacgucgccggcauccuggcgcaggggaagaagaugaucaggccgcaacccauggaguacaaguacucguggaaauccugggggaaagcaaagaucaucggagcagacguccagaacaccaccuucaucaucgacgggcccaauaccccggaaugccccgacgaccaacgggccuggaacaucugggagguggaggacuacggcuucgguauuuuuacgaccaacaucuggcucaaguugcgugacagcuacacgcaggucugcgaucaccgccugauguccgcggccaucaaggacaguaaggccguccaugccgacaugggauacuggauugagucugagaagaacgagaccuggaaacucgcccgggcgagcuucaucgaggugaaaacgugcaucuggccgaagucccacacccuguggagcaacggcguccuggaaucagagaugaucauacccaagaucuaugggggcccgaucucacagcauaauuaccgcccgggguacuucacacaaacggccggccccuggcaucucgggaagcuggagcuggauuucgaccugugcgagggcacaacugugguggucgaugagcacugcggcaaccgggggccgucccugagaaccaccacugugaccggaaagaucauacacgaguggugcugccgaagcugcacccugccgccucugcguuuccgcggggaagacggguguugguauggaauggagauccggcccgugaaggaaaaggaggagaaccugguaaaguccauggugagcgccggcucaggcgagguggacucuuucagcuuagggcuccugugcaucuccaucaugaucgaggaaguaaugcggucacgcuggucccggaaaaugcugaugacgggcacacucgccguguuuuuccuguugaucaugggacagcuaaccuggaacgaucugauccgccugugcaucauggucggcgccaacgcgagcgaccgcaugggaaugggcaccacuuaccucgccuugauggcgacguucaagaugcguccgauguucgccgucgggcucuuauucagacggcuaacuucccgugaagugcugcuucugacgauaggacuaucucucguagccagugucgagcugccgaauagcuuagaagaguuaggcgacgggcuggcgaugggcaucaugauucugaagcuccugaccgacuuucagagucaccagcugugggcuacgcuccugagccugaccuucaucaagaccaccuucucccuccacuacgcauggaaaaccauggcaauggugcugagcaucgucagucuguuuccucucugccugagcaccaccucacagaagaccacauggcuucccgugcugcugggcucacuggggugcaagccgcucaccauguucuuaaucgcggaaaacaagaucugggguagaaggucguggccccugaacgaggggaucauggccgucggcauagucucgauccuccugaguagccugcugaagaacgacgugccccuggccggcccguuaauugccggcgguaugcugaucgccugcuacgucaucagcggauccagcgcggacuuaucccuugaaaaagccgcugaggugagcugggaagaagaggccgagcacuccggcgccagccauaacauccucgucgagguacaggacgaugggaccaugaagaucaaggacgaggagcgggacgauacucugaccauccugcuaaaggcgacguugcuggccgucuccggcguuuacccguuaucuaucccugcaacccuguucgugugguauuuuuggcagaagaagaaacagagauccgggguucugugggacacccccagcccacccgaaguggggcgggcugugcucgaugacgguaucuaucgcauaaugcagagagggcugcucggcaggagucaggucggugugggcguguuccaggagaacguauuucacaccauguggcaugugacgcgcggcgccgugcugauguaccaggggaagcgcuuggaacccagcugggcuuccgucaaaaaggaccugauaagcuauggcggaggguggcggcuacaaggcuccuggaauaccggagaggagguccaaguaaucgccgucgaaccggggaagaaucccaagaacgugcagaccgccccugguaccuucaagacgcccgagggggaggugggggccaucgcccucgacuucaaacccggcaccucuggaagucccauugucaaccgugaaggcaaaaucgugggauuguaugggaacggcgugguaacuacaagugggacguacguuucagcgauugcucaagcgaaggccucccaggagggcccgcugcccgagaucgaggaugagguguucaggaagcgcaaccucaccaucauggaucugcaccccggaagcggcaaaacccggcgguaccugcccgcgaucguccgggaagcuaucaagcgcaaacuccggacacugauucuagccccaacaagagugguggccuccgagauggcagaggcgcucaagggcaugcccauccgguaccagacaacagcggucaagagcgagcacaccggaaaagagaucguggaccuaaugugucaugccacauucaccaugcggcuccucuccccggugcgcguaccgaacuacaacaugaucaucauggacgaggcccacuuuaccgaccccagcuccaucgcagcgcgaggauacaucagcaccagagugggaaugggagaggcugcagccaucuucaugacggccacaccaccuggauccguggaagcauucccgcagagcaacgccgucauccaggacgaggaacgcgacauccccgagcgcucguggaacagcggcuaugaguggaucacggacuuccccggcaagaccgucugguucgugcccagcaucaagagcgggaacgacauagcuaacugucuccgcaaaaacggcaagaggguuauccaguuaagccggaagacuuucgacaccgaguaccagaagaccaagaacaacgacugggacuacguggugaccacggacaucucggagaugggggcaaacuuccgcgcggaucgggucaucgacccacgcagaugucugaagccugugauccugaaagacggccccgaacgggugauccucgccgggccuaugccgguaacaguggcuuccgcagcccaaagacggggccggaucggacguaaucauaacaaagagggagaccaauauaucuacaugggccagccccucaacaacgacgaagaccaugcccauuggaccgaggccaagaugcugcuggacaacaucaacacccccgaagggaucaucccagcccucuucgaaccggaacgggagaaguccgccgcgaucgacggcgaauaucggcugcgcggcgaagcgcguaagacguucguagaacugaugcgccggggcgaucuccccguguggcuguccuacaagguggcuagugagggcuuucaauacagcgaccgccgguggugcuucgacggggaacgcaacaaccagguacuggaggaaaauauggauguggaaauauggaccaaagagggcgagagaaagaagcuccgcccacgauggcuggacgccaggaccuacuccgaccccuuagccuugcgggaguucaaggaguuugccgcgggucgccggagugucuccggcgaccugauccuggagaucggcaagcucccgcagcacuuaacccagcgcgcccagaacgcccuugacaaucucgucaugcugcauaacagugaacagggcgggcgcgcuuacaggcaagcgauggaggagcuaccggacaccaucgaaacccucaugcucuuggcucucaucgccguucugacagggggcgucacucuguucuuucucucgggccggggucucgggaaaaccagcaucgggcuucucugcgugauggcuuccuccgugcuuuuguggauggccagcguagagccgcacuggaucgccgcaaguaucauccuugaguucuuucugaugguccugcuaauacccgaaccugacagacagcguacaccccaagacaaccagcuggcuuaugugguaauuggccuccuguucaugauacugaccguugccgcuaacgagauggggcuucucgagaccaccaagaaagaucuaggcaucgggcauguagcggucgaaaaccaucaccacgccgcgaugcuggaugucgaccuccaccccgccuccgcauggacccuguacgcgguggcuaccaccauaaucacuccgaugaugcgccacacgaucgagaacaccacggccaacaucagccugacagcgauagcgaaccaggcggcgauccucaugggucuggacaagggguggccgaucuccaaaauggacaucgggguaccacuucucgccuuagguugcuacagccaggugaacccccugacacucaccgcugcgguucuuaugcuggucgcacacuacgccaucaucgggccgggacuccaggccaaggcgaccagggaggcgcagaaacggaccgcugccgggaucaugaagaaccccacggucgacggcaucguggccauagaccucgacccggugguuuaugacgccaaauucgagaagcagcugggccagaucaugcuccuuauccucugcaccucucagauucuccugaugcgcacaaccugggccuuaugcgagagcauaacgcucgccaccgggccauuaaccacgcuuugggaggguucaccggggaaauuuuggaacacuaccauagccgugucgauggccaacauauuccgcgguuccuaccucgccggcgcuggguuggccuucucacugaugaagucccucgggggcggacgccgagguacaggcgcccagggcgagacccucggggagaaguggaagcggcaauugaaccaguuguccaagucggaguucaacacguacaagcggagugguaucauggaaguggacaggagugaggccaaagaaggacuaaagcggggcgagacaacgaaacacgcggucagccgcggaaccgcgaaacuucggugguucgucgagcgcaaccucgugaagccagagggcaaggucaucgacuugggaugugggagaggaggguggagcuacuacugcgccggccugaagaaggucaccgaagugaagggguauacuaaggguggcccaggccaugaggagccgaucccgauggcuaccuacggcuggaaccuugucaaacuucacuccgggaaggacguguucuucauacccccggagaaaugcgacacucuguuaugugacaucggcgaaagcucacccaacccuacgaucgaagaggggcgaacacucaggguguugaaaaugguggagccuuggcugcgcggcaaucaauucugcauuaagauccuaaaucccuacaugcccuccguuguggaaaccuuagagcaaaugcagcgcaagcacggcggaaugcuggucagaaacccgcucucccgcaauagcacccacgagauguacuggguauccuguggcacagggaacaucgugagcgccgucaacaugaccucucgcaugcugcugaaccgguuuacaauggcucaucggaagcccaccuacgaacgcgacgucgaccugggggccgggacucggcauguggccgucgagcccgaaguggcaaaccucgacaucauugggcagcggaucgaaaacaucaagcacgagcauaaaucuacguggcacuaugaugaagacaaccccuacaaaacuugggccuaccacggcucguacgaggugaaaccgagcggcagugcgagcagcaugguaaacgguguagucaaacuucuaacgaagcccugggauguaauacccauggugacccagaucgccaugacggacaccaccccauuuggacagcagcgggucuucaaggagaagguggacacccgcacgccaaaagcuaagcggggcaccgcccagaucauggagguaaccgcgaaauggcuuuggggcuuccugagccgaaauaagaagccucgaaucugcacccgcgaagaguucacgcggaagguccguagcaacgcagccauuggggccguguucguggaugagaaccaguggaacagcgccaaggaggcggucgaggacgagcgguuuugggaucucgugcaccgggaaagagagcugcacaagcaagggaagugcgcgaccugcguguacaauaugauggggaaacgcgagaagaaacuuggagaguucgggaaagcgaaaggcagccgggccauaugguacauguggcucggggcccgcuuccuggaguuugaggcccucggguucaugaacgaggaccacugguucagucgggagaacagccucuccggcguggagggggagggucugcacaaacugggauacauccuccgcgacaucuccaauauccccggaggcaacauguacgcugaugacacagccgggugggauacccgcaucacagaagacgaccugcagaacgaggccaggauaaccgauaucauggagccugaacacgcccuucuagccaaaaguaucuucaaacuuacuuaccagaauaagguggugcgcguccagcggccugccaagaacgggaccgugauggacgucaucagccgccgcgaccaacgcgggagcggacagguggguacauacgggcuaaauaccuucacuaacauggaggcucaacucauccggcaaauggaaagugagggcauauucucccccagcgagcuggagacccccaaccuggcagaacgcgugcucgacugguuagagaaauacgggguggagcgguuaaaacgcauggcaaucagcggcgacgacugcgucgugaaaccgaucgacgaucgguucgcgacggcccucaccgcgcugaaugacaugggcaaggugcgcaaggauaucccgcagugggagcccucuaagggcuggaacgacuggcagcagguccccuucugcucgcaccacuuccaccagcugaucaugaaggauggucgggagaucgucgugccgugccggaaccaggacgagcucguagggcgggcuagggucagccagggcgcaggcuggagucuccgggagaccgcaugucuagggaaguccuaugcucagauguggcagcucauguacuuccaccgccgugaccugagacuggccgccaacgcaaucuguucggccgugcccgucgauuggauccccaccuccagaaccaccuggagcauccaugcccaccaccaguggaugaccacagaggacaugcucuccguguggaaccgcguguggauugaagagaacccuuggauggaggacaagacgcacaucucaucuuggggugacgucccguaucugggaaagcgcgaagaccaauggugcggcucacugaucggguugacagcccgggcaaccugggcgaccaacauccaaguugccaucaaccaggugcgccggcuuaucggcaacgaaaacuaucuagauuacaugacuuccaugaaacgcuucaagaacgaaagugaccccgagggugcccuaugguga

SEQ ID NO: 24128 - RNA, 9879 nt, Artificial Sequence
  derived and/or modified CDS sequence (opt11) from DENV-1__FJ024441__SS-prME
ucggugaccaugcugcuaauguugaugcccacggcccuggccuuccaccugaccacccggggaggggagccccauaugaucgugagcaaacaggaaaggggcaagucccuccuguucaagaccucagccggggugaauauguguacucuaaucgcgauggaucugggcgaacuaugcgaagacacuaugaccuauaaguguccacgcaucacggagacggagccagacgacguggacuguuggugcaacgccaccgacaccugggugaccuaugggaccugcagccagaccggugagcaucgucgcgacaagcgauccguggcccucgcgccccacgugggccugggauuagagacacgcaccgagacuuggaugagcagugagggcgcguggcggcagauccagcgcgucgaaacgugggcccuccgucacccgggguucacagugaucgcucuguuccuggcccacgcgaucgggaccagcauaacccagaaggggaucaucuucauccuacugaugcuggugacccccucuauggccaugcgcugugucgguauuggcagccgggauuucguggaaggacuuuccggcgccacauggguggacgugguccuagagcacgggagcugcgugaccacuauggcgaaggauaagcccacgcuggauaucgagcuacugaagaccgaggucacaaaucccgcggugcugcgcaaacucuguaucgaggcuaaaaucuccaauacuacgacugacucacgguguccgacccagggcgaggccacccugguggaggagcaggacgccaacuucguguguaggcggacuuucguggaccgcggcuggggaaacgguugcggccuguucggcaaggguucccucauaacaugcgccaaauuuaagugcgucacaaagcuggagggaaagaucguccaguaugaaaacuugaaguacagcgugaucgugaccguucacacgggggaccagcaccaaguagggaacgaauccaccgagcacggcaccacugcaaccaucaccccgcaggcgccuacuacagaaauccagcucacagacuacggugcccugacgcuggacugcucgccccguacaggucucgauuucaacgagaugguuuugcugaccaugaaggaaaagaguuggcucgugcacaagcagugguuccuugaccugccccucccguggaccucgggggccagcacgucgcaggaaaccuggaacaggcaggaccugcugguuaccuuuaagaccgcccacgcgaagaaacaggaggucgucgugcucggcagccaggagggagcgaugcacacggcucugacuggggccacggagauacaaaccaguggcacgaccaccaucuucgccgggcaccuaaagugucgguugaagauggacaaguugacccuaaaggguaugucauacgugaugugcacaggguccuucaaguuagaaaaggagguggcugagacccagcacggcacggugcugguccagaucaaauaugagggcaccgacgcgcccugcaagauccccuucagcacccaggacgagaagggagucacacagaacggacguuugaucacugccaauccuauugugacagacaaggagaagcccgucaacaucgaggccgagccgccguuuggcgaguccuacaucaccauaggcgccggcgagaaggcgcugaaacuuucgugguucaagaaaggauccucaauuggcaagauguucgaggcuaccgcacgcggggcucgccguauggccauucugggcgacaccgcgugggacuucggcuccauaggcggcgucuucaccagcguugggaagcugguccaccagaucuucgggacggccuacggcgugcuguucucuggcgucagcuggaccaugaagaucgggauuggagugcugcugaccuggcucggccuaaacucacgcucaaccucccugagcaugacgugcaucgccguggggcuugugacccuguauuuaggcguuaugguacaagccgacuccggcugcgugaucaacuggaagggccgcgagcucaagugcgggagcggcauauuuguuacgaacgaggugcacacauggacagagcaguauaaguuucaggccgacagcccgaagagacuguccgcggcuaucggcaaggcuugggaggagggggugugcggcauccgcagcgcaacgcggcuggaaaacauuauguggaaacagauuagcaaugaguuaaaccacauccugcuggagaacgacaugaaguucaccguugugguuggugacgucgcgggcauucuugcgcaaggcaagaaaaugauccgcccgcagcccauggaguacaaauacagcuggaaguccugggggaaggccaagaucaucggcgccgacguacagaacaccacauucaucaucgacggcccuaacaccccggaguguccugacgaccaacgggccuggaacaucugggagguggaggacuacggcuuugggauauuuaccaccaacaucuggcuaaaacugcgcgacagcuacacucaggucugugaccacagacuaauguccgccgccauuaaggacagcaaggccgugcacgcagacaugggguacuggaucgaguccgagaagaacgaaacguggaagcuggcgcgcgcgucuuucaucgaggugaagaccugcgucuggcccaaaucccacacccucugguccaacggcgugcucgagagcgagaugauuauccccaaaaucuacggaggaccgaucagccagcacaacuacaggcccgguuacuucacccagacggccgggccuuggcaccuggggaaguuggaguuggacuucgacuugugcgagggcaccaccguggucguggacgaacauuguggcaacagagggccgucauuacggaccaccacugugaccgguaagauuauccacgagugguguugccgcuccugcacucugccgccccuccgguuccgcggugaggacggcuguugguacgguauggaaauucgucccgucaaggagaaggaagagaacuugguuaaauccauggucagugcagguagcggcgaggucgauucauucagccuaggacuacuguguaucucuauuaugaucgaggaggugaugcgcucucgguggucccgcaagaugcuaaugacgggcacccuggcuguguucuuccugcucaucaugggucagcugaccuggaacgacuuaauccgccucugcaucaugguaggcgccaacgcuagcgaccggauggguaugggcacgacauaccuagcacugauggccacguucaaaaugcgcccaauguucgcagugggccuccuguuccgcaggcugaccuccagagaggugcuccugcugaccaucggacucagccuggucgcgucagucgagcugcccaacagcuuagaagaacuaggcgacgggcucgcgaugggaaucaugauccucaaacugcugacagacuuucagucccaccaacugugggccaccuuacuuucgcucacuuucauuaagaccaccuucucucugcacuacgcguggaagaccauggccaugguccugagcaucgugucccucuucccacugugccuaucaaccaccucccagaagaccacauggcuccccgugcugcuggguagccucgggugcaagccucuaaccauguuucucauagcugagaacaagauuuggggcaggcggaguuggccccucaacgaggguaucauggcaguaggcauagugagcauccuccugagcucccuccugaagaaugacguuccccuggccggaccguuaauugcaggcgggaugcugaucgccuguuacgucauaaguggguccagcgccgaccugucacuugaaaaggccgcugaggucucuugggaagaggaggccgagcacuccggggcaagccacaacauccuagucgagguccaggacgacgggacuaugaagaucaaggacgaggaacgcgacgacaccuugacgaucuugcuuaaagccacgcugcuggcuguguccggaguguacccgcugucuauccccgcgacgcuguucgucugguacuucuggcaaaagaagaaacagcgguccggggugcucugggacacccccagcccgcccgagguggagcgcgccguccuagacgacggcauuuaccggaucaugcagcgcgggcuguuagggcggagccaggugggcguaggugucuuccaagagaacguguuccacacgauguggcacgugacacggggcgccguacucauguaucaggggaaacgauuggagcccagcugggcauccgugaagaaagaucugaucagcuauggcggcggguggcggcuccagggcuccuggaacaccggcgaggaagugcaggucaucgcaguggagcccggcaagaacccaaagaacgugcagaccgccccggggacguuuaaaacacccgagggagagguaggagccauagcccuggauuucaagcccgggaccagcggcucccccauagugaaccgggaggggaagaucgucggucuguacggcaacgggguugugacgacaagcggcacguacguuagcgcgaucgcccaggccaaggccucccaagaggggccuuugccagaaauugaggacgaagucuuccgcaaaagaaaccugaccaucauggaucugcaccccggcagcggcaagacccgccgguaucuuccggcgaucgugcgcgaggccaucaagcgcaagcugcggacguugauccuugcccccacccgggucgucgccuccgagauggcagaggcccugaaaggcaugcccauccgguaccagaccaccgccgugaagagugagcauacuggcaaagagaucguggacuugaugugccacgcaaccuucaccaugcgccuacuguccccuguccgggugcccaauuacaacaugaucauaauggacgaagcccacuucacagacccuagcuccaucgccgcccgcggguacaucagcacccgggugggaaugggggaggcugccgccaucuuuaugaccgccacgccacccgggucagucgaggcguucccucagagcaacgccguuauccaggacgaggaacgcgacauccccgagcgcuccuggaacagcggguacgaguggaucacugacuuuccugggaagacggucugguucguacccuccauaaagagcggcaacgacaucgccaacugucugcggaaaaacgggaagcgagugauccagcucucucguaagaccuuugacaccgaguaccaaaagacaaagaacaacgacugggacuacguggucacgacugacaucagcgagaugggcgcuaacuuucgggcggaccgcgugauagacccccggcggugcuugaagccagucauccugaaggacgggccugagcgggucauccucgccgggcccaugccggugacugucgccuccgccgcccagcgccgggggcgcauaggucgcaaccacaauaaggagggcgaucaguauauuuacauggggcagccucuuaauaaugaugaggaccacgcgcacuggaccgaggcaaaaaugcugcucgacaacaucaauacgcccgaaggaaucauaccagccuuauucgagccggaaagggagaaauccgccgccauagacggcgaguaccgccugagaggcgaggcgagaaaaacauucguggagcucaugcgucgcggggaccugcccguuuggcugucauauaaggucgcaagcgaaggauuccaguauucggaucggcgcuggugcuucgacggcgagaggaacaaccaagugcucgaagagaauauggauguggagaucuggaccaaggaaggcgagcgcaagaagcugcggccccgcugguuagacgcccggacauacuccgacccccucgcuuuaagagaguuuaaagaguucgccgcgggccggcgcucugugucaggagaucugauccucgagaucgggaagcugccgcagcaccugacgcagcgggcccaaaacgcccucgacaaccuggucauguugcacaacagcgagcagggugggcgcgccuaccggcacgcgauggaggagcuccccgauacaaucgagaccuugauguugcuggcgcugaucgcugugcugaccggcgggguuaccuuauucuuucuguccggucgggggcugggcaagacgagcaucggacuccugugcgugauggccuccagcgugcuccuuuggauggccuccguagagccccacuggaucgcggccaguauaauccuggaauuuuuccugaugguuuugcugauccccgagccggaccggcagcgcacuccucaagauaaccaguuggccuacguggucauaggauuacuguucaugauccugaccguggccgcgaacgagaugggccuacuggagaccacgaaaaaggacuuagggaucggccacguggcggucgagaaccaccaccacgccgccaugcucgacguggaccugcaucccgcuucggccuggaccuuguacgcgguagcgacaacgaucauuacgccaaugaugcgccauacaauagagaacacuaccgccaacaucucgcuuaccgccaucgccaaccaggcagccauacugauggggcucgauaagggcuggccaaucagcaagauggacaucggcgucccgcuccucgcccugggaugcuacagccaggugaacccccucacccugaccgccgccguccugaugcucgucgcccauuacgccaucauaggccccgggcugcaggccaaggcaacgcgcgaggcgcaaaagcgcacggcugcaggcauuaugaagaaucccaccguggacgggaucguggccaucgaccuugacccggucguguacgacgccaaguucgagaaacagcuagggcagaucauguugcugauccugugcaccucccagaucuugcuuaugcggacuaccugggcccucugugagagcaucacccuggccaccggcccucugacgacgcugugggagggguccccagggaaguuuuggaacaccacaaucgccguaaguauggcaaacaucuuccgcggguccuaccuggccggagcgggccuugccuucagccucaugaagucccucgguggcgggaggcgcggaaccggggcucagggugaaacguuaggcgagaaguggaaacggcagcucaaccagcugagcaagagcgaguucaacaccuauaaacgcucgggcaucauggaggucgaccggucggaagccaaggagggucugaagcguggggagaccaccaagcacgcgguuucacggggaacggcgaagcuccgaugguucguggagcggaaccuggucaagccggaggggaaggugauugaccugggcugcggccguggcggauggucauacuacugugccggacugaagaagguaaccgaggucaaaggguacacuaagggagggcccggccacgaggagccaaucccgauggccaccuacggguggaauuuagugaaacugcacucaggcaaggauguauuuuucaucccgcccgagaagugcgacacccugcuuugcgacauaggggagagcucccccaacccgaccaucgaggagggcaggacccugcgcguccugaaaaugguggagcccuggcuccggggcaaccaguucugcaucaagauccugaaccccuauaugcccagcgugguggagacccuggagcaaaugcagagaaagcacggcgguaugcucgucaggaacccgcugucccgaaacucaacccaugaaauguauuggguguccugcgguacgggaaauaucgucagugcaguuaacaugaccucccgaauguuacucaaccgguucaccauggcacacagaaagcccaccuacgagcgugacgucgaccugggggccgggacgcgacacgucgccguggagccugagguggccaacuuggacaucauuggucaacggaucgagaacauuaagcaugagcacaagagcacuuggcacuacgacgaggacaacccauacaagaccugggccuaccacggguccuacgaggucaagcccucggguucggcgagcagcauggugaacggggucguuaaguuacugacaaagcccugggauguaauccccauggucacccagaucgccaugaccgauaccacacccuucggccaacagcguguuuucaaggaaaagguggacacuaggaccccgaaagccaagagggggacugcucagaucauggaggucaccgccaaguggcuguggggcuuccucucacgcaacaaaaagcccaggauaugcacgcgagaggaguuuacccgcaaggugcggagcaacgcggccaucggcgccguguucgucgacgaaaaccaguggaacucugcaaaggaggcgguggaggaugagcgcuucugggaccuugugcaccgggaacgcgagcugcauaaacaggguaaaugcgcaaccugcguuuacaacaugauggguaaacgggagaagaagcucggggaguucgguaaagcuaaggggucaagggccaucugguacaugugguuaggcgcccgguuccuggaguuugaggcgcucggcuuuaugaacgaggaucacugguucucccgcgagaacagccuguccgguguggaaggcgaggggcugcacaagcucggauacauccugcgcgacaucagcaagaucccuggagggaacauguacgccgacgacacagccggcugggacacacgcauaacggaggaugaccugcaaaaugaggcacgcauaaccgacaucauggaaccggaacacgcccuacuggccaaguccauauuuaagcugaccuaccagaacaagguuguucgggugcagcguccagccaagaacgggacugugauggacgucaucagccgacgcgaccagcggggaucgggccagguggguacguauggucuaaacaccuucaccaauauggaagcccagcugaucaggcaaauggagagcgaaggaaucuucagucccagcgagcuggagacgccaaaucucgccgagcgcguguuggacuggcucgagaaguacggcgucgaacggcucaagcggauggccaucaguggcgacgacugcguggugaagccgauagacgaccgcuuugcgaccgcccugaccgcccugaacgauaugggcaaggugcggaaggauaucccccagugggaacccagcaagggguggaacgacuggcagcaaguccccuucugcucgcaccacuuccaccaacucaucaugaaggacggccgcgagaucgugguaccgugucggaaccaggacgaguuagugggcagggcccgggugagccagggagcgggcuggagccugcgcgagacugcgugccucgggaaauccuacgcccagauguggcagcugauguauuuccauaggcgggaccugcgguuagccgccaacgcgauuugcagcgcaguccccguggauuggauacccacgagucgaaccacguggagcauccacgcccaccaucaguggaugacgacggaggacaugcuauccguguggaaucgcgucuggauugaggagaauccuuggauggaagacaaaacccacaucagcuccuggggugacgucccauaucuggggaagcgggaagaccaguggugcggcagccuuaucggacugacagcucgggcaaccugggccaccaacauccagguggccaucaaccagguacggcgccugaucgggaacgagaacuaucuggacuacaugaccucgaugaagcgguucaagaacgagagcgaccccgagggagcccugugguag

SEQ ID NO: 24129 - RNA, 9879 nt, Artificial Sequence
  derived and/or modified CDS sequence (opt11) from DENV-1__FJ024442__SS-prME
ucuguuacaaugcugcucaugcugaugcccaccgcccuggccuuccaccucaccaccaggggcggggagccccacaugaucgugagcaagcaggagcguggcaagagccuguuguucaagacuucugccggcgugaauauguguacccucaucgccauggaccugggcgagcugugcgaggauacgaugaccuacaagugccccagaaucaccgagaccgagcccgacgacguggacugcugguguaacgccacugauaccugggugaccuacgguaccugcagccagacgggagaacaccggcgcgacaagcgguccgucgcccucgcgccccacgugggccuagggcuugagacucgcacugagaccuggaugagcucagagggcgcuuggaagcagauccagcgugucgagacuugggcucugcggcacccuggguucacggugaucgcuuuauuccuggcacacgcgaucggcacgaguaucacccagaaagggauaaucuucauccuccugaugcugguuacgccguccauggccaugcggugcgucggcauaggcagccgcgacuucguggaaggucucuccggcgcgaccuggguggacgucgugcuggagcacgggagcugcgugacgaccauggccaaggacaagccgacgcuggacaucgagcuccugaagacugaaguaacgaaccccgccgugcugcggaagcucugcauugaggcgaagaucagcaacacaacgaccgacagccgcugcccgacccagggcgaggccacccucguggaggagcaagaugccaacuucguuugccggcgcacguucguggaccgugguugggggaacggcugcgguuuguucggcaaggggucccucauaacgugcgccaaauucaagugugugaccaaguuggagggcaaaaucguccaguacgagaaccugaaguacagcgugaucgugaccguccauacaggcgaccaacaccagguggggaaugagucgacggagcacgggaccaccgccaccaucacgccacaggcgccuaccacggaaauccagcucaccgacuacggggcacugacgcuggacugcucaccccgcaccggacucgacuucaaugagaugguccugcugaccaugaaggaaaaguccuggcucgugcacaagcagugguucuuggaucugccccuucccuggacauccggggcuagcacgucccaggagaccuggaaccggcaggaccugcuggucaccuucaagaccgcccaugcaaagaagcaggaggucguggugcucggcucgcaggagggcgcgaugcauacugcccugaccggcgccaccgagauccagacgucgggcacuaccacgaucuucgccgggcaccugaagugccgccucaagauggacaagcugacccugaagggcaugagcuacgucaugugcacggggucguucaagcuagaaaaggaaguagccgaaacccagcacggcaccguuuuaguccagaucaaguacgagggcaccgacgcgcccugcaagauccccuucagcacgcaagacgagaagggggugacccaaaauggccggcugaucacggcaaacccgaucgugacugauaaggagaagcccgugaacaucgaggccgaaccgcccuucggggaguccuacaucauuaucggugccggcgagaaggcgcugaagcucagcugguucaagaaggggucuucaaucggcaagauguucgaagccacggcccgcggggccagaaggauggccauacugggcgacacugcaugggacuucggguccaucggcggcguguucacaagcguuggaaagcucguccaccagaucuucggcaccgcguacggugugcuguucucuggcgugagcuggacgaugaagaucgggauaggcguccugcugacuuggcucggcuugaacucccgcagcaccucccugucuaugaccugcaucgcagugggucucgugacgcuguacuuaggcgucauggugcaggccgacuccgggugcgugaucaacuggaagggccgggaacucaagugcgggagcgguaucuucgucaccaacgagguacacaccuggaccgagcaguacaaauuccaggccgacagccccaagagacuguccgcagccaucggaaaggccugggaagaggguguuugcggcauccgaucagccacccggcucgaaaauaucauguggaagcagaucuccaacgagcugaaccacauccugcuggagaaugacaugaaauucacgguuguggugggggacguggccggcauccucgcgcaggggaagaagaugauccggccccagcccauggaguacaaguacaguuggaaguccuggggcaaggccaaaaucaucggcgccgaugugcaaaacaccaccuuuaucauagacgggcccaacaccccggagugccccgacgaucagcgcgccuggaacaucugggagguggaggacuacggcuucgggaucuucacuacaaacaucugguugaagcugcgggauagcuauacgcaggucugcgaccaccgccucaugucugcggcgaucaaggacagcaaagcggugcacgccgacaugggcuauuggaucgaguccgagaagaacgagaccuggaagcuagcccgggcgagcuuuauugaagugaagacgugcaucuggcccaagucccacacccuuuggucuaacggugucuuggaauccgagaugaucaucccgaagauuuaugggggaccgaucagccagcacaacuaucgcccgggguacuucacccagaccgccggcccguggcaccuggggaagcuggagcucgauuucaaucugugcgagggcacgaccguaguggucgacgagcacugcggcaaccgggggccgucacugcgcacgaccacggucaccggcaagauuauccacgaguggugcugccggagcuguacccugccgccguugcgcuuccgcggggaggauggcugcugguaugggauggagauccgccccgugaaggagaaggaggagaacuuagugaaguccauggugucggccggaagcggcgagguggacuccuucucccucggguuacugugcaucuccaucaugaucgaggaagucaugcggagccgcuggucccggaagaugcucaugacaggcacgcuggccguauucuuucugcucaucauggggcagcuaaccuggaacgaccugauccgccuuugcaucaugguaggcgccaacgcgagcgaccgcauggggaugggcaccaccuaccuggcgcugauggccacguucaagaugcggccgauguucgcggucggacuccuguuccgccggcugacuucccgcgaggugcuccugcugaccauugggcucagccugguggccuccgucgagcugcccaacagccucgaggagcugggcgacggguuagcgauggggaucaugauccucaagcugcugaccgacuuucagucccaccaacucugggccacgcugcugucucugacuuucauuaaaaccaccuucuccuuacacuacgccuggaagacgauggcgauggugcugagcaucgucucccucuucccguuaugccuuagcaccaccucccagaagaccacguggcuccccgugcugcugggcagccucgggugcaagccgcugaccauguuccugaucgcggaaaacaagaucuggggccggcgcuccuggccccuaaaugaggggaucauggccgugggcaucgucagcauccuucugagcucccucuugaagaacgacgugccccuggccgggccccucaucgccggcggcaugcugaucgccugcuacguaauaagcggcuccuccgcagaccugucccucgaaaaggccgccgaggugucuugggaggaagaggccgagcacuccggcgcgucccacaauauccugguggaggugcaagacgacgggaccaugaagaucaaggacgaagagcgagaugacacccugaccauccuccuaaaggcgacgcuguuggcagucuccggcgucuacccgcugagcauccccgccacccucuuuguaugguacuucuggcagaagaagaagcagcgcucggggguccucugggacacgcccagcccgcccgagguggagcgggccgugcucgacgacggcaucuaccgcaucaugcagaggggccugcugggccgcucccaggucggcguggguguguuccaggagaacgucuuccacaccauguggcacgugacgcgaggcgccguacucauguaccaggggaagcgccuggagccgagcugggcgucagucaagaaggaccugaucagcuacggcggcgguuggcggcuccagggcucuuggaacaccggggaggagguacaggugaucgccgucgagcccgggaagaaccccaagaaugugcagaccgcccccgggacuuucaagacgcccgagggcgaggugggcgccaucgcccuggacuucaagcccgggaccagcggcucccccaucguuaaccgcgaggguagaaucgugggucuguacggaaacggggugguuacaaccagcggcacguacgugagcgcgaucgcccaggccaaggcuucccaagaggggccgcuccccgaaaucgaggacgagguguuccgcaagcggaaccugaccaucauggaccuacaccccggaucggggaagacccgccgguaccucccugcgaucgucagggaggccaucaagcgcaaauugcggacccucauucucgcccccacacgcgugguggccucagagauggccgaggcucucaagggcaugcccauccgguaucagaccaccgccgucaaaagcgagcacaccggcaaggagaucguggaccugaugugucacgccacuuucaccaugcgcuuacugucccccgugcgggucccgaacuacaacaugaucaucauggacgaagcucacuucaccgacccgagcuccaucgccgcgaggggguacauuucuacucgggugggcaugggggaggcggccgccaucuucaugacggccacgccgcccggguccguugaggcguucccgcaguccaacgcggugauccaggacgaggagcgugauauccccgaacgguccuggaaucugggguacgaguggaucaccgauuuccccggcaaaaccgugugguucgugcccucgaucaaguccggcaacgacaucgccaacugccuacgcaagaacgggaagcggguuauucagcugagccggaagacuuucgauaccgaguaccagaagacgaagaacaaugacugggacuacgugguaaccaccgacaucuccgagaugggggccaacuuucgggcagaccgcgucaucgauccccggcggugccuaaagccggugauccucaaggacgggccagagcgggugauccuggccggcccaaugccggucacgguagcaagcgccgcccagcgccgaggcagaaucggccgcaaccauaacaaggagggcgaccaauacaucuacauggggcagccccuuaacaacgacgaagaccaugcgcacuggacagaagcaaagaugcuacuggacaacaucaauaccccagagggcaucauccccgcucuguucgagccggagcgggagaagagcgccgccaucgacggggaguaccgccuccgcggcgaggcuaggaagacguuugucgagcugaugcggcgcggggaccugccagugugguugucuuacaaaguggccuccgagggcuuccaguacagcgaccggcgcuggugcuuugacggcgaacggaacaaccagguccuggaagagaacauggacguggagauauggaccaaggagggagagcgcaagaagcuuaggccccgcuggcucgacgcgcggaccuacagcgacccacuggcccugcgcgaguucaaagaguucgccgcgggccgacgcuccgugagcggggaccucauccucgagauaggcaagcugccacagcaccucacccagagagcccagaacgcccucgacaaucuggucaugcuccacaacucagagcaaggcgggcgggccuauagacacgcaauggaagagcugccugacacuaucgagacccuaaugcuccuggcccucaucgcugugcucaccgguggggugacccuguuuuuccuaagcggccgugggcucggcaagaccuccaucggcuuacugugcgucauggccagcucggugcuccuguggauggcaagcguagagccccacuggaucgccgccuccaucauccuggaguucuuucucaugguccuacuaaucccagagccagaucggcaacgaacgccccaggacaaccaacucgcguacguggugaucgggcugcuguucaugauccuuacugucgccgccaacgagaugggccugcuggaaaccaccaagaaggaccuagggaucggucacguggcgguggagaaucaccaccacgccgccaugcuggacgucgaccugcaccccgccagugcuuggacgcuguacgcgguggccacuacaaucauaaccccgaugaugcggcacacgauugagaacaccaccgccaacaucagucuuaccgccaucgccaaccaggcggccaucuugauggggcucgauaagggcuggcccaucagcaagauggacauuggcgugcccuugcuggcccuggguugcuacucucagguuaacccccuuacucugaccgccgcggugcucaugcuggucgcccacuacgcaauaaucggcccgggacugcaggccaaggccacccgggaagcgcagaagcgcaccgccgccggcaucaugaagaaccccacgguagacgguaucguggccauugauuuagaccccguggucuacgacgcgaaauuugagaagcagcuggggcagaucauguugcucauacugugcacgagccagauccuguugaugaggaccaccugggcgcugugcgagaguaucacgcuggccaccggccccuuaaccacccugugggaggggagcccgggcaaguucuggaacacgaccaucgccguauccauggccaacaucuuccgcggcucuuaccuggccggcgcgggccuagccuucuccuugaugaaaagccucgggggcgggcgacgcgggacaggggcgcaaggcgagaccuugggcgaaaaauggaagcggcagcuaaaucaauuaagcaaguccgaguucaacacuuacaagcgcagcgggauaauggagguggaccgcuccgaggccaaggagggcuugaagcgcggggaaaccaccaagcacgcggucagccggggcacggccaagcugaggugguucgucgaacggaaccuggugaagccugaagggaaggugaucgaccuaggaugcggccgcgggggcugguccuacuacugcgccgggcuaaaaaaggugacggaggugaagggcuacaccaagggcgggcccggccacgaagagcccaucccgauggccaccuauggguggaaucuggucaagcugcacucaggcaaggacguguuuuucauaccccccgaaaagugcgacacccuccugugcgacaucggggagagcagccccaacccgacgaucgaggaagggcggacccuccgcgugcucaaaauggucgagcccuggcugcgggggaaccaguuuuguaucaagauccugaacccauauaugccuuccgugguggaaacccucgagcaaaugcagcgcaagcacggcggcaugcugguccggaacccguuaucccgcaacuccacccacgagauguacuggguuagcugugggacaggcaacaucgugucugccguuaacaugacgagcaggauguuacugaaccgguucaccauggcgcaccgcaagcccaccuacgagcgggacguggaccuuggugcuggcacacgccacguggcagucgagcccgagguagcgaaucucgauaucaucgggcagaggaucgagaauaucaagcacgaacacaagagcacguggcacuacgacgaagacaacccauacaagaccugggcguaccacgggagcuacgagguuaagccguccggcucugcguccagcauggucaacgggguggucaagcugcugaccaagcccugggacgucauccccauggugacccagaucgccaugacggacaccacucccuucggccagcaacgcgucuuuaaggagaagguggacacccggacgccgaaggccaagcgcggcaccgcccagaucauggaagugaccgccaaguggcucuggggcuuccugagccggaacaagaagccccgcaucuguacccgggaggaauuuacgcgcaagguccgguccaacgcugcgauaggcgccgucuuuguugacgaaaaccaguggaauagcgcgaaggaggcggucgaggacgagcgcuucugggaccucgugcaccgggaacgcgagcuccacaagcaagggaagugugcaacuugcguguacaacaugauggggaagcgggaaaagaagcugggugaguucggaaaagccaaggggucccgcgccaucugguacauguggcugggugcccgguuccuagaguucgaagcgcugggcuucaugaacgaggaccauugguucagccgcgagaacucccugagcgggguggagggcgagggucuccacaagcugggcuacaucuuacgggauaucuccaagauccccggaggcaauauguacgcugacgacaccgcgggcugggauacccgcaucaccgaggacgaucuccagaaugaggcccgcaucaccgacaucauggagccagagcacgcccugcucgccaagagcaucuucaagcucaccuaucagaacaagguggugcggguccagcgccccgccaagaacggaaccgugauggaugugaucucgcgacgcgaucagcggggcagcgggcaggucgguacguacggccugaacacauucaccaacauggaggcccagcugauccgccagauggaguccgaagguauuuucucacccuccgagcucgagacccccaaccuggcagagcgggugcuggacuggcucgagaaguacggcguggagcgcuugaagcggauggccaucagcggggacgacugcguugugaagccgaucgacgaccgcuuugcuacggcccugaccgcccugaacgacaugggcaaggugcggaaggacaucccacagugggagccuuccaaggguuggaaugacuggcagcagguccccuucugcagccaucacuuucaucagcugauaaugaaggacggccgcgagauaguggugccgugccggaaccaggacgagcuggucggccgcgcucggguuucccaaggggccggcuggagccuccgagagaccgcgugcuuggggaagagcuacgcccagauguggcagcugauguacuuccaucggcgcgacuuacggcuggccgcaaacgcgaucugcuccgccgugcccguggacuggauccccaccagccgaacgaccugguccauccacgcccaccaccaguggaugaccaccgaagacaugcuuagcguguggaacaggguguggaucgaagagaaccccuggauggaggacaagacccacaucuccagcuggggggacguccccuaccucgggaagcgggaggaccaguggugcggcucccugauuggccugaccgcccgcgccacuugggcgacgaacauccagguagccaucaaccaggugcggcgccucauugggaacgagaacuaccuggacuacaugaccagcaugaagcgguucaagaacgagggcgacccggagggcgcccucugguga

SEQ ID NO: 24130 - RNA, 9879 nt, Artificial Sequence
  derived and/or modified CDS sequence (opt11) from DENV-1__FJ373296__SS-prME
ucggugaccaugcugcucaugcucaugccuauugcccucgccuuccaucucacaacacgcggcggggaaccccacaugaucgugagcaagcaggaacggggcaagagccugcuguuuaagaccagcgcgggggugaacaugugcacucucaucgccauggaccugggcgaacucugcgaggacaccaugacguacaagugcccccgcaucacggaagccgagcccgaugaugucgacugcuggugcaacgcgaccgacacuugggugacguacgguaccugcagccagaccggcgagcaucgacgcgauaagcgguccguggcccucgcgccccacgucggccuugggcuggagacacggacggagacuuggaugaguuccgagggcgccuggaagcaaauccaacgcguggagaccugggccuugcgccaccccggguucacagugauugcgcuauuccuggcgcaugcgaucggcacgagcaucacccagaagggcauaaucuuuauccuuuugaugcuggugaccccuuccauggccaugcggugcgugggcaucggcuccagggacuucguugaggggcucucgggugccaccugggucgacgucgugcuggagcacgggagcugcgugacgaccauggccaaggacaagcccacccuggacaucgagcuucugaaaaccgaggucacuaaccccgcggugcugcggaagcucugcaucgaggccaagaucuccaauaccaccaccgacagccgcugcccgacgcagggcgaggccacccucguggaggagcaggacgccaacuucguuugccggaggaccuucguggaccgcgguugggggaacggcugcggacuguucggcaaggggucccucauuacaugcgccaaguucaagugcgugacgaagcuggagggcaagaucguucaguaugagaaccugaaauacagcgugauagucaccguccacaccggcgaccagcaccagguggggaaugaguccaccgaacacggcacgacugcgaccaucacgccucaggcgcccacaacggagauccagcucaccgacuacggggccuugacccuagacugcagcccucgcaccgggcucgacuucaaugagaugguccuguugacgaugaaagaaaagaguuggcuagugcauaaacagugguuccucgaccuuccauugcccuggacgucgggggccuccaccucacaggagaccuggaaccggcaggaccuguugguaacuuucaagaccgcccacgcgaagaagcaggaggucgugguguugggcagccaggagggcgccaugcacacagccuuaacaggggcuacggagauccagacgucgggcaccaccacaaucuucgcugggcaccugaagugccgccucaaaauggacaaguugacccugaaaggcaugagcuacgucauguguacggggaguuucaaguuagagaaggagguggcggagacccagcacggcacggugcugguccagaucaaguaugaaggcaccgacgcccccugcaagauccccuucagcacucaggacgagaagggggccacccagaacggccgguugaucacggccaacccgaucgucaccgacaaggaaaaaccggugaacaucgaggcggaaccgcccuucggggaauccuauaucgucaucggcgccggugagaaggcccugaaacucuccugguucaagaaaggguccucaauuggcaagauguucgaagcuaccgcccguggggcccggcggauggccauccugggcgacaccgccugggacuucggguccaucggcggcguguucacgagcguggggaagcugguccaccaaaucuucggcaccgccuacgggguccucuucuccggcgugagcuggaccaugaagaucgggaucggagugcuguuaaccuggcucggcuuaaacucccgcagcaccucacugucuaugaccugcaucgccguggggcucgugacauuguaccugggcgugauggugcaggcggacucgggaugcgugaucaauuggaaaggacgggaacucaaauguggaagcgggaucuucgucacaaacgaaguucacacguggaccgagcaguacaaauuucaggccgacagcccgaagcgccuauccgccgcgaucggcaaggcuugggaggaggggguuugcgggauucggagcgcgacccgacucgagaacaucauguggaagcaaaucuccaacgagcuaaaccacauacugcuggagaacgacaugaaacucacagucguggugggggaugucgccggcauccuagggcagggcaagaagaugauccggccgcagcccauggaguacaaguacuccuggaagucauggggaaaggccaagaucaucggggccgacgcucagaacaccacuuuuaucauugacggccccaacaccccggagugccccgacgaccaacgagcauggaacaucugggagguggaggacuauggguucggcauuuucaccacaaauauuuggcugaaacuccgggacagcuacacccaggugugcgaccaccgccugauguccgccgcuaucaaggauuccaaggccguccaugcggacaugggguacuggaucgagucggagaagaacgagaccuggaaacuugcgcgagccagcuucaucgaggugaagacgugcaucuggccaaagucccacacccucuggagcaaugggguguuggagucugaaaugaucauccccaagaucuacggcggcccgauaagccagcacaacuaccgcccaggcuacuuuacccagacugccgggcccuggcauuugggcaagcuggaacuggacuucgaucugugugagggaaccaccgucguuguagaugaacacugcgggaaccgggguccgucccuccgcacgaccaccgucaccgggaagaucauccacgaauggugcugccggucgugcacgcugccgccccuucgcuuccggggcgaggacggguguugguacggcauggagauccgcccggugaaggagaaggaggagaaccuuguuaaguccauggugagcgccggaucaggggagguggacuccuucagucugggucuguuguguaucuccaucaugaucgaagaagugaugcggagccgcuggucgcgaaagaugcugaugaccgggacccuugcaguauucuuccuccuaaucaugggccagcugaccuggaacgaucucaucaggcucugcaucauggugggggccaacgcaagcgaccggaugggcaugggcacgacuuaccuggcccucauggccacuuucaagaugcgaccgauguucgcgguggguuuguuauuccggcggcuuacaagucgcgagguucuccugcucacgauuggccugucucuggucgccuccguggagcuccccaauucacuugaagaguuaggggauggacucgccaugggcaucaugauccugaaguugcucaccgauuuucagucccaccagcugugggccacccuguugucucugacauucaucaaaacgacguucucccugcacuaugcguggaagaccauggcuaugguccucagcaucguaucccuguuucccuugugccucagcaccacgucgcagaagaccaccuggcugcccguccuccucgggagccugggcuguaagccacuaaccauguucuugaucgcugagaacaaaauaugggggcgcaagucauggccccugaacgagggcauuauggccguuggaaucgugucuauccugcucagcucccugcugaagaacgacgucccccucgccggcccacugaucgcaggagggaugcuuaucgccugcuacgugaucagcgguuccucagcagaccucagucuggagaaggcggccgagguauccugggaggaggaggcggagcacucaggggccagccacaacauacucgucgaggugcaggaugacgguacuaugaagaucaaagacgaggaacgcgaugacacccucacuauccuucuaaaggccacgcuccuggccguauccgggguguacccgcugucuauccccgccacucucuucguaugguacuuuuggcagaaaaagaagcagcgcucaggagugcugugggacacccccagcccgcccgaggucgagcgcgccgugcuagacgacggaauauaccggaucaugcagcgcgggcugcucgggcggucccaggugggggucggcguguuccaggagaacguuuuccacaccauguggcacgucaccagaggggccgugcuuauguaucaggguaagcggcuggagcccaguugggccuccguuaagaaggaccucaucagcuauggugguggcuggcgccugcggggguccuggaacaccggcgaagaaguccaggugaucgccguggaacccgggaagaaccccaaaaacguacagaccgcgcccggcacguucaagacccccgagggcgagguuggggcgaucgccuuagacuucaaacccggcacaagcggcuccccaaucgucaaucgcgagggcaaaaucgucggucucuacgggaacggagugguuacgacaagcgggaccuacgucagcgcaaucgcccaagcgaaggccagucaggaaggaccucugcccgagaucgaggaugagguguuccgcaaacgcaaucugaccaucauggaccuccaucccggaucaggaaagacgcgucgauaucugccagcaaucguucgagaagccaucaagcgcaaacuuaggacacucauccuggcccccacccgggucguggcgagugagauggccgaggcgcugaagggcaugcccauccgcuaccagacaacggccgucaaaucggagcauaccgggaaggagaucgucgaccucaugugccacgccaccuucacuaugcgguugcugucccccguacgagugccgaacuacaauaugaucaucauggacgaggcccacuucacggacccgagcuccauugccgcccggggguauaucagcacgcgcgucgggaugggcgaggcggccgcgaucuuuaugaccgccacgccgcccgguuccguagaggccuucccacaaagcaacgccgucauccaggacgaagaacgggauaucccggagcgcuccuggaacucgggcuacgaguggaucacugauuuccccggaaagaccgucugguuuguucccuccaucaagagcggcaacgauaucgcgaacugccuccggaagaacggcaagcgcgugauccaacugucccggaagaccuuugacacggaguaccaaaagacgaagaacaacgacugggacuaugucgugacgaccgacauaagcgagaugggggccaacuucagggccgaccgggugaucgacccgagaaggugccugaaaccugucauccuaaaggauggcccugagcgugucauccuagccggcccgaugccggucacagucgccagcgcggcucagcggcgcggccggaucggccgcaaucacaacaaggagggggaccaguacaucuacaugggccaaccccugaacaaugacgaagaccacgcgcacuggacagaggcgaagaugcuccuggacaacaucaacacccccgaaggaaucauacccgccuuguuugagccggagcgcgagaagucugcagcaguggacggcgaguauagacuaaggggagaggcucggaagacguucguagagcugaugcgcagaggggaccuucccgugugguuguccuacaagguggccucugagggcuuccaguacucagaccgccgguggugcuucgacggggaacgcaauaaucagguccuggaagagaacauggaugucgagauauggacaaaggagggcgagcggaagaaacugcgcccccguuggcucgacgcgcgcacuuacuccgacccacuggcacugcgggaguucaaggaguuugccgcagggcgucgcucagugucuggugaccucauuuuggagaucgggaagcugccgcagcaccucacacagcgcgcccagaacgcacuagacaaccuggucaugcuucacaacagcgagcagggcgggcgggcuuaccgccacgccauggaggagcuuccggacaccaucgaaacccugaugcucuuagccuuaauugccgugcucacuggaggggugacucuguuuuuccuguccggacggggccucggcaagaccucgaucggguuacugugcgucauggcguccagcguguugcuguggauggccuccguggagccccacuggaucgcugcaagcaucauacucgaguuuuucuugaugguccugcugauccccgagccggaccgccagcggacgccacaggauaaucaguuggccuacguggugauaggccugcuguuuaugauccucacggucgcggccaacgagaugggcuuacuggagacgaccaagaaggaccucggcaucgggcacguugccguggagaaccaucaucacgccgcuaugcuggacguggaccugcaccccgcgagugccuggacccuguacgccguggcgaccacaauaauaaccccgaugaugcgccauaccauagaaaacaccacagccaacaucagccuaacggcgaucgccaaucaggccgccauccugaugggcuuagacaagggcuggcccaucuccaaaauggacaucggggugccccugcuggcgcucggcugcuauagccaggugaacccccucacucugaccgccgcaguacucaugcugguggcccauuaugccaucaucgggccuggccugcaggcgaaggccacgcgcgaggcccagaagcggacugccgccgggauuaugaagaaucccacggucgacgggaucguggcgauugaccucgaccccguggucuacgacgccaaguucgagaagcagcugggucaaaucaugcugcucauccugugcaccagccagauccuccucaugcguacgaccugggcccugugcgagaguaucacgcuggccaccgggccccucacgaccuuaugggagggcuccccggggaaguucuggaacacgaccaucgccgugucaauggcgaacauauucagaggguccuaccuggcuggagcggggcuugccuucucucugaugaaaucccugggcgggggucgacgggggaccggcgcgcagggcgaaacccucggcgagaaguggaagcgacaauuaaaccaauuguccaagagcgaguucaacaccuacaagcgaagugguaucauggaggucgaccgcagcgaggccaaggagggccucaaaagaggggaaaccacgaagcacgccgucucccgugggaccgccaagcugcguugguucguugagcgcaacuuggugaagcccgagggcaaggucaucgaccuuggcugcggacggggcggguggucuuacuauugcgcuggccucaagaagguaaccgaggugaagggguauaccaagggcggacccggacacgaggagcccaucccgauggcgacguacggcuggaaccuagugaagcugcacuccgggaaagacguguuuuucaucccgcccgagaaaugcgacacucugcugugcgacauuggcgagucuuccccaaauccgacaauugaggaggggcggacccugagagugcucaaaaugguugagccguggcugcgcggcaaccaauucugcaucaagauccugaaucccuauaugccaagcgugguggagacacuugaacagaugcagcggaaacauggcgggauguuggugcgcaacccgcugucccggaauagcacccacgagauguacuggguguccugcggcacggggaacaucgucucagccgucaacaugaccucccgcaugcuccugaaccgcuuuacuauggcccaccggaagcccaccuacgagcgcgacguagaccugggcaccggcacccggcacguggccgucgagcccgagguggccaaucucgacaucaucggucagcgcaucgagaauaucaagcacgagcauaagagcaccuggcacuacgacgaagacaaccccuacaaaacgugggcauaccauggcuccuacgaggugaagccuagcgggagcgcgagcagcauggucaacggcguagucaagcugcugaccaagccgugggaugugauccccaugguuacccagauugccaugaccgacacgacgcccuucgggcagcagcgaguauuuaaggagaagguagacacccgcaccccaaaggccaagcgggggacggcccagaucauggaagugaccgcgcgcuggcucuggggcuuccugucccgaaauaagaagccccgcaucuguacccgggaggaguuuaccaggaagguccggagcaacgccgccaucggggccguguucguggacgagaaucaguggaacuccgcaaaagaggccgucgaggacgagcgcuucugggacuuagugcaccgggagcgcgagcuccacaaacaggguaaaugcgccacgugcguguacaacaugauggggaagagggagaagaaacuuggcgaguucgggaaagccaaggguagccgcgccaucugguacauguggcugggcgcgcgauuucuggaguucgaggcccugggauuuaugaacgaagaccacugguucucccgagaaaacucauuguccggggucgagggggagggccuccacaagcugggguacaucuuaagggacaucagcaagauccccggaggcaauauguacgccgacgacaccgccgggugggacacccgcaucaccgaggacgaccuacagaacgaggccaagauaacggacaucauggagccggagcacgcguugcuugcgaaggccaucuucaagcucaccuaucagaacaagguggugcgcguccagcggccggcaaagaacggcaccgugauggacgugauaucccgccgggaccagcgcggaagcggccaggucggcacuuacggauuaaacacguucaccaacauggaggcccagcucauacggcagauggaauccgaagguauuuucucgcccuccgagcucgagacgcccaaccuggcggagcgcgcccuggacuggcuagagaaguacgggguggaacggcuaaagcgcauggccauuagcggcgaugacugcgugguaaagccaaucgacgaucgguucgcuaccgcccugacggcgcucaacgacauggggaaggucaggaaagacaucccacaaugggagcccagcaagggcuggaacgacuggcaacagguuccuuuuugcucucaccacuuccaccagcugauuaugaaggacgggcgggagaucguugugccgugcaggaaccaggaugagcuaguggggcgggcccgcgucucccagggugcgggguggucucugcgggagaccgccugucugggcaagagcuacgcgcagauguggcaguuaauguacuuccaucgccgggaccuucgccuggccgccaacgcaaucuguagugccguucccguggacuggguaccaacgagcaggacaaccuggucgauccacgcgcaccaccaguggaugaccaccgaggacaugcugagcguguggaaccgcguguggauugaggagaaucccuggauggaggacaagacacacaucuccagcugggaggacgucccguaccucggaaagcgcgaggaccaguggugcggcucccugaucggccugacggccagggcgacgugggcaacgaacauucagguggccauuaaucaggugcgccggcucaucgggaacgaaaauuaccucgauuacaugaccucaaugaagcgcuucaagaacgaguccgaccccgagggcgcucugugguga

SEQ ID NO: 24131 - RNA, 9879 nt, Artificial Sequence
  derived and/or modified CDS sequence (opt11) from DENV-1__FJ182018__SS-prME
agcgugaccaugcugcucauguuaaugcccacugcccuggccuuccaccucaccacccggggcggggaaccccacaugauagugagcaagcaggagcggggaaagucccugcuguuuaagaccagcgccggggugaacaugugcacucuuaucgccauggaccugggcgaacugugugaggacaccaugacuuacaagugcccgaggaucaccgaaaccgaacccgacgacguggacugcuggugcaacgccacggacacgugggugaccuacgggaccugcagccagacgggcgagcaccggcgggacaagcgguccguggcccucgcgccccacgugggccuggggcuggagacccggaccgaaacuuggaugagcuccgaaggggccuggaagcagauccagcgcgucgagacaugggcccuccggcaccccgguuucaccguaaucgcgcuauuccuggcacacgcaauaggcaccagcaucacccagaaggggaucaucuucauccuccugaugcuagugacgcccucaauggccaugcggugcguuggcaucggcucccgcgacuucgucgaaggucucuccggcgccaccugggucgacgucguccuggagcaugggagcugcgugacaacgauggccaaggauaagcccacucuugacaucgagcuccugaagaccgaggugaccaacccagccguguuacgaaaacucugcauagaggcgaagaucuccaacaccacgaccgacagucgcugcccgacccagggggaggcgacccugguagaggaacaagaugccaauuucguuugccggcgcacguucguggaccggggcugggggaacggcugcgggcuguuuggcaagggcucccucaucacgugcgccaaauucaagugcgugaccaagcuggaaggcaagauaguccaguacgagaaccugaaguacucggugauagugaccguccacacaggggaccagcaccagguggggaacgaguccaccgagcaugguacaaccgccaccaucacgccccaagcgcccacuaccgagauccaacucaccgacuacggggcucugacgcuggauugcuccccccgcacuggacucgacuucaacgaaaugguccuccugaccaugaaagagaaguccuggcucguacacaaacagugguuccuggaucugccccuacccuggaccagcggggccucuacgagccaggaaaccuggaaucggcaggaucugcuggugaccuucaagacugcccaugccaagaagcaggaggucguggugcucggcagccaggagggugcgaugcacacggcccugaccggggcuaccgagauccagaccuccggcacgaccaccaucuucgccgggcaucuaaagugccgccucaaaauggauaagcugacccugaagggcaugucauacgucaugugcacggguuccuucaaguuggaaaaggagguggccgagacgcagcacggcaccgugcugguccagaucaaguacgagggaaccgacgcuccgugcaaaauccccuucagcacgcaggacgagaagggggugacccagaacggcagacugaucaccgcuaaccccaucgugaccgacaaggaaaagcccguaaacaucgaggccgaaccgcccuucggggagaguuacauaauuauaggcgccggcgagaaggcgcugaagcucucaugguucaagaaaggguccagcaucggcaagauguucgaagccacggcaaggggggcgcggcgcauggccauccugggugauaccgcgugggacuucggcuccaucggcggcguguucaccagcguggggaaacugguccaccagaucuucggcaccgccuacggggugcucuucuccggcgugucguggacgaugaagaucgggaucggcguccugcugaccuggcucgggcugaacucccgcagcaccucccugucaaugaccuguauagccguagguuuggugacccuguaccugggcguaauggugcaggccgacuccggcugcguuaucaacuggaaggggcgcgagcucaagugcggaagcggcaucuucgucaccaacgaggugcacacguggacugagcaguauaaguuccaggccgacagcccgaagagacuguccgcugcuaucgggaaagcuugggaggagggggugugcggcauccgaagugcaacccgccuggagaacaucauguggaagcagaucuccaacgagcucaaucacauccuguuggaaaacgacaugaaguuuacggucgucgugggggauguggccggcauucucgcgcaggggaagaagaugauccguccccagcccauggaguacaaguacagcuggaagucauggggcaaggccaagaucaucggcgccgacgugcagaacacuaccuucaucaucgacggacccaacaccccggaaugcccagacgaccagcgcgccuggaacaucugggagguggaggacuacggcuuugggauauucacaaccaacauuuggcugaagcugcgggacucacacacccaggucugcgaccaccgcuugaugucggccgccaucaaggacagcaaggccgugcacgccgacaugggcuacuggaucgaguccgagaagaacgagaccuggaagcucgcucgggcgucuuucaucgagguuaagacgugcaucuggcccaagucccacacgcuguggagcaacggcguccucgaauccgagaugaucaucccuaagauuuacggggggccgaucagucagcacaacuaucgccccggguacuucacccagaccgccggccccuggcacuuagggaagcuggagcucgauuucgaccugugcgagggcacgaccguggugguagacgagcacugcggcaaccggggaccgagucugcgcaccaccaccgugaccggcaagaucauccaugaauggugcugccggagcuguacgcugccgccccuccgcuuccgcggggaagauggcugcugguacgggauggagauccgccccguuaaggagaaggaggagaaccuggucaaguccauggugagcgccggcaguggcgagguggacuccuucucucucgggcugcugugcaucuccaucaugaucgaggaggugaugcggagccgcuggucccggaagaugcucaugaccggcacgcuggccguguucuuccuccucauuauggggcagcuaacuuggaacgaccugauucgccucugcaucauggugggcgccaacgcgagcgaccgcaugggaauggguacuaccuaucuggcccuaauggcuacguuuaaaaugcguccgauguucgccguaggccucuuauuccguaggcugaccucucgugaggugcuccugcugacaaucggguugagccugguggccuccgucgagcugcccaacagucucgaggagcugggcgacgggcuggcuaugggaauaaugauccucaagcuguuaacagacuuucaaucccaccagcucugggccacgcugcugucauuaaccuucaucaagaccaccuucagucugcauuacgcguggaagacgauggccauggugcugagcaucgucucccuguucccccugugccugagcaccaccucacagaagaccacguggcucccugugcugcuaggcagccucggaugcaaaccauuaaccauguuccugauugccgagaacaagaucuggggccgcaggagcuggccccucaaugagggcaucauggcugugggaaucgucagcaucuugcugagcucccuauugaaaaacgacgugcccuuggccggcccacucaucgccggcggcaugcugaucgccuguuaugugaucucgggguccagugcggaccugucuuuagagaaggccgccgaagucagcugggaggaagaggccgaacacuccggggcaagccacaacauccugguggaggugcaggacgaugggacaaugaagaucaaggaugaggagcgcgaugacacccugaccauucuccugaaggcgacgcuguuggccgucuccggcguguacccguuaucuaucccagccacccuguucgugugguacuucuggcagaagaagaagcagcgguccgguguccucugggacacccccagcccgcccgaggucgaacgggccgugcuggacgauggcaucuaucgcaucaugcagcggggccuguuggggcgcucgcaggucgggguggguguguuccaggagaacguuuuucacacgauguggcacgugacgcggggcgccguguuaauguaucaggggaagcgacuggagccgagcugggcauccgucaagaaggaucugaucagcuauggcggcggguggcggcuccagggcuccuggaacaccggggaggagguucagguuaucgccgucgagcccggcaagaaccccaagaacguucagaccgcccccgggaccuucaagacgccugagggcgaggugggcgccauagcccuggacuucaagcccgggaccagcggcucgcccaucguaaaccgugaggggaagaucguuggccuguacggaaacgggguggucaccaccagcggaacguacgugagugcgaucgcacaagccaaggccucccaagaagggccccuccccgagaucgaagacgagguguucaggaagcgcaaccuuacgaucauggaccuucaccccggaagcgggaaaacgaggcgguaucucccggcaaucguccgggaggccaucaagcgcaagcuacgcacccugauccucgcccccacgagggugguggccuccgagauggccgaggcgcugaagggcaugcccauccgcuaccagaccaccgccgucaagagcgaacacaccggcaaagagaucguggaucucaugugccaugccacguucaccaugcggcugcugucccccgugcgggucccgaacuauaacaugaucaucauggaugaggcccacuucaccgauccaagcuccaucgccgcaaggggguacaucagcacccgcguugguaugggggaggccgccgccauauucaugacggccacgccgcccgguucgguugaagcguucccucagagcaacgccaucauccaggaugaagagcgggacauccccgagcgcuccuggaauagcggguacgaguggauuacugacuuuccaggcaagaccgucugguucgugcccucuaucaagagcggcaacgauaucgccaacugccugcggaagaacgggaagcgcguuauucaacucucgcguaagacguucgacaccgaguaccagaagaccaagaacaacgacugggacuacgucgugaccacggacaucucugagaugggugcaaacuuccgcgcggaucgggugaucgacccgcgcagaugccugaagcccguuauccucaaggacgggcccgaacgcguuauccucgccggcccgaugccgguuaccgucgccuccgccgcccagcggcgcgggcggaucggccgcaaucacaauaaggagggcgaccaguacaucuacauggggcagccccugaacaaugacgaggaccacgcacacuggaccgaagccaagaugcugcucgacaacaucaacacccccgagggcaucauucccgcgcuguucgaaccggagcgugagaagagugcagccaucgauggggaguaccggcugcgcggcgaagcgcguaagacguucguggagcugaugcgccgcggggaccugcccgucuggcuauccuacaaggucgcgucggagggguuucaguacagcgaucgccgguggugcuuugacggcgaacgcaacaaucaaguccucgaggagaacauggacguagagaucuggacaaaggagggggagcggaagaagcugcgcccccgguggcuggacgcacgcaccuacuccgacccccucgcccugcgggaguucaaggaauucgccgcgggucgccggagugucucaggggaccuaauccucgagaucggaaagcuaccgcaacaccugacccagcgcgcacagaacgcccuagacaaccuugugaugcugcauaauagcgagcagggggggcgggccuaccgccacgcuauggaggagcuccccgacacaaucgagacgcugauguuguuagcacugaucgccguccugaccggcggggugacucucuucuuccugucugggcgggggcugggcaagaccagcaucggacuccugugcgugauggccuccagcguccuccucuggauggccagcguagagccccacuggaucgcggccagcauuauccuggaguuuuuccugauggugcuccugauuccugagccggaccgccaacggacuccccaggacaaccagcuggcuuacguggucaucggguuacuguuuaugauccugacaguugccgccaaugagaugggccugcuugagaccaccaagaaggaccuggggaucggccaugucgcgguugagaaccaccaccacgccgccaugcuagacguggaucugcaccccgccuccgccuggacgcuguacgcggucgccacuaccaucauaaccccgaugaugcgccauacgaucgagaacaccacagcaaacauaagccucaccgccauagccaaccaggcugccauuuuaaugggucuggacaagggcuggcccaucuccaagauggacauuggcgugccacuccuggcccuggggugcuacagccaggugaacccccucacgcugaccgccgcgguacugauguugguggcccacuacgccaucaucggcccggggcugcaagcaaaggccacccgcgaagcccagaaacggaccgccgccggcauuaugaagaaccccacgguggacgggaucgucgcuaucgaccuggacccggugguguacgacgccaaguucgaaaagcagcucggacagaucauguuacuuauccucugcaccucccagauccugcugaugcgaaccaccugggcgcugugcgaaagcauaacgcuggccaccggcccacugaccacccucugggagggauccccgggcaaguucuggaacacaaccaucgcagucagcauggccaacaucuuccgggggucauaccuggcaggcgcgggccuggccuucucucucaugaaaagccucgggggcggacgccgugggaccggggcccagggugagacccugggggaaaaguggaagcgccagcucaaccagcuguccaagagcgaauuuaacacguacaagcgguccgggaucauggaggucgaccgcagcgaggccaaggagggccugaagcgaggcgaaaccaccaagcacgcggugucccgcggcaccgccaaacuccggugguucguggagcgcaaccuggugaagcccgaagggaaggucaucgaccugggcugcggccgcgggggcuggagcuacuacugugccgggcugaagaaggucacggaggugaagggcuacaccaagggcggccccggccacgaggagcccaucccgauggccacuuacgguuggaaccucguaaagcugcacuccggcaaggacguguucuuuaucccgccugagaagugcgacaccuugcucugugacaucggggaaagcucacccaacccgacgaucgaggagggccgaacccuuaggguacugaagaugguggagcccuggcuccgcggcaaucaguucugcaucaaaauccugaacccuuacaugcccucggucguggagacccuggagcagaugcagcgcaagcaugguggcaugcucgugcgcaacccgcuuuccagaaacagcacccacgagauguacugggucuccugugggaccggcaacaucgugagcgcggugaacaugacgucccgaaugcugcucaaccgauucaccauggcucaccggaagccgaccuaugagcgggacgucgaucugggugccggcaccaggcacguagccguugagcccgaggucgccaaccuggacaucaucggccagcgcauugagaacauaaaacaugagcacaagagcacguggcacuaugacgaggacaaccccuacaagaccugggccuaccacggguccuacgaggugaagccgagcgguuccgcuagcucgauggucaacggggucgugaagcucuugaccaagcccugggacgucauccccauggugacccagaucgccaugacggacaccacgcccuucggccagcagagaguguucaaggagaaggucgacacccgcacgccgaaagccaagcgggggaccgcccagaucauggagguaacagccaaguggcuguggggcuuccucucccgcaauaagaagccacggaucugcacccgcgaggaguucacgcggaagguacgcagcaaugcagcaaucggcgccgucuucguggacgagaaccaguggaacuccgccaaggaggcgguggaggacgagcgguuuugggaccuugugcaccgcgagcgggagcugcacaagcaggggaaaugcgcgaccuguguuuacaauaugauggguaagcgcgaaaaaaagcucggggaguucggcaaggcgaagggaagccgggccaucugguacauguggcugggcgcccgcuuccucgaguucgaggcucuuggcuucaugaacgaggaccacugguucucccgggagaacucccugucagggguggagggcgagggguugcacaagcuuggcuacauccugcgcgacaucagcaagaucccaggggggaacauguacgccgacgacaccgccggcugggacacuaggaucacggaggacgaucugcagaacgaggcccgcaucaccgacaucauggagccggagcacgcccuccuggcgaaguccauauucaaacugaccuaccagaacaagguagugcgcgugcagcggcccgccaaaaacgggaccgucauggacgugaucucacgcagagaccagcgcggcuccggccagguugggacauacggccucaacacuuuuaccaacauggaggcccagcuuauccggcagauggagagcgaggggaucuucucacccagcgagcuggaaaccccaaacuuagccgagcgcguccuggacuggcuagagaaauacggcgucgagcggcucaagcgcauggccaucuccggggacgacugcguggucaagccgaucgacgaccgguucgcuacggcccugacagcguuaaacgacaugggcaaagugaggaaggacauaccgcagugggagccaagcaagggguggaacgacuggcagcagguccccuucuguucccaccauuuccaccagcucaucaugaaggacggucgggagaucgucgugccgugucgaaaccaagacgagcuggugggccgggcccgcgugagccaaggggccggcuggagcuugcgggagaccgcgugccuugggaaguccuacgcccagauguggcagcugauguacuuccaucgccgggaccugcgccucgccgcaaacgcgaucugcagcgccgugcccguggauuggauaccaaccucccggacgaccuggagcauccacgcgcaccaccaguggaugaccaccgaggauaugcuguccgucuggaaucgcguguggaucgaggaaaacccuuggauggaggacaagacgcacaucagcucuuggggcgacguuccguauuuagggaagcgcgaggaccaguggugcggcagccucaucggcuugacugcgcgggccaccugggcgaccaacauccaggucgccaucaaccaggugcgccggcugaucgggaacgagaacuaccucgacuacaugaccuccaugaagagauucaagaacgaaggugacccggagggcgcacugugguga

SEQ ID NO: 24132 - RNA, 9879 nt, Artificial Sequence
  derived and/or modified CDS sequence (opt11) from DENV-1__FJ410287__SS-prME
agcgugacgaugcugcugauguugaugcccaccgcccuggccuuccaccucaccacccggggcggggagccccacaugaucgugagcaagcaagagcguggcaagucccugcuguucaagaccagcgccgggguuaacaugugcacucucaucgccauggacuugggcgagcugugugaggacacuaugaccuacaaaugcccucggaucaccgagaccgaaccugacgacguggauugcuggugcaacgcaacggacaccugggucaccuaugggacaugcagccagacgggugagcaccggcgagacaagcggagcguggcccucgcgccacacgugggccugggccuggagacacggaccgaaaccuggaugagcucagagggcgcauggaagcagauccagagggucgagacaugggcccuccgccacccgggguucaccgucaucgcgcuguuccuggcccacgcgauaggcaccagcaucacgcagaaggggaucaucuucauucuccugauguugguaacgcccuccauggccaugcggugugucggcaucggcagccgcgacuucguggaggggcuguccggcgcgacuuggguggacgucgugcuggagcacgggucaugcgugaccaccauggcuaaggacaagcccacgcuggacaucgagcuccugaagaccgaggugaccaaccccgccgugcugcggaagcucugcaucgaagcgaagaucuccaacaccacgaccgacucacgcugccccacgcagggcgaagccacccugguagaagagcaggaugccaacuucgucugccggcgcaccuucguggaucggggauggggcaacggcugcggccuguucggcaagggguccuugaucacgugugccaaguucaagugcguuaccaaauuagagggaaagaucguccaguacgaaaaccugaaauacucggugaucgugacaguucacacgggugaucagcaccagguugggaacgaguccaccgagcacggcacuaccgcuaccauuaccucccaggcgcccacgaccgaaauccaacucaccgacuacggugcccuuacgcuggauugcucaccccggaccggcuuagacuucaacgagaugguccugcugaccaugaaagagaaguccugguugguacacaagcagugguuucuugaucugccccuuccguggaccagcggagcgagcacgucucaggagacguggaaucggcaagaccuguugguaaccuucaagaccgcccacgccaaaaagcaggaagugguggugcucggcucacaggagggagcgaugcacacggccuugacuggggccaccgagauccagaccagcggcacgaccaccaucuucgcagggcacuugaagugccgcuuaaagauggacaaacugacccuuaagggcauguccuacgucaugugcacggggagcuucaagcucgagaaagaaguugccgaaacccagcacggcaccguccugguccaaaucaaguaugagggcaccgacgcgccaugcaaaauccccuuccugacucaggaugagaagggugugacgcagaacggucggcucauuaccgcaaaccccauagugacagacaaggaaaagccagucaacauugaagccgaaccgcccuucggggaguccuacaucaucaucggcgccggcgagaaggcgcuuaaacugagcugguucaagaagggguccagcaucgggaaaauguucgaggcaacggcccgcggagccaggcgcauggccauccugggcgacacugcgugggauuucggguccaucgguggcguguuuaccagcguggggaaacucguccaucagaucuuuggaaccgccuauggcgugcuguucuccggcgugagcuggacgaugaagaucgggauaggcguccuucucacuuggcugggccugaacucccgcagcacaucccucagcaugaccugcaucgccguagggcucgugacccuguaccucggcguuauggugcaggcagacuccgggugcgugaucaacuggaaaggccgggagcugaagugcgggagcggcaucuucgucaccaacgaggugcacaccuggacagagcaauacaaguuucaggcggacagccccaagcgccuguccgcggccaucggcaaagccugggaagagggggugugcggcauucguagcgccacccgccucgagaacaucauguggaagcagauauccaacgagcugaaccauauccugcucgagaaugacaugaaguucacaguuguggugggagacgucgccggaaucuuggcgcaggggaagaagaugauucggccgcagcccauggaguauaaguacagcuggaaguccugggguaaggccaagaucaucggggcugaugugcagaacaccaccuucaucaucgacgggcccaacacgcccgagugcccggacgaccagcgcgcuuggaacaucugggaaguggaggacuacggcuucgggaucuucacgacaaacauuuggcugaaacuccgggacagcuacacccaagucugugaccaccgccugauguccgcggcaaucaaggacagcaaggccgugcacgccgacaugggcuacuggaucgaguccgagaagaacgagaccuggaagcuggcgcgggccagcuucaucgaaguuaagaccugcaucuggcccaagucccacacccucuggagcaacggcgucuuggaguccgagaugaucauacccaaaauuuacgggggccccaucucccagcacaacuaccgcccaggguacuucacccagaccgccggccccuggcauuuagggaagcucgagcucgacuucgaucugugcgagggcacuaccgugguagucgacgagcacugcggcaaccgggggcccucccucaggaccaccaccgugaccgggaagaucauccaugaauggugcugccggagcugcacccugcccccccugagguuccgcggggaggacggcugcugguaugggauggagauacgccccgugaaggagaaagaggagaaccucgucaaguccaugguuagugcaggcagcggcgagguggauuccuucucgcuggggcuucucugcaucuccaucaucaucgaggaagucaugcgaagccgcuggucccggaaaaugcugaugaccggcacccuugcaguuuucuuccuccugaucauggggcaacugacuuggaacgaccucauccgccugugcaucauggugggcgccaacgccagcgacagaauggggaugggcaccaccuaccuggcccucauggccacguucaagaugcgacccauguuugccguagggcugcuauucagaagguugaccucacgcgaggugcugcugcucaccauugggcugucacugguggcguccgucgaauugccgaacagccuggaggagcugggcgacgggcucgcgaugggaaucaugaucuuaaaguuacucaccgacuuucagucccaccaauugugggcgacgcugcucucgcuuaccuucaucaaaacgacuuucagucugcacuacgccuggaagacgauggcuauggugcuuagcaucgucucccuguucccacugugccucagcaccaccucccagaagaccacguggcuccccgugcugcucggcagucugggcugcaagccccuaacgauguuccucauagcggagaacaagaucuggggccggcgcuccuggccgcugaaugaggggaucauggccguggguauugucaguauccugcucagcucccugcugaagaaugacguuccccucgcagggccccuaaucgcaggcggcaugcugaucgccugcuacgugaucagcgguuccucugcggaccucucacuggagaaagccgccgaggucagcugggaagaggaggcagagcacuccggcgccagccacaacauccuuguggaagugcaggacgaugggaccaugaagaucaaagacgaggaacgggacgacacccucacaauccugcugaaggcgacgcuauuggcgguuuccggcguguaccccuugagcaucccggccacccucuucgugugguauuucuggcagaagaagaagcaacgcuccgggguccugugggacacccccucgccaccggagguggagcgggccgugcuggacgacggcaucuacaggaucaugcaacggggccugcucgggcgcucccaggucggagugggaguguuccaggagaaugucuuccauaccauguggcacgugacgcggggagcaguguuaauguaccaggggaagcgccuggagccgagcugggcaucugucaagaaggaccugaucagcuacggcggcggguggcggcugcaaggcuccuggaacacuggggaggaaguccaggugaucgccgucgagcccggaaagaaccccaagaacgugcagacggccccggggaccuucaagacgccagagggcgaggugggggccaucgcccuggacuucaaacccgguaccaguggcagccccauugucaaccgcgaggggaagaucgugggcuuauacggcaaugggguggucaccacaucaggcacguacgugucggcaauagcccaggccaaggcgucccaggaagguccccugccggagaucgaggacgagguguucagaaagcggaaccugaccaucauggaccuccaccccggcagcgguaagacccggcgcuacuuacccgccaucguccgggaggccauuaaacgcaagcugagaacccuuauccuggccccgacccgagugguggccuccgagauggcugaggcguugaagggcaugcccauccgcuaucagaccacagcagucaaaagcgagcacacgggcaaggagaucguggaccucaugugccaugccacguuuaccaugcggcugcucuccccaguacgcguucccaacuauaacaugaucaucauggacgaggcccacuucaccgacccgagcucaauagccgcgcgggguuacaucagcacccgcguuggcaugggggaggccgccgccaucuucaugacggccacgccgccuggcuccguggaggcguucccccagagcaacgcugucauccaggaugaggaacgggacaucccagagcgcuccuggaacagcggguaugaguggauuaccgacuucccuggcaagaccgugugguucgugcccucgaucaagagcggcaacgacaucgccaacugccuccggaagaacgguaagcgcguuauucagcucuccagaaagacuuucgacacggaguaccagaaaacuaagaacaacgacugggacuacguggugacaacggacauaucugagaugggcgccaacuucagggcggaccgggucauugacccccgccgcugccugaagccgguuauccucaaggacgggcccgagcgcgugauccuggcaggccccaugcccgucacuguggccucagccgcccagcggcgcggacggaucggccgcaaccacaacaaagagggcgaccaguacaucuacauggggcagccgcuuaacaacgacgaggaccacgcgcacuggaccgaggccaaaaugcuccuggacaauaucaacacccccgagggcaucauucccgcucuguucgagcccgaacgcgagaagucggccgccaucgauggggaguaccgucuccgcggggaggcccggaagacguucgucgaacugaugcgccgcggagaccuaccgguguggcucuccuacaagguggccagcgagggguuccaguauagcgacaggcgguggugcuuugacggggagcgcaacaaccagguccuagaggagaacauggacguggagaucuggaccaaggagggcgagcggaagaagcugcgcccccgguggcucgacgcccgcaccuacuccgacccucuggcccugcgggaguuuaaggaauucgcagcuggccgccggagcguuuccggggacuuaauacuggagaucgguaagcugccccagcaccucacccagcgcgcccagaacgccuuagacaaucuggucaugcuccauaacagcgaacagggcgggagagccuaccgccacgcuauggaagagcugccugacacaaucgagacucugaugcuccuggcccugauagccgugcucaccggcggggucacacuauuuuuccuauccggccgggggcucggcaagaccuccaucgggcugcugugcgucauggccagcagcgugcuccuuuggauggccuccguggagccccauuggaucgcggcgagcauaauccuggaguucuuccucaugguccugcugauccccgagcccgaccgucagcggacgccacaggacaaccaacuugccuacguugugaucgggcuguuguucaugauacucacuguagcugccaaugagaugggccugcuggagaccaccaagaaggaccucgggaucgggcacguggcgguagagaaccaucaccacgcugccaugcuggacguugaccugcaccccgccuccgcuuggacucucuacgccguggccaccaccaucauaacccccaugaugcgccacacgaucgagaacacaacugccaacauuagccugaccgccaucgccaaucaggcggccauccugaugggacuggacaagggcuggccgaucuccaagauggacaucggagugccgcugcuggcccucgguuguuacagucaggucaauccccugacgcugaccgcugcggugcugaugcucguggcccacuacgccaucaucggcccggggcuacaggcuaaggcaacgcgcgaggcgcagaagaggacagcugcgggcaucaugaagaacccgaccguagacgggauuguggccaucgaucuagacccagugguauaugacgccaaguucgagaagcagcuggggcagaucaugcugcucauccuaugcaccucccaaaucuuacucaugcgcaccaccugggcgcugugcgagucaauuacgcucgccacgggcccccuuaccacccugugggaggggucgccuggcaaguucuggaauacgaccaucgccguaagcauggccaacaucuuccggggguccuaccuggcaggcgcgggucucgcguucagccucaugaagucccucgggggggggcgccgggggacaggggcccagggagagacccucggcgagaaguggaagcgccaacugaaccagcugucuaagucugaguucaacacguacaagcgguccgggaucauggagguggaccgcagcgaggccaaggagggccucaagaggggggagaccaccaaacacgccgucucccgcggcaccgccaagcugcggugguucguggaacgcaacuuagugaagccugaggggaaggucaucgaccugggcugcggcagggggggcuggucauacuauugcgcagggcucaagaaggucacggaggugaaaggcuauacgaagggcggacccggccaugaggagcccauccccauggccaccuauggguggaaccugguuaagcugcacuccggcaaggacguuuuuuucaucccgcccgagaagugcgacacccuccucugcgauaucggcgaaagcucccccaacccgacgauagaggagggccgcacccugcgcgugcucaagaugguugagccauggcuccgcgggaaucaguucuguaucaagauucugaacccguauaugcccucugugguggagacccucgagcagaugcagcggaagcacggcggcaugcuagugcgcaacccccugagcaggaacuccacgcacgagauguacugggugaguugugggacgggcaacauugugagcgccgucaacaugacguccaggaugcuccugaaccgcuucaccauggcgcaccgaaagccgacauaugaaagagacguggacuuaggggccggcaccagacacguggccguagaacccgagguggccaaccuagacauaauuggccagcgcaucgagaacaucaagcacgagcacaaaagcacguggcacuacgacgaggacaaccccuacaagaccugggccuaccauggcuccuacgaggugaagcccagcggcuccgcguccucuauggucaacggcguuguuaaguuauuaaccaaacccugggacguaauccccauggugacccagaucgccaugacggacaccacccccuucggccagcagagagucuucaaggagaagguggacacgcgcacacccaaggccaagcgggggaccgcccagauaauggaggugaccgccaaguggcucuggggcuuccuguccagaaacaagaaaccgcggaucugcacccgcgaggaguucacgcggaagguccgcucuaacgcagccaucggcgccguguucguggaugagaaccaguggaacuccgcuaaggaggcggucgaggacgagcguuucugggaucuggugcaccgcgagcgggaacuccacaaacaggggaagugcgcgacgugcguguacaacaugaugggcaaacgcgagaagaagcucggggaguucggcaaggccaaggggagccgggcgaucugguacauguggcuuggcgcacgcuucuuggaguucgaggcacugggcuucaugaacgaggaccacugguucucccgggagaauagccuguccgggguagagggcgaggggcuucauaagcugggcuacauccugcgugacaucuccaagauccccggcggcaacauguacgccgacgacacugcggggugggacacccggaucacagaggaugaucuccaaaaugaggcgcgcaucacagacaucauggaacccgagcacgcacuguuggcgaaguccaucuucaagcucaccuaucagaacaaaguggugcgcguucagcggccggccaagaaugggaccgugauggacgugauuagccgccgggaccagcgcggcucugggcaagucggcacguacggccuuaacaccuucaccaauauggaggcccaguugauccggcaaauggagagcgaggggaucuucagccccagcgagcucgagacccccaaccuggccgagcgcguacuggacuggcucgaaaaguacgggguggaacggcugaagagaauggccaucaguggggacgacugcgucgugaagcccaucgacgacagauucgcgaccgcccugacagcccucaacgacaugggcaaggugcgcaaggacaucccucagugggagcccuccaaaggguggaacgacuggcagcagguccccuucugcucccaucauuuccaccagcugauuaugaaggacggcagggagauagucguacccugccgaaaccaggacgagcuggucggccgugcacgcgugucacagggggccggguggagccuccgagagaccgcguguuuagggaaguccuacgcacaaauguggcagcugauguacuuucaccgcagggaccuccgccuggccgccaacgcgauuugcagugccgugcccgucgacuggauccccaccucccggacgaccuggagcauccaugcucaucaccaguggaugaccaccgaggauaugcuguccgucuggaaccgcguguggauugaggagaacccuuggauggaggacaagacgcacauuagcaguuggggagacguccccuaccuggggaagcgugaagaucaauggugcggcagucugaucggccucacugcccgggcuacuugggcgaccaacauccagguggccauaaaccaggugcgccgguuaaucgggaacgagaacuaccuggacuauaugacguccaugaagcgcuucaaaaacgagggcgacccggaaggcgcccugugguga

SEQ ID NO: 24133 - RNA, 9879 nt, Artificial Sequence
  derived and/or modified CDS sequence (opt11) from DENV-1__FJ432719__SS-prME
ucggugacaaugcuacuaaugcucaugcccaccgccuuagcuuuccaccuaacaacuagagggggcgaaccccauaugaucguuuccaaacaagaacgaggcaagagcuuacuguucaaaaccuccgcgggcguaaacaugugcacacuuauagcgauggaucucggugaacuaugugaggauaccaugacguauaaaugcccuaggauaacugaaacugaaccggaugacguagacugcuggugcaaugccacggacaccuggguaacauacgggaccugcagccaaacgggugaacaucggcgggacaaaagauccgucgcccuagcaccgcacgugggccuaggccuagagacacgcaccgagacauggaugucuucugagggggcauggaaacaaauccagcgagucgaaaccugggcccuccggcacccgggcuucaccgugaucgcccuauuccuagcccacgcaauagggaccucaauaacucaaaaaggaaucaucuuuauacuccugaugcuggugacuccgagcauggccaugcgaugcguagggaucggaucgagagacuucguagagggacuaagcggggcgacaugggucgacguuguccuugaacacgggucuuguguaacaacaauggccaaggauaagccuacguuggauauagagcuuuuaaagacggagguaacaaacccagcaguccugcgaaagcucugcauagaagcuaagauaucgaauacuaccaccgauagcagaugcccaacacaaggagaagcuacauuaguagaggagcaagacgcuaacuucgucugccgacgaacguuuguagaccguggauggggaaacggaugcggacuguucgggaaggggucacuuauaacaugugcaaaguucaaaugcgucacaaagcuagaaggcaagaucguacaguacgaaaaccuaaaauauucggugaucguaacgguacauacaggggaucagcaccaagucggcaacgaaagcacggaacaugggacgaccgcaaccaucacgccccaggcaccgaccgcagagauacaacucacagauuacggagcccuaacgcuagacugcagcccaagaacaggacuagacuucaacgaaauggugcuccucaccaugaaggagaaaagcuggcuaguacacaagcaaugguucuuagaucuaccacuaccguggacaagcggagcaaguaccucucaagagacauggaaccgccaagauuuacucgucaccuucaaaacggcacacgcgaaaaagcaagaagucguagugcuagggucgcaagaaggcgccaugcacacggcccuaaccggagccacggagauccaaacauccggcacaacuaccauauuugcaggucaccuuaaguguagacugaaaauggacaaguuaacgcuuaagggaaugaguuacgugaugugcacuggguccuucaaacuagagaaggaacucgcagagacccagcacggcacgguacucguacaaaucaaguaugagggaacggaugcgccaugcaaaauuccguucucgacccaggacgaaaagggagugacacaaaacggcagacugauaacggcgaacccgauugugacggacaaagagaaaccaguaaacaucgaagcagaaccacccuucggggaaaguuacauuguaauaggcgccggggaaaaagcucucaagcucucuugguuuaagaaagggagcuccauagguaagauguucgaagcaaccgcccgaggggcccgccguauggccauauuaggugacacugcaugggacuucgguaguauaggagggguauucacgagcguaggaaaacucguccaccaaauauucggcacagccuacggaguacuguucucuggggugagcuggaccaugaaaaucggcauaggcgugcuacugaccuggcuuggccuaaacuccagauccacaucccucucgaugacgugcauagcagucggauuagugacauuguaccucggagucaugguccaagccgacucaggcugcgucaucaauuggaagggacgagagcuaaaaugcgguucgggaaucuucgugacaaaugagguccacacauggacagaacaauauaaauuccaagcggacuccccuaagcgcuuaagcgcggcaauuggaaaggccugggaagaaggcguaugcgggauccguucagccacacgacuugagaacauaauguggaagcagauauccaacgagcucaaccauauacuacuggaaaacgacaugaaauucacagucguaguuggcgaugucgccggcauauuagcccagggcaaaaagaugauccgcccacaaccaauggaauacaaguacucuuggaaaaguuggggcaaggccaaaauaaucggagccgacgugcagaacacgacuuuuauuauagacgggccgaacacuccugaaugccccgacgaccaacgugccuggaacaucugggaaguugaggacuacggguuuggaaucuucacaacgaauauauggcugaagcuccgugacaguuacacccagguaugcgaccaucgacucauguccgcggccauaaaagacucgaaagccguccacgcugacaugggauauuggauugaguccgaaaagaaugaaacuuggaaacuagcacgagcauccuucauagagguaaagacaugcaucuggccgaaaucccauacgcuauggagcaauggggugcucgaguccgagaugauaaucccaaagaucuacggugggccgauaagucaacacaacuaccggccaggauacuuuacacaaacggccggcccuuggcaccucggcaaacuggaauuggacuucgaccugugugaagggacaaccguagugguagacgaacacugugguaaccgaggucccagccugagaaccacgacggucacagggaaaauaauccacgaaugguguuguaggagcugcacacugccacccuugcgguucagaggugaggacggguguugguacggaauggaaauacggcccgucaaagagaaagaagagaaucuagugaaaucuauggugucggcagggucgggagaaguagacucguucagccugggccucuugugcaucuccauaaugaucgaagaaguaaugagaucgagguggucgcgcaaaauguuaaugacgggcacgcucgcaguauucuuccucuuaaucaugggccaauugacauggaacgaccuaauacgacuguguaucaugguuggggcaaacgcaagcgaccgcaugggcauggggaccaccuaccuggcgcugauggccacguucaaaaugaggccgauguucgcgguaggacuacucuuuaggcgccucaccucccgcgagguccugcuccuuacaaucggacuaucgcuuguagccuccgucgaacuuccgaauagccucgaagaacugggcgacgggcuggcaaugggcauaaugauacuaaaacugcucacggacuuccaaagucaccaauugugggccacccuccuuagccuuacauuuauaaagacaacuuucagccuccacuacgcuuggaaaacaauggcgaugguacuaagcaucgucucgcuauucccccuaugccugucgacaacaagucaaaagacgaccuggcuacccgugcuacucgguucacuaggguguaaaccacucaccauguuucugaucgcagagaacaaaauauggggacggcgaucauggcccuuaaacgaggggaucauggcgguaggaauagucuccauacuacugagcucccuccucaaaaacgaugugccgcuugcgggaccccucauagcaggaggcaugcuuauagcuugcuacgucauaucgggcagcagcgccgaccucucccucgaaaaagcggcggagguguccugggaagaggaggccgagcauagcggagcgucacacaacauccucguggaaguccaggaugacggcacuaugaaaaucaaggacgaggaacgcgaugacacccuaaccauccuccuaaaagccacacugcuagccgugucgggaguauauccgcuauccaucccggcgacguuguucguuugguacuucuggcagaagaagaaacagaggucggggguccuaugggacacccccaguccgccggaggucgaaagggccguacuggaugacggaauauaccggaucaugcaacgagggcuccucggacgcucgcaaguaggcgugggagucuuccaagagaacguguuucauacuauguggcaugugaccaggggcgccguuuuaauguaccaaggaaaacgccuggagccgagcugggcgucagucaagaaagaccugauauccuauggaggaggauggcgcuugcaaggcucauggaacacaggagaagaggugcaaguuauagcgguagaaccugggaaaaacccgaagaacgugcaaaccgcccccgguaccuucaaaacgccagagggagaaguaggagcaauagcucuggacuuuaagccuggaacaucaggcaguccgaucguaaaccgugaggguaaaaucguaggauuauaugguaacggagucguaacgaccucgggaacauaugugagugcgauagcccaggccaaggcgucacaagaaggaccacuaccggaaaucgaggacgaggucuucagaaaacgaaaccuaaccaucauggaucuucacccaggcucaggcaagacuagaagauaccuccccgcaauaguccgagaagcaaucaaaaggaaacuccgcacgcuaauccuugccccuacucggguaguagcuucagaaauggcagaagcacucaaaggcaugccgaucagguaucaaaccacagcugucaagagcgagcacacaggcaaggagaucgucgaccugaugugccacgcuaccuuuacuaugcgacuccucucaccaguccgugucccaaauuauaacaugauaaucauggacgaagcgcacuuuaccgaccccucgagcauagcugcccgaggguacauaucuaccagaguagguaugggugaagccgcagcuauuuuuaugaccgcaacacccccugggagcguggaagcguuuccgcaaagcaaugcgguaauccaagacgaggagcgcgacauaccugaacgauccuggaacaguggguacgaguggauaacggacuuccccggcaagacagucugguucgugccaucuaucaaaagcgggaacgacauagcaaacugccugcggaaaaacggcaagcgggugauccaguuaagccgaaaaacguucgacacugaauaccaaaagacaaagaauaacgacugggacuacguggucaccacagacauaucagaaaugggggccaacuuccgugcagacagaguaaucgauccgcgccgcugucuaaaaccggucauccucaaagacgggcccgaaaggguaauacucgcaggacccaugcccguaaccguggcuagcgccgcccagcgaagagggcgaaucggcagaaaucacaauaaagaaggggaccaauacauauacaugggacaaccgcuaaacaacgacgaggaccacgcacauuggacagaagcaaagaugcuccucgacaacauaaacacccccgagggcauaauacccgcuuuauucgaacccgaacgcgaaaaaucagcggccauagacggcgaauaccggcuacgaggagaggcccgcaagaccuucguagaauugaugaggaggggugacuugcccgucuggcuuuccuauaaggucgcuuccgagggcuuccaguauagcgauagacgauggugcuuugacggcgaacguaacaaccaaguacuggaagagaacauggacguggaaauauggacgaaagagggagaaaggaagaaacuacgaccgcguuggcuagaugccaggacauacagcgacccucucgcacuaagggaguucaaggaauuugccgcaggccgaaggagcguaagcggugaccuaauacuagaaaucggaaaacuuccgcaacaccucacgcaacgcgcacagaaugcccuugacaaccuagucaugcuccacaacagugaacaaggaggccgagccuaccgccacgcaauggaagaacugccugacaccauagagacccucauguuacuugcucugaucgcaguccuaaccggcgggguaacauuguucuuucucuccggcagagggcugggcaaaaccagcauaggcuuacucugcgucauggcgucaucaguccuccuuuggauggcuagcguagaaccccacuggaucgcagcaagcaucauacuugaguucuuccuuauggugcuacugauacccgaacccgacagacaacgaacgccccaagacaaccagcuggcguaugugguaauugggcuacuauucaugauacuaaccguagccgcgaacgaaaugggucuacuagaaacaaccaagaaagacuuggggauagggcauguagccgucgaaaaucaccaccacgcggcaaugcuggacguagaccuccauccagccucagcguggacacucuacgccguggcuacaaccauaaucacccccaugaugcgccacacgauagagaauaccacggcuaacauaucacuuaccgcgauugcgaaccaagccgcaaucuugaugggauuggauaaagguuggccgaucuccaagauggacaucggagugccguuguuagcacugggguguuacucacagguaaauccccucacacugacugcugcuguauuaaugcuaguagcccacuacgcaauaauugguccaggccuccaggccaaagccacccgcgaggcucaaaagcgcacugcagcagguauaaugaaaaacccuacaguagacggcauaguggcgaucgaccucgacccaguaguguacgacgcgaaauuugaaaagcaauugggccaaauaaugcuucuaaucuuauguacuucccagauccuccuaaugagaacgacaugggcgcugugcgagagcauaacccuagcaacuggaccgcugacaacacucugggaaggcucaccaggaaaauucuggaacaccacgauugcgguauccauggcaaacaucuuucggggcuccuaccuagcaggagccggacuagccuucagcuuaaugaaaagccucggaggagggcggcgaggaacgggagcccaaggcgagaccuugggcgagaaauggaaacggcaacugaaccagcugaguaagagugaguucaacacauacaagcgaucaggcaucauggagguagaccgaagcgaagccaaggaaggccugaaaagaggagaaaccacaaaacacgcaguuuccaggggcaccgcaaaauuaagaugguucguggaacguaaccugguuaaaccggaaggcaaagucauagaccugggaugugggcgagggggauggagcuacuacugcgcaggccuuaagaaagugacugaagucaaaggguacaccaaggguggccccggccaugaagaacccauaccgauggcaacauacggauggaaccugguaaagcuccauaguggcaaagaugucuuuuucauuccucccgagaaaugcgacacacuccuaugcgauauaggagaaucaucccccaacccgacuauagaagaaggcagaacgcucaggguccugaaaaugguggaaccauggcuucgaggaaaccaguucugcauaaagauccugaaccccuacaugccuagcguaguggaaacgcucgaacagaugcagcgaaagcacgguggaaugcuggugaggaacccgcuaagccgaaacaguacacacgagauguacuggguaucauguggcacaggcaacaucgucagcgcagucaacaugacgucgcgaaugcugcuuaaccgcuucacgauggcgcaucgaaaaccaaccuacgagcgugacguagaccucggagcaggcacacgccacgucgcggucgagccugaaguggccaaccucgacauaaucggccaaagaaucgaaaacauaaaacaugaacacaaaaguacguggcacuacgaugaggacaacccauacaagacuugggccuaucauggauccuaugagguaaaacccucggguagcgccagcagcauggucaacggggucgucaaacuccucacaaagcccugggaugugauacccaugguaacacagauagccaugaccgauacuacccccuucggacaacagagggucuucaaggaaaagguggauacacgaacacccaaggccaaaagaggaaccgcccagaucauggaagucacggccaaauggcuauggggguuccucucucgcaacaagaaacccaggaucuguacaagagaagaguucacccgaaaaguacgcaguaacgccgccauaggagcaguuuucguagaugagaaccaauggaacucagccaaagaggcggucgaggacgaaagguuuugggaccuaguucaucgcgaacgagaacuacauaaacagggcaagugcgccaccugugucuauaacaugauggguaaacgugagaaaaagcuaggugaguucggcaaagcaaaagguuccagagccauaugguacauguggcucggggcaagauuuuuggaguucgaagcacuagguuuuaugaacgaagaccauugguuuucccgggaaaauagccuaucggggguugaaggagagggacuacacaagcuaggauauauacugagagacauauccaaaauaccgggcgguaauauguaugccgacgacacggccggaugggacacacgcaucacggaagaugaccuacagaacgaggcccgaauaaccgacaucauggaacccgaacacgccuuguuagcaaagagcauauucaaacuaacauaccaaaacaagguugucagaguccaaagaccggccaagaacggcaccgucauggacgucauaucucgccgagaccaacgcgguucaggccaaguaggaacguacgggcucaacacauuuacuaacauggaagcccaacuaauccggcagauggaaagugaagggauauucagucccucagaguuagaaacaccaaaccuggcagaacgcguacucgauuggcuugaaaaguacgguguagagcgacuaaaaaggauggccauaucgggugacgacugcguaguuaagccaaucgaugacagauucgcaacggccuugacagcgcuuaaugauaugggaaaaguuagaaaagacauuccacagugggaaccuuccaaaggguggaaugacuggcaacaaguuccauucugcucacaucacuuccaccagcugauuaugaaagacggaagggaaauaguugugcccugucgcaaucaagacgaguuagucgggcgggccagagucucucagggggcaggcuggagccuacgagaaacagcgugucuagguaagucguacgcucaaauguggcaacuaauguacuuccacagacgcgaccuucgacucgccgcaaacgccauauguuccgccguacccguugauuggauaccaacgucccggacaaccuggucaauacaugcccaccaccaguggaugacgaccgaagauauguuaucgguauggaaccgcguuuggauugaggagaacccguggauggaagacaaaacacauaucagcagcuggggagacgugccauaucucggaaaacgggaggaccaguggugugggagcuugaucggacuaacggcccgggccacgugggccacaaacauucaggucgcaaucaaccagguacgcaggcuaauagguaacgaaaauuauuuggacuacaugaccagcaugaaaagguucaaaaacgagagcgacccugagggagcucuaugguaa

SEQ ID NO: 24134 - RNA, 9879 nt, Artificial Sequence
  derived and/or modified CDS sequence (opt11) from DENV-1__FJ182020__SS-prME
ucggugaccaugcugcucaugcugaugccuacagcccuggcauuucaccucacaacccggggcggggaaccccacaugaucgugucgaagcaggaacggggcaagagccuguuguucaagaccagugccggggugaacaugugcacucucaucgccauggaccuuggggaguucugcgaggacacgaugacuuauaaaugcccccgaaucacugaggccgagccugaugauguggauugcuggugcaacgccaccgacacguggguuaccuacgggacaugcucccagacgggggagcaucgucgggacaagagaucaguggcccuggcgccccacgucggccucgggcuggaaacccgcaccgagacguggaugagcagcgagggugcauggaagcagauccagcggguggaaacgugggcgcugcgccaccccggauuuacggugaucgcccucuuccuggcucacgccauuggcaccucaaucacacagaaagggauaaucuucauccugcucauguuagugacgcccuccauggccaugcggugcgucggcaucgguucucgcgacuuuguggaggggcuguccggagccacguggguggacguggugcucgagcacggguccugugugaccaccauggccaaggacaagcccacccuggacaucgaguugcugaagacggagguaaccaaccccgcggucuuaaggaaacuuugcaucgaggcgaaaaucuccaacacuaccaccgacagccgcugcccaacccagggcgaggccacccucgucgaggagcaggaugcgaacuucguuugccggcgcaccuucguggaucggggcugggggaacggaugcgggcuguucggcaaggggagucuuaucacgugcgccaaguucaagugugugaccaagcucgagggcaaaauuguccaguacgagaaccucaaguacagcgucaucgucaccguccacaccggugaccaacaucaggugggcaacgaauccacggagcacgggaccaccgcgaccaucacgccccaggccccaaguacggagauccagcugaccgacuauggcgcccucaccuuagacugcagcccccggaccggccuggacuucaacgaaauggugcuccugacgaugaaggagaaguccuggcuggugcauaagcagugguuccucgaccuaccguuacccuggaccagcggugcuucaaccucacaggagaccuggaaccggaaagaccuucugguaacauuuaagaccgcccacgcgaagaaacaggagguaguggugcuggguucccaggaaggagccaugcacacagcucuaacaggggcaacggagauccagaccagcggcacuacuacgauuuuugccgggcaccugaaaugccggcugaaaauggacaagcucacccugaagggcauguccuacguuaugugcaccgggagcuucaaacuggaaaaggagguggcggagacucagcacggaacaguuuuaguccagauuaaauacgaaggaaccgacgcccccugcaagauccccuucuccacccaggaugaaaagggcguuacccagaacggacguuugaucacugccaacccgaucgugacagacaaggagaagccggucaauauagaggccgagccgcccuucggggagagcuacauagugaucggcgcaggcgagaaggcauugaaacuuucgugguucaagaaggguucuagcaucggcaagauguucgaagccaccgcccgaggcgcgcggcgcauggcgauacucggcgacaccgccugggacuucgggagcaucggaggcguauucacgagugucgggaagcugguucaccaaaucuucgggaccgccuacgggguacuguucagcggcgucucguggacgaugaagaucgggaucggcguguugcuaaccuggcuggggcucaacucgagaucuaccucguuguccaugacuugcauagccguggggcuggucacacucuacuuaggcgugauggugcaggccgacagcgguugugucaucaauuggaaggggagggaauugaagugugggucaggcaucuucgugaccaaugaggugcacacguggacagaacaguauaaguuccaggcugacuccccuaagcgccuuucggcggcaaucggcaaggccugggaagagggcgucugcggcauacgguccgcgacacgucuugagaacaucauguggaaacagauaagcaaugaacuuaaccauauccugcuggaaaaugacaugaaguuuaccguuguggucggugauguggcgggcauccucgcccagggaaagaagaugauccggccccaaccaauggaguacaaguauuccuggaaguccuggggcaaggcaaagauuauaggcgcggacguacagaauaccacguucaucaucgacgggccaaacacaccggaguguccggacgaucagcgcgcguggaacauaugggaggucgaagacuauggauucggcaucuucaccacaaacaucuggcucaagcugcgggacucguacacacaggugugcgaccaccgccugaugagcgcggccaucaaggacucuaaggccguccacgcggacaugggcuacuggaucgagagcgagaagaaugagaccuggaagcucgcgcgggccuccuuuaucgagguaaagaccugcaucuggcccaagagccacacccuguggucaaacggggugcuagagagcgagaugaucaucccgaagaucuaugggggcccaaucucgcagcacaacuaccgcccaggguauuucacgcagacggcgggucccuggcaccucgggaagcuggagcuggauuuugaccucugcgagggaacgaccguggucguggacgagcacugcggcaaccggggaccgagccuucgcacgaccaccguaaccggcaagaucauccacgaguggugcugccgguccugcacgcugccaccccuccgcuucaagggggaggacggaugcugguacggcauggagauacgcccagucaaggagaaagaggagaaccuagucaagucgauggugagugccggcuccggcgaggucgacucguucucccugggguugcugugcauaagcauaaugauagaggaggucaugaggucccgguggagccggaaaaugcugaugaccggcacucucgccguauucuuccuccucauaauggggcaacuuaccuggaacgaucugauucgacugugcaucaugguuggcgccaaugcuagcgaccgcauggguauggggacgacauaccuugcccugauggccaccuucaagaugcgcccgauguucgccgugggacuccuguuccggcggcugaccucgagagaagucuugcuccugacgauuggguugagccuggucgcaagcguggagcugcccaacucccuggaagaacucggcgacggacuggccaugggcaucaugauucugaagcugcuaacggauuuccagagccaccaguuaugggcuacccuccugucccugaccuucauuaagacaaccuucagccuccauuaugccuggaagaccauggcgaugguacucuccaucgugagccucuucccgcucugccugagcaccacuagccagaagacuaccuggcugcccguauuacugggcuccuuggggugcaagccuuuaaccauguuucugaucgcggaaaacaagaucugggggcgcaagagcuggccgcuaaacgaggggaucauggccgucggcaucgugagcauccuccuguccagccugcuaaagaacgaugucccacucgcugggccccugauugcgggcggcauguuaaucgcguguuaugugauauccgggagcucggccgaucuaucgcuggagaaggccgccgagguguccugggaggaagaggccgaacacuccggcgcgucgcauaacauacucguggagguccaggacgacgguacgaugaagauaaaggacgaagaacgggacgacacgcugacaauccuacugaaagcgacacugcuggccguuagcggcguguauccacucucgaucccggccacccuguucgucugguacuucuggcagaagaagaagcagcguagcggcgugcugugggauacgcccucgcccccggagguggaacgcgccguccucgaugacggcaucuaccgcaucaugcagcggggcuuacuggggcgcagccaggucggggugggagucuuccaggaaaauguguuccacaccauguggcacgugacccggggcgcaguccugauguaucaggggaagcgucucgagcccuccugggccagugugaagaaggaccugaucuccuacggcggaggguggcggcuccagggcagcuggaacacaggggaagaggugcaggucauagccguggagccuggcaagaaccccaagaacgugcagacugcccccgggacguucaagacuuccgaaggggaggugggcgccauagcgcuggacuucaagcccgggaccucugggagcccaaucgugaaccgcgagggcaagaucgugggccuguacggcaacggcgucgugacgacuucggggaccuaugugagcgccauagcccaagcaaaggcgucccaagaggggccacugccugagauagaagaugaggucuuucggaagcgcaaccucaccaucauggaccuacaccccgggagcgggaagacgaggcgcuaccuccccgcgauaguccgggaggccaucaagaggaaacuccggacucugaucuuggcgccgacccgcguggucgccuccgagauggcggaggcgcucaaagggaugcccauccgcuaccagaccacggccgugaagagugagcacaccggaaaggagaucgucgaucugaugugucaugccacguuuaccaugcggcuccugucccccgucaggguacccaacuacaacaugaucaucauggacgaggcccacuucacagacccuagcucaaucgcagcacgggguuauaucagcacccgggugggcaugggggaggccgccgcuauuuuuaugaccgcgacacccccaggcuccguggaggccuucccccagagcaaugcaguuauucaagacgaggaacgggauauccccgaaagguccuggaacucgggguacgaguggaucacagacuuccccggaaagaccguaugguucguccccuccaucaagucggggaaugauauugcaaacugccugaggaaaaacggaaaacgcguaauccagcucagccggaagaccuucgacaccgaauaccagaaaacgaagaauaacgacugggacuacgucgucacaacggacauuucggagaugggcgcgaacuuccgcgcugaccgggugauagaccccaggcggugccucaaaccggugauucugaaagacggucccgagagaguuauucuagcuggccccaugccugugaccguugccagugccgcccagcggcgaggucggaucggcaggaaccacaacaaggagggcgaucaguauaucuacauggggcaaccgcuaaauaacgacgaggaccacgcgcacuggacggaggcgaagaugcuguuagacaacauaaacacccccgaggguaucauucccgcacuauucgagcccgagcgggagaaauccgccgcgaucgacggggaguaccgccugcgcggcgaggcacgcaagaccuucguggaacugaugcgccgcggggauuuaccgguguggcugucauacaagguagccagugagggcuuccaauauagcgaccgccgguggugcuucgacggagagcggaacaaucaggugcuggaagagaacauggacguggagaucuggaccaaggagggggaacggaagaaguugaggccccgguggcuggacgccaggacguacuccgacccccuggcccucagagaguucaaggaguucgcggccggccggaggagcgucuccggggaccugauacuagagaucgggaagcuaccccagcaccugacacaacgcgcgcaaaacgcccuggacaaccucgugaugcugcacaacagcgaacaaggcggacgcgcguaccgccacgccauggaagaacugccggauacaaucgagaccuugauguuacuagcucuaauugcgguacuuacuggcggugucacucuguucuuccuauccggccggggacuuggcaagaccagcauaggacugcucugcguuauggccuccucugugcuacuguggauggcguccgucgagccgcacuggauagcggcuagcaucauccucgaguucuuccugauggugcugcucaucccggagcccgaucgacaacggaccccgcaggacaaccagcuggcauauguggucaucgggcuccuguucaugauccugaccguggccgcgaacgaaaugggccugcucgagacgaccaagaaagaccuggggauaggccacguggccguggagaaccaucaucacgccgccaugcuggacguggaccuccauccagcuuccgcauggacccuguacgccguggccacuacgauaaucacgcccaugaugcgccacaccaucgaaaacacgacggccaacauaucacugacugcuaucgcgaaccaggcggcgauccuaaugggucucgacaagggcuggccgaucuccaagauggacaucggaguccccuugcuggcccuggggugcuauagccaggugaacccucugacccuuaccgcggccgugcugaugcuggucgcccacuacgccauuauaggccccggccuucaggcuaaagcgacgcgggaagcacagaagcggacugccgcaggcaucaugaagaaucccaccgucgauggaaucguagcgauagaccuggaccccgucguguaugacgcgaaguucgagaagcagcuaggccagaucaugcuccucaucuuauguacaagucagauccuacugaugcguacgacgugggcacugugugagagcaucacccucgccaccggcccccugacgaccuugugggaagggucccccgguaaguucuggaauaccaccaucgccgugagcauggcaaacaucuucagagggagcuaccucgcgggcgcgggccuugccuucucccugaugaaaagccuaggagggggaagacgagggacuggggcucagggcgagacccugggcgagaaguggaagcgccaacugaaccaacucuccaagucagaguucaacaccuacaagcgguccggcaucauggaggucgaucguuccgaggcaaaggagggccugaagcgcggggagaccaccaagcacgccgucagucgcggcaccgcgaagcugcggugguucguggagcgcaaccucgucaagccggagggcaagguuauagaccugggguguggccgcggcgggugguccuacuacugugcugggcuaaagaaggugacugaggugaaaggcuacaccaagggcggcccgggccacgaggaaccgauucccauggccacauacggguggaaccuggugaaauuacacuccggcaaagacguguucuucauuccgcccgagaagugugacacgcugcuuugugacauaggggagucuucccccaacccuaccaucgaggaaggaaggacccugaggguccugaagaugguggagccgugguuacguggcaaccaauucuguaucaaaauccuaaacccuuacaugcccagcguggucgagacccuggagcagaugcagcggaagcacgggggcaugcuggugcgaaacccccucucccggaacagcacccaugaaauguacugggugucaugcggaaccggcaauaucguaagugcggugaauaugaccucccgaaugcugcuaaaccgguucacgauggcccacagaaagccgacguaugagcgcgacguggaccucggggccgguacccggcacgucgcgguugagccugagguagccaaccuggacaucauaggucagcgcauagagaacaucaaacacgagcacaagagcacuuggcacuacgacgaggacaaucccuacaagaccugggcauaccacgggaguuacgaggucaaacccagcggcagcgcauccaguauggugaacggggucgugaaacugcuuacgaagccgugggacgucauccccauggugacccagaucgccaugaccgacaccacacccuuuggccagcagcggguguucaaagagaagguagauacccguacgcccaaggccaagcgggggacagcccaaaucauggaggugaccgcgaaguggcuguggggcuuccuuucgcggaacaagaagccgcggaucugcacccgcgaggaguuuacccgcaaggugcgcagcaacgccgcuaucggugccguguucgucgacgagaaccaguggaacuccgcgaaggaggccgucgaggacgagcgguucugggaccuuguucaccgcgagcgggaguugcacaagcaggggaagugcgcgacgugcgucuacaauaugaugggcaagcgcgagaagaagcugggggaguucggaaaagcgaagggcucccgggccaucugguacauguggcugggcgcgcgcuuccuugaguucgaggcccugggcuucaugaaugaggaccacugguucucgagggagaauagccuaagugggguggagggcgaagggcugcacaagcugggcuacauccuacgcgacaucagcaagauccccgggggcaauauguaugccgacgacacggccggcugggauacacggauaaccgaggacgaucugcagaacgaggccaagauaacugacaucauggagccagagcacgcccugcuggcgaaauccaucuucaagcugacuuaccagaacaaggugguccgcgugcagcggccagccaagaacgguaccgucauggacgucaucagccgccgcgaucagcgaggcagcggccaggugggcaccuauggcuugaacaccuuuacuaauauggaggcccaacucauccgccaaauggagagcgaggggaucuucaguccuucugagcuggaaacccccaacuuagccggccguguucucgacuggcuggagaagcauggggucgagcgucugaagcggauggcgaucucaggcgacgacugcguggugaaacccaucgaugaccgcuuugccaccgcccuuacggcuuuaaacgacaugggcaaaguccggaaagauaucccccagugggaacccagcaagggcuggaacgauuggcagcaggucccuuucugcucccaccacuuccaccaguugauuaugaaggauggucgagaaauagugguacccugucgcaaccaggacgagcugguggggcgcgcacgggugagccaaggcgcgggcuggagccugcgcgagacggccugucuggggaaauccuacgcccagauguggcaguuaauguacuuccaccggcgcgaccuccgguuggccgcgaacgcaaucuguagcgccgugccgguagacuggguuccuaccucccgcacaaccuggagcauucacgcacaucaccaguggaugacgaccgaagacaugcucuccguguggaacaggguguggaucgaggagaacccguggauggaagacaagacccacaucagcuccuggggagacgugcccuaccugggcaagcgcgaagaucaguggugcggcagccugaucgggcucaccgcucgggcgacgugggccaccaacauccaggucgcgauaaaccaagugcgucggcugaucgguaacgaaaacuaccuagacuacaugacguccaugaagcgguuuaaaaacgagagcgauccggagggggcccucugguga

SEQ ID NO: 24135 - RNA, 9879 nt, Artificial Sequence
  derived and/or modified CDS sequence (opt11) from DENV-1__FJ182022__SS-prME
ucggugacuauguuguugauguugaugcccaccgcccuagccuuucaccuaacgacccggggcggggaaccccauaugaucguaagcaagcaggagcggggcaagagcuuauuauuuaagaccucugcaggggugaacaugugcacccucaucgcuauggaucugggcgagcugugcgaggacacgaugaccuacaagugcccacgcaucaccgagaccgagcccgacgauguggacugcuggugcaacgccacggauaccugggugaccuacggcaccugcagucagacgggugaacaccggagagacaagcggaguguggcccucgcgccccacguuggccuggguuuggagacccgcaccgagaccuggaugagcuccgagggcgcauggaagcagauccagcgggucgagacaugggcgcuccgacaucccggguuuacagugaucgcccucuuccuggcccacgccaucggcaccagcaucacccagaaagggauuaucuucaucuuacugaugcuggucacucccucuauggccaugcggugcgucgguaucgguagccgcgacuucguggaggggcucuccggggcaaccuggguggacguagugcuggaacacgggucgugcguaaccaccauggccaaggacaagcccacgcuggacaucgagcuccugaagacggaggucaccaacccagcugugcuacggaagcucuguauugaggcgaagauauccaauacgacgaccgacucuagaugccccacccagggcgaggccacccuuguggaggagcaggaugcuaacuucgucugccggcgaacguuugucgaccgggguugggggaauggcugcgggcuguucggcaaggggucgcuaaucacgugugcaaaguucaagugcgugaccaagcuggagggcaaaauuguccaguacgagaaccugaaguacagcguaauugugaccguucauacgggcgaccagcaccagguagggaacgaguccaccgagcaugggaccacagcuaccaucacgccucaggcgcccaccacagagauccagcucacagacuacggggcccugacgcuagauugcagcccucgcacuggguuagauuucaacgaaaugguguuacugaccaugaaagagaaguccuggcugguccacaaacagugguuucucgaccugccucugcccuggaccuccggagccagcacgucccaggagaccuggaaccggcaggaucugcucgucaccuuuaagaccgcccacgccaagaaacaggagguagugguguuaggcagccaggagggugcgaugcacacugcccugaccggggcgaccgagauucagacguccggcacgaccaccaucuucgccggccaccugaagugccgccuaaaaauggacaagcugacccuuaggggcaugagcuacguuauguguacugggagcuuuaagcucgagaaggagguggccgagacccaacacggcacaguacugguccagaucaaguacgagggcaccgacgcacccugcaagauccccuuuucuacgcaggacgagaagggggugacccagaacggccgccugaucaccgccaacccgauugucaccgacaaagagaagcccgucaauaucgaggcugagccgcccuucggagaguccuauaucgugaucggcgccggcgaaaaggcgcugaagcucagcugguuuaagaagggcuccagcauagguaaaauguucgaggccacggcccgcggcgccagacguauggcgauccugggcgacaccgcaugggacuuuggauccauuggcgggguguucaccagcgucgggaagcuggugcaccagaucuucggcacagccuauggggugcuguucuccggcgucucuuggacgaugaagauuggaaucgguguguuacugacuuggcugggacugaauucccgguccacaucacucagcaugaccugcaucgccguggggcucguaacgcuguaucugggcguuaugguccaagccgacuccgggugcgucaucaacuggaagggccgggagcucaaauguggaagcgguaucuucgugaccaacgaggugcacaccuggaccgagcaguauaaguuccaggccgacagcccgaagcggcugucggcggcuaucgguaaggccugggaggagggggucugcggcauccguagcgcgacccgacucgagaacaucauguggaagcagaucuccaacgagcucaaucacauacugcuggagaacgacaugaaguucacgguaguggucggggacguggccggcauccucgcgcaagggaagaagaugauccgcccccagcccauggagcacaaguacagcuggaaguccuggggcaaggcaaagauaaucggugccgacgugcagaacaccacguucaucauugacgggccaaauacgccggagugccccgaugaccagcgcgccuggaauauuugggaagucgaggacuacggcuucgggauauucaccaccaacaucuggcugaaacugcgcgacaguuacacucaagugugcgaucaccgccucaugucagcggccaucaaggacagcaaggcugugcaugcagacaugggcuacuggauugaauccgagaagaacgaaaccuggaagcuggcccgcgcgucuuuuaucgaggucaagacaugcaucuggcccaagucccacacccuguggaguaauggcgugcuggaaucggagaugaucaucccaaagaucuacggggguccgaucagccagcacaauuaccggcccggguacuucacucagacggccggccccuggcaccugggcaagcuggaguuagacuucgaccugugcgagggcacgacgguggugguggacgagcacugcgguaaucgcgguccgucccugcggaccacaacggugaccggcaagaucauccacgaguggugcugccgcucauguacccugccgccccuccgguuccgcggggaggauggcuguugguacgggauggagauccggcccguuaaggagaaggaggagaaccugguuaaguccaugguaagcgccggcucgggagaggucgacuccuucagccucgguuuguuaugcaucuccauuaugaucgaagaggugaugcggucgcgguggagucguaagaugcucaugaccggcacgcuagccguguuuuuucugcucaucauggggcaguuaaccuggaacgacuuaauucgccucuguauaaugguaggugcgaacgcgagcgauagaauggggauggggaccaccuaucuggcucucauggccacguucaagaugcgcccgauguucgccgugggacuccuguuucgacgccugaccucccgggaggugcuucugcugacgaucgggcugagccuggucgccuccguggagcugcccaacagccuugaagaacugggggacgggcuggcgauggguaucaugauccucaaacugcugaccgacuuccagagucaucagcucugggccacgcuucugagccucaccuucauaaagaccacguucucccuucacuacgccuggaagacgauggccaugguccugaguaucguuucccuguucccccugugccuguccacgaccucccagaagaccacguggcuccccguucugcugggcagcuugggaugcaagccgcugacuauguucuuaauugcggagaacaaaaucuggggucggcgguccuggccucucaacgaggggaucauggcaguaggcaucgugucgauccuguugagcucccuccugaagaaugacgugccccuggccgggccacuaaucgcuggcggcaugcugaucgccugcuacgucaucagcggguccagcgcugaccuaucccucgagaaggcugccgaggugagcugggaggaggaggccgagcacagcggagccagccacaauauucugguggagguccaggacgacgguaccaugaaaaucaaggacgaggagcgcgacgacacccuaaccauccuacugaaggcgacgcugcucgccgugucuggcguguacccacugagcauccccgccacccuguucguaugguacuucuggcagaagaagaagcagcgguccggggugcucugggacaccccuucgccgcccgagguggagcgagcaguccuggaugacggcaucuaucgaaucaugcagcgcggcuuacuggggcggucccagguuggcguggggguguuccaagagaauguguuccacaccauguggcacgugacgcgcggcgccguccucauguaccaggggaaacgucuggagcccucuugggcguccgugaagaaggaucugauaagcuacggaggcggguggagacuccagggcucuuggaacacuggggaggaggugcaaguaaucgccguggaacccggcaagaacccaaagaacgugcagaccgcuccagggacauucaaaacacccgagggugaggucggcgccaucgccuuagacuuuaaacccgggaccucgggcucccccaucgugaaccgggaggggaagaucguaggccuguacggaaacggggucgugaccaccagcggcacguacgugagcgcgaucgcacaggccaaggccucgcaagaggggccgcuccccgagaucgaagaugaggucuuucgcaaacgcaaccugaccaucauggaccugcaccccggcagcgggaagaccaggcgguaccucccggcuauaguccgcgaagcgauuaagcgcaaacugaggacccugauccucgcccccacgcgcguggucgcuucagagauggccgaagcgcugaagggcaugcccauccgguaccagacgacagccgugaagagcgagcacaccggcaaagagaucguggaucuuaugugccaugcuacuuucacaaugcgccuccuguccccaguaagagugccuaauuacaacaugaucaucauggaugaggcgcacuucaccgacccgaguucaauugcagcaagaggauacaucagcacacgggugggcaugggugaggccgcugccaucuucaugacggccacgcccccagguuccgucgaggcguucccgcagagcaacgccgugauccaggacgaggagcgcgacauuccggaacggucuuggaacagcggcuacgaguggauuaccgacuucccagguaagaccguuugguucguacccaguaucaagagcgggaaugacauugcuaacugccugcgcaagaacgggaagcgcgugauacaacucucgcgaaagacuuucgacaccgaguaccagaagaccaagaauaacgacugggacuaugucgucaccacggacauaagcgagaugggcgccaacuuccgggcugaccgcgugauagauccgcggcgcugccugaagcccgugauccugaaagacggacccgaacgggucauccucgccggcccaaugccagugaccguggccuccgcagcucaacggcgggggcgcaucggccggaaucacaacaaggagggcgaccaguacauuuauauggggcagccccuaaauaacgacgaggaccacgcucacuggaccgaggccaagaugcugcucgacaacauuaacacccccgagggcaucaucccggcucuguuugagccggagcgcgagaaguccgccgccaucgacggggaguaccgccuccguggggaagcaagaaagacguuuguggaacuaaugcggcgcggggauuugcccguguggcuguccuauaaagucgccagcgagggcuuccaguacagcgaccggcgcuggugcuucgacggcgagcggaacaaccaaguguuggaggagaauauggacguggagaucuggaccaaggagggagagcgcaagaagcugcggccccgcuggcuggacgcccggaccuacuccgacccgcucgccuugagggaguucaaggaauucgccgcgggccggaggagcgucuccggggaccugauccucgagauaggcaagcuuccgcagcaccugacccagcgggcccagaacgcccuagacaaccuugugaugcugcacaacagcgagcagggcgggcgcgcuuaucggcacgcgauggaagagcuccccgacacgaucgaaacucugaugcugcucgcccucaucgccguucugacuggcggggucacccucuucuuccuauccggccgagggcugggcaagaccagcaucggccucuuaugcguuauggccucaagcgugcugcucuggauggccuccgucgagccccacuggaucgcggccagcauaauccuggaauuuuuccugauggugcugcugaucccugagccagaccggcagcgcacgccccaggacaaccaguuggccuacguggucaucgggcuccuguucaugauauuaaccguggccgccaacgagaugggcuuacuagagacgaccaagaaggaccuggggaucggccacguagcggucgagaaccaccaccacgccgccaugcuggauguggaccugcacccagccagcgcguggacgcuguacgcgguggcaaccaccaucaucaccccuaugaugcgccacacgaucgagaacaccaccgccaacaucucucucaccgccaucgccaaccaagcggccauccugaugggacuggacaagggguggcccaucuccaaaauggacauuggcgugccccuccuggcccuggggugcuauagccaggugaacccccucacgcugaccgccgcggugcugaugcucgucgcacacuacgcaaucauugguccgggacugcaggccaaagccacucgggaagcgcagaaacgcacugccgccggcaucaugaagaacccuaccguggacggaaucguggccaucgaccuggaucccgucguuuacgacgccaaguucgagaagcagcucggacagaucauguuacugauccucugcacaucccagauccugcugaugcggacgacaugggcgcucugugaguccaucacgcuggccacuggcccgcugaccacauugugggaggggucuccgggcaaguuuuggaacaccaccauagcaguguccauggcaaacaucuuccggggguccuaccuggcgggcgcuggccuggccuucagccucaugaagucccuugggggcgggcggcgcgggaccggggcccagggcgagacucugggcgagaaguggaagcggcagcuuaaucaacugucaaagagcgaauucaacacguauaaacgcuccggaaucauggagguggaucgcagcgaggcgaaggaaggucugaagcgcggugagaccacgaaacaugcggugucccgggggaccgccaaguugcggugguucgucgagcggaaccuggucaagcccgaaggaaaggugaucgaccugggcugcggccgcgguggcuggagcuacuacugcgccgggcugaagaaggugacggaggucaagggcuauaccaagggcggccccgggcaugaggagcccaucccaauggcuaccuacgguuggaaucucgugaagcugcacuccggcaaggacguguucuucaucccaccggagaagugcgauacccugcucugugacaucggggagagcuccccuaacccgaccaucgaggaggggcggacccugcgaguauuaaagaugguggagcccuggcuccgggggaaccaguucugcauuaagauccugaaccccuauaugcccagcgugguggagacccuggagcagaugcaacgcaaacacggagguaugcuagugcggaacccuuugagccgcaacagcacacacgagauguacugggugucaugugggaccggcaacaucgugagcgccgugaauaugacaucccgcaugcuacugaacagguuuaccauggcacaccguaaacccacauaugagcgggacguggaccugggggccggcacccgccacguggccguagagcccgagguagccaaccuugacaucauaggccagcgaaucgagaacaucaagcaugagcacaagagcacuuggcacuaugaugaggacaaccccuacaaaaccugggccuaccacgggagcuacgaggucaagccuucuggcuccgcgaguagcauggugaacggaguugugaaacuccugaccaagccaugggacgugauccccaugguaacccagaucgccaugacggacaccacacccuucggccagcagcgagucuuuaaggagaaggucgacacucggacgccuaaggccaagcgggggacagcccagaucauggaagucaccgccaaguggcugugggguuucuuaaguaggaacaagaagccucgcaucuguacccgggaagaguucacacgaaagguccggucuaaugcggcaauaggagcaguauucguugacgaaaaccaguggaacagugccaaggaagcaguggaggacgagagguucugggaccuggugcaccgggagcgcgagcugcacaagcaggggaagugcgcuacuugcguuuacaacaugaugggcaagcgggagaagaagcucggggaguucggcaaggccaaggggagccgcgcaaucugguauauguggcugggugcccgguuucuggaguucgaggcgcucggcuucaugaacgaggaccacugguucucgcgcgaaaauucuuuguccggaguggagggcgaggggcugcacaagcucggcuauauccugcgggacauaagcaagauccccgggggcaacauguacgccgaugacaccgcgggcugggacacccgaauaacggaagacgaccuacaaaacgaggcccgcaucaccgacauaauggagccggagcaugcccuccuagcgaaaucaaucuucaagcugaccuaucagaacaagguggucagggugcaacguccagcgaaaaacgggacugugauggacgucaucagcaggcgagaucagcggggcucaggccaggugggcacguacggccucaacaccuucaccaacauggaggcccagcugaucagacagauggagucugaagggaucuucagccccucugaauuggagacccccaaccucgccgagcgggugcuggauuggcuggagaaauacggagucgagcgccucaagcggauggcaaucaguggagacgacuguguggugaagccgaucgaugacagguucgcgacggcccugacugcccugaacgacaugggaaagguacggaaggauaucccccagugggagcccagcaaggguuggaacgacuggcaacagguccccuucuguucccaccacuuccaccagcucaucaugaaggacggccgcgagauaguggucccguguaggaaccaggacgaacuagugggucgcgcccgggucagccagggggccggcuggagccugcgcgagaccgcgugucucggcaagaguuacgcccaaauguggcaacugauguacuuccacagacgcgauuuaagauuagccgccaacgcgaucugcagcgccgucccuguggacuggauccccaccucccguacgacuuggagcauucacgcccaccaucaguggaugaccaccgaggacaugcuauccguauggaacagggucuggaucgaggagaaccccuggauggaagacaagacucacaucagcuccuggggcgacgugccguaccuagggaagcgggaagaccaguggugcggcagccucaucggccugacagcccgcgccaccugggcgacaaauauccagguggcuauuaaccagguccggcgcuuaauagggaaugagaacuaccucgacuacaugaccagcaugaaacgguucaagaacgaaagcgacccggagggcgcccuuugguga

SEQ ID NO: 24136 - RNA, 9879 nt, Artificial Sequence
  derived and/or modified CDS sequence (opt11) from DENV-1__FJ024447__SS-prME
agcgugaccaugcugcugauguugaugcccaccgcccuggccuuccaccucaccacgcggggcggggagccacacaugaucgugagcaagcaggagcggggcaaaagccugcuguucaagaccucggccggggugaacaugugcacgcucaucgccauggaccuuggcgaguuaugcgaggauaccaugacguacaaauguccccgcauaacagagacagagccugacgacguggacugcuggugcaaugcgacggacaccugggucaccuacgggaccugcagucagacgggcgagcaccgaagggacaagcgguccgucgcccucgcgccgcaugugggccuggggcuugagacccguaccgaaaccuggaugagcuccgagggcgccuggaagcagauccaacgugucgaaacgugggcucugcgccacccaggauucaccgugauagcccuguuccuagcccacgcgaucggcaccucgaucacccagaagggcaucaucuucauccuccugaugcuggugacgcccuccauggccaugcggugcgucggaaucggcagucgcgacuuuguggaggggcucucgggugccacauggguggacgucgugcuggagcacgguaguugcguuaccacgauggccaaggacaaaccaacgcuggauaucgagcucuugaagaccgaggucacaaaccccgcggugcugagaaagcucugcaucgaggcgaagauaucgaacaccacgaccgacucucgcuguccgacacaaggcgaggcuacccugguggaggagcaggacgccaacuucgucugccgacgcacguuuguagaccgaggaugggggaacgggugcgggcuguuuggcaaggguucccucauuacgugcgccaaguuuaagugcguuaccaagcuugagggcaagauaguccaguaugagaaccugaaguacagcguuauagugacaguccauacgggugaccagcaccaagucggcaacgaguccacugagcacggcaccacagccaccaucacgccgcaagcgcccaccaccgagauccaacuaaccgacuacggggcccugacgcuggacuguuccccccguacuggccucgacuuuaacgagaugguccuccugaccaugaaggaaaaguccuggcucguucacaagcagugguuccuggaucugccccuccccuggacaagcggggccagcacaucucaggagaccuggaaccggcaggaccugcuggugaccuucaagaccgcucacgcgaagaagcaggaggucguggugcucggcagccaggagggagcgaugcacacggcccugaccggggccaccgagauccagacuucuggcacaaccaccaucuucgccgggcacuuaaagugccgccucaagauggacaagcugacccuaaagggaaugucuuacgucaugugcacgggguccuucaagcucgaaaaggagguggcggagacccagcacggcacugugcugguccagaucaaguacgagggcacggacgcgcccugcaagaucccuuucagcacgcaggacgagaagggaguuacucagaacggccgacugaucaccgccaauccuauuguuacagacaaggagaagcccgucaacaucgaggccgagccgcccuucggggagaguuacaucguaaucggugccggcgagaaagcgcugaagcuaagcugguuuaagaagggguccagcauaggcaagauguucgaggccacggcccgcggggcccggcgcauggccauccugggcgauaccgcgugggacuucggguccaucggcggcguguucaccagcguugggaaggugguucaccagaucuucggcaccgccuacgggguccucuucaguggcgugagcuggacgaugaagaucgggaucggcgugcuccucacuuggcugggacugaacucccgcucuacaucccugagcaugaccugcaucgcugucgggcuggugacgcucuaccugggcgugaugguccaggcggacuccgggugugugauuaauuggaaggggcgggagcugaagugcgggagcggcauuuuuguuaccaacgagguccacacguggaccgagcaguacaaguuccaggccgacucgccuaagaggcucucagcggcgauuggcaaggccugggaggaggguguguguggcauccggucagcuacccgccuagagaacaucauguggaagcaaaucuccaacgagcuuaaccacauccuccucgaaaaugacaugaaguucacggucgucguaggggacguagccggcauccuggcgcaggggaagaagaugauccggccccagcccauggaauacaaguacuccuggaagagcuggggcaaggccaagaucaucggagcggacguccaaaacacaaccuucauuaucgacggccccaacaccccggaaugccccgacgaucagcgugccuggaacaucugggagguggaggacuacggauucgggaucuucacuaccaacaucugguuaaagcugagagacucuuacacccaggugugugaccaccgccugauguccgcggccaucaaggacagcaaagcgguccacgccgacaugggcuauuggaucgagagcgagaagaacgaaacauggaagcucgcucgggcgucuuucaucgaggugaaaacuugcaucuggcccaagucccauacucuguggagcaacggcgugcuggaguccgaaaugaucauccccaaaauauaugggggcccgaucagccagcacaacuaccgcccuggcuacuucacucagaccgcaggcccauggcaccucgggaaguuagagcuggauuucgaccucugcgagggcacgaccguagugguggacgagcacugcggcaaucgagggccgucccugcgcacgaccacggugaccggcaagaucauccacgaauggugcugucggagcugcacccugccgccccugcgcuucagaggggaggacggcugcugguacgggauggagaucaggccagugaaggagaaggaggagaacuuagugaaguccauggucagcgccggcaguggcgagguggacucguucucacuggggcuccuuugcauauccaucaugaucgaggaggugaugcgaucccgcugguccagaaaaauguuaaugaccggcacucucgcagucuucuuccugcuuaucauggggcaacucaccuggaacgaccugauccgccugugcauaauggugggcgccaacgcgagcgaucgcauggggaugggcaccaccuacuuggcccuaauggcuacguucaagaugcggccgauguucgccgucggucuucuguuucgccggcugaccucacgcgagguccugcuucugacaaucgggcugagccucguagccuccgucgagcugcccaacagccuggaagagcucggcgacggguuggcgaugggaaucaugauccugaaacuccuaacugacuuccagucccaucagcucugggccacgcuccugagccugaccuucaucaagaccaccuucucccuccacuaugccuggaagacgauggcaauggugcugaguaucgugucccuguucccccucugucugagcaccaccucccagaagaccacgugguuaccgguccucuuaggcagcuuggggugcaagccgcucaccauguucuugaucgcggagaacaagaucuggggccggagguccuggccccugaacgagggcaucauggccgucggaaucgugagcauccuccugagcagccugcucaagaaugaugugccccuggccgguccgcugauugccggcggcaugcucaucgccugcuacgugauaaguggguccagcgcugaccugucccuagagaaggccgccgaggugucgugggaggaagaggccgaacauuccggugccucccacaacauccucguugaggugcaggacgaugggaccaugaaaauuaaggacgaagagcgggacgacacccugaccauccugcucaaggcaacgcugcuggcgguguccggcguguacccgcucagcauccccgccacccuguucgugugguacuucuggcagaagaagaagcagcgcucagggguguugugggacaccccuuccccgcccgaggucgggcgggcggugcucgaugacggcaucuaccgcauuaugcagagaggguuacugggccgcucccagguaggggucggcguuuuccaggaaaauguguuccauaccauguggcacgucacgagaggggccgugcugauguaccaggggaagagacucgagcccagcugggcuuccgugaagaaggauuugaucagcuacggcgggggcuggcggcuacaaggcuccuggaacaccggggaggagguucaggugaucgcaguggagcccgggaagaaccccaagaauguccaaacggcacccggaacguucaagacgccugagggcgagguuggagccaucgcccucgacuucaagcccggcaccuccgggucccccaucgugaaccgcgagggcaagauugucggccuguacgggaauggcgugguuaccacgagcgguacuuacgucagcgcgaucgcgcaggccaaagccucucaggagggaccgcuaccugagaucgaggacgagguguuucggaagcgcaaccuuaccaucauggaccugcaccccgggagcggcaagacccggcgauaccugccggccauuguacgggaggcaaucaaaaggaaacuucgcaccuuaauucuggccccaacgcgggucguggccuccgagauggcggaggcgcucaaaggcaugccgauccgcuaccagaccaccgccgugaagucggagcacaccgggaaggagaucgucgaucugaugugccacgcgacguuuaccaugcggcugcucucccccgugcguguuccgaacuauaacaugaucaucauggacgaggcccacuucacugaccccagcuccauugcugcgcgaggcuacauuucuacgcgcgucggcaugggugaggccgcagcaaucuucaugacggccacgccgcccggguccguagaggccuucccgcagagcaaugccgugauccaggaugaagagcgagacaucccagagagaucguggaacucuggguacgaguggaucacagacuuccccgggaagacggucugguucguacccuccaucaagagcgggaacgacauugccaacugucugaggaagaacggcaagcgcgugauccaacuguccaggaagacguucgauacagaguaccagaagaccaagaauaacgauugggacuacguugugacaacggacaucagcgagaugggcgccaacuuccgcgcggaucggguaauugauccgcgccggugccucaaaccggucauuuuaaaggacggccccgagcgcgugauccuggccgggcccaugccgguaacgguugcuucagcugcgcagcggcgcggccggaucggccgcaaccacaacaaggagggggaccaguacaucuacaugggccagccccuuaacaaugacgaggaccacgcgcacuggacggaagcgaagaugcuguuggacaacauuaacacuccagaggguaucauccccgcccucuucgaaccagagagggagaagucagccgccaucgacggagaguaccggcugcgcggggaggcacggaagacguucguggagcuuaugcgccggggcgacuugccagucuggcuguccuauaagguggccagcgaaggcuuccaguacagcgacagacgguggugcuuugacggggagcgcaacaaccaggugcuggaggagaacauggacgucgagaucuggaccaaggagggcgaacggaagaagcuccgcccacgguggcuggacgcccgcaccuacuccgacccacucgcccucagggaauucaaggaguucgccgcaggccgccggagcgugagcggagaccugaucuuggagaucggcaagcucccacaacaucugacccagcgcgcgcagaacgcccuggacaaucucgugauguuacacaacagcgaacaaggcgggcgggcauaccgccacgcgauggaagaacuuccagacacgaucgagacccucaugcuucuggccuuaaucgcgguccugaccgggggcgugacccuguucuuucucuccgggcggggccugggcaagaccagcaucgggcugcuuugcgugauggccaguagcguccuacucuggauggcauccguggagccccacuggaucgcggcgucuaucauccucgaguucuuccugauggucuuacuaauuccggagccggaccgccagaggacgccccaagacaaccaacuggccuaugucgugaucggucuacuguucaugaucuuaacgguggccgccaacgagauggggcuccucgagaccaccaagaaggaccuggggaucgggcacgucgcgguggagaaccaccaccacgccgcuaugcuggacguggaccuccaccccgccuccgcauggacauuguacgcgguugcaaccacaaucauaaccccgaugaugcggcacacgaucgagaacaccaccgccaacaucagccugaccgccauagcuaaucaggcggccauccucauggggcuggacaagggcuggccuaucuccaagauggacaucggggugccccugcucgcguugggcugcuacagccagguaaaccccuugacacucacugccgcgguauuaaugcugguugcccauuaugccauuaucgggccgggccuacaggccaaagccacgcgcgaggcgcagaaacggacggccgccgggaucaugaaaaacccgaccguggacggcaucgucgccaucgaccuggaccccgugguguaugacgccaaguuugaaaagcagcuaggccagaucaugcuccugauccucugcacaucucaaauacuccugaugcguaccacgugggcguuaugugaaagcauaacgcucgccacagggccccugaccacacuuugggagggguccccggggaaauucuggaauacgaccauugcggucagcauggccaacaucuuuaggggcuccuaucucgccggcgcagggcuugcauuuagccugaugaaaagccucggcgggggacgcagggggaccggcgcccagggcgagacacugggugaaaaguggaagcgucaacucaaucaacucuccaagagcgaguucaacacauacaagcgguccgguauuauggagguggacagaagcgaggccaaggaagggcugaagaggggcgagacuaccaagcaugcugugagccgcgggaccgccaagcugcguugguucguugaacgcaaccucgugaaacccgagggcaaagugauugacuugggcugcggacggggcggguggagcuacuacugcgcaggccugaagaaagucacagaggugaagggguauaccaagggcggccccggacacgaagagcccauuccaauggccaccuacggcuggaaccuggugaagcuccauuccgggaaggaugucuucuucaucccgcccgagaagugcgacacgcugcugugcgacaucggugaaucuucccccaauccgacgauugaggaggggaggacccuccgggugcuuaaaaugguggagcccuggcugcguggcaaccaauucuguaucaagauccucaacccuuacaugcccagcgugguggagacccuggagcagaugcagagaaagcauggcgggaugcuggugcgcaacccccucucgcggaacucaacccacgagauguacuggguuucaugugggacugggaacauagugagcgccguaaacaugacgucucgcaugcugcugaaccgcuucacuauggcgcaucggaagcccacguaugagcgcgacgucgaccucggggccggcacccggcacguggccguggagcccgaagucgcgaacuuagacaucaucgggcagcgcaucgagaacauaaagcacgaacacaagagcacguggcacuacgacgaggauaaccccuacaagaccugggccuaccauggcuccuacgaggugaaaccgagcggguccgcgagcagcauggucaacggcguggugaaguugcucaccaagccuugggacgucaucccuauggucacccagaucgccaugacggacaccaccccuuucgggcagcagcggguguucaaggagaagguggauacucgcacgccaaaggcuaagcgaggcaccgcccagaucauggaggugacugccaaauggcuguggggcuucuugucccgcaacaagaaaccaagaaucugcacccgcgaggaauuuacucggaaggugcgaagcaacgcugccaucggcgccgucuucguggacgagaaccaguggaacuccgcaaaagaggcuguugaagacgagcguuucugggacuugguccacagagaacgggagcugcacaagcagggcaagugcgcgaccugcguguacaacaugauggggaagcgcgaaaagaaguugggcgaauucggcaaagccaagggcagccgggcuauuugguauauguggcucggugcccgcuuccucgaguucgaggcucugggguucaugaacgaggaccacugguucucccgggagaacucacucagcggcguggaaggggagggcuuacacaagcugggauacauccuccgcgacaucagcaacauccccggcggcaacauguaugcggacgacacagcugggugggacacccggaucacggaggacgaccugcagaacgaggcccgcaucacugacauaauggagccugaacacgcacuucucgcgaaguccauauucaagcugacauaucagaacaagguugugcgcguucagcggcccgcgaaaaacggaaccgucauggacgugauaucucgccgggaccagagagggagcggucagguaggcacguacgggcugaacaccuucaccaacauggaagcccagcuuauccggcaaauggaaagcgagggcauuuucucccccucggaacuugaaaccccaaaccuggccgagcgcguacucgacuggcuggagaaauacgggguugagcggcuuaagcgcauggcaauuuccggcgacgacugcguggugaagccaauugacgaccgguucgcgacggcccucaccgcccugaacgacauggggaaggugcguaaagacaucccccaaugggagcccagcaagggguggaacgacuggcagcaaguuccauucugcucccaccauuuccaccaacugaucaugaaggacggucgggagaucguagugccgugccgcaaccaggacgaauuggugggacgggcccgcgugagccagggcgccggguggagccucagagagacagccugccucggcaaguccuacgcucagauguggcagcucauguacuuccaucgccgggaccugcgccuugccgccaaugcgaucuguagcgcggugcccguugauuggaucccaaccucccggacgaccuggagcauccacgcccaccaccaauggaugaccacggaggacaugcuuuccguuuggaaccgcguguggauugaggagaaccccuggauggaagacaagacccacaucagcuccuggggagacguuccguaccuggguaaacgcgaggaccaguggugcggcagccugaucgggcucaccgcccgggccaccugggcgaccaacauacagguagcgauaaaccaggugcgcagauugaucgggaaugagaacuaccuugacuacaugaccuccaugaagcgcuucaagaaugagucggaccccgagggcgcccucugguga

SEQ ID NO: 24137 - RNA, 9879 nt, Artificial Sequence
  derived and/or modified CDS sequence (opt11) from DENV-1__FJ182025__SS-prME
agcgugaccaugcugcucaugcugaugccuaccgcccuggcguuucauuugaccacacggggcggugagccccacaugaucgugaguaagcaggagcgggggaagucccugcuguuuaaaacgagcgccggugugaacauguguaccuuaaucgccauggacuuaggggaacugugcgaggauaccaugaccuacaaaugcccuaggaucaccgagaccgagccggacgacguggauuguugguguaacgccacggacaccuggguuacguauggcacgugcagccagacgggcgagcaccgccgugacaagcggucaguggcccucgcgccccacgugggccucggccucgaaacccgcacagaaaccuggaugagcucagagggcgcauggaagcaaauccaacggguggaaacgugggcuuugcgccaccccggguucaccgugaucgcccuguuccuggcccacgccaucggcaccagcaucacacaaaaggggaucaucuucauccuccugaugcuggucacucccucaauggccaugcggugcgucgguauaggcucgcgggacuucgucgaaggacucuccggcgcuaccugggucgacgucguucuggagcacgggucaugcgugaccaccauggccaaggauaagccaacgcuggacaucgagcuccugaagacugagguuaccaaccccgcuguucugcggaagcucugcaucgaggcuaaaauuaguaauaccacgaccgacagcagauguccgacccagggcgaggccacacugguggaggagcaggacgccaacuucguuugccggcgcacguucguggaccggggcuggggcaacggcugcggcuuguucggcaaggggucccucauuacgugcgcuaaguucaagugcgugaccaaacuagaaggaaagaucguccaauacgagaaccugaaguacagcgugauugugaccguucacaccggcgaccagcaucagguggguaacgaguccaccgaacauggcaccaccgccaccaucacgccucaagcgcccaccaccgaaauccagcucacugacuacggggcccucacguuggacugcucuccccguaccggucuugauuucaacgagaugguccugcugaccaugaaggagaaguccuggcucgugcacaagcagugguuccuagaccugccacuacccuggaccucuggcgccucgacgagucaggagacguggaaccggcaggaccugcugguaaccuucaagaccgcccacgcgaagaagcaagaggucgugguuuuaggcagccaagagggcgcgaugcacacugcccugaccggggccacggagauccagaccagcgggaccacaaccauauuugccgggcaccugaaaugccgccucaagauggacaaacugacccugaaggggaugagcuacgucaugugcacgggaagcuucaagcuugagaaagaaguggccgagacccagcacgguaccgugcuuguccagaucaaguacgagggcaccgaugcgcccuguaagauccccuucucuacacaggacgaaaagggagugacccagaacggccgacugaucaccgcgaacccgaucgugaccgacaaggagaaacccgugaacauugaggcagaaccgcccuucggagagucuuauauagugaucggcgccggugagaaagcgcugaaguuaagcugguucaagaaaggauccagcaucggcaaaauguucgaggccacggcacgcggggcgagacgcauggcuauuuuaggcgacacagcgugggacuucggaucgaucggcggcguauucacuagcgucgggaaacuggugcaccagaucuucggaaccgcguacgggguccuguucucuggcgucagcuggacgaugaagaucgggaucggcguccugcugaccuggcuugguuuaaacucccgcagcaccucccucagcaugaccuguauugccgucgggcucgucacacuguaccugggcgugauggugcaggcugauuccgggugcgugauuaacuggaagggucgggagcucaagugcggaagcgguaucuucguuacgaaugagguucauaccuggaccgaacaguacaaguuccaggcggacagccccaaacgguugucagcggcgaucggaaaggccugggaggaggggguaugcggcauccggagcgccaccagacuggagaacaucauguggaagcaaauuuccaaugaguugaaccauauccuccuugagaacgacaugaaguucacugugguggucggggacguggccggcauccucgcgcaggggaagaagaugauccgaccccaacccauggaguacaaauauagcuggaaguccuggggcaaggcuaagaucaucggcgccgacguacagaacacaaccuuuaucaucgacgggcccaacaccccggagugucccgacgaccagcgggcguggaacaucugggaggucgaggacuacggcuucgggaucuucacgaccaacauauggcuuaaguugcgggacagcuacacccaggugugcgaccaccgccuuauguccgcggccaucaaggacagcaaggccguacacgccgacauggguuauuggaucgagucggagaagaacgaaaccuggaagcuggcacgggcgucauucauugagguaaagacguguaucuggcccaagucccacacccuguggaguaaugguguacucgaguccgagaugaucaucccaaagaucuacggggggccgaucucccagcauaauuaccgccccggcuacuucacccagacugccggcccuuggcaccugggcaagcuggagcucgacuuugaccucugcgagggaacgaccgugguuguugacgagcacugcggcaaccgggggccgucccugcgcaccaccacuguaacggggaaaaucauucacgaguggugcugucggucgugcacccugccgccccuccgcuuccgcggggaggacggauguugguaugggauggaaaucagacccgugaaggagaaggaggagaaccuggugaaguccauggugucagccggcagcggcgaaguagacuccuucuccuuagggcugcugugcauauccaucaugauagaggaagugaugcgcagccguugguccagaaagaugcucaugaccgguacgcuggcuguguucuuccugcucaucauggggcagcugaccuggaaugauuuaaucagacucuguauuauggucggcgccaaugcgagcgaccgcauggguaugggcaccaccuaccuugccuuaauggccacuuucaagaugcggccgauguuugccguagggcuucuguuucgccggcugacaucccgugagguguuacuucugaccaucgggcugagccuggucgcuuccguggaguuacccaacagccucgaggagcuuggagacgggcuggcgaugggcaucaugauauuaaagcuguugacggauuuccaaucccaccagcugugggccacuuuacugucgcucaccuucauuaagaccacuuucucccuacacuacgccuggaagacgauggccaugguccugagcauagugucccucuucccccugugucugagcacuaccucccagaagaccacgugguuaccugugcuucucggcagccucgggugcaagccgcugaccauguuccucaucgcggagaacaagauaugggggaggcggucguggccccucaaugaggggauuauggccgucggaaucgugagcauacuacuaagcagccuccugaagaacgacgugccgcuggccggacccuugauagccggcggcaugcugaucgcauguuacguaaucagcggguccagugcggaccugucccucgagaaggccgccgaagucagcugggaggaggaggccgagcacuccggcgccagccauaacauccugguggagguccaggacgacggcaccaugaaaaucaaggacgaagagcgcgaugacacccugacgauccuucugaaggcgacgcuccucgccguguccggcguauacccguugucgauaccagcaacgcuguuugucugguacuucuggcagaagaagaagcagcgcuccggggugcucugggacacaccaagcccgcccgagguggguagagcaguccuggacgauggcaucuaccgcaucaugcagcgcgggcugcugggcaggagucagguggguguuggcguuuuccaggagaacguauuccacacaauguggcacguuacgcgcggggccguccucauguaucagggcaagcgccuugagccgucuugggcuuccgugaagaaggaucugauaucauacggcgggggcuggcggcuucagggaucuuggaacaccggggaggagguccaaguuaucgccguggagccaggcaagaaccccaagaacguucagacggcaccaggaaccuucaagacucccgagggcgaggucggggcuaucgcccucgacuucaaaccgggcaccucugggucucccaucgugaacagggagggcaaaaucgugggucuguacgggaacggcgucguaaccacuucagggacuuacgugagcgcgauagcccaggccaaggcgucccaggagggcccgcuacccgaaaucgaggacgagguguuccggaagcgcaaccugaccaucauggaccugcacccggggucuggcaagacccggcgauaucucccggcaaucgugcgugaggcaauaaagcgcaaacugcgcaccuuaauccucgccccuacgcggguggucgcauccgagauggcugaagcgcugaaaggcaugcccauacgcuaccagaccacagccgucaagagcgagcauaccgggaaggagaucgucgacuugaugugucaugccacguucaccaugcggcugcugucccccguccgugucccuaacuacaacaugaucauuauggaugaggcccacuucacugaccccagcagcaucgccgcgcggggauauaucagcacacgcguggggaugggcgaggccgccgccaucuuuaugaccgcgacaccgcccggauccgucgaggcguucccgcagucuaacgccgugauccaagacgaggagagagauauccccgagcgcucguggaacagcggcuacgaguggaucacugacuuuccagguaagaccgugugguucgucccuuccaucaaguccggcaacgacaucgcaaauugccuuaggaagaacggaaagcgcgugauccagcucucccggaagacguuugacacugaguaccagaaaaccaagaacaacgacugggacuacgucgugaccacggacaucucggagaugggagccaacuuucgcgcggaccgggugaucgacccccgccggugccugaagccagugauccucaaggacggucccgagcgcgucauccuagccgggcccaugccggugacugucgccuccgcagcgcagcggcgcggccggauaggucgcaaccacaacaaggagggcgaccaguacauuuauaugggccagccccuuaauaacgacgaggaccacgcgcacuggaccgaggcgaagaugcuccucgacaacauuaacaccccagaaggaaucauccccgcucucuucgagccagagcgcgagaaguccgccgccauugauggcgaauaccgccuccgcggagaggcgcggaaaacguucguagagcucaugcggcggggagaccuccccguuugguuauccuacaaggucgccucagaggguuuccaguacagcgacagacgguggugcuuugacggggaacgcaacaaccagguucucgaggaaaacauggauguggaaaucuggacgaaggagggcgaacgcaagaagcugcgcccccgguggcuggacgcccgcaccuacuccgacccccucgcccugcgggaguucaaggaguucgcggccggccgccgguccgucucuggcgaccugauccucgagaucgggaagcucccucagcaucugacccagcgcgcccagaaugcccucgauaaucuggugaugcugcacaauagcgagcagggugggcgagcuuaccgccacgccauggaggaauugcccgacacgauugagacccugaugcuccucgcccugaucgcuguguuaacugggggugucacccucuucuuucuaucggggcgaggacugggcaagacaagcaucggacuccuuugcguuaucgccuccucugugcugcuuuggauggcaaguguugaaccccacuggaucgcagcaagcauuauccucgaauucuuccugauggugcuccugauccccgagccggaccgccaacggacaccccaggauaaccaacuggccuacguggucaucggucugcuuuuuaugauccuaacaguggcugccaaugagaugggucuccuagagaccacaaagaaggaccugggcaucgggcacguggcagucgagaaccaccaucacgcggcaaugcucgacguggaucugcaccccgccucugcauggacccuguacgcgguggccaccaccaucaucaccccgaugaugcggcacacuauagagaacaccacugccaacaucagccucaccgccaucgcuaaccaggccgcgauucuaaugggucuggacaagggcuggcccaucaguaaaauggacaucggggucccccuucuagcucugggcugcuacucccaagugaacccccucacgcugacggcagcggugcuaaugcucgucgcccauuaugcuauuaucgggccgggacuccaggccaaggccacucgugaggcgcaaaagcggaccgccgcugggauaaugaaaaacccuacggucgacggcaucguagcuaucgaccucgaucccguggucuaugacgccaaauucgagaaacaacucggccagaucaugcugcuuauccuuugcaccucccaaauacugcugaugcgcaccaccugggcgcucugcgagagcauuacguuggccaccggaccccugaccacgcucugggaaggcuccccggggaaguucuggaacaccaccaucgccguaagcauggccaacaucuuuaggggauccuacuuagcuggcgccgggcuugccuuuucccucaugaagucucugggcgggggcaggcgggggaccggggcccagggcgagacccugggggagaaguggaaacgccaguuaaaccaacugucgaagucagaguucaacacuuacaagcgaucaggaaucauggaggucgacaggucugaggccaaggaggggcugaaacggggcgagaccaccaagcacgcggugucccgcgggaccgcgaagcuccggugguucguggagcgcaaccuggugaagccugagggcaaggugaucgaccugggaugcggacggggcggguggagcuacuauugcgccggcuugaagaaggugacagaggucaagggguacaccaagggcggccccgggcacgaagagcccauuccgauggccaccuacgguuggaaccuggugaagcuucacuccgggaaggacguauucuucauuccgcccgaaaagugcgacacccugcucugcgacaucggcgagaguucccccaacccgacgaucgaggaggggcgaacuuugcggguccugaagaugguggagcccuggcugcgcggcaaccaguucugcaucaagauccucaaccccuauaugcccagcguaguagagacccuggagcagaugcagcggaagcacggaggcaugcucguucgcaacccgcucagucgcaauuccacccaugagauguacuggguguccuguggcacggguaacaucguuagcgccgugaacaugacgucccgaaugcugcuuaaccgcuucaccauggcgcaccggaagccaaccuaugagcgggacguagaccucggcgccggcacccgucaugucgccguggagcccgagguugccaaucuggauaucauugggcagcguaucgagaacaucaagcacgagcacaagagcacauggcacuacgacgaggacaacccguacaagacgugggccuaccauggauccuaugaggucaaaccgagcgggucugccagcagcauggugaauggugucgugaagcuccugacuaagcccugggacgugaucccgauggucacucagaucgcgaugacagacaccacccccuucgggcagcagcggguguucaaggagaagguggacacccgcacgccgaaggccaagcggggcacugcccaaauaauggaggucaccgccaaguggcuguggggcuuccucucgcgcaacaagaaaccccggaucugcacccgcgaggaguucacgcggaagguacguagcaacgccgccauaggggccguauucgucgacgaaaaucaguggaacuccgccaaggaggcggucgaggacgagcgguuuugggaccuagugcacagggaacgcgaacuucacaagcagggaaaaugcgcgaccugcguauacaacaugauggggaagcgugaaaaaaaacucggcgaguucgggaaggcgaaaggcucucgugccauuugguacaugugguuaggcgccagguuucuggaguucgaggcgcucggguucaugaacgaggaccacugguucucccgggagaacagccuauccggcguagagggggagggccuccacaagcucggguacauucugcgcgacaucagcaacauccccggcggcaauauguacgccgacgacacggcugggugggacacccggaucacggaggacgaccugcagaacgaggcccgcauuaccgacaucauggagccugagcacgcccugcuggcgaaguccaucuucaagcuuaccuaccagaacaaaguagucagaguacagcggccuacuaagaauggaacggugauggauguuaucagccgccgcgaucaacgcggguccggccagguaggcaccuacgggcucaacaccuucaccaacauggaggcccagcugauccggcagauggagagcgagggcaucuuuucccccagcgaguuggagacacccaacuuggccgagcgcgugcuggauuggcuggagaaguacggugucgagcggcugaagcgcauggccauuuccggcgacgacugcguggucaagccggucgacgaccgguuugccaccgcgcucaccgcccucaacgacauggggaagguucgcaaggacaucccccagugggagcccagcaagggcuggaacgacuggcaacagguccccuucuguucccaucauuuccaccagcuaaucaugaaggacggacgggagaucguagugccuugucgcaaccaggaugaguuaguagggcgagcccgcguuagccagggggcagguuggagucugcgggaaacugccugccucgguaaauccuaugcgcaaauguggcaacugauguacuuccaccgccgagaccugcgccucgccgccaacgccauuuguucggccgugccaguggacuggauccccacgagccggaccaccuggagcauacacgcccaccaucaguggaugaccacugaggacaugcuguccgucuggaaccgcguguggaucgaggagaaccccuggauggaggauaaaacccacaucagcucauggggcgacgugccguauuuggguaaacgcgaggaccaguggugcggcagccuuaucgggcugaccgcccgagccaccugggccacgaacauccaggucgcaaucaaccaagugcgcagauuaauugggaacgagaacuaccucgacuacaugacgucaaugaagcgcuucaagaacgagagcgaccccgagggggcccugugguga

SEQ ID NO: 24138 - RNA, 9879 nt, Artificial Sequence
  derived and/or modified CDS sequence (opt11) from DENV-1__FJ373297__SS-prME
uccgugaccaugcuacucaugcugaugccgacggccuuggccuuccacuugaccacccgcgguggagaaccccacaugauaguuuccaagcaggagcgggguaagagccugcuguucaagaccuccgccgggguuaacaugugcacgcucaucgccauggaccuuggcgagcugugcgaggacacuaugaccuacaagugcccccggaucacagagguggagcccgaugacguggacuguugguguaacaccaccgauaccugggugaccuacgguaccugcagucagacaggcgagcacagaagggacaagcgguccguggcccuugcgccgcacgucggucuggggcuggagacgagagccgagaccuggaugagcuccgagggcgcguggaagcaaauacagaagguggagaccugggcacugaggcacccaggguucacggugaucgcccuguuccuggcccacgcgaucggcaccagcauuacccagaaggguauaaucuucauccuccugaugcuggucacccccuccauggccaugagaugcgucgguauaggcagccgggauuucgucgaagggcucuccggggccacaugggucgacgugguacuggagcacgggagcugcgucaccaccauggcaaaggauaagccgacucuggacaucgaauugcugaagacggaggugaccaaccccgccgugcugcgaaaacuuugcaucgaagcgaagaucuccaacaccaccacggacagccggugcccgacucagggcgaggccacccuggucgaggagcaggacgccaacuucgugugcaggcggaccuucguggaccguggcugggggaacggcugcgggcuguuuggcaaagggucccucaucacgugcgccaaauucaaaugcgucacaaagcuagagggcaagaucgugcaguacgaaaaccugaaguacucggugaucguuaccgugcacaccggcgaccagcaccaggucggcaacgaguccacggaacacggcaccaccgccaccaucacgccucaggcucccacaagcgagauccaacuuaccgacuauggggccuuaacccuggauugcagcccccggacugguuuagacuucaacgagauggugcuguugacaaugaaagagaagagcuggcucgugcacaagcagugguuucuggaccugccgcuccccuggaccagcggggccuccaccagccaggagaccuggaacaggcaggaucuguuggugaccuucaagacggcccaugcaaagaaacaagagguaguggugcucggcucccaagagggcgcgaugcauaccgcccugaccggggccacugagauccagaccagcggcacaaccacgaucuuugccgggcaccuuaagugccggcucaagauggacaagcuaacccugaaggggaugagcuacgugaugugcaccggucucuucaagcuggagaaggagguggcggaaacccagcaugguacgguccuggugcagauuaaguacgagggcaccgaugcgcccuguaaaauccccuucagcacccaggacgaaaaaggggugacccagaacggccgccuaauaacggccaaccccaucgucacggauaaggagaagccgguuaacauugaggccgaaccccccuucggggagagcuauaucgugaucggcgccggcgaaaaggcgcuaaaacugagcugguucaagaaggguuccagcauuggcaaaauguuugaagcaaccgcccggggcgcccgccggauggcuauacugggcgacaccgcgugggacuucgguuccaucggcggcgucuuuacgagcguggggaagcucgugcaccagaucuuuggcaccgccuacggggucuuauuuuccggagugucuuggacaaugaaaaucgggauaggggugcugcuuaccuggcugggccuuaacagucgcucuacaucccucucaaugaccugcauugccgucgggcuggugacgcuguaccuagggguaaugguccaagccgacuccgggugcgugaucaacuggaagggccgcgagcugaaaugcgggucgggcaucuucgugacuaacgagguccacacguggaccgagcaguacaaguuccaggccgacagcccgaagcggcuguccgcggccauaggcaaggcgugggaggagggcguuuguggcauacgcuccgcgacacggcuggagaacaucauguggcgccagauaucaaacgaguugaaccacauucugcucgaaaacgacaugaaguucacaguggucgucggggacguggucggcauacuggcucaggggaagaaaaugauccgaccccaaccuauggagcauaaguacagcuggaaguccuggggcaaggcgaagauuaucggggcagacguccagaacaccacguucaucaucgacgggcccaauaccccggagugcccugacgaccagcgcgcuuggaauaucugggagguggaggacuacggcuucgggaucuucaccaccaauaucuggcuaaagcucagagacucuuacacgcaggucugugaccaccgccugauguccgccgcgaucaaggacagcaaggccgugcaugccgacaugggcuauuggauugaguccgagaagaacgagaccuggaagcuggcacgggccagcuuuaucgagguaaagaccugcaucuggccuaagucccacacacucuggagcaacggcguccuagaguccgagaugauuaucccgaagaucuacgggggcccgaucagccaacacaacuaccgucccggguacuucacgcagaccgcuggacccuggcaccuggggaaguuggagcuggauuucgaccugugugaggggaccacggugguuguagacgagcacugcggcaaccgggguccgucacuccgcacaaccaccgugacuggaaagaucauccacgaguggugcugccggagcugcacgcuuccgccgcuaagauucaaaggggaagauggcuguugguacgggauggagaucagaccugugaaagagaaggaggagaaccucgugaagucuauggugagcgccggcagcggcgaaguagauuccuucagccuggggcuguugugcaucuccauuaugaucgaggagguaaugcggagccgguggucccgcaaaaugcugaugacgggcacccucgcugucuucuuucuucugaucauggggcaguuaaccuggaacgaccucauaagguccugcaucauggugggagccaacgccuccgaccgaauggguaugggcacgacuuaccuggcucugauggccaccuucaagaugcgcccgauguuugccgucggccuccuguuccggcgccucaccagccgggagguccuccugcugacgaucgggcucucuuuaguugccagcguggaguuacccaauucccucgaggaacucggugaugggcuggccaugggcaucaugauccucaagcugcugaccgacuuccagagcuaccagcucugggcuaccuuacuguccuugaccuucauuaaaaccacauucagcuuacacuacgcauggaaaaccauggccauggugcugaguaucgucucacuccuuccucugugucucuccaccaccucacagaaaaccaccuggcuucccgugcugcucgggagucugggauguaagccgcugaccauguuccuuaucgcggagaauaaaaucuggggcagaaagagcuggccccuaaacgaaggaaucauggcggugggcaucgucuccauacuacucuccucguuacugaagaaugacgugccccucgcagggccccugauugccggcggcaugcugaucgccugcuaugugauaagcggcagcuccgccgaccugagccuggagaaagcggcggaggucuccugggaggaggaggcugagcacucuggagcuucccacaacauccuagucgaggugcaagacgaugggaccaugaaaaucaaggacgaggagcgggacgacacacucaccauccugcugaaggccacccuccuggcggucaguggcguguacccgcuguccaucccagccacccucuuuguuugguacuuuuggcagaagaagaagcagcgcucagggguccugugggacacgcccaguccuccagagguggagcgggccgugcuggacgacggaauauaccguauaaugcagcggggccugcucgggcgcucucaggucggcguggggguguuccaggagaacgucuuucacacgauguggcacgugacucggggcgcugugcugauguaccaggggaaacgccuggagcccuccugggccagcgucaagaaggaccucaucucuuacggcggcggguggcggcugcagggcagcuggaacacuggagaggaagugcaggugaucgcggucgagcccggcaagaaccccaaaaacgugcagacggcaccaggcaccuucaagaccccggagggcgaggugggcgccaucgcccuggacuucaagccugggacauccggcagccccaucgucaacagggagggcaaaaucgucgggcuguacggcaacgggguggucaccacuagcggcaccuacgugucggccaucgcucaggcaaaggccucacaagaaggaccgcugcccgaaaucgaggaugagguguuccguaagcgcaaccugaccaucauggaucuccaccccggcagcgguaagacgcggcgcuaccuaccggccaucguucgggaggcuauuaaacgcaagcugcggacccucauccuggcccccacccgcgugguggccagcgagauggcagaggcccugaaaggcaugcccauccgcuaccaaaccacggcggucaaguccgagcacaccggccgggagaucgucgaccucaugugccacgcgaccuucacgaugcgccugcugagcccggugcgggucccgaacuacaacaugaucauuauggacgaggcccauuucacggaucccucuagcaucgccgcccgcggguauaucuccacgcggguagggaugggugaagcagccgccaucuucaugaccgcuacuccgcccggcagcguggaagccuucccacaguccaacgcggugauucaggacgaggagcgcgacauccccgagcgcucuuggaacuccggguaugaguggauuaccgacuuccccgggaagaccgugugguuuguacccagcaucaagagugggaacgacaucgccaacugucuccgcaagaacgggaagcggguaauucagcugagccgcaagacuuuugacaccgaguaccagaagacgaaaaauaaugacugggacuaugucgugaccaccgacauaucugagaugggagcuaacuuucgggccgaucgcgucauagacccgcggcggugcuugaagcccguuauacucaaggaugggcccgagcgcgucauccuggcggggcccaugccggugaccguggccagcgccgcccaacgcagagggcgcaucggucggaaccacaacaaggagggcgaucaguacaucuacaugggucagccacugaacaacgaugaggaccacgcccacuggacggaggccaagaugcucuuggacaauaucaacacccccgagggcaucauucccgcccuguuugagccggagcgcgagaagagcgccgcuaucgacggcgaguaccgccuccggggcgaggcgcgaaagaccuuuguagagcugaugcggcgcggggaccugcccguauggcucagcuacaagguggcgucggagggcuuccaauacuccgacaggcguuggugcuuugacggggagcggaacaaucaagucuuggaggagaacauggacguggaaaucuggaccaaggagggcgagcgcaagaagcugcggccgcgcuggcucgacgccaggacuuacagcgacccucuggcccugagagaauuuaaggaauuugcagccggccggcgcagcgugagcggggaccugauucuggagaucggcaagcuaccccagcaucucacccagcgagcgcagaacgcacuagauaaccuggucauguugcacaauuccgaacagggcgggcgggcguaccggcacgccauggaggaguuacccgacacuaucgaaacccucauguugcuggcccugaucgcugugcucaccggaggggugacccuuuucuuccuaagcggucgugggcucggcaagaccuccaucggucugcuuugugucauggccagcuccgcccuacuguggauggccucgguggagccccacuggaucgcagccuccaucauccuggaguucuuucuaauggugcuacugauacccgagccagacaggcagcguacuccccaggacaaccagcucgcauauguugugaucgggcuacuguucaugauccucaccguagcagccaacgagaugggacugcuggagacgacaaaaaaggaccuugggaucgggcacgucgcgguugagaaccaccaccacgcuaccaugcucgacguugaccugcaccccgcgagcgccuggacgcucuacgccgucgcgacgaccaucaucaccccgaugaugcgccacacuauagagaacaccaccgcaaacaucucccucaccgcaaucgccaaccaagccgcaauucugaugggucucgacaagggcuggccgaucagcaagauggacaucggcgugccccugcuggcccucgggugcuacucgcagguaaacccccugacccugaccgcggcuguacucaugcugguagcgcacuacgccaucaucggcccggggcugcaggccaaggcaacccgcgaggcccagaagcgcaccgcggcuggcaucaugaagaacccgaccgucgacgggaucgucgccaucgaccuugaccccguaguguacgaugccaaguucgaaaagcagcugggccaaaucaugcugcuuauccugugcacgagccagauccugcucaugcggaccaccugggcccugugugaauccaucacccuggcgacgggcccucucaccaccuuaugggaggggucaccgggcaaguucuggaauaccaccaucgccgucuccauggccaauauauuccgcgggaguuaccuggccggggccggccucgcuuucagccugaugaagucccucgggggcgggcggagagggaccggggcccagggugagacccugggcgagaaauggaagaggcagcucaaccagcugagcaaguccgaguucaacacuuacaaaagaagcgggaucauggagguggaucgguccgaggcaaaggaggggcuccgccgcggggaaaccaccaaacacgccguguccagaggcacugcgaagcugcgaugguuugucgagcgcaauuuagugaagcccgaggggaaggucauugaccugggcugcggcaggggcgguugguccuacuacugcgcugggcucaagaaggucaccgaggugaagggguauacgaagggcggcccgggccacgaagaacccaucccgauggccacguacggguggaaccuugugaagcugcacuccggcaaagacguguucuucaucccgcccgagaagugcgacacccuccugugcgacaucggggaauccucccccaacccgaccauugaggagggccgcacgcugcggguacuaaagaugguggagcccugguuacgcgggaaccaguucugcaucaagauacuaaacccauacaugccgagugucguggagacccucgagcagaugcagcggaaacacggaggcaugcuggugcgcaacccgcucagccguaacagcacccacgagauguauugggucagcugcgggaccgguaauaucguguccgccgugaacaugacgagccgcaugcuccugaaccgcuucacgauggcacacagaaagccgacuuacgaacgcgacguggacuuaggagccggaacacggcacguggccguggaacccgaggucgcaaaccuugauauaaucggucagcgcaucgagaacauaaagcaugagcauaagucgaccuggcacuacgacgaggauaaccccuacaaaacuugggccuaccacgggagcuaugagguaaaaccguccggcagcgccagcagcauggucaacgggguggugaaguuacugacuaagcccugggaugugauaccaauggugacccagaucgcgaugaccgauacgacucccuucggccagcaacggguguucaaggagaaggucgacacccgcaccccgaaggcgaagcgcggaacggcccaaaucauggaggugaccgcccgcugguuguggggcuuucugucccggaacaagaaaccuaggaucugcacccgggaggaguucacccgcaaggugcgguccaaugccgcgaucggcgcuguguucguugaugagaaccaguggaauagcgccaaggaggcgguggaggacgagagguucugggaucugguccacagagagcgagagcuccacaagcagggcaagugugcgaccuguguauacaacaugaugggcaaacgugagaagaagcugggagaguucgggaaggccaagggcucccgggccaucugguauauguggcuaggcgcucgguuccucgaguucgaggcccugggcuucaugaacgaagaucacugguucagcagagaaaauucccucagcgggguugagggcgaggggcuucacaagcugggcuacauucugcgggacaucuccaaaaucccagguggcaacauguacgcggacgauaccgccggcugggacaccaggaucaccgaggacgacuugcagaacgaggccaagaucacggauaucauggagccggaacacgcccuguuagcgacaucgaucuucaagcuaaccuaccagaacaaggucguacgagugcagcggcccgcgcgcaaugguaccgucauggacgugaucuccaggcgcgaucaacgggguagcggccaagugggcacauacggccugaacaccuucaccaacauggaagcccagcucauccgccaaauggaguccgaggggauuuucaguccuucugagcucgagacccccaaccuggccgaacggguccuggacuggcucgagaaacacggcguggaacgccugaagcggauggccaucagcggggacgauuguguggucaagcccaucgaugaccguuucgccacggcgcuguccgcccucaacgacaugggcaaggugcggaaggacaucccucaaugggagcccagcaaaggguggaacgacuggcagcaagugcccuucugcucucaucauuuucaccagcugaucaugaaagacggccgcgagaucguugugccgugccguaaccaggacgagcuggugggccgcgcccgggucucucagggcgcgggauggagccuccgggagacggccugucuggggaaguccuacgcucaaauguggcagcugauguacuuccauagacgagaccuccgguuggcagccaacgcuaucuguagugcggugcccguggauugggucccgaccaaccgcaccacaugguccauccacgcccaccaccaguggaugacgaccgaagacaugcugucgguguggaaucgaguguggauagaggaaaauccuuggauggaagacaagacacacaucuccagcuggggugacgucccuuaucucgggaaacgggaggaccagugguguggcucguugaucggccugaccgcccgcgccaccugggccacaaauauccagguggcaaucaaccaggugcggcgguugaucgggaacgagaacuaccuggacuacaugaccagcaugaagcgguucaagaacgacuccgacccugagggagcucugugguga

SEQ ID NO: 24139 - RNA, 9879 nt, Artificial Sequence
  derived and/or modified CDS sequence (opt11) from DENV-1__FJ024448__SS-prME
agugugacaaugcugcucaugcugaugcccaccgcccuggccuuccacuuaacgacccgaggcggggaaccgcacaugaucgugagcaaacaggagcggggcaagucuuugcuguucaagacgagcgcgggggugaacaugugcacccucaucgcuauggaccugggcgagcuaugcgaggacaccaucacauacaaguguccccgcauuaccgagaccgagccugaugacguggauugcuggugcaaugccacggacaccugggucacauaugggaccuguagccagacgggcgagcaccggcgcgauaagcgguccguggcccucgcgccccacguuggucuggggcuggagacgcgcacggagacuuggaugagcuccgagggcgccuggaagcagauccagcgggucgagacgugggcgcucagacaccccggguucaccgugaucgcucuauuucuggcacacgcgauaggcacuagcaucacccaaaaggggaucaucuucauucuccugaugcuggugacgcccuccauggccaugagaugugucggcaucgguagccgagacuucguggaagggcuauccggcgcuaccuggguggacguggugcuggagcacggguccugcgugacuaccauggccaaggacaagcccacgcuggacaucgagcugcugaaaaccgaagucaccaaccccgccguacugcggaagcucuguaucgaggcaaaaauauccaacaccacgacugacagccggugcccgacccagggagaggccacucugguggaggagcaggacgccaacuucgucugucggcgaacguucguggaccgaggcuggggaaacggcugcgggcuguucggcaaagggucccucaucacgugcgccaaguucaagugcgugaccaagcuggaggggaagaucguccaguacgagaaccuuaaauacagcgugaucgugaccguccacacgggcgaccagcaccaaguugggaacgaguccaccgagcacgggacaaccgccaccauuacgccccaggcgcccaccacggagauccagcuaaccgacuacggugcccugacucuggacugcagcccccgcaccggccucgacuucaacgagaugguacuguuaacaaugaaggagaaauccuggcucgugcacaagcagugguuucuggaccuacccuuacccuggaccuccggggccucgacgucgcaggaaacguggaaccggcaggaccugcuggugaccuucaagaccgcacacgcuaagaagcaggaggucguggugcucggcagccaggagggcgcgaugcauacggcgcugacuggcgccaccgaaauccaaaccuccggcacgacuaccaucuucgccgggcaucuaaaaugccgccucaaaauggacaagcugacccugcggggaaugagcuacgucaugugcacgggguccuucaagcucgagaaagagguggccgaaacccagcacggaaccguacuuguccagaucaaguacgaggggaccgacgcccccugcaagauccccuucucaacccaggacgagaagggagugacccagaacggucgccuaaucaccgccaacccgaucgugacagacaaggagaagcccgucaacauagaggcugagccgccguuuggagaguccuacaucgugauaggcgccggcgagaaggcguugaagcucuccugguuuaagaagggguccagcaucgggaaaauguucgaggccacagcccgcggggccaggcgcauggccauccugggcgauaccgcgugggacuuuggguccaucggcggcguguucaccagcgucgguaagcuggugcaucagaucuuuggcaccgccuacgggguguuauucuccggcgucucuuggacgaugaagaucgggaucggcgugcugcucaccuggcucgggcugaacucucggagcaccucccugagcaugaccugcaucgccguggggcucgucacgcuguaccugggcguuauggugcaggccgauuccggaugcgucauaaacuggaagggccgagagcugaagugcgggaguggcaucuucgugaccaacgaggugcacacguggaccgagcaguacaaguuucaggccgauucccccaagcggcuguccgcggccaucgggaaagccugggaggagggggucugcggcaucagaagcgcgacucggcuggagaacaucauguggaagcagauauccaaugagcucaaccacauccugcuggagaacgacaugaaguucacuguggugguaggggacguggcgggcaucuuagcgcaggguaagaagaugauccgcccccaacccauggaacacaaguacagcuggaagaguuggggcaaggccaagaucaucggcgccgacgugcagaacacgaccuucaucaucgacgggcccaauaccccggagugccccgacgaccagagggcguggaacaucugggaggucgaggacuacggcuuugggauuuucacgacuaauaucuggcugaaauuacgcgacagcuacacccaagugugcgaccaccggcuuauguccgcggccaucaaggacucgaaggccgugcacgccgacaugggcuacuggaucgaguccgaaaagaacgagacuuggaagcuggcccgcgcgagcuucaucgaagucaagacgugcaucuggcccaaaucccacacccuguggucgaacggcgugcucgaauccgagaugaucauccccaagaucuacgggggcccgaucagccagcauaacuaccggcccggguacuucacccagacugcaggccccuggcaccuggggaagcuugaauuggacuucgaccugugcgaggggacgaccguggucguugacgagcacugcgguaacagagggccgucccugcggaccaccacggugacuggcaagauuauucacgaguggugcugucgcaguugcacucugccuccccuccgguuccgcggggaggacggaugcugguacgggauggagauccggcccgucaaagagaaggaggagaaccugguuaagucaauggugagcgccgguagcggcgaggucgacuccuucagcuuagggcugcugugcaucuccauuaugaucgaggaggugaugcgcagucgguggucccgcaagaugcuuaugaccggcacccucgccguguucuuccuacucaucauggggcagcuuaccuggaacgaccugauacggcuaugcauuauggucggagccaaugcgucugaccggauggggauggggaccaccuaccuggcccugauggcaaccuucaagaugcgcccgauguucgccgugggccuacuguucaggcgccucacuucccgggaggucuuacugcugacuaucgggcuuucgcucgucgcaagcguggagcugcccaauagcuuggaagaguugggcgacgggcuggcaaugggcaucaugauccucaagcugcugaccgacuuccaaucccaucagcucugggcaacgcugcugagccucacuuucaucaagacuaccuucucucugcacuacgccuggaaaacgauggccaugguccugagcaucgugucccucuucccccugugccuaagcaccaccucccagaagaccacguggcuccccguccugcugggcucgcucgggugcaagccgcuuaccauguuccuuaucgcggagaacaagaucuggggccggcgguccuggccccucaacgaagggaucauggccgucgggauagugagcauccuucugagcucccuccugaagaacgacguaccccuggccggcccccucaucgccggcggcaugcuuauugccugcuacgucauuucaggcuccagcgcggaccugagucucgagaaggcagccgaggugagcugggaggaggaggccgagcauuccggcgcuagccacaacauccuaguggagguccaggacgacgggaccaugaagaucaaggaugaggaacgcgacgacacccugaccauccuccugaaggcgacgcugcucgccgccucuggcguguacccgcugagcauccccgcaacccuguucguuugguauuucuggcagaagaagaagcagcgguccgggguccucugggacaccccgagcccgccggaggucgagcgcgccgugcucgacgacggcaucuacaggaucaugcaacgcggccuucuggggcggucccaggucggcguggguguguuccaggagaacguauuccacaccauguggcacgugacgcgcggugcugugcucauguaccaggggaagagacuggagccuaguugggcguccgucaagaaggaccugaucagcuaugguggaggguggcgccuucaggguucauggaacaccggggaagaagugcaggugaucgccguagagcccggcaaaaaccccaaaaacgugcagaccgccccaggaaccuuuaagacuccagagggcgaggugggugccaucgcguuggacuucaaacccgggaccaguggcucgcccaucguaaaccgugaggggaagaucgugggccuguacgggaacggaguggucacuacaucggggacguacgugagcgccaucgcccaggccaaggcgucccaggaagggccguugcccgagaucgaggacgagguguuccgcaagcggaaccuaacuaucauggaccuacaccccggcagcggaaagacccgccgguaccucccggcgaucgugcgcgaggccaucaagcgcaagcugcggacccucauccucgcccccacccgcgugguggccuccgagauggcggaggcucugaagggcaugcccauccgguaucagacuacagccguaaaaagugagcacaccgggaaggagaucguggaccugaugugccacgccacguuuaccaugcgccuccuguccccggugcgggucccgaacuacaacaugaucauuauggacgaggcccacuucaccgaucccagcuccaucgcggcccgcggguacauuagcacucgggugggcaugggagaggccgccgccaucuucaugacggcuacgccgcccggcuccgucgaggccuucccgcagagcaacgccguaauucaggacgaggaacgcgacaucccugagcggucuuggaacagcggguacgaguggaucaccgacuuccccggcaagaccgugugguucguacccuccaucaaaagcgggaacgacauagccaacugccugcgcaaaaacgggaagcgggucauccaauuaucccgaaaaacguuugacaccgaguaccagaagaccaagaauaacgacugggacuacguggugacgacggacaucagcgagaugggcgcgaauuuuagagccgaucgcgucaucgacccgcggcgcugccugaaaccggugauacugaaggacgggcccgagcgggugauccucgccggccccaugccgguaacgguggccagugccgcgcaacgccgggggcggaucggccguaaucauaauaaagagggcgaccaauacaucuacaugggacagccccugaacaacgacgaggaccacgcccacuggaccgaggccaagauguuacucgacaacaucaacacccccgaggguaucauccccgcccuguucgagccggagcgggagaaauccgccgcuaucgacggggaguaccgccugcgcggcgaagcccgaaagacguucgucgaacucaugcggcguggggaucugcccguguggcugucuuacaagguggccagugaggguuuccaguacagcgauagacgcuggugcuucgacggggagcggaauaaccagguccucgaggagaauauggacguggagauuuggaccaaggagggggagcgcaagaaacugcggccccgcuggcuggacgccagaaccuauuccgacccccucgcccugcgcgaguucaaggaguucgccgcgggccggcgcagcguguccggggaccuuauccucgagaucggcaaacucccacaacaccugacccagcgggcccaaaacgccuuagauaaccuggucaugcugcauaacagcgagcagggagggcgcgcguaccggcaugcaauggaggagcuaccugacacgaucgagaccuuaaugcugcucgcccugauugccgugcuaaccggcggagugacccucuucuuccuuucgggccgcgggcuugggaagacgagcauuggccuccuaugcgucauggcuuccagugugcugcucuggauggcauccguggagccgcacuggaucgcugcauccaucauucuagaguucuuccugaugguccucuuaauccccgagccggaucggcagcgcacgccccaggacaaccagcuggccuauguggugaucgggcuccuguucaugauccugaccguggccgcuaaugagaugggccuucuggagaccacaaagaaggaccuggggauuggccacguggccguggaaaaccaucaccacgccgccaugcucgaugucgaccugcaccccgcuagcgcguggacgcuguaugccguggcuaccaccaucaucacacccaugaugcgacacacgaucgagaauaccaccgccaacaucagccuuaccgccaucgcaaaccaggccgccauccuaauggggcuggacaagggcuggcccaucuccaagauggacaucggugugccccucuuagcgcuggggugcuacagccaggucaacccccucacgcugaccgcugcugugcugaugcucguggcccacuacgccaucaucggcccggggcugcaagccaaggcgacccgggaggcccagaaacgcaccgccgcgggcaucaugaaaaaucccacggucgacgguaucgucgccaucgaccuggacccuguggucuaugacgcgaaguucgagaagcaacucggccagaucaugcugcugauccucugcaccucccagauccugcugaugcgcaccaccugggcgcucugcgagagcaucacgcuggccaccggcccccugaccaccuuaugggaaggguccccgggcaaguucuggaacacgaccaucgcugugagcauggccaacaucuuccgcggcuccuaccuggcgggcgccggccuggccuucagccucaugaagucccucgggggcgggcgucgcgggaccggagcccagggcgagacccugggagagaaauggaagcggcagcucaaccagcuauccaaguccgaguuuaacacuuacaagagauccgguaucauggagguugaccggagcgaggcgaaggagggccugaagaggggggagaccaccaagcacgcugucucccggggcaccgccaagcuccgcugguuuguugagcggaaccuggugaagcccgaggggaaggucaucgaccugggcugcggccgcgggggcuggagcuacuacugcgcggggcugaagaaggugacagaggugaaaggcuacaccaagggcggccccggccacgaggagcccaucccgauggccaccuacggcuggaaccucguuaaacugcauuccggcaaggacguguucuucauaccuccagagaagugcgacacccugcucugcgacaucggggagagcuccccuaacccgacgauagaggagggucggacucugcgcgugcuuaagaugguagagcccugguugcgggggaaccaauucugcaucaagauccugaaucccuauaugcccagcgugguggagacccuggagcagaugcagaggaaacacggcggaaugcugguccggaacccucuaucccgcaacagcacccacgagauguacuggguauccugcgggaccgggaacaucgugagugcugucaacaugacgucccgcauguugcucaaccgauucaccauggcccaccgcaagcccaccuaugaacgggacguggaccugggggcgggcacccggcacguggccgucgaacccgaaguggcaaaccuggacaucaucggccagcgcaucgagaacaucaagcacgagcauaagucgacguggcacuacgaugaggauaacccuuauaagacaugggcguaccacggguccuacgaggugaagccgaguggguccgccagcagcaugguaaacggggucgucaaacuccucaccaagcccugggacgucauccccaugguuacccagaucgcuaugacggacaccacacccuucggccagcagcgcgucuuuaaggagaagguggacacccggacgccgaaagccaagcgcgggaccgcccagaucauggaggucaccgcgaaauggcuguggggcuuccucucccggaacaagaagccccgcaucugcacgcgggaggaguucacgcgcaagguccggagcaacgccgccaucggagcaguguucguugaugagaaccaguggaauuccgcgaaggaggcaguugaggacgaacgcuucugggacuuggugcaccgggagcgcgagcuccacaagcaagggaagugcgcgaccugcguauacaacaugaugggcaaacgggagaagaaguugggcgaauucgggaaggccaaggggucucgcgccaucugguacauguggcugggcgcgcgauuccuggaguucgaggcuuugggcuucaugaaugaggaccauugguuuuccagagagaacucacuguccggggucgagggcgaggggcugcacaagcucggcuacauccugcgggacaucucgaagaucccagggggcaacauguaugccgacgacaccgcaggaugggacacccgcaucacggaggaugaccugcagaacgaggcccgcaucacggacaucauggaaccggagcacgcgcuccuggccaagaguaucuucaagcugaccuaccagaacaaggucguucggguccagcgccccgccaagaacgggaccgugauggacgugauaucuagacgcgaccagcggggcaguggccagguaggaacguauggccucaauaccuucaccaacauggaggcccagcugaucagacaaauggagagcgaggggaucuucucccccagcgagcuugaaacucccaaccucgccgagcgggugcuagacuggcuggagaaguacggcguggagcgucucaagcggauggcgaucaguggcgacgacugcgucguaaagccgauagacgaccgcuucgccacggcccugaccgcccucaacgacauggggaagguucguaaggacaucccccagugggagccaagcaagggcuggaacgacuggcagcaaguccccuucugcucccaccacuuccaccaacucaucaugaaggacggccgggagaucguggugccgugucggaaccaggacgagcuggucggccgcgcccgugugucacagggggcgggguggagcuuacgcgagacugccugucuggggaaguccuacgcacagauguggcagcuuauguacuuccaccggcgcgaccugcgccucgccgcgaacgcaaucugcagcgcugugcccgucgacuggauccccacgucccggacgacguggagcauccacgcgcaucaccaguggaugaccaccgaggauaugcugucugucuggaaccgcguguggauagaagagaaccccuggauggaggacaagacgcacaucagcuccuggggcgacgucccauaccuggggaagcgggaggaccaauggugcggcagccucaucggccugaccgcgcgcgccaccugggccaccaacauccagguggccaucaaccaaguccggcgccuuaucggaaacgagaacuaccucgacuacaugacauccaugaagcgguuuaagaacgagucagaucccgagggcgcucugugguaa

SEQ ID NO: 24140 - RNA, 9879 nt, Artificial Sequence
  derived and/or modified CDS sequence (opt11) from DENV-1__FJ182026__SS-prME
ucagugacaaugcugcugaugcugaugccgaccgcccuggcguuccaucucacaacccgaggcggggagccccacaugauugugagcaagcaggagcggggcaagagccuacuguucaagacaagcgcaggggugaacaugugcacccucaucgcgauggaccucggcgagcugugcgaggauaccaugacguacaagugcccacggaucacagagaccgagccagacgauguggacugcugguguaacgccacagacacgugggucaccuacgggacguguagucagacgggcgagcaccgaagggacaagcggucuguggccuuggcgccccaugugggccuggggcuggagaccagaaccgaaaccuggaugucgucagagggcgcuuggaagcagauccagcgggucgagacgugggcccuacggcaccccggguucaccguaaucgccuuauuccuagcccaugcgauaggaaccucuaucacccagaagggcaucaucuuuauccuacuaaugcuggugacgcccuccauggccaugcgaugcgucgguaucggcucuagggacuucguagaggggcucucuggagccaccuggguggaugucgugcuggagcacggaagcugcgucaccaccauggccaaagauaaaccgacguuagacaucgagcuccugaagacagaggucaccaaccccgccguacugagaaagcucugcauugaggcgaagaucuccaauaccacgaccgacagccgcugcccaacccagggcgaggccacccucgucgaggagcaggaugccaacuucgugugucggcgcacguuuguggaccguggcugggggaacggcugcgggcuguucgguaaggguagccucaucacgugugccaaguuuaagugugugacuaagcuggagggcaagaucguccaguacgaaaaccuaaaauacagcgugaucgugaccguacacacgggcgaccagcaccagguggggaacgagagcacagagcacgguacgacggccaccauaacgccccaggcgcccaccacagagauucagcucaccgacuacggggcccugacguuggacugcucacccagaaccggccuugacuucaaugagaugguccuucugaccaugaaggagaaaucuuggcuugugcacaaacagugguuccuagaccugccccucccauggaccagcggggccagcacuucgcaggagacauggaaccggcaagaccugcuugucaccuucaagacggcccaugcgaagaagcaggagguggugguacuaggcagucaggagggcgcuaugcacacagcccugacgggggccaccgagauccagaccuccgggacgaccaccaucuucgccgggcacuugaagugccggcucaaaauggacaaguugacccugaaggguaugucuuacgucaugugcacuggguccuucaagcuugaaaaggagcuggccgaaacccaacacggcacagugcuggugcagaucaaguacgaggguacagacgcgccuugcaagauccccuucagcacgcagaacgagaaaggggucacccaaaacggaagguuaaucaccgccaacccgaucguaaccgacaaggagaaacccgucaacauagaagccgagccgcccuucggggaguccuacaucgucaucggggccggcgagaaggcgcucaagcugagcugguucaagaaggggucuaguaucgggaagauguucgaggccacggcccgcggcgcccggcgcauggccauccugggcgacaccgcaugggacuucgggucgaucggcggcguauucaccaguguggggaaacucguacaucagaucuucggcacagcuuacggcgugcuguucucgggcguaaguuggacgaugaagaucgggaucgguguccugcuaaccuggcugggucugaauucccgcagcaccucccucagcaugaccugcaucgccguggggcuggugacgcuguacuuagggguaaugguucaggccgauuccgggugugucaucaacuggaagggccgggagcugaagugcgguagcggcaucuuugucacgaaugaggugcacaccuggaccgaacaguacaaguuccaggccgacucaccgaagcgcuuguccgcggccaucgggaaggcgugggaggagggggugugcggcauacggagcgccaccagacucgaaaacaucauguggaagcaaaucuccaacgagcugaaccacauucugcuugagaacgacaugaaguucacggucguggugggggacguggccggaauccuggcgcaggggaagaagaugauccggccccagcccauggaguacaaguauaguuggaaguccuggggcaaagcuaagauaaucggagccgauguccagaacacgaccuuuaucauagacgggcccaacaccccagagugucccgacgaucagcgcgcguggaauaucugggagguggaggacuacggcuucggaaucuucacaaccaacauuuggcugaagcuccgggacagcuacacccaggucugugaccacagauugauguccgcggccaucaaggacagcaaggccguccacgccgacaugggcuacuggaucgagucggaaaagaacgaaacauggaaacuggcccgggcgucguucaucgaggugaagacgugcaucuggccgaagucgcacacccuauggucuaacgggguccuggaguccgagaugaucauacccaagaucuacggaggcccgaucagccagcacaacuaccgccccggauauuucacacagaccgccggccccuggcaccuagggaagcucgaguuagacuucgaccugugcgaaggcacgaccgugguggucgacgagcacugcggcaaccgugggccuagucuccgcacgacuacggugacuggcaaaaucauccacgaguggugcugucggaguugcacccuaccuccucugcgcuuccgcggggaggaugggugcugguacgggauggagauccgccccgugaaggagaaagaggagaaccucguaaaauccauggugucggccggcagcggcgagguggacucauuuucauuaggguuauugugcaucucaaucaugaucgaggaggucaugcggagucgcuggucacggaagaugcugaugaccggaacgcuggccgucuuuuuccuccugaucauggggcagcuuacguggaacgacuuaauccggcuaugcaucauggugggagccaacgcgagcgaccgaauggguauggguaccaccuaucuggcguuaauggccacguucaagaugcggccgauguuugccgugggccugcucuucaggcgccucaccucccgugaggugcuguuauuaacgauaggguugagcuuggucgccuccgucgagcuccccaacagcuuggaggaguuaggagauggguuggcgauggguaucaugauacugaagcuucuaaccgacuuccagucccaucagcugugggccacgcugcucagcuuaaccuuuauaaagacgaccuucuccuuacacuacgccuggaagacgauggcgaugguccucagcaucgucucccuguucccccugugcuuaagcaccaccucccaaaagaccacguggcugcccgugcuguuaggaagccugggguguaagccgcuuacuauguuccucaucgccgagaacaagaucuggggcagacgcuccuggccccugaacgaagggaucauggccgugggcaucgucagcauccugcucucaucccuguuaaagaacgacgugccccucgccgggccucuuaucgccggagggaugcugaucgcgugcuacgugauuucuggguccagcgcggaccucucccuggagaaggccgccgaggucagcugggaagaggaggccgagcacagcggcgccagccauaacauccugguggaagugcaggaugacggaaccaugaagaucaaggacgaggagcgggacgacacccucacgauccugcuuaaggcgacacuccuggccguguccggaguuuacccgcugagcauucccgccacccuauucgugugguacuucuggcagaaaaaaaagcagcgcuccggggugcuuugggacacccccagcccgcccgaggucgaacgggcagugcuugacgacggcaucuaccgcauuaugcagagaggacugcucgggcgcagucaagucggcguggggguuuuccaggagaaugucuuccacaccauguggcacgucacccggggcgccgugcugauguaccaggguaagcgccuggaaccgaguugggcguccgucaagaaggaucucauuagcuauggcggaggguggcgucugcagggcuccuggaacgccggggaagagguacaggugaucgccgucgagcccggcaaaaaccccaagaacgugcagaccgccccugggaccuuuaagacccccgaaggggaggugggcgccauugcgcuggacuucaaacccgggacguccggcucccccauugucaaucgggaagggaagaucgugggccucuacggcaaugggguugucaccacgagcggaaccuacgugagcgcaauugcccaggccaaggcgucccaggaggggccgcugccugaaaucgaggaugagguuuuccggaaacgcaaccugaccaucauggacuugcauccaggaagcgggaagacgcggcgcuaucugccggcuaucgucagagaggccaucaagcgcaagcuucgcacccucauccuggcccccacccgggugguggcuuccgaaauggcggaggcccugaaaggcaugccgauccgcuaccagacgaccgccgucaagagcgagcacaccggcaaggaaaucguugaccugaugugccacgccacuuucacgaugcggcugcugucgcccgugcgcguccccaacuacaacaugaucauaauggacgaggcccacuucaccgaccccagcuccaucgcggcccgggguuacauaagcacccgcguggggaugggggaggccgccgccaucuucaugacagcgaccccgcccgguuccguggaggcguucccgcagaguaacgccguaauccaggacgaggagagggacauacccgaacgcuccuggaacucaggguacgaguggauuaccgacuuccccggaaagacugugugguucgugcccuccauaaagagcggcaacgacaucgcuaacugccuccgcaagaacgggaagcgugucauccagcugucgcguaaaaccuucgauacggaguaccagaagaccaaaaacaaugacugggacuacguugugacuacugacaucagugagaugggcgcgaauuucagagccgaccggguaaucgacccgcgccggugccugaaacccgugauacugaaggacgggcccgagcguguaauauuggccggccccaugccgguuaccguggccuccgccgcgcagcgccgcgggaggaucggccgcaaccacaacaaggaaggcgaccaguacauuuacaugggucagccccucaacaacgacgaggaccacgcccacuggacugaggccaagaugcuccuggacaacauuaacaccccugagggcaucauccccgcccuguucgagccggagcgggaaaaguccgccgcgaucgacggggaguaccgacuccgcggcgaggcccgaaaaaccuuuguggaacugaugcgcaggggugaccugcccguguggcucucauacaagguggcaagcgagggcuuccaguacucugaccgccgauggugcuucgauggagagcgcaacaaccagguccuggaggagaauauggacguugagaucuggacuaaggaaggggagaggaagaaguuaagaccccggugguuggacgcucgcaccuacuccgacccccuggcgcuccgggaguucaaggaguucgcugccggccgccggagcgugucaggggaccucauccuggaaaucggcaagcugccgcagcaccugacccaacgcgcccagaaugcccuggacaacuuagucaugcuccacaacagcgaacagggcgggagggcguaccgccacgccauggaggagcugcccgacaccaucgaaacguugaugcuccuggcccuaaucgccgugcuaaccggcggcguaacacuuuucuuccuguccggccgaggacucggcaagacuagcaucggccugcuuugcgucauggccuccuccgugcuccuguggauggcguccguggagccccacuggaucgccgcuucuaucauacuggaauucuuuuugaugguccuuuuaauccccgagccggaccgucagcggacgccacaggauaaccagcucgccuacguaguuaucgggcugcuguucaugauucucacggucgcggcgaacgagaugggucuacuggagaccaccaagaaggaccucggaauaggccacguggccguggagaaccaucaccacgcggcgaugcuggacgucgaccuccauccggccuccgcguggacacucuaugccguggccacgaccaucaucacaccgaugaugcgccacacaauugagaauacgaccgccaacaucagccugaccgccaucgcgaaccaagccgccauacugaugggacuugacaagggcuggcccauuuccaagauggacaucggcguaccccugcuggcucucgggugcuacagccaggucaauccccugacccugacggcugccguucucaugcucguggcccauuacgccaucaucggcccggggcugcaggccaaggcgacccgggaagcucagaagcggacggccgccggcauaaugaagaaccccaccgucgacgggaucguggcgaucgaccuagacccggucgucuaugacgcaaaauucgagaaacagcuggggcagaucaugcugcuuauccugugcacgucccagauccugcucaugcgcacgaccugggcgcugugcgaaagcaucacccuggccacgggcccccucaccacccuuugggaaggguccccgggcaaguucuggaacaccacuauagccguaagcauggcgaauauauuccgggggucguaccuggcgggggcuggcuuagcauucagccuuaugaaguccuuagggggcggccgccguggaacaggagcacagggcgaaacccucggcgagaaguggaagcgccagcuuaaccaacuguccaagagcgaguucaacaccuacaagcggucugggaucauggaaguggaccgcagcgaagcgaaggagggccucaagcgcggggagacgacaaaacacgccgucucccgaggcaccgccaagcugcgcugguucguggagcggaaccuggugaagcccgagggcaaggucaucgaccugggcugcggccgcgggggcuggagcuauuauugcgccggccucaaaaaagugaccgaggugaaaggcuacacgaagggagggcccggccaugaggaacccauuccgauggcgaccuacggguggaaccuagucaagcuacacuccgggaaggacguguucuuuaucccgccggagaaaugcgacacgcuccugugcgacaucggcgaaagcucccccaacccgaccaucgaggagggccgcacgcugcgggugcuuaagaugguagagcccuggcuuagagggaaccaguucugcaucaagauccucaacccauacaugccaagcgugguggagacccucgagcagaugcaacggaagcacggcgguauguuaguccgcaauccguuauccagaaacagcacgcacgagauguacugggucuccugcgggaccgguaacaucgugagcgcggucaacaugacgucccgcaugcuucucaaccgcuucacgauggcccaccggaagcccaccuaugaaagggacguagaccugggggccggcacccgacacguggccguagagcccgaggucgccaaucucgacauaauuggccaaagaauagagaacaucaaacacgaacacaaaaguaccuggcacuaugacgaggacaaccccuacaagacgugggcguaccauggcuccuacgaagugaaacccagcggcuccgccagcagcauggugaacgggguggucaagcuucugacaaaacccugggacgugauacccaugguaacccagauagccaugaccgacacaacccccuucggucagcaacgggucuucaaagagaagguggacacccggaccccgaaggccaagcgagggacggcgcagaucauggaagugaccgcgaaguggcuuuggggcuuccugucccgcaauaagaaaccucggaucugcacccgcgaggaauuuacccggaaggugcggagcaacgccgcaauaggcgccguguucgucgacgagaaucaguggaacucggcgaaagaggccgucgaggacgagcgauucugggaccugguccaccgcgagcgggagcuccacaaacaggggaagugcgccacguguguguauaauaugaugggcaaacgcgaaaagaagcugggggaguucggaaaggcaaaaggaagucgggcuaucugguauauguggcuuggggcccguuuccucgaauucgaggcacuuggauuuaugaacgaggaccacugguucaguagggagaacucucuguccgggguagagggcgaggggcuccacaagcuggguuacauccuacgcgacaucucgaaaauuccggguggaaauauguacgccgacgauaccgccgguugggacacccggaucaccgaggacgaucuccagaacgaagcccguauaacggacaucauggagccggagcacgcgcugcuggccaaguccaucuucaagcugaccuaccagaacaagguggugaggguccagcggcccgccaagaacgggaccgugauggacgucaucagccgccgggaucagcgaggcuccgggcaggucggcaccuacggccugaacacguucacuaacauggaagcccagcugaucaggcagauggagagcgaaggcaucuucuccccuagugaacucgagacccccaaccuggcugagcgcgugcuggacuggcucgagaaauacggcguggagcggcugaagcgcauggcgaucuccggggaugacugcgucgugaagcccaucgacgaucgguucgccaccgcccugacggcccucaacgacauggggaagguucgcaaggacaucccccagugggagccaagcaaaggguggaacgacuggcaacagguccccuuuugcucacaccacuuccaccagcugaucaugaaggacggcagagagaucgugguaccuugccggaaucaggacgagcugguugggcgggcucgcgugagccagggggcuggauggucccuccgggagaccgcgugucuggguaaauccuacgcgcagauguggcagcugauguacuuucaccgucgcgaccuccgcuuagcagcuaaugcgaucugcagcgccgugccggucgacuggauaccgaccuccagaacaaccugguccauccacgcgcaccaccaauggaugaccaccgaagacauguuguccgucuggaaucgcguguggaucgaggagaaccccuggauggaagacaagacccacaucagcuccuggggcgacguaccguaucucgggaagcgcgaagaccaauggugcgggagccugaucggccugacggcccgggcgacgugggcuaccaauauccagguggccauaaaccaaguccgccgguugaucgggaacgagaacuacuuagacuacaugaccucgaugaagcgcuucaagaacgagagcgaucccgaaggcgcccuuugguaa

SEQ ID NO: 24141 - RNA, 9879 nt, Artificial Sequence
  derived and/or modified CDS sequence (opt11) from DENV-1__FJ182027__SS-prME
agcguaaccaugcugcuaaugcugaugcccacggcccuggccuuccaccucaccaccaggggcggggaaccgcacaugaucgugucaaagcaagagcggggcaagagucuguuguucaaaacgagugccggggucaacaugugcacccucauugcgauggaccugggcgagcugugcgaggacaccaucaccuacaagugcccccgcauuaccgagaccgagcccgacgacguggauugcuggugcaacgccacagacaccuggguaaccuaugggacuugcagccagacgggcgagcauaggcgggauaagcgguccguagcccucgcgccccacgugggccuggggcuggagacccgaaccgagaccuggaugagcuccgagggcgccuggaagcagauacaaagagucgagacgugggcccuacgccaccccggguucaccgugaucgcccuauuucuggcacacgccauaggcaccagcaucacccagaagggcaucauauucauacuccugaugcuggugacacccuccauggcuaugcggugugucggcaucggcucacgcgauuucguggaagggcucuccggcgccaccuggguggacgucgugcuggagcacgggagcugcgugaccaccauggccaaggacaagcccacgcuggacauagagcuccugaagacugaggucaccaacccggcagugcugcggaagcucugcaucgaagccaagauauccaacacaacgaccgacucacgcuguccgacccagggcgaggccacccugguggaggaacaggacgccaacuuugucugccgcagaacguucguagaccgggguugggggaacggcuguggcuuauucggcaagggcucacucaucacgugcgcaaaguucaagugcguaacaaagcuggagggcaagaucguccaguaugagaaccucaaguacagcguaaucgugaccguccacaccggcgaccaacaccagguggggaacgagucuaccgagcacgguacuaccgccaccaucacgccgcaggcgcccaccacggagauccagcucacagacuacggggcccugacgcuggacugcagcccccgcaccggccucgacuucaacgagaugguccugcugaccaugaaggaaaaguccuggcucgugcacaagcagugguuccuggaucugccucuacccuggaccagcggugccagcacaucccaggagacguggaaccggcaggacuuacuggugaccuucaagaccgcccaugccaagaagcaggaggucguaguucucggcagccaggagggcgcgaugcacacagcccugacgggggccaccgagauccaaaccuccggcaccacaaccaucuucgccgggcacuuaaagugccgccucaagauggacaagcugacccugaggggcaugagcuacgucaugugcaccggguccuucaagcucgagaaggagguggccgagacccagcacggcaccgugcugguccagaucaaguacgaggguacagacgcgcccugcaagauccccuucagcacgcaggaugagaagggggucacccaaaacggccgccuuaucacagccaauccgaucguuacugacaaagagaagccggucaacaucgaggccgagccuccuuuuggugagucauauaucguuaucggcgccggggagaaagcgcugaagcucagcugguucaagaagggguccagcaucggcaagauguucgaggccacugcgcgcggggcccgccgcauggccauccuaggcgacaccgcgugggacuucggguccaucggcggcguguucaccagcgucgggaagcugguucaccaaaucuucggcaccgccuacggcgugcuauuuuccggcguuagcuggacgaugaagaucgggaucggcguacuguuaaccuggcucggucugaacucccgcagcaccucccugaguaugaccugcaucgcagugggccucgucacucuguaccugggcguaauggugcaagcugacuccgggugcgugaucaacuggaaaggccgcgagcuuaagugcgggagcggcaucuucgugaccaacgaggugcacaccuggaccgagcaauacaaguuccaggccgacagcccgaagcggcuguccgcggcuaucggcaaggcaugggaggagggggucugcggcauacgcagcgccacccggcuggagaauaucauguggaagcagaucuccaacgagcucaaccauauccugcuggagaacgacaugaaguucacggugguggugggggacguagccggcaucuuagcccaggggaagaaaaugauccgcccccagccgauggagcacaaguacaguuggaaguccuggggcaaggccaagauuaucggcgcugacgugcagaacacuaccuuuaucauagacgggccaaacaccccugagugcccggacgaccagcgggcauggaacaucugggaggucgaggacuacggcuucgggaucuucacgacaaacaucuggcugaagcugcgcgacagcuacacccaggugugcgaccaccggcucauguccgcagcgaucaaggacagcaaggcggugcacgccgacaugggcuacuggaucgaguccgagaagaacgagaccuggaagcuggcacgcgcuagcuucauagaggucaagacaugcauuuggcccaagucccacacccuguggagcaauggcguuuuagaguccgagaugauaauccccaagaucuacgggggcccgaucagccagcauaacuaccggcccggguauuucacccaaaccgccggcccguggcaccuggggaagcuggagcucgacuucgaccugugcgaggguacgaccgucguaguggacgaacacuguggcaaccguggcccgucccugcggaccaccacgguuaccggcaagauaauccaugaguggugcugucgcagcugcacccugcccccccuccgguuccgcggggaggauggcugcugguaugggauggagauccggcccgucaaagagaaagaggagaaccuggugaaauccauggugagcgccggcucgggcgagguggacucauuuagccucggacugcugugcaucuccaucaugauagaggaggugaugaggagccgguggucccgcaagaugcucaugaccggcacucuggccgucuucuuccugcucaucauggggcagcuaaccuggaacgaccugauucgcuugugcaucaugguaggugccaacgcgagcgaccguauggggaugggcaccacguaccuggcacugauggccaccuucaagaugcgcccgauguucgccgugggccuccuguuccggcgccugacauccagggagguucuccugcugaccaucgggcucucccugguagccuccguggagcugcccaacucccucgaggagcuuggcgaugggcuagcgaugggaaucaugauccucaagcugcucaccgacuuccaaucucaccagcuuugggccacccuguugagccucaccuuuauaaagaccacauucucccugcacuacgccuggaagacgauggccaugguccugucgaucgugucccuuuucccucugugccugagcacaaccucccagaagaccacguggcuaccggugcuguuaggcucgcucggcugcaagccgcugaccauguuccugaucgcggagaacaagaucuggggcagacguuccuggccucucaacgaggggaucauggccgucggcaucgugagcauacugcuaagcucgcuccugaagaacgaugugccucuggcagguccacucauagcaggcggcaugcugaucgccuguuacgucauaucgggguccagcgcggaucuguccuuagagaaagccgcugaagugucgugggaggaggaggccgagcacuccggugccagccauaacauauuaguggagguccaggacgacgggacgaugaagaucaaggacgaagagcgcgacgacacacugacaauccucuugaaggcgacgcugcucgccguguccgggguguacccgcuuagcauccccgccaccuuguuugucugguacuucuggcagaagaagaagcagagauccgggguucucugggacacccccucgccgcccgagguagagcgcgcaguccuggacgaugggaucuaucggaucaugcagcgaggacugcuggggcggucccaggugggcguaggggucuuccaggagaacguguuccacaccauguggcacgugacgcgcggcgcaguccucauguaccaggguaagcggcuggagcccaguugggcgagcgugaagaaggaccugaucagcuacggaggcggguggcgccuccagggcucguggaacacaggggaggaggugcaggucaucgcuguggagccuggcaagaaucccaaaaacgugcaaaccgcgcccggaaccuucaagacccccgagggugaggucggcgccaucgcccuggacuucaagcccgggaccucugguucccccaucgucaaccgugaggggaagauugugggcuuauacggcaacggggucgugaccaccagcggcacguacgugagcgcaaucgcccaggccaaggcuucacaggaagggccacuccccgagaucgaggacgaggucuuccgcaagcggaaccugaccaucauggaccugcacccaggcagcgggaagacccgccgcuaccucccggccaucgugcgcgaggccaucaagcgaaagcugcggacccugauccucgcccccacccgcgucgucgccucggagauggccgaggcguugaagggaaugcccauccgguaccagaccaccgccgucaagagcgagcacaccggcaaggagaucguggaccugaugugccacgccacguucaccaugcgccuccugagcccgguccgggucccgaauuacaacaugauaauuauggacgaggcccacuucaccgacccuagcuccaucgccgcgcgcggguacaucaguacaagggugggcaugggggaggccgccgcaaucuucaugacggccacgccgcccggcucugucgaagccuucccgcagucgaacgccgugauccaggacgaggagcgcgacauccccgaacguuccuggaauagcggguacgaguggaucaccgauuuccccgguaaaacagugugguucguuccauccaucaaguccggaaacgacaucgccaauugccugagaaagaacgggaagcgcgugauccaguugucccgcaagacguucgacaccgaguaccaaaagaccaagaacaacgacugggacuacguggucaccacggacaucagcgagaugggcgccaacuuccgcgcggaccgcguaaucgauccgcggagaugccugaagcccgugauacugaaggacggcccagagcgaguuauccucgccggccccaugccgguuacagucgccuccgccgcgcagcgccgggggcgcaucggccgaaaccacaacaaagagggcgaccaguacaucuacauggggcaaccucugaauaacgaugaggaucacgcgcacuggaccgaggccaaaaugcugcucgacaauaucaacacacccgagggcaucauccccgcccuguucgagccggaacgggagaaguccgccgccaucgacggggaguaccgccugaggggcgaggcgcgcaagaccuucgucgagcucaugcggcgcggggaccugccgguauggcuguccuacaaaguugccagcgagggcuuccaguauagcgaccggcgcugguguuuugacggcgagcggaacaaccaggugcucgaggagaacauggacguggagauauggaccaaggaaggugagcgcaagaagcuucggccucgcuggcuggacgcccggacuuauagugauccauuggcccugcgugaguucaaggaauucgccgcuggacggcgcagcgucuccggcgacuuaauccucgaaaucgggaagcugccacagcaucugacccagcgggcccagaaugcccucgacaaccuggugaugcugcacaauagcgagcagggcgggcgcgccuaccgucaugcgauggaggaacucccugacacgaucgagacgcugaugcugcucgcccugaucgcugugcugacuggcggaguaacccucuucuuccuguccggccgcgggcugggcaagaccagcaucggccuccugugugugauggccuccucgguucugcucuggauggccuccguggagccgcacuggauagcggcuagcaucauccuggaauucuuucugaugguguuacugauccccgagccggaccggcagcgcacgccccaggacaaccaacuggccuacguggucaucgggcuacucuucaugauccugacugucgcugccaacgagaugggccugcuggagaccaccaagaaggaccuagggaucggccacguggcggucgagaaccaccaccacgccgccaugcucgacguggaccugcaccccgccuccgccuggacgcuguacgcgguugccaccacuaucaucaccccgaugaugcgccacacgaucgagaacaccaccgccaacaucucacucaccgccaucgccaaccaggcggcgauccugauggggcuagauaagggguggcccauuaguaaaauggauaucggcgucccccuccuggcccuggggugcuacagccaagugaacccccucacgcugaccgcagcggugcucaugcucgucgcacacuacgccaucaucggaccggggcugcaggcuaaagccacccgggaggcgcagaaacgcaccgccgcaggcaucaugaagaaccccacugucgacgggauuguggcuauagaucucgacccugucguguacgaugccaaguucgagaaacagcucggccagauaauguugcugauccucuguaccucccagauauugcugaugcgaacgaccugggcucuaugcgagagcaucacgcuggcuacggggccccugaccacccucugggaggggucuccgggaaaauucuggaacacgaccaucgccgugagcauggccaauaucuuccgcggguccuaccuggccggcgcgggccuggccuucagcuuaaugaagucccucgggggagggcggcgcgggacgggugcccagggcgagaccuuaggcgagaaguggaagcggcaguugaaucaguuguccaagagcgaauucaacacguacaagcgcuccgggauuauggaggucgacaggagcgaggccaaggagggccugaagcgcggugaaaccaccaagcaugcggugagccgaggcaccgccaagcuccgcugguucgucgaacggaacuuagucaagcccgaggggaaagugaucgaccugggcugcggccgcggcggcuggagcuacuacugcgccggccucaagaaggugacggaggucaaaggcuacaccaagggcggucccggccacgaggagcccaucccaauggccaccuacggguggaaccuugugaagcugcacuccgguaaggauguguucuucauuccgccugagaaaugcgacacccuguugugcgacaucggggaaagcucccccaacccaaccaucgaagagggccggacccugcgcguacugaagaugguggagcccuggcuccgggggaaucaguucugcaucaagauccugaacccguauaugcccagcguugucgagacguuagagcagaugcaacgcaagcacggcggcaugcuggugcggaauccccuguccagaaacagcacccacgagauguacugggugucuugcgggaccggcaauaucguuuccgccgugaacaugacgucuagaaugcuccucaaccgguucacuauggcgcaccgcaagcccaccuacgaacgggacguggaucucggggcaggcacucgccacgucgcaguggagccagagguggccaaccuggauauuaucggccagcggaucgagaauaucaagcacgagcacaagagcacguggcacuaugacgaggacaacccguacaagacuugggccuaccacggguccuacgaggucaagccgucgggcuccgcaagcucgaugguaaacggcgucgugaagcuccugaccaagcccugggacgugaucccuauggucacccagaucgcuaugacggacaccacccccuucggccagcagcgcguguucaaggaaaaaguggacaccagaacaccgaaggccaagcgcgggacugcccagauuauggagguuaccgccaaauggcuguggggcuuccucucccggaacaagaagccccgcaucugcacccgggaggaguucacacgcaaggugcggucuaacgcggcgaucggcgcaguguucgucgaugagaaccaguggaacucagccaaggaggcgguggaggacgagcgcuucugggaccuagugcaucgggagcgcgagcugcacaagcaggggaagugugcgaccugcguauauaacaugauggggaagcgcgagaagaagcucggggaguucggcaaggccaaagggagccgcgccaucugguacauguggcugggugcccgguucuuagaguucgaggccuugggcuucaugaaugaagaccauugguucuccagggagaacagcuuauccgggguggagggcgaggggcugcacaaguuaggcuacauccugcgugacaucagcaagauucccgggggcaacauguacgccgaugacaccgcuggcugggacacgagaauaacggaggacgacuugcagaacgaggcccguaucaccgacaucauggagccggagcaugcccuccuggcgaagucaaucuucaaacugaccuaccaaaacaaggugguuagggugcagcgccccgccaagaacgggaccgugauggacgucaucagccggcgcgaccaacggggcuccgggcaaguaggcacguauggccucaauaccuucaccaauauggaggcccagcuuauccgccagauggagagcgaagggaucuuuucccccagcgagcuagagaccccaaaccuagcggagcgggugcuggacuggcuggagaaguacggcguggagcgccucaagcggauggccaucuccggggacgacugcguaguuaaaccgaucgacgacagauucgcgacggcccugaccgcccugaacgacaugggcaagguccggaaggacaucccacaaugggagccuagcaaaggguggaaugacuggcaacagguccccuucuguucccaccacuuccaccaacucaucaugaaggauggccgcgagaucguggucccgugccgaaaccaagacgagcuggugggccgcgcccgggugagccagggggccggguggucccugcgcgagaccgccugccuggguaagaguuaugcccagauguggcagcugauguauuuccaccggcgggaccucaggcuggccgcgaaugcgaucugcagcgccguccccguggauuggauucccaccucaaggaccaccuggagcauccacgcucaccaccaguggaugaccacagaagacaugcuguccguguggaaccgcgucuggaucgaagaaaaucccuggauggaggacaagacgcacaucuccuccuggggcgauguuccuuaccuggggaagcgggaagaucaguggugcggcagccucaucggccucaccgcccgcgccaccugggcgaccaacauccagguggccaucaaucagguccggcgccugaucgggaaugagaacuaccucgacuacaugacaucgaugaagcgguucaagaaugagagcgacccugagggcgcccugugguga

SEQ ID NO: 24142 - RNA, 9879 nt, Artificial Sequence
  derived and/or modified CDS sequence (opt11) from DENV-1__FJ024449__SS-prME
agcgugaccaugcugcucaugcugaugcccacagcacuugcuuuccaucucacaacacgggggggggaaccucauaugaucguaagcaagcaggagcguggcaagagccugcuguucaagacgagcgccggggugaacaugugcacccucaucgccauggaucugggcgaguuaugcgaagauaccaugaccuacaagugcccccggaucaccgaaaccgagcccgacgacguggacugcuggugcaaugcaacggacacaugggucaccuaugggacgugcagccaaaccggcgagcaccggagggauaagcgguccguggcacucgcaccccacgugggacugggucuagagacgcgcacggagaccuggaugagcucagagggggccuggaagcaaauacagcgggucgagacaugggcccuccggcaucccggguucaccguuaucgcccuguuccuggcccacgcgaucggcacuagcaucacacagaaagggaucaucuucauccuucugaugcuggugacgcccuccauggccaugcggugcgucggcaucggcucacgcgauuucgucgaggggcuauccggcgccaccuggguggacgucguucuggaacacgggagcugcgugaccaccauggccaaggacaagcccacgcuggacaucgagcucuuaaagaccgagguaaccaaccccgccguccugcggaagcucugcaucgaggcgaagaucuccaacaccacgaccgacagcaggugcccaacccagggcgaggcgacccugguggaagaacaggacgcgaacuuugugugccggcgcacguuuguggacaggggcugggggaacgguugcggccuguucggcaaggggucccucauaacuugcgcuaaguucaagugugugaccaaguuggagggcaaaauaguccaguacgagaaccugaaguacagcgugaucgugaccguucacacgggcgaccagcaccagguggguaacgaguccaccgagcacggcaccaccgccacuaucacgccccaagcacccaccaccgaaauucaacucacugacuauggggcucugacucuggacugcagcccccgcaccggcuuagacuucaacgagaugguacuguugaccaugaaggagaaaagcuggcucgugcacaagcagugguuucuggaccugccacuccccuggaccucaggcgccagcacgucccaagagaccuggaaccggcaggacuugcuaguuaccuucaagaccgcccaugcgaaaaagcaggaagucgugguguugggcagccaggagggcgccaugcauacggccuuaaccggugcaacggagauccagacguccggcacgaccaccaucuucgccgggcaccugaagugccgccuuaaaauggacaagcugacccugaagggcaugaguuacgucaugugcaccggguccuucaagcucgagaaggagguggccgagacccagcacggcacgguguuagugcaaaucaaguacgagggcaccgacgcgcccugcaagaucccguucagcacacaggacgagaagggggugacacagaacggcagauuaaucaccgccaacccgaucgucaccgauaaagagaagcccgucaacauagaggcugagccucccuucggugaguccuacauaauaaucggcgccggcgagaaagcgcugaaauugucuugguuuaagaagggguccaguaucggcaagauguuugaagccacggcccgcggggccagacgcauggccauccugggcgacacugcgugggacuucggcuccaucggcggcguguucaccagcguggguaagcugguccaccagauauucggaaccgccuacggggugcuguucuccggcgugagcuggacgaugaagauugggaucgguguccuguuaacuuggcucggccugaacucccgcuccaccucacugucaaugaccugcaucgcggugggacuaguaacgcuguaucugggggucauggugcaggccgacagcggcugcgugaucaauuggaagggccgcgagcucaagugcgggagcggcaucuuugugacuaacgaggugcacaccuggaccgagcaguauaaguuucaggcugacucaccuaagcguuugucugcggccauagggaaagccugggaggaaggugugugcggcauccggagcgcuacccgccuggagaauaucauguggaaacagaucuccaacgagcucaaccauauccuccuggagaacgacaugaaguucacggugguggugggugaugucgcuggcauccuagcucagggaaagaagaugauccggccgcagcccauggaguauaaguacucuuggaaguccugggggaaggcuaagauaauuggcgcggaugugcagaacaccaccuuuaucauagauggccccaacaccccggaaugccccgacgaccagcgcgccuggaacaucugggagguggaagauuacggcuucggaaucuucacgaccaauaucuggcugaagcugcgugauucccacacccaggucugcgaucaccgccuaaugagugcggccaucaaggacagcaaggccgugcacgccgacaugggauacuggaucgaauccgagaagaaugagaccuggaaacuggcccgggcuagcuuuaucgaggugaagacgugcaucuggcccaagucccacaccuuaugguccaacgggguccucgaauccgagaugaucaucccgaagaucuacggaggcccuaucucccagcacaauuaccgucccggguauuucacccagaccgcgggcccuuggcaccucgggaagcuggaacuggacuucgaccugugcgagggcacuaccguggugguugaugaacacugcggcaaccgugggccaagucuaaggacaaccacggugacugguaagaucauucacgaguggugcugccggagcugcacccugcccccccuccgcuucagaggggaggacgggugcugguaugggauggagaucaggcccgugaaggagaaggaagagaaucuugucaaguccauggugucggccggauccggcgagguggauucuuucagccucgggcugcugugcaucuccaucaugauagaggaggucaugagaagccgauggucccgcaagaugcugaugacaggcacgcuggccguguucuuccuacugauaauggggcagcucaccuggaacgaucugauccgcuuguguaucauggugggcgccaacgccagcgaccgcauggggaugggcaccaccuaccuggcccuaauggccaccuucaagaugcggccgauguucgcaguagggcuccuguuccgacgucugaccucacgcgaggugcuccugcuaacgauuggguuaagccuggucgcuuccgucgagcugcccaacucccucgaggagcugggggacgggcucgcaaugggcauuaugauccucaaacugcuaaccgacuuucaaucccaccagcucugggccacgcugcugucgcucaccuucaucaagacaaccuuuuccuuacacuacgccuggaaaacgauggcuauggugcuaucuaucguaucccuauucccacugugccugagcaccaccucccagaagaccaccuggcuacccguacugcugggaagccucgggugcaagccgcugaccauguuccugauagcggagaacaagaucugggggcggcgcuccuggccuuuaaacgaggggaucauggccgugggcaucgugagcauccuucugagcucguuauuaaagaacgacgugccgcuugccgggccccucaucgccggcggcauguugaucgccugcuacgugaucagcggguccagcgcggacuugucccuagagaaagccgccgaggucagcugggaggaagaggcugaacacuccggugccucacacaacauucugguggaggugcaggacgacggaaccaugaagaucaaggacgaagaacgugacgauacccucaccauccuucugaaggcgacgcuacucgccgucuccggcguauacccgcuuagcauaccggccacacuguucgugugguacuucuggcaaaagaagaagcagcgcuccgguguccucugggacaccccgagcccgccggagguggagcgggccguucucgacgacggaaucuaccgcauuaugcagagaggccugcuggggcgcucccaagucggcguaggggucuuccaggagaacgucuuccacaccauguggcaugugacgcggggggccgugcucauguaccaggggaagcgccuggagcccagcugggcguccgucaagaaggaccugaucagcuacggaggcggguggcggcuccagggauccuggaacacgggagaggagguccaggucaucgccguugagccaggcaagaaccccaagaauguccagaccgccccggggaccuucaaaacgcccgagggcgagguaggcgccaucgcccuggauuucaaaccgggcaccagcggcuccccuaucgucaaccgcgagggcaagaucgugggcuuauacggcaacggggugguuaccaccucuggcacguaugugagcgcaaucgcccaggccaaagccucccaagaggggccgcuccccgagaucgaggacgagguguuccggaagcgaaacuuaaccaucauggaccugcacccuggaagcgguaaaacgcggagguaucuccccgcgaucguccgcgaggcuaucaagagaaagcugcgcacccugauccucgcccccacgcgggugguggcguccgagauggcggaggcacugaaaggcaugcccauacgcuaccaaacuaccgccgucaagucagagcacaccggcaaggagauuguggaccugaugugccacgccacguucaccaugagacuccugucccccgugcgcgucccgaacuacaacaugaucauuauggacgaggcccacuucaccgauccuagcuccaucgccgcacguggauacauuagcacccgcgugggcaugggggaggcugcggccauuuucaugacugcaaccccaccuggcuccguugaggcguuuccgcagagcaacgccgucauccaggacgaggagagggauauccccgagcggucguggaacagcggauacgaguggaucaccgacuuccccggcaagacugugugguuuguucccuccaucaaguccggcaacgacaucgccaacugcuugcggaagaacgggaagcgcgucauucagcucagccggaaaacguucgacaccgaauaccagaagacuaagaacaacgauugggacuaugugguuaccacggacaucagcgaaaugggcgccaacuuucgggcggaccggguaaucgacccgcgccggugccugaaacccgugauccugaaggacggucccgagcgcguaaucuuggccggccccaugccggucaccguagccuccgccgcccagcggcgcgggcggauuggccgcaaccauaacaaggaaggggaccaguacaucuauauggggcagccguuaaacaacgacgaggaucacgcgcacuggaccgaggcaaagaugcugcucgacaacaucaacacccccgaaggaaucauccccgcccuguucgagccggagcgggagaagucggccgccauagacggggaauaucggcuccgcggcgaggcccggaagacguucgucgagcucaugaggcgcggggaccuacccgugugguuauccuauaagguggccagcgaggguuuccaguacucagaucgacgguggugcuucgacggcgagagaaacaaccaaguucuugaggagaacauggacguggagaucuggacuaaggagggcgagcguaagaagcuacgcccccguuggcuugaugcccgcaccuacuccgauccccuugcuuuacgagaguucaaggaguuugccgcgggucgccggagcguguccggugaccugauccucgaaauaggcaagcucccgcagcaucugacccagcgcgcccagaacgccuuagacaaccucgucaugcuucauaacagcgagcagggcgggcgagccuaccgccacgcgauggaggaguuacccgacacgauugagacccugaugcugcucgcccugaucgcugugcugacuggcggcgugacccuguucuuccuguccggcagggggcucggaaagacuagcaucggccuccugugcgucauggccagcagcguguugcucuggauggccucaguggaaccccacuggaucgccgccagcaucauccuggaguucuuccugauggugcuacugaucccugagccggaccgccagcgaacgccccaggauaaucaacuggccuacguaguuauaggauugcuguucaugauccucacggucgcagccaacgagaugggccuccuagagacuaccaagaaggaccucgggaucggccacguagcgguggagaaucaucaccacgccgccaugcucgaugucgaccugcacccagccuccgccuggacgcuuuacgcgguugccaccacaaucauuacaccgaugaugcgccacaccaucgagaacaccaccgcaaauaucagccucaccgcaaucgccaaccaggcggccauccugauggggcuggacaaaggauggcccaucuccaaaauggacaucggcgugccccuccuggcccuggggugcuacagccaagucaacccucucacgcugacugccgcggugcucaugcucguagcacacuacgccauaaucgggcccggauugcaggcgaaggccacgcgcgaggcgcagaagcgcaccgccgcuggaaucaugaaaaaccccacagucgaugggaucguggccaucgaccuggaccccguggucuacgacgccaaguucgaaaagcaacucggccagaucauguugcugauacucugcaccucccagauucugcugaugcgcaccaccugggcgcucugcgagucaaucacgcucgccaccggccccuuaaccacacugugggagggguccccaggcaaauucuggaacacgacaauugccgucagcauggccaauaucuuccggggguccuacuuagccggcgcgggacuggccuucagccuuaugaaaucccucgguggcgggcgccgggggaccggggcucagggcgagaccuugggggagaaguggaagaggcaauuaaaccaacuauccaagagcgaguucaacacguacaagcggagugggaucauggagguggaccguucugaggcgaaagagggccugaagcgcggggaaaccaccaagcacgcggucucccgcgguaccgcuaagcuccggugguuuguggagcgcaaccucgugaagcccgaggggaagguuauugacuuaggcugcggccgcgggggcuggucauacuacugcgccggguugaagaaggugacggaggugaagggcuacaccaaaggcggccccggccacgaggagcccauaccuauggccaccuacggauggaaccuugucaaguugcauuccggcaaggacguguucuucaucccgcccgagaagugcgacacccugcucugugacaucggggagagcucccccaacccgacgaucgaggagggccgaacccugcggguucugaagaugguagagcccuggcuccgcggaaaccaguuuugcaucaagauccugaaccccuacaugcccagcgugguggaaacacuggagcagaugcagcggaagcauggcggaaugcucgugaggaacccgcugagcagaaacagcacucaugagauguacuggguauccugcgggaccggcaacaucgugagcgccgucaauaugacgucccguaugcuccucaaccgauucaccauggcgcaucggaagccaaccuacgagcgcgacguggaccuaggagcaggcacccggcauguagccgucgagcccgaggucgcgaaucuggacauaauuggucagcgcaucgaaaacaucaagcacgagcauaagucaacguggcacuacgacgaggauaauccauacaagaccugggcguaccacggcuccuacgacgugaagccuagcggauccgcgagcagcauggucaacggggucguuaagcuccuuaccaagcccugggacgugaucccuauggugacccagaucgccaugacggauacaacccccuucggccaacagcggguuuucaaggagaagguggacacccgcacgcccaaggcuaagcgggguaccgcucaaaucauggaagucaccgccaaguggcuguggggcuuccucucccguaauaaaaagccccgcaucuguacccgugaggaguucacgcggaagguaaggucuaacgcggccaucggcgcaguguucguagaugagaaccaguggaacagcgcgaaggaggcggucgaagacgagcgguucugggaccuugugcauagagagcgggaguugcacaagcaggggaagugugcgacguguguguacaacaugauggggaagcgcgagaagaagcucggagaauucggcaaggccaaggggucgcgggccaucugguacauguggcugggcgcccgcuucuuggaauucgaagcgcucggcuuuaugaaugaggaccacugguucucccgggagaauucucuguccggcgucgagggcgaagggcugcauaagcucggcuacauccugcgcgacaucagcaagauuccuggggguaacauguacgccgacgauacggccggcugggauacccggauaacugaggacgaucugcagaaugaggcucgcaucaccgacaucauggagccggagcacgcccuccuggcgaaguccaucuuuaagcugacuuaucaaaacaagguggugcgcguccagcggcccgccaagaacggcacagugauggacguuaucucccgccgggaccagcgcggaucagggcaggucggcaccuacggacucaacaccuucaccaacauggaggcccagcucauccggcagauggaaucggagggcaucuucucacccagcgagcuggagaccccgaacuuggcugaacgcgugcuggacuggcuaaagaaguacggcguggagcguuugaagcgcauggcuaucucaggggacgacugcgucgugaagccuaucgacgaccguuucgcgacggcucugacugcccugaacgacauggguaaggugcgaaaggacaucccccaaugggagcccagcaagggcuggaacgacuggcagcagguccccuucugcagccaucacuuccaccagcucauuaugaaggacggccgggagaucguggucccgugccgcaaccaggacgagcuggucggccgggcccgcgugagccagggggcgggauggucccugcgagagacggcuugccucgggaaauccuacgcccagauguggcagcugauguacuuccaccgcagggacuuacgccuggccgccaacgcuaucugcagcgccgugccaguugauuggauccccaccucuagaaccaccuggagcauccacgcccaccaccaauggaugacgacugaagauaugcugucagucuggaaccgcguguggauagaggagaauccuuggauggaggacaagacacacaucaguuccuggggggacgugccguaccuggggaagcgagaagaccaguggugcggcagcuugauaggccugaccgcccgugcgaccugggcgacuaacauccagguugccaucaaccaggugcgccggcugaucgggaaugagaacuaccucgacuauaugaccuccaugaagcgcuucaagaacgagggcgacccagagggggcccugugguga

SEQ ID NO: 24143 - RNA, 9879 nt, Artificial Sequence
  derived and/or modified CDS sequence (opt11) from DENV-1__FJ390383__SS-prME
agcgugaccaugcuccugaugcuaaugcccaccgcccuggcauuucaccucaccaccaggggaggggagccccacaugaucgugagcaagcaagagcggggcaagagccugcuguucaagaccuccgcaggggugaacaugugcacgcucaucgccauggaccugggugagcugugcgaggacaccaugaccuauaagugcccccggaucacugaaaccgagccugacgacguggacugcugguguaacgccacagacaccugggugaccuacgggacuugcagccagacgggcgagcaccggcgggacaagcgguccguggcucucgcaccccacgugggccucgggcuggaaacccgcacagaaacguggaugucaagcgaaggugcguggaagcagauucaacgugucgaaacgugggcccuccggcaccccggguuuacugugaucgccuuguuccuagcccacgcgaucggcaccagcaucacccaaaaggggaucaucuuuauccuccuaaugcucgugacgccguccauggcgaugcgguguguaggcaucggcagccgcgacuuuguggaggggcucuccggggccaccuggguggaugucgugcuagagcacggcagcugcgugaccaccauggcuaaggauaagcccacgcuggacaucgagcugcugaagacugaggucaccaaccccgccgugcugcggaaacucugcaucgaagcgaagauuucgaauacaacuacagacagccgcugccccacccagggagaggccacccucguggaggaacaggacgccaacuucguaugucgucgcacuuucgucgaccgggguugggggaacggcugcggucucuucggcaaggggucccugaucacgugcgccaaguucaaaugugucaccaagcuggaagguaagaucguccaguacgagaaccugaaauacagcgugaucgugaccguccauacgggagaccagcaccaggucgggaaugaauccaccgagcacggcaccacugcuaccauaacgccccaggcgccaaccaccgagauccaauugaccgacuacggcgcgcuuacgcuugacugcagcccccgcacuggcuuagauuucaacgagaugguucuguugaccaugaaggaaaagucauggcucguucacaagcagugguucuuagaccugccccuccccuggacgagcggagccagcacgucacaagagaccuggaaccgucaggaucuccugguaaccuuuaagacugcccacgccaagaaacaagaggugguggugcucgguagccaggagggcgcgaugcacacagcccugaccggggcaacggagauccagaccuccggcacuaccaccaucuuugccgggcaccugaaaugccgucugaaaauggacaagcugacacuaaagggcaugagcuacgucaugugcacggggucauucaagcucgagaaggaaguggccgagacccaacacgguaccguucugguccagaucaaguaugaaggcacggacgcgcccuguaagauacccuuccugacgcaggacgagaaaggggugacgcagaacggucgauugauuacagccaacccgauagugaccgacaaggagaagcccguaaacaucgaggccgaaccgcccuucggagagucauacaucaucaucggcgccggcgagaaggcgcucaagcuguccugguucaagaaggggagcucgaucggaaagauguucgaggccacggcgcgcggggcaaggcgcauggcaauccucggagacaccgcgugggacuucgggagcauuggcgggguuuucaccaguguagggaagcugguccaccaaauuuuugggaccgcauacggggugcuguucucuggcguguccuggacaaugaagaucgggaucggcguccuacucacuugguugggccucaacagccgcucaaccagccucagcaugaccugcauagccguagggcucgugacgcuguaccuuggcguaauggugcaagccgacagcggaugcguuaucaacuggaagggcagagagcugaagugcggguccggcauuuucguuacuaaugagguucacaccuggacugagcaguacaaauuucaagcugacuccccgaagcggcugagcgcggccaucgguaaggcaugggaggaagggguauguggcauacguuccgcuacacgguuggagaacaucauguggaagcaaaucagcaacgaacugaaccauauucuguuagagaacgacaugaaguuuacugucguggugggcgauguggcuggcaucuuggcgcaggggaagaagaugaucaggccccagcccauggaguauaaguauucauggaaguccuggggcaaggcgaagauuaucggagcugacguucagaacaccacguucauuaucgacggccccaacacuccggagugcccugacgaccagagagcauggaacauaugggaaguggaagacuacggcuuugggaucuucacgaccaauauuuggcucaaacuccgggacucauacacucaggucugcgaccaccgccugaugucagcggccauaaaagacaguaaggccguacacgccgauaugggguacuggaucgagagcgaaaagaaugagacauggaagcucgcccgggcauccuucaucgaggucaagacaugcaucuggcccaaaagccacacccucuggaguaacgggguccuggagagcgagaugaucauacccaagaucuacgguggcccgauuucacaacacaacuaucguccugguuacuucacgcaaaccgccggaccguggcaccuggguaagcucgagcucgacuuugacuugugcgaaggcacgaccgugguggucgaugagcacugcggcaaccgggguccuucgcugcgcacgacgacggugaccggcaagaucauccacgaguggugcuguagguccugcacccugccgccacugcgcuuccgcggggaggacggcugcugguaugggauggagauccggccggugaaggagaaagaggagaacuuaguaaagagcaugguguccgccgguaguggcgaaguagacucuuucagccuugggcuccucugcaucagcaucaucaucgaggaggucaugcggaguagguggucgcgaaagaugcuaaugacuggcacgcuggcaguguucuuccugcugauuauggggcaguugacuuggaacgacuugauccgccugugcaucauggugggggccaacgcguccgaucggauggggauggguaccaccuaucuagcccucauggccacguucaaaaugcguccuauguucgccguaggccucuuauuccgccgguugacuagccgcgaagugcuccugcucaccauugggcugucccucguugcgagcguugagcuccccaacucccuggaagaacugggcgacgggcucgccauggggaucaugaucuuaaaguugcucacagacuuucagagccaucagcugugggcuacguuacugagucuaaccuucaucaagaccacauuuagccugcacuaugcguggaagacuauggcaaugguucuguccaucguuagccuuuuuccccugugucucuccaccacaucgcagaagaccacguggcugcccgugcuucucggcucucugggaugcaaaccgcugacaauguuccucauugcggaaaacaagauuuggggccggcgcagcuggcccuugaaugaggggauaauggcggugggcauuguauccauccugcucagcagccuguuaaagaacgacgagccucucgccgguccacugaucgccgguggcaugcugauugccugcuauguaauuuccgggagcuccgcggaucuaucccuggagaaggccgcugaggucucgugggaagaagaggcugagcauucgggggccagccacaacauacuuguggaagugcaagacgaugggaccaugaagaucaaggaugaggagcgggacgacacacucacaauccugcugaaggcgacauuacuggcggucucuggcguguacccgcugucaaucccagccacccucuucgugugguacuucuggcagaagaaaaagcagcggagcggcgugcugugggacacccccaguccacccgaggucgagcgggccguccuggacgauggcauuuaccguauaaugcagcggggccugcuugggcgcagccaagugggggucgggguguuucaggaaaauguguuccacacuauguggcacgucacgcguggggcaguacugauguaccaggguaaacggcuggagccuaguugggcgagugugaaaaaggaccucauuuccuacggcggcggguggcggcugcaaggcuccuggaacaccggggaggaaguccagguaaucgccguggagcccggcaagaaccccaaaaauguccagaccgcccccgggaccuucaagacgcccgagggcgaggugggcgccaucgcccucgauuucaagcccgggaccuccgguagccccaucgucaaccgggaggggaagauaguugggcucuacggaaacgggguugugaccacuuccgggacauaugucucggccauugcacaagccaaggccagccaagaggggccgcuaccagagauagaagacgagguguuucggaaaaggaaccugaccauuauggaucuccacccaggcuccgggaagacccggcgcuaccuaccugcgaucgugcgagaggcaauaaagcgcaagcugcgcacccucauccuggccccgacgagggucguggccagcgagauggcagaggcgcugaaggggaugcccauucguuaccagaccacugccgugaagucagaacauacagggaaggaaauuguggaccucaugugccacgcaacuuucaccaugcgucuccugucacccgugcgcguaccgaacuacaauaugaucauuauggacgaggcccacuuuaccgaccccucaagcauagccgcacggggguacaucuccacacgaguagggaugggcgaagcugcagccaucuucaugacggccacgccgccgggcagcguggaagcguucccgcaguccaacgccgugauucaggacgaggagcgggacauccccgagcgaagcuggaacucaggguacgaguggaucacugacuucccgggcaaaaccgucugguuuguccccucaaucaagaguggcaacgacauugccaacugccuccgcaaaaacggcaagcgcgugauccagcugagccggaagacauucgacaccgaauaccagaagaccaagaacaaugauugggacuauguagugaccacggauaucagcgagaugggugccaacuucagagcggaucguguaaucgacccgcgccguugccugaagcccgucauccugaaggaugggcccgagcgcguaauacuggcugguccaaugccggugaccgucgccagugcugcccagcggcgugggcgaaucggucgcaaucacaacaaggagggcgaccaguacaucuacauggggcagccucugaacaacgacgaggaucacgcucacuggacggaagccaagaugcugcuagacaacaucaacacuccugagggcaucauccccgcgcuguucgagccggagcgagagaaguccgccgccaucgacggugaguaucgccuccgcggcgaggcgcggaagacguucguggagcugaugcgcagaggggaccugcccgucuggcucagcuacaaaguggccuccgagggcuuccaguacagcgaccgacgguggugcuucgacggcgagcgcaauaaccaagugcuugaggagaacauggauguagaaaucuggacuaaggaaggggagcgaaagaagcugcgcccucggugguuagacgccagaacauacagcgauccacuggcgcugcgggaguucaaggaguucgccgcuggccgacgguccgucagcggugaucucauccuggagaucgggaagcugccacaacaccucacucaacgagcccaaaaugcucuggauaaccuugugaugcuucacaacuccgagcaaggcgggcgggcauaccgccaugcgauggaggagcugcccgacacgauugagacccugaugcuccuugcgcugauagccguccucaccggcggugugacccuguucuuucugaguggccggggccuagguaagacaucuauaggccugcuuugcgugauggcgaguuccguucuccuguggauggccagcguggaaccccacuggauagccgccuccaucauccuggaauuuuuccucaugguucugcuuaucccggagccggaccggcagaggacgccgcaggacaaccagcucgcguacgucgugaucggccugcuguucaugauccucaccguggccgccaacgagauggggcugcucgagacgaccaagaaggaccuaggcaucggccacgucgccguggagaaucaucaccacgcggcaaugcuggauguggacuuacacccagccagugcguggacucucuaugcggucgccaccacuaucauaaccccgaugaugcggcacacgaucgagaacacgaccgccaacaucucacugacggccaucgccaaccaggcggcuauccugaugggguuggacaaaggcuggcccaucagcaagauggacaucggcguaccccugcuggcccucgggugcuacucccaggugaacccccugacuuuaaccgccgcgguccucaugcugguggcucauuacgccaucaucggcccggggcuucaggccaaggcuacccgcgaggcgcagaagaggaccgccgcaggcaucaugaaaaacccgacuguggacggcaucgucgccauugaccucgacccugugguguaugacgccaaauucgagaagcagcucggccagaucaugcugcuaauccuauguaccucacagauccugcucaugcgcaccacaugggcgcugugcgaguccauuacgcuggccaccggcccacucaccacccugugggagggcagcccggguaaguucuggaacacgaccaucgccgucaguauggccaacauauucaggggcagcuaccuggcgggcgcgggccuagccuucucgcugaugaagucccucggcggcgggcgccgugggacaggggcucagggcgaaacccucggcgagaaguggaaacgccagcugaaucaacugagcaaguccgaguucaacacauacaagcgaucugggaucauggaaguggacaggucggaagccaaggagggcuugaagcgcggggagaccaccaagcacgcugugucgcgcgggacagccaagcugagaugguucgucgagcgcaaccuggugaagcccgaggguaaggugaucgaccugggcugcggccguggcggguggaguuacuacugugccggccucaagaaggucacggaggugaagggguacaccaagggcggccccggacaugaggaacccaucccaauggccaccuauggguggaaccuagugaagcugcacagugggaaggaugucuucuucauaccacccgagaagugcgacacccuccucugcgacaucggcgagagcucccccaacccgacgaucgaggaaggucgcacgcugcgcgugcucaaaaugguggagcccuggcugcgcgggaaccaauucuguaucaagauccuuaaucccuacaugccauccgucguggagacccucgagcagaugcagcggaagcaugggggcaugcuggugcgcaauccacucucgcguaacuccacucacgagauguauugggucucuugcgggacaggcaauaucguguccgcggugaacaugacgagccgcaugcuucugaaccgcuuuacgauggcccaccgaaagcccaccuaugagcgcgacgucgaccugggggccggcacccggcacgucgccguggagcccgaggucgccaaccucgacaucaucggucagcggaucgagaacauuaaacacgaacauaaguccacuuggcacuacgacgaagacaacccuuauaagacaugggccuaucacgggucguacgaggucaagccguccggcagcgcguccagcauggugaacggagucgugaaacucuugacaaagccuugggacguuauacccauggugacucagaucgccaugacggacacuacgccguucggccagcagcggguguucaaggaaaaggucgauacgcgcacccccaaggcgaagcggggaaccgcccaaaucauggagguaacggcaaaguggcucugggguuuccugagccgcaacaagaagccacggaucugcacucgggaggaguucacacggaaggugcgcuccaacgcggcaaucggcgccgucuuuguggacgagaaucaguggaacagugccaaggaggcgguggaggacgagcgguuuugggaccugguccaccgcgagcgggagcuccacaagcaggggaaaugcgcaaccugcguguacaauaugauggguaagcgcgagaagaaacugggggaguucggcaaggcaaaagggucccgggccaucugguacauguggcucggcgccagguuccuggaguucgaggcguugggauucaugaacgaggaccacugguuuagccgggagaacucguuaucagguguggagggcgagggcuuacacaagcucggcuacaucuuacgcgacaucuccaagauuccuggggguaauauguacgcggaugacaccgcgggaugggacacccggaucacagaggacgaccugcagaacgaggcaagaaucaccgacaucauggagccggagcacgcccugcuggccaagagcaucuucaagcucacguaccagaauaaagucgugcgcguccagcggcccgccaagaacgggaccguaauggacgugauuucucgucgggaucaacgcggcagcggccagguggggacguacggccuaaacaccuucacuaacauggaggcccaacugauccggcagauggaaagcgaggggauuuucucucccucggaguuggaaauccccaacuuagccgagcgcguucuggacugguuggagaaguacggcguagagcggcugaagcggauggccauuagcggggacgacugcguggucaagccgauagacgaccgauucgcgaccgccuuaacugcgcucaaugacauggguaaggugagaaaagacaucccccagugggaacccaguaagggguggaacgauuggcagcagguccccuucuguagccaccacuuccaccagcugaucaugaaggacggccgggaaaucgucguacccuguaggaaccaggacgagcugguaggccgggcucgcgugucccagggggcuggcuggagccuccgggagaccgcgugccugggcaagagcuacgcccaaauguggcagcugauguacuuucauaggcgggaccugcgcuuggccgccaacgcgaucugcuccgccguacccgucgauuggauccccaccagccggaccacauggaguauccacgcccaccaccaguggaugacaacagaggacaugcugaguguguggaacagaguauggaucgaagagaaccccuggauggaggacaagacccacauuuccucauggggcgacgugccguaccucgggaagagggaggaccaguggugcgggucccugaucggccugacugcccgggcuacaugggcaaccaacauccagguugcaaucaaccaggugaggcgccucaucgguaacgagaacuaucuggacuacaugaccagcaugaagagauucaaaaacgagggagaucccgagggggcccuuugguga

SEQ ID NO: 24144 - RNA, 9879 nt, Artificial Sequence
  derived and/or modified CDS sequence (opt11) from DENV-1__FJ182033__SS-prME
agugugaccaugcugcucaugcugaugcccacugcccuggccuuucaucucaccacgcgcggaggugagccgcacaugaucgugaguaagcaggagcguggcaagagccugcuguucaagaccagcgccggugugaacaugugcacccucaucgcaauggaccugggcgagcuuugugaagacaccaugaccuacaagugcccgcgaaucacggaagucgagcccgacgacgucgacugcugguguaacacaacggacaccugggugaccuacgggaccugcagccaaacgggcgagcaccggcgcgacaagcggucaguagccuuggcgccacacgugggucuggggcuggaaacucgcgccgagacauggaugucauccgagggagcguggaagcagauccagaagguggagaccugggcccucagacaccccggguucaccgugaucgcgcuguuccuggcccacgcaauuggcacgagcaucacccagaaggguaucauauucauccuccugaugcuggucacccccuccauggcgaugcggugcgugggcaucggcagccgggacuucguggagggucucuccggugccacuuggguggacguuguguuggagcacgggagcugcgucaccaccauggccaaagacaagcccacccuagacaucgagcuccucaagacggaaguuaccaacccugcagugcugcgaaagcucugcaucgaggcgaaaauuuccaacaccacaacggacagccggugcccaacccagggcgaggccacccuggucgaggagcaggaugccaacuucgucugccgccggaccuucguugaccguggcugggggaacggaugcgggcuguucggcaaggggucucucauuacgugugccaaguucaagugcgucaccaaacuggagggcaaaaucgugcaguacgaaaauuuaaaauacagugucauuguaaccgugcauaccggcgaccagcaccaggucgggaacgaguccacugagcacggaacgaccgcaaccaucacgccccaggcgcccacgagcgagauccaguugaccgauuacggggcccugacgcuggauugcagcccuagaaccggucucgacuuuaacgagauggugcuguuaacgaugaaggagaaguccuggcucgugcacaagcagugguuccuggaccugccguuacccuggaccagcggggccuccaccagccaggagacuuggaaccgccaggaccuccuggucacauucaagaccgcccaugccaagaaacaggaggugguuguccucggcucccaagagggugcgaugcacaccgcccugaccggcgccacggagauccaaaccagcggcaccaccacgauauuugcugggcacuugaagugcagacucaagauggauaaguugacccugaaggggauguccuacgugaugugcacugggagcuucaaguuagagaaggaaguugccgagacccagcauggcacgguccugguacagauuaaauacgagggaaccgacgccccguguaagauccccuuuuccacccaggacgagaagggggugacacagaacggccgccuaauuacagcgaacccgauagucacggauaaggagaagcccguuaauaucgaggccgagccgcccuucggggagagcuauaucgucaucggcgccggagaaaaagcgcugaaauuauccugguucaagaagggaagcuccaucggcaagauguucgaggcgaccgccagaggggcgcggcggauggcuauccugggugacaccgcgugggacuucgggagcaucggcggggucuucacgucgaucggaaagcuggugcaucagaucuuuggcacagcauacggaguguuguucagcggggucuccuggacgaugaagaucgggauuggcgugcuacugacguggcucggccuuaacagccgcuccacgagccugucuaugacuuguaucgccgugggucugguaacccuguaccuuggggugauggugcaagcagacagcgggugcgucaucaacuggaaaggccgugaguuaaaaugcgggucaggcaucuucgugaccaaugagguacacacguggaccgagcaauacaaguuccaagccgacuccccgaagcggcugagcgcggccauuggcaaggcaugggaggaggggguaugcgguauccgcuccgccacccggcuggagaacaucauguggcgccagaucucuaacgagcuuaaccacauccugcuagaaaacgacaugaaguucaccguugugguuggcgacgucguggguauccuugcccaggggaaaaagaugaucaggccacagcccauggagcacaaguacuccuggaaguccuggggcaaggcgaagauaaucggagccgacguccagaacacuacguuuaucaucgacgggcccaauacuccggaaugccccgaugaucagcgcgccuggaacauuugggaaguggaggauuauggcuucgguaucuucaccaccaacaucuggcugaaacugcgggacuccuacacccaagugugugaucaccgacucaugucagccgcuaucaaggauuccaaggccguacacgccgacaugggcuacuggaucgagagcgaaaagaacgagaccuggaaguuggcucgcgccuccuuuaucgagguaaagaccugcaucuggcccaagucgcacacucugugguccaacggcguuuuggagagcgagaugaucauucccaagauauacgguggaccgauaucccaacacaacuaccgcccuggcuacuucacgcaaaccgcgggccccuggcaucucgggaaauuggaacucgacuuugaccugugcgaggguaccaccgucguuguggaugagcacuguggcaaccgugggccaucgcugcgcacgacaacugucaccgguaagauaauccacgaguggugcugccgguccuguacguuaccgcccuuacgcuucaagggggaagauggcugcugguacgggauggagauccggccagugaaggaaaaggaggagaaccuaguaaagagcauggucagcgccggcuccggcgagguugacagcuucucccucggacuucuguguauuucuaucaugauagaggaggugaugcgaucccgguggucgcgcaagaugcucaugacggggacccuggccguguucuuccugcucaucauggggcaacucaccuggaaugaccuaauccgguccugcaucauggugggcgccaacgccuccgaccggauggggaugggcacgaccuaccucgcgcugauggcuaccuucaagaugcgcccgauguuugccgugggccuccuguuucggagguugaccuccagagaaguccuacuccugacgaucgggcugagccucguggccuccgucgaacugcccaacagccuugaagagcucggugacggccuggccauggguaucaugauacugaaguuacugacggauuuccaguccuaccagcuaugggcgacccugcuaagccugaccuucaucaagacgaccuucucauuacacuacgccuggaagaccauggccaugguccugagcaucgugagccuguuaccccuaugucuaagcacgacgucccagaagaccaccuggcuccccguccugcucggcucacuaggcugcaagccacugaccauguuucuuaucgccgaaaacaagaucuggggcagaaagagcuggcccuuaaacgaggggaucauggcggugggaaucgugucgauucuguugagcuccuugcuaaagaaugacgucccccuggccgggccccugaucgccggcggcaugcugaucgccugcuacgucauaucagggucaagcgccgaccugucacuugaaaaggcggccgagguaucaugggaggaggaggccgaacauucuggcgccagccacaacauccuggucgaggugcaggacgacggaaccaugaagaucaaggacgaggagcgggacgauacccucacgauccuccucaaagccacccuguuggcgguguccggcguguacccgcugagcauccccgcuacccuguuuguuugguacuuuuggcagaagaagaaacagcgguccggggugcucugggacacgcccuccccgcccgaggucgagcgcgccguguuagacgacggcaucuaccguaucaugcagcggggacuacuggggcgcucccagguggguguuggggucuuccaggagaacguuuuccacaccauguggcaugucacacguggcgccguuuugauguaucagggaaagcgccuggagccgagcugggccucagugaagaaggaccuuaucucauacggcggcgguuggcggcugcaaggcuccuggaacaccggggaggagguccaggugauugcgguggagccuggcaagaaccccaagaacguccagacggcccccgggaccuucaaaacccccgaaggcgaggucggcgccauugcacuggacuucaaacccggcaccagcgggucacccauagugaaccgcgaggggaagaucguaggccuguacggcaacggaguggugacgacgucaggaaccuacgucagcgcgaucgcgcaggcgaaggcaucgcaggaggggccgcucccugagaucgaagacgagguguuccgaaagcgcaaccugacaaucauggaccugcauccggguagcgggaagacgcgucgcuaccucccggcgaucguacgggaggcgauaaagcgaaagcugcgaacccucauccucgcccccacccguguaguggccuccgaaauggccgaagccuuaaaaggcaugcccauccgcuaccagacaacagcugucaagucugaacacaccggccgugagaucgucgaccuuaugugucacgccaccuucaccaugcgucuccugucucccgugcgagugccgaacuacaacaugaucaucauggaugaagcccacuucacggaccccagcagcaucgcugcccgcggguacaucagcacucggguagggaugggcgaggcggccgccaucuucaugacagccacgccgcccgguuccguggaggccuucccgcagagcaacgcggugauccaagaugaggagcgcgacaucccagagcggucguggaauagcggguaugaguggauuaccgacuuccccgggaaaaccgugugguucgugcccuccauuaaaagcggcaacgacaucgcgaacugccugcgcaaaaaugggaaacgagugauucagcucagccgaaagaccuuugacacugaguaucagaagacgaagaacaacgacugggacuacguagugacgacagacaucagcgagaugggcgccaauuuucgggcagaucgcgugaucgauccccggcgcugccugaagcccgugaucuuaaaggauggccccgagcgggugauacucgcggguccuaugccgguaacgguugcguccgccgcccagcgccgggggcgcaucgggcggaaccacaacaaggagggcgaccaguacauauauauggggcaaccacugaacaacgaugaggaccacgcccacuggaccgaggcaaagaugcugcucgacaacaucaacacccccgaggggaucaucccggcccuguucgaaccggagcgcgagaaguccgccgcuauugacggugaguaccgccuccggggcgaagcucgcaagacuuucguggagcucaugcgacgcggggaccugccuguuuggcugagcuacaagguggcuagcgagggcuuccaguacagugacagacgcuggugcuuugauggcgagagaaacaaccaggugcucgaggaaaacauggacguagagauuuggacaaaagagggugagcgcaaaaaacugcggccccgcuggcuggacgcccggacguacuccgacccccucgcccugcgcgaguucaaggaauucgccgcagggaggcguagcgucucgggggaccugauccucgagauagguaagcuuccgcagcaccuaacccagcgcgcgcaaaaugcucuagacaaccuggugaugcugcacaacagcgagcaagguggacgagcauaccggcacgccauggaggagcugccggacaccaucgagacgcugaugcugcucgcgcugaucgcggugcucacgggcggggugacccucuucuuccuguccggucguggguugggaaagacuagcauuggucucuuaugcgugauggcuuccagcgcccuauuauggauggccuccguggagccccauuggaucgccgccagcaucauccuggaguuuuuccuaauggugcucuugaucccagagccggaccggcagagaaccccccaggacaaccagcuggccuaugucgucauugggcuacuguuuaugauccugaccgucgccgccaacgagaugggccuccuggagacaaccaaaaaggaccugggcaucggccacguggccgucgagaaccaucaccacgccaccaugcucgauguggaucuccaccccgcuuccgccuggacguuauacgccguagcuacgacaaucaucacucccaugaugagacauacgaucgagaacacgacggccaacaucagccucacagccauagccaaucaggcggcaauccugaugggacuugauaagggauggccgaucagcaagauggacauaggaguaccccuccuggccuuagggugcuacagucaggugaacccacucacccugacggccgcagugcugaugcuagucgcucauuacgccauuaucgggccgggucugcaggccaaggccacccgagaagcccagaagaggaccgcggcagggaucaugaagaaccccaccguggaugggauaguggccaucgaccuggaccccgucguguacgacgccaaguucgaaaagcagcucggccagaucaugcugcugauucucugcacgucgcagauccuccugaugcgcacaaccugggccuuaugugagucaaucacacuggcgaccgggccccugacaacacugugggaggggucaccggggaaguucuggaacaccacgauugccgugagcauggcgaauaucuuccgggggagcuaccuagcuggcgcgggccuggcguucucucucaugaagucccucgggggcgggcggcgcggcaccggggcccagggcgagacucugggugagaaguggaagaggcagcucaaucagcuguccaagucugaauucaacaccuauaagcgcagugggaucauggaggucgaucggagcgaagccaaggaagggcugcgacguggggaaacgaccaagcaugccguguccaggggcaccgcgaaauuaagaugguucguagagagaaaccugguuaagcccgaggggaaagugaucgaccuuggcuguggccgcggcggguggucguauuacugugccgggcuaaagaagguuaccgaaguaaagggauacacgaaaggcgggcucggccacgaggaacccaucccgauggcgaccuacggcuggaaucuggugaaacuccacuccgggaaggacguauucuucaucccgcccgagaaaugugacacgcuccugugcgacaucggggagagcagccccaaccccacgaucgaggagggccgcacgcugcggguccugaaaaugguugagcccuggcugcgcgggaaccaguucuguauaaagauacugaacccauacaugcccucgguagucgaaacccuugagcagaugcagcggaagcacggcgguaugcuggugcgcaacccccugucccgaaacucaacccacgagauguauuggguauccugcgggacuggcaacaucgucucugcagucaacaugacgucccguauguuauuaaaucgguucacgauggcucacaggaagcccaccuaugagcgcgacguggaccugggggcuggcaccaggcacguagccguggagccggagguggccaaucucgacaucaucggccagcgcaucgagaauaucaaacacgagcacaagagcaccuggcacuacgacgaagacaaucccuacaaaacgugggccuaccauggguccuacgaaguaaagcccucgggcagcgccaguagcaugguuaacggggucguaaaacugcuaaccaaaccgugggacgugauccccaugguuacccagauagcgaugaccgacacgaccccauucgggcaacagcggguauucaaggagaaaguggacacccgcacucccaaggccaaacgcgggacggcccagauaauggaggucaccgcacgguggcuauggggcuuucugucccggaauaagaagccgcgcaucuguacccgggaggaguucacgagaaagguucggagcaacgcugcuaucggggcggucuucguagaugagaaccaauggaacuccgcuaaagaggccguggaggacgaaagauucugggaucuggugcaucgagaacgggagcuucacaagcaggggaagugcgcaacaugcgucuacaacaugaugggcaaacgggagaagaaguugggcgaguucggcaaggcuaaggggagccgcgccauuugguacauguggcuuggcgcaagauuccucgaguucgaagcccuggguuucaugaacgaagaccacugguuuagccgcgagaauagcuuauccgggguggagggggaagggcuccacaagcugggcuacauccuccgggacaucucaaagauacccgggggcaacauguacgccgaugacacggccggcugggauacccgcaucaccgaggacgaccuacaaaacgaggccaagaucacggacaucauggagcccgagcaugcccugcucgccaccuccaucuucaagcucaccuaccaaaacaaggugguccgagugcagcggccggcgcggaacgggaccguaauggacguuauuucccggcgcgaccagcggggauccggucaggucggaacguauggccugaacaccuucaccaacauggaggcccagcuuauucggcagauggagagcgaggggaucuuccugcccuccgaacuggagacccccaaccuggccgaacgggugcucgacuggcuugagaagcacggcgucgagcggcugaagcggauggcgaucagcggagaugacugcguggugaaacccauugacgaccgcuuugcgacggcgcucacugcccugaacgauaugggcaagguacggaaggacaucccccaaugggagcccuccaaaggguggaacgacuggcagcagguccccuucugcucgcaccacuuccaucagcugaucaugaaggacggacgcgagaucguaguccccugccggaaccaggacgaauugguuggccgcgccagggugagccagggagccggauggucccugcgcgaaaccgccugccuugguaaaagcuacgcgcagauguggcagcucauguacuuccaucggcgcgaccugcggcuggccgcgaacgcgaucugcuccgcagugccgguggauuggguuccaacgucacgcacaaccugguccauccacgcccaccaucaguggaugacgaccgaagacaugcucucgguguggaaccgcguguggaucgaagagaaccccuggauggaagacaagacgcauauuuccagcuggggcgacgugcccuaccugggaaagcgggaggaccaguggugcgggucacugaucggccucacagccagggccacuugggcgaccaacauccaaguagcaauaaaccaagugcggaggcugauagggaacgagaacuaccuggacuacaugacaucuaugaagcgguucaagaacgaaucagacccugaaggcgcucucugguga

SEQ ID NO: 24145 - RNA, 9879 nt, Artificial Sequence
  derived and/or modified CDS sequence (opt11) from DENV-1__FJ182034__SS-prME
agcgugaccaugcuucucaugcugaugcccaccgcccuggcuuuucaccuaacaacccggggcggggagccccacaugaucgugagcaagcaggagcggggcaagagccugcuguucaagaccagcgcaggggugaacaugugcacuuuaaucgccauggacuuaggcgagcucugcgaggacaccaugaccuacaagugcccccgcaucaccgaagccgaacccgacgauguggacugcuggugcaacgccacggacacgugggugaccuaugggaccugcagccaaacuggcgagcaccgccgggauaagcgguccguagcgcucgcgccucaugugggcuuggggcuggagacccgcaccgagaccuggaugagcuccgagggcgccuggaagcagauccagcguguggaaacuugggcucuccgccaucccggguucacggugaucgcccuauuccuggcgcaugccaucggcacaagcaucacccagaaggggauuaucuucauccuucugaugcuggugaccccauccauggcuaugcggugcgucggcauuggcagccgcgacuucguggaggggcucuccggcgccacguggguggacguggugcuggagcaugggagcugcgugaccaccauggcaaaagacaagcccacccuggacaucgagcuccugaagaccgaggucacgaaucccgcggugcuacggaagcucugcaucgaggccaagaucaguaacaccaccacugacagccgcugcccgacccagggcgaagccacccugguggaagagcaagaugccaacuucgucugccggcgcaccuucgucgaccggggcugggggaacggcugcgggcuguucggcaaagggucccucaucaccugcgccaaguucaagugcgugacuaagcuggagggcaagaucguccaguaugagaaucugaaguacagcgugauaguuaccguccacaccggcgaccagcaccagguagggaacgaguccacggagcacggcaccacugcgaccaucacgccccaggcccccagcacggagauucagcucaccgacuacggggcccugacccuggacugcucgccccggaccggccucgacuuuaacgaaaugguccugcugacgaugaaggagaaguccuggcucguacacaaacagugguuucuggaccuaccguuacccuggaccagcggcgccuccaccagccaggagaccuggaaucggcaggaccugcuggugacguucaagaccgcccaugcgaagaagcaagaggucgucgugcucggaucccaggagggcgcaaugcacaccgccuuaacgggcgccacggaaauccagaccagcggcaccaccacgauauucgccggccaucugaaaugccgccugaagauggacaagcugacccugaaagguauguccuauguuauguguacagggagcuucaagcucgagaaggagguggcggagacccagcaugguacgguauugguacagaucaaguacgagggcaccgacgcccccugcaagauccccuucuccacccaagacgagaagggaguaacccagaacggccggcugaucacggccaaccccaucguaaccgacaaagaaaagcccguaaacauugaagccgagccgcccuucggggagucauacaucgugauuggcgcgggagagaaggcucugaagcuuuccugguucaagaaagggagcagcaucggcaagauguucgaagccaccgcacgcggggcacggcgcauggcuauccugggcgacaccgccugggacuucgggagcaucgguggcguguuuacgucagucggaaagcugguccaccagaucuucggcaccgcauacgggguucucuucagcggcguauccuggaccaugaagaucgggauaggcgugcugcugacauggcuuggcuuaaacagccgcucuacgucucuauccaugaccugcaucgccguugggcucguaacccuguaccugggcgugaugguccaggccgacagcgguugcgucaucaacuggaaggggcgggagcucaagugugggagcgguauauucgugaccaacgaggugcacacauggaccgagcaguacaaguuccaggcggauaguccgaaaagacucagcgcggccaucggcaaggccugggaggaggggguuugcggaauccggucagcuacccgccuggagaacaucauguggaagcagauuagcaacgaauugaaccacauccugcuggaaaacgacaugaaguuuaccguuguggucggcgacgucgcggggauccucgcacaggggaagaagaugauaaggccccagcccauggaauacaaguacuccuggaaguccuggggcaaggccaagaucaucggcgccgacguacaaaacacgacguucaucaucgacgggccaaacaccccggagugccccgacgaccagcgcgcguggaacaucugggaggucgaggacuacggcuucgggaucuucaccaccaauaucuggcugaaguugcgggacuccuacacacaggugugugaucaccgccucaugagugcugccauuaaggacuccaaggccguacacgccgacauggguuacuggaucgagagcgagaagaacgagaccuggaagcuggcgcgggccuccuucaucgaggugaagaccugcaucuggcccaaaagccacacccugugguccaauggagugcucgagagcgaaaugauaauccccaaaaucuacggggggccuaucucccagcacaacuaccgcccuggguacuuuacgcagaccgccggucccuggcaccuggggaagcuagaacucgacuucaaccuaugcgagggcaccaccguggucguggacgagcacugcggcaaucggggcccgagccuacgcacgaccaccgugaccggcaaaaucauccaugaguggugcugccgguccugcacgcugccaccccuccgcuucaaaggggaggacggcuguugguaugguauggagauccggcccgucaaggagaaggaagagaaccugguuaaaucaauggugagcgccggcucgggcgagguagacucauucucccucggccuucuguguaucucgaucaugaucgaggaagugaugagaucccgguggagccgcaagaugcucaugaccggcacacuggcuguguuuuuccuguugaucauggggcagcugaccuggaaugaccugauccggcucugcaucaugguaggcgcuaacgccuccgaccgcauggggauggggaugacguaccuggcccuaauggccaccuucaagaugcgcccgaugcucgccguuggccugcuguuccgccgccucaccagcagggaggugcugcugcucaccaucggacugucccuggucgcgagcguggagcuacccaauucccuggaggaacugggcgacgggcuggccaugggcaucaugaucuugaagcugcucacggacuuccaaagccaccagcugugggccacccuuuugucccugaccuucaucaagacgacuuacagccugcacuacgccuggaagaccauggcgauggugcucuccaucgugucgcuguucccccucugccuaucuaccacaagucagaagacgaccuggcugcccgugcugcucggcucccuggggugcaagccgcugaccauguuccucauugcggagaacaagaucugggggagaaagagcuggccacugaaugaggggaucauggccgucggcaucgugagcauucugcucuccagccuucugaagaacgacgugccacucgccgggccccugaucgccggcggcaugcuaaucgcaugcuacgucaucuccgggagcuccgccgacuugagccuggagaaggccgcagaggugagcugggaggaggaggccgagcacaguggcgcgucccacaacauccugguggaaguccaggacgaugggacaaugaagauaaaggacgaggagcgggacgacacacugaccauccuccucaaagccacccucuuagccgugagcggcguguacccgcucuccaucccagccacccucuucgucugguacuuuuggcagaagaagaagcaacgcagcggggugcugugggacacccccagcccgcccgaaguggagcgcgcggucuuagacgacggcaucuaccgcaucaugcagcggggccugcucggacgaagccaggugggcgugggcgucuuucaggaaaacguguuccacacgauguggcacgugacccggggcgcgguucugauguaccaagggaaacgccuggagcccuccugggccagcgugaagaaagaccucaucuccuacggcggcggguggcgacugcagggcagcuggaacacaggugaagagguccaggucauagcgguugaacccgggaagaaccccaagaacgugcagaccgcccccgggacguucaaaaccuccgagggcgaagucggugcuaucgcgcuugacuuuaagcccgggacaucgggcucacccauuguaaaccgcgaggggaagaucgugggccucuauggcaacgggguaguuaccacuuccgguacuuacguuagcgccaucgcccaggccaaggcgucccaggaggggccacugccagagaucgagaacgaaguuuuccggaagcggaaccugaccauaauggaccuccaccccggcucagggaagaccagacgcuaccugcccgcuaucgugcgggaagcgaucaaaagaaagcugcgaacccucauccuggccccgacccgcguggucgccucagagauggccgaggcccugaaggggaugccgauacgcuaccagaccaccgccgucaagagcgagcacacgggaaaagagaucguggauuuaaugugccacgccaccuucaccaugcgucugcugaguccgguccgugugccgaauuacaacaugaucaucauggacgaggcacacuucacagacccuagcuccaucgcggcccggggauauaucagcacacgcgugggcaugggggaggccgccgccaucuucaugaccgccacaccgccgggcuccgucgaggccuucccccagagcaacgccgugauccaggacgaggagcgggacaucccggagcgcuccuggaacucaggguacgaguggaucacagauuuuccuggcaaaacggugugguucguccccuccaucaagagcgguaacgauaucgccaacugccuccggaaaaacgggaagcgcgucauccagcuuucccggaagaccuuugacaccgaguaccagaagaccaagaacaacgacugggacuacguugucacgacagacaucagcgagaugggugcgaacuuccgcgccgaucgggugaucgacccucgccggugucugaagccagugauucucaaggacggucccgaacgcgucauccuggccggcccuaugcccgugaccgucgccagugccgcucagcgucguggacggaucggccguaaccacaacaaggagggugaucaguacaucuauauggggcagccguugaacaacgacgaggaucacgcccacuggaccgaggccaagaugcuccucgacaacaucaacacgcccgaggguaucaucccggcccuguuugagccugagcgggagaaguccgccgcgaucgacggggaguaccgccuccgcggcgaggcccguaagaccuucguagagcugaugcguagaggugaccugccgguguggcucagcuacaaagucgccucggagggcuuccaguacagcgaccgccgguggugcuucgacggugagcgcaacaaccaggugcuggaggaaaacauggauguggagaucuggaccaaggagggggagcggaagaagcugcgcccccgguggcucgacgcccgcacguacuccgacccccuggcccuccgggaauucaaggaguucgccgcuggccgucggagcgucucuggcgaccucauacuggagaucggcaagcugccccagcaccucacgcagagggcgcagaacgcccuggacaaccuggugaugcuccacaacagcgagcaaggcggucgggcuuaucgccacgccauggaggagcugccggacaccaucgagaccuuaaugcuccuggcccugauagccgugcugaccgggggugucacccucuucuuccuguccggccgggggcucggaaaaaccagcaucggccuguugugcguaauggccucguccguccuccuguggauggcguccgucgagccccacuggaucgccgccagcauaauccuggaauucuuccucauggugcugcugauccccgagcccgaccgccagcggaccccacaagacaaccagcucgcuuacguggucaucgggcuguuauucaugauacugaccguggccgcgaacgagaugggccugcuugaaaccacgaagaaggaccucgggauaggccacguagccgucgagaaccaccaccaugccgccaugcuggacguggaccugcacccagccuccgcguggacccucuacgccguagccaccacgaucaucacuccaaugaugcggcacaccauugagaacacuaccgcuaacauuagccugacggccaucgcgaaccaggcagcuauccugauggggcucgacaagggcuggcccaucuccaagauggacaucggcgucccccuguuagcccucgggugcuacagccaggugaacccccugacucugaccgcggccguguugaugcucgucgcccauuaugccaucaucggucccggccugcaggccaaagcaacccgggaggcccagaaacgcacggccgccggcaucaugaagaacccgaccguggacgggaucguggccauugaccuggaccccgucguguacgacgccaaguuugagaagcagcugggucagaucaugcugcuuauccuuugcaccucgcagauccuguuaaugcgcaccacgugggcccugugcgagagcaucacccuugccaccggcccucuaacgacgcuaugggaagggagccccggcaaguucuggaacacaaccaucgcggugagcauggcaaacaucuuccgggguagcuaccuggcgggcgccggcuuggccuucucucugaugaagucccuggggggcgggcgccggggcaccggugcccagggggagacgcucggcgagaaguggaagcgccagcugaaucagcuguccaagucagaguucaacaccuauaagcgauccgguaucauggagguggaccgcagcgaggcuaaggagggccuuaagcgcggggagaccaccaagcacgccguuagccgaggcacggcaaagcugcggugguucguggagcgcaaccuggucaaaccggaggggaagguaaucgaucugggcugcgggcgcgggggguggagcuacuauugcgccgggcucaagaaggucaccgaggucaaggguuacaccaaaggugggcccggccacgaagagcccauaccaauggccacuuacggauggaaccuggucaagcugcacuccggcaaagacguguucuucaucccgcccgaaaaaugcgacacgcuccugugcgacauaggggagagcucgcccaaccccacaaucgaggagggccgcacccugcgaguccuaaagaugguggagccguggcugcgagggaaccaauuuugcaucaagauccugaaccccuacaugccuagcgucgucgagacccucgaacagaugcagcggaagcacggcggcaugcuggugcgcaacccccugucccggaacucaacgcacgagauguacuggguguccuguggaaccggcaacauugucagcgcgguaaacaugacaucucgcaugcuccugaaccgguuuaccauggcccaucgcaagccgaccuacgagcgggauguggaccugggggccggcacacggcacgucgccguggaacccgagguggccaaccucgacaucauuggucagcgcauagaaaacauuaagcacgagcacaaaagcaccuggcacuacgacgaggacaauccauacaagaccugggcguaucacggcaguuacgaagucaagcccagcggauccgcguccagcauggugaacgggguagugaagcugcugaccaagccgugggaugugauccccauggucacgcagaucgcaaugaccgacacuacuccguucggccaacaacggguguuuaaggagaagguggauacacgcacuccgaaggccaagcggggaaccgcccagaucauggagguuaccgcgaaguggcucuggggcuuucugucccgcaacaagaagccccggauuuguacgcgcgaggaguucacccguaaggugcggucuaacgccgccaucggggccguguucgucgacgagaaucaguggaacuccgcgaaggaggccguagaagacgagcgguucugggaccuggugcaccgcgagcgggagcuccauaagcaggggaaaugcgcgaccugcguuuacaacaugauggggaaacgcgaaaagaagcugggggaguucgguaaggccaaggggagccgggccaucugguacauguggcugggcgcgcgcuuccucgaguuugaggcccugggcuucaugaacgaggaccacugguuuuccagggagaacucgcucuccgggguagaaggcgaggggcuacauaagcuggguuacauccugcgcgacaucucuaagauuccuggagguaacauguacgccgacgacacagcuggcugggacacucggaucacggaggacgaccuccagaacgaggccaagaucaccgauauaauggagcccgagcacgcguuacuggccaagaguaucuucaagcucacuuaccaaaacaaggugguccgggugcagcggccagccaaaaacgggacgguuauggacguaaucagccgccgcgaccagcgcggauccggccaagugggcacauacgggcugaacacuuucacaaacauggaggcccagcugauccgccagauggaaagcgaagggaucuuuucccccagcgagcucgagacgcccaacuuggccggcagggugcuggauuggcucgagaagcacggugucgagcgacugaaacggauggcaaucuccggcgacgacugcgugguaaagcccaucgacgacagauucgccaccgcguuaacggcccucaacgauauggguaaaguccggaaggacaucccgcaaugggagcccagcaagggcuggaaugacuggcagcagguccccuucugcagccaccacuuccaccagcugaucaugaaggacggccgcgagaucgugguccccugccggaaucaggacgagcucgugggacgcgcccgggugagccagggcgcgggguggucucuccgcgagacagccugcuuaggcaaguccuacgcccaaauguggcagcugauguacuuccaucggagggaccuccggcuggccgcgaacgccaucuguucugccgucccgguagacugggugcccacgucccggaccaccuggagcauccacgcccaccaccaguggaugaccacggaggacauguuguccguauggaauagaguguggaucgaggagaaucccuggauggaggacaagacccacaucagcucuuggggagacguacccuaccucggcaagcgcgaggaccaguggugcgggagccugaucgggcugacagcccgggcgaccugggccacaaacauccaagucgcuauaaaucaggugcgccgccucaucggcaacgagaauuaccuggacuacaugaccuccaugaaacgguuuaagaacgagagugauccggaaggggcccuuugguaa

SEQ ID NO: 24146 - RNA, 9879 nt, Artificial Sequence
  derived and/or modified CDS sequence (opt11) from DENV-1__FJ182036__SS-prME
uccgugaccaugcuguuaaugcugaugcccaccgcacuggccuuccauuuaaccacccggggcggggagccccacaugaucgugucaaagcaggaacggggcaagagccuauuguuuaagacaagcgccggggugaacaugugcacccucaucgcgauggacuugggcgagcucugugaagacaccaugaccuauaaguguccacggaucaccgaaaccgaacccgacgauguggacugcuggugcaaugccacggacacgugggugaccuacgggaccuguucucagaccggcgaacaccggcgggauaagcggucaguggcacucgcgccccauguuggccugggccuggagacccguaccgagaccuggaugagcagugagggcgccuggaagcagauccaaagagucgagacgugggcccuccggcacccuggguucaccgugaucgcccuuuuccuggcccacgcgauugguacuagcauaacccagaaggggauaaucuuuauacuacugauguuagccacgcccagcauggcaaugcggugcgugggcaucggcagcagggacuucgucgagggucucuccggagccaccuggguggacguuguucuggaacacgggucuugugugaccaccauggccaaggacaagcccacgcuggauaucgagcuccugaagacugaagugaccaaccccgcaguccugaggaagcucugcaucgaggccaagauauccaacaccacuaccgacagccgcugcccgacgcagggcgaggcgacccugguggaggagcaggaugcaaacuucgugugccggcgcacguucguagaccgggggugggggaacggcugcggguuguucggcaaggggucccucaucacaugcgccaaguucaaaugugugaccaagcuagagggcaagauugugcaguacgagaaucugaaguacagcgucaucgugaccgugcacacgggcgaucaacaucaggucgggaacgaguccacagagcacgguaccaccgcgaccaucacgccccaggcccccacuacggagauacagcucaccgauuacggggcccugacgcuggacugcagcccgcgcaccggccucgacuuuaacgagaugguguugcugaccaugaaggagaaguccuggcucguccacaagcaaugguuccuugaccugcccuuacccuggaccagcggggccagcacuucccaggagaccuggaaccggcaagaccugcucgugacauucaagaccgcccacgcgaagaaacaagagguggucgugcucggcucccaggagggagccaugcacacggcccuaaccggcgcuacagagauccagaccucuggcacgacuaccaucuucgcugggcaccugaagugucgccucaaaauggacaagcugacucugaaaggcauguccuacguaaugugcaccggguccuuuaagcucgagaaggagcuggcggagacccagcacggcaccguccugguacagaucaaguacgagggcaccgaugcccccugcaagauccccuucuccacacaggacgagaagggggugacccagaacgggcggcugaucacagcaaacccuaucgucaccgauaaggagaagcccgugaacaucgaggccgaaccgcccuucggggaguccuacaucgugaucggagcgggcgagaaggcccucaagcugucgugguuuaagaagggcagcagcaucggcaagauguucgaggccacggcccgcggggcccggcgcauggcgauacugggcgacaccgccugggacuucgggucaaucggcggcgucuucaccucuguggggaaacucgugcaccagaucuucggcaccgccuacgggguacuguucucaggcguaucguggacuaugaagauugggaucggcguccugcucacguggcugggccugaacagucgcagcaccucccucagcaugacuugcauagccguggggcuggugacgcuguaccucggcgugaugguccaggccgauuccgggugcgugaucaacuggaagggccgggagcugaagugcgggagcggcauuuucgugaccaacgagguacacaccuggaccgaacaguacaaauuccaggcggacagcccgaagcgccuguccgccgccaucggaaaggccugggaggagggugugugcggcauccggucagccacccgccucgagaacaucauguggaagcaaaucuccaacgagcugaaccauauccuacucgaaaacgauaugaaguucacgguaguugugggagacguagcaggcauccuagcccaggggaagaagaugauccgcccccagcccauggaauacaaauacucauggaaauccuggggcaaagccaagauuaucggcgccgacguacagaacaccacauucaucaucgauggucccaacaccccggagugccccgacgaucaacgcgcguggaacaucugggaaguggaggauuacggcuucgggaucuucacgaccaacauauggcugaagcugcgggacagcuauacccaggugugcgaccaccgccugaugucggcugccaucaaagauagcaaagccguccacgccgacaugggcuacuggaucgaguccgagaagaaugaaacguggaagcuggcgagggccucuuucaucgaggugaagacuugcaucuggcccaagagccacacccucuggaguaacggcgugcuggaguccgagaugaucauccccaagauauauggggggccgaugagccagcacaacuaucgcccuggguacuucacacagaccgccggaccuuggcaucuggggaagcucgagcuggauuucgaccuaugugagggcacgaccgucgucguagaugaacacugcgggaaccgagggccaucccuccggaccaccacggucaccggcaagaucauccacgaguggugcugccggagcugcacccugcccccccuucgcuuccgcggggaggacggcugcugguacgggauggagauucgcccagugaaggaaaaggaagagaaccuugucaagucaauggucucagccggauccggcgaaguggauuccuucagccuggggcuucucugcaucuccaucaugaucgaggaggugaugcggagccgguggucccguaagauguuaaugaccggcacgcuggccgucuuuuucuuacugaucauggggcagcugaccuggaacgaccucauucgccuguguaucauggucggcgcgaacgccagcgaccgcauggggaugggcaccaccuaccuggcccucauggccacguucaaaaugcggccgauguucgcgguggggcuucuguuccgccgucucaccuccagggagguauuacugcuaaccauuggucugagccugguggcgucaguggagcuccccaauagccuggaggagcugggcgacgggcucgccaugggcauuaugauccugaagcugcucaccgacuuccaaucacaccagcuaugggccacgcugcucagccugaccuucaucaagaccaccuucucccugcacuacgccuggaagacaauggcgaugguccuuagcaucgugucgcuguucccccugugcuugagcaccacuucccagaagaccaccuggcuccccgucuuacucggcagcuuagggugcaaaccucugaccauguuucucaucgcggagaauaaaaucuggggucggcggucguggccacugaaugagggaaucauggccgugggcaucguguccauccuguugucgagccugcugaagaacgacgucccccucgcaggaccccugaucgccggcggcaugcuaaucgcaugcuacgugaucagcggguccagcgccgaucucucccuggagaaggcugcggagguaaguugggaggaggaggccgagcauagcggagcgucgcauaacauccucgucgagguccaggacgaugguacgaugaagaucaaggacgaagagcgggacgacacucucaccauccuguugaaagccacgcuccuggccgugucgggcguuuauccccuguccauccccgccacccucuucguuugguacuucuggcagaagaagaagcagcggaguggagugcucugggacacacccagcccgccggaggucgagcgggcagugcuggacgacggcaucuacaggauuaugcagcggggccuccucggucgcucccaggugggggucggaguguuccaggagaacguguuucacaccauguggcauguaacgagaggcgcggugcugauguaucagggcaagaggcuggagcccagcugggccuccgugaagaaggaccucaucagcuacggcggcggguggcggcugcaaggcuccuggaauaccggggaggagguccaagugaucgccguggagccaggcaagaaccccaagaacguccaaaccgcucccgggaccuucaagacgccagagggcgaggugggcgccaucgcguuagacuuuaagcccgggaccagcggaucccccaucgugaaccgcgaggguaagaucgucggccucuacgguaacgggguggugaccaccagcggcacguacgucagcgccaucgcccaagcgaaggcgucccaggagggaccgcugcccgagaucgaagaugaaguguuccggaagcgcaacuuaaccaucauggaccuccaccccggcucagggaaaacccggcgcuaccugccggccaucgugcgggaggccaucaagcgcaagcugcgcacccucauccuggcccccacccggguaguggcauccgagauggcggaggcccugaagggcaugcccauccgcuaccaaacaaccgccgugaagagcgagcacaccgguaaggagaucgucgacuugaugugccaugccacguuuacgaugcggcugcuaucgccugugcgcgugccgaacuauaacaugauaaucauggacgaggcccacuucacagaccccagcucaaucgcggcccggggguauauaagcacccgcgugggaaugggggaggcggccgccauuuucaugacggcgacgccgcccggcuccguggaggccuucccgcagagcaacgccgugauccaggaugaagagcgggacauccccgagcgauccuggaacagcggguacgaguggaucaccgacuucccgggcaagaccgugugguucgugccgucaauaaagucgggcaacgacaucgccaacugccucagaaaaaacgggaagagagugauccagcugagcaggaagacguucgacaccgaguaccagaagaccaagaacaacgacugggacuacgucgugaccacggacaucagcgagaugggcgcgaacuuccgugccgaccgggugaucgacccgcgcagaugccucaagcccgucauccucaaggauggucccgaacgcgugaucuuggccggccccaugccggugaccguagccuccgcugcgcagaggcgcgggcggaucggucggaaccacaacaaggagggcgaccaguacaucuacauggggcagccccugaacaacgacgaggaccaugcccacuggacagaggccaagaugcuccuggacaacaucaacaccccggagggcaucauccccgcgcuguucgagccggagcgcgagaaguccgccgcgaucgacggggaguaccggcugagaggcgaggcacggaagacguucguggagcugaugcgccgcggggaccugcccguuuggcucuccuacaaggucgccagcgaagguuuucaguacagcgaccgccgcuggugcuucgauggcgagcgcaacaaccagguguuggaggaaaacauggacgucgagaucuggaccaaagagggggagcgcaaaaagcugcgcccccgguggcucgacgccaggacauacuccgacccgcuagcccuccgggaguucaaagaguucgcggccggccgccggagcgugaguggcgaucucauacuagagaucggcaaguuaccgcagcaucucacccagcgggcccaaaacgcgcuggacaauuuggugaugcuccacaauagugagcaaggcgggcgggcguaccgccacgccauggaggaacugcccgacaccaucgaaacccugauguugcuggcccugaucgccguccucaccggcgggguuacccuguucuucuuauccggccguggguuaggaaagaccagcaucggccugcugugcgugauggccuccagcguacuccuguggauggcguccguggagccccacuggaucgccgccagcauuauacuagaguuuuuccucaugguccugcugauccccgaaccggaccggcaacggacgccccaggacaaccagcucgccuacguugugaucgggcugcuguucaugauccucacuguggcggcgaacgagaugggguuacucgagaccaccaagaaagaucucgggauaggccaugucgcaguagagaaccaccaccacgccgcaaugcuggacguggaccugcaucccgccuccgcguggacgcucuacgccgucgcaaccaccaucaucacccccaugaugcgccauacgaucgaaaauaccaccgccaacauuagcuugaccgccaucgcgaaccaggccgccauccugauggggcucgauaagggcuggcccaucuccaagauggacaucggcgugccucugcucgcccucgggugcuacagccaggucaacccccuaacgcugaccgcggccguccucaugcugguggcccacuacgccaucauaggcccggggcugcaggcuaaggcaacccgcgaggcccagaagcggaccgccgcuggcaucaugaagaacccuacgguggacggaaucgucgcuauagaccuggacccagugguguacgacgcgaaguucgaaaagcagcuaggccagaucaugcugcucauccugugcacgucccagauccugcucaugcgcaccaccugggcccugugcgaaagcaucacacuggccaccggccccuuaaccacccuuugggagggguccccggguaaguucuggaacacgacgaucgccgucagcauggccaacaucuuccgggggucauaccuggcaggcgccggcuuggccuucagccugaugaaaucccucgggggcgggcgcagagggaccggugcccaaggugagacacuuggcgagaaguggaagcgccaguugaaccagcuguccaagagcgaauucaacacguacaagcgcagcgggaucauggagguggaccggagcgaggcgaaagagggacucaagcggggcgagaccacaaagcacgccgugucccgcggcaccgcuaaguuacggugguucgucgagcguaaccuugugaaaccggagggcaagguuaucgacuuaggcugcggccgcggcggauggagcuacuacugcgccgggcucaagaaggucacggaggugaaaggcuacacaaagggaggcccgggccacgaggagcccaucccaauggccaccuacggguggaaccuggugaaauuacacuccggcaaggacgucuucuucaucccgcccgaaaagugcgacacccucuugugcgacaucggggagagcucccccaacccgacgaucgaggagggccgcacccugcggguucucaagaugguggagcccuggcugcgggggaaccaguucugcaucaagauccucaaccccuacaugcccagcguagucgagacccucgagcagaugcagcggaagcacggcggcaugcugguaaggaacccccugucccggaacuccacccacgagauguacugggucucgugcgggacugguaacaucgugagcgcggugaauaugacgucccgcaugcuccugaacagauuuaccauggcccaccggaagcccaccuacgagcgcgacgucgaccugggggccgguacccggcacguggccguggagcccgaggucgcuaaccucgacaucaucggccagcgcaucgagaacaucaagcacgaacacaagagcacguggcacuacgacgaggacaaucccuacaagaccugggcguaccauggguccuacgaggugaagccgagcggcuccgccagcagcauggugaacggggucgucaagcugcugaccaagccuugggacguuauccccaugguuacccagaucgccaugacggacaccaccccuuucgggcagcagcgaguguucaaggagaaggucgauacccgcacgccgaaggccaagcgugggacggcacagaucauggaaguuaccgcgaaguggcuauggggcuuccugucccgcaacaagaagccacggaucugcacccgggaagaauuuacucggaaggugcgcagcaacgccgccaucggugccgucuucguggacgaaaaccaguggaacuccgcgaaggaggccgucgaggacgagcgguucugggaccugguucauagggagagggaguuacacaagcagggaaagugcgcgaccugcguguacaauaugaugggcaagcgcgaaaagaaguugggggaguucggcaaggcgaaggggagccgggcuaucugguacauguggcugggcgcgcgcuuuuuggaguucgaggcacugggcuucaugaacgaagaccacugguucucccgggagaacucacugagcgggguggagggcgagggucuccacaaacugggcuauauccugcgcgacaucagcaagauccccgggggcaauauguaugccgacgacacugccggcugggacacccggaucacggaggacgaccuucaaaacgaggcgagaaucaccgauaucauggagccggagcacgcucuacuggccaaaaguaucuucaaauuaaccuaccagaacaagguagugcgugugcagcggcccgcuaagaacgggaccgucauggaugugauuucccgucgggaccagcgcggcuccggccagguggguacuuacggccugaacaccuucaccaauauggaggcgcagcugauucggcagauggagagcgaggggauuuucucacccucugaguuggagacacccaaccuggccaaacgcguccucgacuggcucgagaaguacggcguggagcgucugaagaggauggcaaucuccggggacgacugcguggucaaacccauugaugacagauucgccacggcccugacggcccucaacgacaugggcaaggugcgcaaggacaucccccagugggagcccagcaagggguggaacgauuggcagcagguucccuucugcucccaccacuuccaccagcuuaucaugaaagacggccgggagaucgucguaccgugccgcaaccaagacgagcuggugggccgggcccgugucagccagggggcgggcuggagucuccgggagaccgccugccuagggaaguccuacgcccagauguggcagcugauguacuuccaccgccgggaccugcgccuggccgcgaacgccaucugcagcgccgugcccguggacuggauccccaccucucggacgaccuggagcauccacgcccaccaucaauggaugaccaccgaggacaugcuguccgucuggaacaggguuuggauagaagagaaccccuggauggaagacaaaacccacaucucuuccuggggcgacgugccauaccuggggaagagggaggaccaguggugcggcagccucaucggucuuacugcccgggcgacuugggccaccaacauacaggucgccaucaaccaggugcgccggcucaucgggaaugagaacuaccuggacuacaugaccuccaugaagcgcuuuaagaaugagagcgaccccgagggcgcccugugguga

SEQ ID NO: 24147 - RNA, 9879 nt, Artificial Sequence
  derived and/or modified CDS sequence (opt11) from DENV-1__FJ205876__SS-prME
uccguaacuaugcugcucaugcucaugccaaccgcccuggccuuucaccucaccacccggggcggggagccccacaugauugugaguaagcaggagcggggcaagagccuauuauucaaaacgucagccggggugaacaugugcacccuuauagccauggaccugggcgagcugugcgaggauacaaugaccuauaaauguccccggaucaccgagaccgagccagacgacguggacugcuggugcaacgccacggacaccugggugaccuaugggaccuguagccagacaggggagcacaggcgggacaagcgguccguugcccucgcgccccacgugggccucgggcuagaaacccgcaccgagaccuggaugagcuccgaaggggccuggaagcagauccagcgcguggagacgugggcccuccgucaccccggcuucaccgucauagcccuguuccuggcccacgcuaucggcaccagcauuacccagaaggggaucaucuuuauucuccucauguugguuacuccguccauggccaugcgaugcgugggcauaggcucacgggauuucguggaggggcucuccggcgccaccuggguggacgucgugcucgaacacggguccugcguaaccaccauggccaaagacaagcccacgcuggacaucgagcuacugaaaaccgaggugacaaauccagcugugcugagaaagcucugcaucgaggcgaagauuucuaacacgacgaccgacagccgcugcccgacccagggcgaggccacccugguggaggagcaagacgccaacuucgucugccggcgcacguucguggaucggggaugggguaacggcugcggacuguucgggaaggggucccuaauuaccugcgccaaguucaaaugcgugaccaagcuggagggaaaaaucguccaguacgaaaaccugaaauacagcgugaucgugacuguccacacgggcgaccagcaccaaguggggaacgaguccaccgagcauggaaccaccgccacgaucacgccacaagcccccaccacggagauccagcuaaccgauuacggcgcucugacccuggacuguagcccacgcaccggccucgacuucaacgagauggugcugcugaccaugaaggagaaguccuggcucgugcauaagcagugguuccuggaccugccccucccuuggacaagcggagccagcacgucccaggagaccuggaaucggcaggacuuacucgugacauucaagacagcccacgcgaagaagcaagaaguuguggugcucggcucccaggagggggcgaugcacacugcccuaaccggggccaccgagauccagaccucaggcacgaccacuaucuucgccgggcaccugaagugccgccucaagauggacaagcugacucugaaggggaugucuuacguuauguguacgggguccuucaagcuugaaaaggagguggccgaaacccagcacggcaccguucuggugcaaauaaaguacgagggcaccgacgcgcccugcaagauucccuucucgacgcaggacgaaaagggggugacccagaacggacggcugauuaccgcaaacccgauuguaaccgauaaggagaaaccgguuaacaucgaggccgaaccgccguucggcgaguccuacaucgugaucggugcuggcgagaaggcgcugaagcucagcugguucaagaagggcuccagcauuggcaagauguucgaggccacggccaggggggcccggcgcauggccauccugggcgacacugccugggacuucggguccauagguggaguguucaccagcgucggcaagcuggugcaccagauauucggcaccgccuacggcgugcuguucucaggcgucagcuggacgaugaagaucgggauuggcguucugcugacuuggcucggucugaacucccgcagcaccucgcugagcaugaccuguauugccgucgggcucgucacgcuguaccuuggcguuauggugcaagccgacuccgggugcgugauaaacuggaagggccgggagcuuaaaugcgggagcggcaucuucgugaccaacgaagugcacaccuggacugagcaguacaaguuccaagccgauagcccgaagcgacuuuccgcggccaucggcaaggcaugggaggaggggguuugcggcauccggagcgccacccgccuggagaacaucauguggaaacagaucuccaacgaacugaaucacauccugcuagagaaugacaugaaauucacggugguuguuggggacguggcaggcauccucgcgcagggaaagaagaugauaagaccccagccaauggaguauaaguauucauggaagucgugggggaaggcaaagaucauuggcgcugaugugcagaacacgaccuucaucaucgacgggcccaacaccccggagugcccggacgaccagcgcgccuggaacaucugggagguagaggacuacggcuuugggaucuuuacgacaaauauuuggcugaagcugcgugacucuuacacucaggugugcgaccaccgccucauguccgcagccaucaaggauagcaaggccguccacgcagacaugggauacuggaucgagagugaaaagaacgaaaccuggaagcuggccagagcgagcuuuauugagguuaaaacaugcaucuggcccaagucccauacacuguggagcaacggcguucuagaguccgagaugaucauccccaagaucuacggggguccgauuagccaacacaauuaucggcccggguacuucacacagacagccggccccuggcaccuaggcaagcuggagcucgauuucgaccuaugcgaaggcaccaccguggucguggacgagcacugcggcaaccgugggccgucccugagaaccaccaccgucacggggaagaucauacacgaguggugcugucggagcugcacccugcccccucuccgcuuucgcggggaggacggcugcugguacgggauggagauacgccccgugaaggaaaaggaggagaaccucguuaaauccaugguaagcgcaggaagcggcgaagucgacaguuucagcuugggacugcugugcaucuccaucaugauugaggaggugaugcggagccgcugguccagaaagauguugaugaccggcacauuagccguuuucuuccuacucaucaugggccaacugaccuggaaugaccugauacggcucugcaucauggucggcgccaacgcgagcgaccgcauggggaugggcaccacauacuuggcccugauggccacguucaagaugcggccgauguucgccgugggacuccuguuccgccggcugaccucccgcgagguacuccugcugacgaucgggcucagccucguggccuccguggagcuucccaacagccucgaggagcugggagacgggcuggcaauggggaucaugauccucaaacugcugaccgauuuucagucccaccagcucugggccacgcugcuaucacucacguuuaucaagaccacauucucccugcauuaugccuggaagaccauggccaugguccuaucgauaguuagucucuucccccugugccuaagcacuaccucccagaagaccacguggcuccccgugcuucuggggagccucggcugcaagccgcucacaauguuucugaucgcggagaauaagauaugggggcggcgauccuggccacucaaugaggggauaauggcaguuggcaucguuagcauucugcugagcagcuugcugaagaacgaugugccccuggccgggccccucaucgcaggcggcaugcucauugccugcuacgucaucagcggcaguucugcggaccucucccucgaaaaagcugcggaggugagcugggaagaggaagccgagcacuccggcgccucccacaacauccugguggagguccaggacgaugggaccaugaaaaucaaggacgaggaaagagaugacaccuugaccauccuucugaaggccacgcuacucgccguuucgggaguguacccgcugagcauuccugccacccuguucgucugguacuuuuggcagaaaaagaagcaacgcuccgggguccucugggacacccccagcccgcccgaaguagagagagccgucuuagacgacggcauauaccguaucaugcagcgggggcugcuggggcgcucccaggugggcgucggggucuuucaggagaacguguuccauaccauguggcacgugacgcggggggccguccucauguaccagggcaaacgccuggagccaucgugggcguccgugaagaaggaccugaucagcuacggcggaggguggcggcuccagggcuccuggaacaccggugaagaaguucaagucaucgccguggagcccggcaaaaaccccaaaaacgugcagacggcccccgggaccuucaaaacgcccgagggcgaggucggcgccaucgcccuggacuucaaacccggaacuuccggcucccccaucgugaaccgcgaggggaaaaucgugggcuuguauggcaacggcguagugaccacgucaggaacguacgucagcgcgauagcccaggccaaggccucccaggaggggccgcuccccgagaucgaggacgaggucuuccgcaagcgcaaccuaaccauaauggaccugcacccaggcagcgggaagacacgccgcuaucucccagcgaucgugcgugaggccauuaagcgcaagcugcgcacccugauacucgccccaacgcgaguugucgcguccgaaauggccgaggcucugaaaggcaugccuauucgcuaccagaccaccgccguuaagagcgagcauaccggaaaggagaucguggacuuaaugugccaugccacuuucaccaugcgguuacuguccccgguucgagugccgaacuacaacaugaucaucauggacgaagcgcacuucaccgaccccagcuccaucgcagcgcggggguauaucagcacucgcgugggcaugggggaggcggccgccaucuucaugacggccacgccgcccggcuccgucgaggcguucccgcaaagcaacgccgugauccaggacgaggagcgugacaucccggagcgcagcuggaacaguggguaugaauggauuacugacuuucccggcaagaccgugugguuuguccccaguaucaagagcggcaacgacaucgcaaauugccugcggaagaacgggaagcgcgugauucagcucucccggaaaacguucgacaccgaguaccagaagaccaagaacaacgacugggacuacguggucaccacggacaucagugaaaugggugccaacuuuagggcggaccgggugauagauccccgccggugccugaaaccgguaauccugaaggaugggcccgagcgcguaauccucgccggccccaugcccgucaccgucgccucugccgcccagcggagaggccggaucgggagaaaccacaacaaggaaggcgaccaguacauuuauauggggcagccccuuaacaacgacgaagaccacgcgcacuggacugaggccaagaugcugcucgacaacaucaauacccccgaggggaucauccccgcccuguuugagccggaacgcgagaagagugccgccaucgacggggaguaccggcugagaggugaggcucggaagacguucguggagcugaugcgccgcggggaccugcccguguggcuguccuacaaagucgcuagcgagggauuccaauacucugaccgacggugguguuucgacggcgagcggaacaaccagguacucgaggaaaacauggacguggaaaucuggaccaaggagggggaaagaaaaaagcugcggccucgguggcuggacgcccgcacguauuccgauccucucgcccugcgggaauuuaaggaauucgccgcgggacgcaggagcgucucaggggaccugauccucgaaaucggaaagcuaccccagcaccugacacagcgugcccagaacgccuuagauaaucugguuaugcugcacaauuccgagcagggcgggcgggccuaccgccaugcgauggaggaguuaccugacacaaucgagacccuuaugcugcucgcccugaucgccgugcucacaggcgggguaacccuguucuuucuguccggccgggggcuggggaaaaccagcaucggccuccugugcgugauggcauccagcgugcugcucuggauggcguccgucgagccucacuggaucgcugccagcaucauccuagaguucuuccugauggugcuccugaucccugagccugaucgccagcggacgccccaagauaaucaacuggcauauguggucaucgggcuccuuuucaugauccugaccguggccgcuaacgagaugggccuccucgagaccaccaagaaggacuuggggaucgggcacguggcgguugagaaccaccaccacgccgccauguuggacguggaucugcacccugccuccgccuggacucuguacgcgguggcuaccaccauuaucaccccgaugaugcgccacacgaucgagaacaccaccgcgaauaucucgcucacugccauagccaaccaggcugcuauucugauggggcucgacaagggcuggcccaucuccaagauggacauaggcgucccccuacuggcccucggguguuacagccaggugaauccauuaacgcugacugccgcggugcugauguuggucgcccacuacgccaucauuggaccaggucugcaggccaaggccacccgcgaggcgcagaagaggacugcugccggcaucaugaaaaauccgacgguggacgguaucguggcgaucgaucuggaccccguuguguacgacgccaaguucgagaagcaacucggccaaaucaugcugcugaucuuguguaccucccaaaucuugcugaugcgcacaaccugggcgcuuugugagucuaucacgcuggcaaccggcccuuugacgacccucugggagggaaguccuggcaaguucuggaacacgacaaucgcagugagcauggccaauauuuuccggggauccuaccuggccggcgcgggcuuagcauuuagccucaugaagucgcucgggggcggacgccgugggaccggggcgcagggcgagacccugggcgagaaauggaaacgccagcucaaccagcuguccaagagcgaguucaauacguacaaacggucagggaucauggaggucgaccgaagcgaggcuaaggagggccugaagcgcggagagaccacuaagcacgcgguguccagaggcaccgcuaagcuucggugguucguggagcgcaaucuggucaagcccgaggggaaggugauugaccuugguugcggccgcgggggguggagcuauuacugcgccggucugaagaaagucacggagguaaaaggguacaccaagggaggccccggccacgaggagcccaucccaauggccacguacggauggaaccucgugaaacugcacuccgggaaggacgucuucuucaucccgcccgaaaagugcgauacguugcucugugauauaggggagagcucccccaacccgacgaucgaggagggccgcacccugcggguccuuaagaugguggagccguggcuccgcggaaaccaguucuguaucaagauacugaacccauacaugcccucagugguugagacccucgagcagaugcagcguaagcacggcgggaugcucgugagaaacccguuaagucggaacagcacucacgagauguauuggguguccugugggacuggcaacauagucuccgccguaaacaugacuucccgcaugcuguugaaccguuuuacaauggcgcacagaaagcccaccuacgagcgugauguggaccugggggcaggcacccggcacgucgccguggaaccugagguggccaaccuggacaucaucggucagcguaucgagaacauuaagcacgagcacaagaguacguggcauuacgacgaggacaaccccuacaagacaugggccuaccacggguccuacgaggucaagccgucuggguccgcaagcuccauggugaacggggucguaaaacuccugaccaagcccugggacguuauccccauggucacccaaaucgcaaugacggauacgacucccuuuggccagcagaggguguucaaggagaagguggacacgcgcacuccgaaggcgaagcgggggaccgcacagaucauggaggucacugccaaguggcugugggguuucuugucccgcaacaaaaagccccggaucugcacgcgcgaagaguucacccguaaggugcgcagcaacgcagccaucggggccguguucgucgacgaaaaccaauggaacuccgcuaaggaggcgguagaggacgagcgguucugggaccugguccaucgcgagcgggagcugcauaaacaggggaagugcgcgacgugcgucuacaacaugaugggcaagcgcgagaagaagcucggggaauucggcaaggcgaaggggucucgggccaucugguauauguggcugggagcccgcuuccuggaguucgaggcgcucggcuucaugaacgaggaccacugguucaaccgggagaauuccuuaagcgguguggagggcgaggggcuccacaagcucggcuacauccugcgugacauauccaagauccccgggggcaacauguacgccgacgacacggccggaugggauacccggaucacagaggacgaccugcagaacgaagcccgcaucacggacauaauggaaccggagcacgcccuccuggcgcgcagcaucuuuaagcugaccuaucagaacaagguaguccgggugcagagacccgccaagaacgggacggugauggacgugaucucccggcgcgaccagcgggggaguggacaggugggaacuuacggccuaaacaccuucaccaauauggaggcucaacugaucaggcagauggaauccgagggaaucuuuucuccuuccgagcuggagacacccaaccuugccgagagaguucuggacuggcucgagaaauacggcgucgagaggcugaagcggauggccaucagcggggacgacugcgucgugaagccgauagacgacagauucgcgacagcccugacugcacugaacgacauggggaagguccggaaagacauaccccagugggagcccagcaaaggguggaacgacuggcagcagguccccuucugcagccaccacuuccaccaguuaauaaugaaggauggccgugaaaucguggucccgugccggaaccaggaugaacucgugggacgcgcccgagugucccagggcgcuggcuggucacugcgcgagaccgcgugucuggggaagagcuacgcccagauguggcagcugauguacuuccaccggcgcgaucugcgucucgcagcuaaugcuaucugcucagccgucccgguggacuggauccccaccagcagaacgaccugguccauucacgcacaucaccaguggaugacaaccgaggacauguugagcguguggaaucgugucuggaucgaggagaaccccuggauggaggauaagacccacaucucaaguuggggagacguaccguaccuaggaaagcgggaggaccaguggugcggcuccuugaucggccugaccgccagggcuacuugggcaacgaacauccagguggccauaaaccaggugcggagacugaucgggaaugagaacuaccucgauuacaugacgagcaugaagcgguucaagaacgaguccgaccccgaaggcgcacugugguag

SEQ ID NO: 24148 - RNA, 9879 nt, Artificial Sequence
  derived and/or modified CDS sequence (opt11) from DENV-1__FJ024455__SS-prME
agcgugaccaugcugcugaugcugaugcccacggcccuggccuuucaccucaccacgcggggcggggaaccgcacaugauagugagcaagcaggagcggggcaagagucuacuguucaagacuagcgugggugugaacauguguaccuuaaucgcaauggaccugggcgagcugugcgaggacacaaugaccuacaaaugcccccggaucaccgaaaccgagcccgaugacguggacugcuggugcaacgccacggacaccugggucaccuacggcaccuguagccaaacgggcgagcaccggcgggacaagcggaguguggcccucgcgccccacgucggccugggccuggaaacgcgcaccgaaaccuggaugagcuccgagggcgccuggaagcagauucagcggguagagacgugggcgcuccggcacccugguuuuacagugaucgcccuauucuuagcccacgccaucgggacuagcauuacacagaaggggaucaucuuuauccuccugaugcuggucacgcccuccauggcgaugcggugcgugggcauagguagcagggauuucgucgaggggcucuccggcgccacgugggucgauguggugcuggaacacggcagcugcguuaccaccauggccaaggacaaacccacgcuggauaucgagcuccugaagaccgaggugaccaaccccgccgugcugcggaagcucugcaucgaggccaagaucuccaacaccacuacggacagccgcugccccacucagggagaggcgacacuggucgaggagcaggacgccaacuuugucugccggcgcacguucguggaccggggaugggggaacgggugcgggcuguucgguaaggggucccuuaucacgugcgccaaguuuaagugcgucaccaagcuggaagggaagaucguccaguacgagaaccugaaguauagcgugaucgucaccgugcacacgggugaccagcaccagguagggaacgaguccaccgagcacggcacaacggccaccauuacgccacaggccccgaccaccgagauccagcucaccgacuacggggcgcugacccuggauuguagcccgcgcacaggccuugacuucaacgagauggugcuguuaaccaugaaggagaagucguggcucguucacaagcagugguuccuggaccugccguuaccguggaccagcggcgccuccacgucccaggagaccuggaaccgucaggaccuccuggucaccuucaagaccgcccacgcgaagaaacaagagguugugguccucggcagucaggaaggagcaaugcacacggcgcugacuggggccaccgagauccagacgucaggcaccaccacgaucuuugccgggcaccugaagugccgccucaaaauggauaagcugacgcucaagggcaugucuuacgucaugugcaccggauccuucaagcucgagaaggagcuggcggagacccagcacggcacgguacuuguccagaucaaguacgagggcacagacgcacccugcaagauacccuucagcacgcaagacgagaagggggugacccagaacgguagauugauaaccgcgaaucccauagugaccgacaaggagaagcccgucaauaucgaggccgaaccgcccuucggcgaguccuacaucguuaucggcgcgggcgagaaagccuuaaagcuguccugguucaagaaggguuccuccaucggaaaaauguuugaggcuacggcccgaggggcuagaagaauggccauccugggcgacacagccugggacuucggcuccauaggcggcguuuucaccuccgucgguaagcucgugcaccaaaucuuuggcacagcguacgggguacuguuuuccggcguuucauggacgaugaagauaggaaucggcguuuugcucacauggcugggcuugaacagucgaaguaccucccucagcaugaccugcaucgccgugggucuagucacucuuuaccuuggagugauggugcaggcugacuccgggugcgucaucaacuggaaaggccgggagcugaagugugggagcggaaucuuugugaccaacgagguccacacauggacagagcaguacaaguuccaggccgacuccccgaagcgccuguccgccgcgauagguaaagccugggaggaagggguuugcgggauacggagcgccacacgccucgagaauaucauguggaagcagaucuccaacgagcuuaaccacauccuccucgaaaacgacaugaaauucacggugguagucggugacguugccggcauauuagcccagggaaagaagaugauccggccccagcccauggaguacaaguacagcuggaagucuugggggaaggcgaagauaaucggugcugacguacagaacacuaccuuuauuaucgaugggccgaacaccccggagugccccgacgaucaaagggcguggaacaucugggagguugaagacuacggcuucgguaucuuuacgaccaauaucugguugaagcuccgggacucuuauacacaggucugcgaccaccgacugaugucggccgcgaucaaggacagcaaagcuguccacgccgacaugggguacuggaucgaguccgagaagaacgaaacguggaaguuggcccgggcuuccuucaucgaggucaaaacauguaucuggccaaagucucauacucucuggagcaauggugugcuagaguccgaaaugauaauacccaagaucuacgggggcccgauuagccaacacaacuaccgccccggguacuucacucagaccgcgggcccauggcaccuggggaagcucgaauuagacuucgaccucugcgaggguacgaccguggucguagacgagcacugcgguaaccggggcccgagccuccgcaccacaacagugaccggcaagauaauccacgaauggugcugucggagcugcacccugccuccucuucgcuuccgcggggaagacggcugcugguacgggauggaaauuaggccggucaaggagaaggaggagaaccuggugaaaaguauggugucugccggaagcggcgagguagauagcuuuagccugggucugcucugcauaucaaucaugaucgaggaggucaugcgaagccgcuggucccggaagauguuaaugacggggacacuggccguguucuuucuccucaucauggggcagcugacuuggaacgaccuaauccgccuguguauaauggugggcgccaacgccagcgaccgcauggggaugggcacaacuuaccuugcacucauggccacguucaagaugcgaccuauguucgccguaggccugcucuuucgccgacucacuucucgcgaaguuuuacugcucaccaucgggcucucgcuggucgcuuccguggagcuccccaacagccuggaggagcugggugacggucuagcuaugggaaucaugauccuuaagcugcucacggauuuucagucacaucagcugugggcgacgcugcuuucccuuaccuuuaucaagaccacguucagccugcacuacgccuggaaaacgauggcaaugguccuuucgaucgucucacuguuuccacuaugccucaguacgaccucccagaagaccacgugguuacccguucugcucggcagccuggggugcaagccccucaccauguuccuuauagcagagaacaagauuugggggcgccgcuccuggccccuuaacgagggcaucauggcgguuggcaucguguccauccugcuaagcucccugcugaagaacgacgucccccucgcgggaccccugaucgccgguggaaugcugauagccugcuacguaaucagugggagcucggccgaucucuccuuggagaaggcggccgaggucuccugggaggaggaggcagagcauucuggcgcgagccacaacauccugguggaaguccaagaugacgggacgaugaagauuaaagacgaggagagggacgacacccucaccauccuucugaaggcaacgcuccuggcggugucgggcguguacccgcuuagcauccccgcaacccucuucgucugguacuucuggcagaagaagaaacagcgguccgggguucugugggacacaccuaguccacccgagguggaacgggccguccuggacgacgggauauaccgaaucaugcagcggggccugcucgggcgcagccaagucggcgugggagucuuccaggagaacguauuucacacuauguggcacgugacgcguggcgccguucugauguaucaggggaaacgccuagagcccagcugggccuccguaaagaaggaccucaucagcuacggcggaggguggcggcugcagggauccuggaacaccggggaggaagugcaggucaucgcggucgagccaggcaagaaccccaagaacgugcagaccgcgcccgggacuuuuaagacgcccgagggagaggugggcgccaucgcucuggacuucaagcccgggacgagcggcucccccaucguaaaccgcgaggguaagaucguuggucucuacgggaacggcgucgucaccaccucuggcacuuacgucagcgccaucgcgcaggcaaaagcaucccaggaggggccgcccccugaaaucgaggaugaggucuuccggaagcgcaaccugacuaucauggaccugcauccggggagcgggaagacccgucgcuaccuccccgccaucgugagggaagcuaucaagagaaaguugaggacucugauucuugccccuacgcggguggucgccucugagauggcggaggcguuaaaggggaugcccauacgguaucaaacuacugcugucaaaagcgaacacaccgguaaggagaucguggaccugaugugccacgccacguucacgaugcgauuacuguccccggugcggguucccaauuacaacaugaucaucauggacgaagcccauuucaccgaccccagcucgaucgccgcccggggguacaucagcacaagaguggggaugggggaggccgccgccaucuucaugacugccaccccacccggcucagucgaggcauucccacagagcaacgcggugauacaagacgaggagcgggacauuccagagcggaguuggaacagcggguacgaguggauaaccgacuuccccgguaagacugugugguuuguccccucgauaaagagcggcaacgacauagccaacugucugcgcaagaaugggaagcgcgugauucagcucucccgaaagacauucgacacagaguaccagaagaccaagaauaacgacugggacuacguggucaccacggauaucagcgaaaugggcgccaacuuccgcgccgaccgggugauagacccccgccggugccugaaaccagucauccugaaggacgggccugaacgugucauucucgcgggcccgaugcccguuaccgucgcguccgcugcucagcggcgcggcagaaucggccgcaaccacaauaaggagggcgaucaguacaucuacauggggcagccgcuuaacaaugacgaggaccacgcccacuggacggaggcgaaaaugcuguuggacaacaucaauaccccggagggaauuaucccggcccucuucgagcccgagcgggagaaaagcgccgccaucgauggagaguaccggcuucgcggcgaggcccguaagacguucguagaacucaugcgccgcggggaccuccccguguggcuguccuauaaaguugcgagcgagggcuuucaguacagcgaccgccgguggugcuucgacggcgagcgcaauaaccagguucuagaggagaacauggauguggagauauggacgaaggagggggagcggaagaaauugaggccccgguggcuggacgcccgcacuuacucggauccgcucgcccuacgggaguucaaagaguucgccgcgggccgccggagcgucucuggcgaccugauccuggaaauuggcaagcugccacaacaucugacccaaagagcgcagaacgcccuagacaaccuggucaugcugcacaacagcgagcagggcggucgugcauauaggcacgccauggaggaacugcccgacacgaucgaaacccugauguugcuugcgcugaucgccgugcugaccggaggggucacccucuucuuccuuuccgggcgggggcuuggcaagaccucaaucggccuacugugcgugauggccuccagcgugcuguuguggauggcauccgucgagccccacuggaucgccgcgagcaucauuuuagaguuuuuccugauggugcuccugauuccggagcccgacaggcagcggacgccccaggauaaccaacuggccuauguggucaucgggcucuuguucaugauccugacuguugccgcuaacgagaugggccucuuggaaacgaccaaaaaggacuuagguaucggccauguggcggucgagaaccaucaccacgcggcgaugcucgacguggaccugcaccccgcguccgccuggacacuguacgccgucgcgaccaccaucaucacccccaugaugcgccauacgauugagaacaccacagcuaacaucucccuuaccgccaucgcaaaucaggccgcgauacuaauggggcuggacaaaggcuggcccaucuccaagauggacaucggcgugccccuccuggcccuggggugcuauucacaagugaacccgcucacguuaacggccgccgugcugauguuggucgcgcauuacgccaucaucggcccuggauuacaggccaaggccacccgcgaggcccagaagcggacagcagccggcaucaugaagaacccaacgguggacgggaucguugccauagauuuagacccugucguguacgaugccaaguucgagaagcaacuaggccagauuaugcuacugauccucugcaccucccagauccugcugaugcgcaccacaugggccuuaugcgaaagcaucacgcuagcgacuggcccgcugacaacccucugggaggguagucccggcaaguucuggaacacgacuaucgccgugucuauggccaacaucuuccggggguccuaccuggccggcgccggacuggcguucagccucaugaagucccuugggggcgggaggagggguaccggggcccagggugagacccugggcgaaaaguggaagcgccagcucaaucagcuuaguaagucagaguucaacaccuacaagcggucugggaucauggaagucgaucgcagcgaagccaaggaggggcuaaagcgcggggaaaccaccaagcacgccgugucacgcggcaccgcgaagcuccggugguucguggagagaaacuuggucaagcccgaagggaaggucaucgaucuagggugcggcagagggggauggagcuacuacugcgccgggcugaagaagguaacggaaguaaaaggcuacaccaaagguggacccggucacgaggagccgauccccauggcgacauaugguuggaaccucgugaaacuccauuccggaaaggacguguucuuuaucccgcccgagaagugcgacacccugcucugcgauauaggggagagcuccccgaaccccacgauagaggagggcagaacccugcggguccugaagaugguugagccauggcuccgagguaaccaguucuguaucaagauccucaacccauacaugcccagcguugucgagacacucgagcagaugcagcggaaacacggcggcaugcucgugcgcaacccccucucuaggaacucaacccacgagauguacugggugagcugcggaaccggcaacaucgucagcgccgucaacaugacgagucgaaugcugcucaaccgcuucaccauggcccaccggaagcccaccuacgaacgcgacguggaccugggcgcggguacccggcacgucgcgguggagcccgagguggcaaaccucgacaucauaggccagcgaaucgagaacaucaaacaugagcacaagagcacguggcacuacgaugaggacaacccguacaaaaccugggccuaccacgggucguacgaggugaaaccaagcgguuccgccucuagcaugguaaauggcgucgugaaguugcugaccaagcccugggaugugaucccgaugguuacccagaucgcaaugacggacacuacccccuucggccagcagcguguguucaaagaaaagguggauacucgcacgcccaaggcaaagcgggggaccgcacagauuauggaggucacggcuaaguggcucuggggcuuccucucccgcaacaagaaaccucgcaucugcaccagggaggaguucacgcggaaggugcgcagcaaugcagcgauaggagccguuuucguugacgagaaucaguggaacuccgcaaaggaggccguggaggacgagcgguucugggaucucguccaccgcgaacgggagcugcacaaacaggguaaaugcgcuacuugcguauacaacaugauggguaagcgcgagaaaaagcucggggaguucggcaaagccaagggaagccgggcaaucugguacauguggcugggcgcgcgcuuccuggaguuugaggcucucggguucaugaacgaggaccacugguucucccgggagaacagccuguccggcguagagggcgaggggcugcacaaacuaggcuacauccugcgggacaucagcaagauccccgggggcaacauguacgcggaugacaccgccggcugggacacucggaucacggaggaugacuuacaaaacgaagcccggauuaccgacauuauggagccagaacaugcacuccuggccaaaagcauauucaaauuaaccuaccagaacaagguuguccgugugcaacgaccugcgaagaaugggaccguaauggacgucaucagccgccgggaccagagaggcuccggccaggucggcacguacggccucaacaccuucacuaacauggaagcccaacucauucggcagauggagagcgaagggauuuuuaguccaagcgagcuggaaaccccgaaccucgccgagcgcguguuagacuggcuggagaaauacggugucgagcgucucaaacgcauggccaucuccggcgacgacugcguggugaagcccauagacgaccgguucgccacggcgcugaccgcgcuaaacgauaugggcaagguccgcaaggacauuccccagugggaacccagcaagggcuggaacgauuggcaacaggucccguucugcucccaccacuuccaccaacucaucaugaaggacggccgggagaucgugguccccugccgcaaccaagacgagcuugugggccgggccagggugagccaaggggcuggcuggagccuucgggagaccgccugccugggaaagagcuacgcccagauguggcagcugauguacuuccaccgccgggaccugcgucucgccgcuaacgcaauuugcagcgcggucccgguggacuggauccccacuucgcggacgaccuggagcauccaugcccaccaccaauggaugacaacagaggauaugcuguccguguggaaccgcguguggaucgaagagaacccuuggauggaggacaaaacgcacaucagcagcuggggugacgugcccuacuuagggaagcgcgaggaccaguggugcgguagccucaucggccugacggcccgggccaccugggccaccaacauccagguagcuaucaaccaaguccgccggcuaauugguaacgagaacuaccuugacuacaugacuucgaugaagcguuucaaaaacgagagcgaucccgagggcgcccuuugguga

SEQ ID NO: 24149 - RNA, 9879 nt, Artificial Sequence
  derived and/or modified CDS sequence (opt11) from DENV-1__FJ024456__SS-prME
agcgugaccauguuguugaugcugaugcccacugcucuggccuuccaccucaccacccggggcggggaaccccacaugaucgugacgaagcaggagcgggggaagagccugcuguucaagaccagcgcggggguaaacaugugcauccucaucgcuauggaccugggcgagcugugcgaggauaccaugaccuacaagugcccccggaucaccgaggcagagcccgacgauguggauugcuggugcaacgccaccgacaccuggguuaccuacgggacaugcagccagacaggcgagcaccggcgcgauaagcggagcguggcccucgcgccccaugugggcuuggggcuggagacacgcaccgagacguggauguccucagagggcgcauggaagcagauccaacggguagagaccugggcccuccggcaccccggguuuacggugauagcccuguuccuggcgcacgcaaucgguaccagcaucacccagaagggaaucauuuucauucuccugaugcuagugacgccgaguauggcaaugcggugcgucggcaucggcucccgcgacuucguggaggggcucagcggcgccacguggguggacguuguguuagagcaugguuccugcgugacgaccauggccaaggacaagcccacccuggacauugagcuccugaagacggaggucaccaacccagcgguguuacggaaacucuguaucgaggccaagaucagcaacaccacaacggacucccgcugccccacccagggcgaggcaacccucauggaggaacaagacgcuaacuucgugugccggcgcaccuucguggaccgggggugggggaauggaugcgggcuguuuggcaagggaagccucaucacgugcgcgaaguucaagugcgugacuaagcuggagggcaagaucgugcaguacgagaacuugaaguacuccgucaucgugaccgugcacacuggcgaccagcaccaggucgggaacgagagcacggagcauggcaccaccgcgaccaucacgccccaggcgcccacguccgaaauacagcucaccgauuacggggcccugacccuggacugcagcccucgcacgggccuagacuucaacgagauggugcugcugacgaugaaggagaaguccuggcucguccacaaacaaugguuccuggaccugccgcuccccuggaccuccggggcaagcaccucccaagagacguggaaccggcaggaccuucucgugacguucaaaaccgcucaugcgaagaagcaggagguggucgugcucggaagccaggagggcgccaugcacaccgcccuaaccggggccacggagauccagaccuccggaacgaccacgaucuucgcggggcaucugaaaugucgccucaagauggacaagcugacccugaaaggcaugucauacgugaugugcaccgguuccuucaagcucgagaaggaagucgcggaaacucagcaugguacgguauuggugcagaucaaauacgagggcacugaugcaccuugcaagaucccguucagcacccaggacgagaagggggucauccagaacggccggcugaucaccgccaacccgauagugacggacaaagaaaagccugugaauauagaggccgagccgcccuucggagaguccuacaucgucaucggagugggcgagaaagcacugaagcugagcugguuuaagaagggcuccucgauaggcaagauguucgaggccaccgcccgcggugccaggcgcauggccauccugggcgacaccgcaugggacuucggguccaucggcggcguuuucaccagcgucgggaagcuggugcaucagaucuuuggcacggccuacgggguccuguucuccggcgucuccuggaccaugaagaucggaauuggagugcugcuaaccuggcucggccugaacucccgcagcaccagucugagcaugacgugcaucgccgucgggcucguuacccuguaccugggcgugauggugcaggccgacuccgggugcgucaucaacuggaaaggacgggagcucaagugcggaagcggcauuuucgucaccaacgaggugcacaccuggacggagcaguauaaguuccaggccgacagcccgaaacgacugucugcggccaucggaaaggccugggaggagggggucugcggcauccggagcgcaacccgccuggagaacaucauguggaagcaaaucuccaacgaguugaaccauauacugcuggagaacgacaugaaguuuaccgugguagucggggacgugguaggcauccucgcucaagggaagaagaugauacggccucagcccauggagcacaaguauagcuggaaguccuggggcaaggcgaagaucaucggcgccgacguccagaacaccaccuucauuaucgacgggccaaacacgccggaaugccccgacgaccagcgcgccuggaacaucugggagguggaggacuacggcuucgguaucuucaccacaaacauuuggcugaagcugcgggauuccuacacccaagccugcgaccacagacuaauguccgcggccaucaaggacagcaaggccguacacgccgacaugggcuacuggaucgaaucggagaagaaugaaacguggaaacuggcucgggcgagcuucaucgaggucaagaccugcaucuggcccaagucccacacacuguggagcaacggcgugcuggagagugagauggugauucccaagaucuacgggggcccuauuagccagcacaacuaccgcccgggguauuuuacccaaacggccggcccguggcaccuggggaagcuggaacuugacuucgaccugugugaaggcaccacagucgugguggaugagcacuguggcaaccgggguccaucccugcgcaccacgaccgucaccggcaagaucauccaugaguggugcugucguagcugcacccugccgccccuucgcuucaagggggaggacggcuguugguacgggauggagauccggcccgugaaggagaaggaggagaaccuggugaaguccauggucucugcgggcagcggcgagguggauucuuucagccugggucuucugugcauuuccaucaugaucgaggaggugaugcgcagccgguggagccgcaagaugcuuaugacgggcacucuggcggucuucuugcuucugauuauggggcagcuaaccuggaacgaccucauccgacugugcaucauggugggcgccaacgcgagcgaccguauggggaugggcaccaccuaccuggccuuaauggccaccuucaagaugcgcccgauguucgccguggggcugcuguucagacgcuuaacuucccgcgagguccugcugcucaccaucgggcugagccugguugccuccguugagcugcccaacagccuggaggagcugggcgaugggcuugcgaugggcaucaugauucugaagcugcucacggacuuccagucccaccagcugugggccacacugcucagcuugacauucauuaagaccacgcugucccuccacuacgccuggaagaccauggccauggugcugagcaucgugucccuguucccccucugccugagcaccaccucccagaagacaaccuggcugcccguucuucugggcucucuggggugcaagccgcuaaccauguuccugaucgcggaaaacaagauuuggggccgcaaguccuggccgcugaacgaggggaucauggccgugggaguggucagcauccuccugagcucccugcucaagaaugacgugccccuggccgggccccucaucgccggcggcaugcucaucgccugcuacgugaucagcggcagcucagcggaccugucccuggagaaggcugccgaggucagcugggaagaggaggccgagcacuccggcgccagccauaacauccucguggagguacaggacgacgggaccaugaaaauaaaggacgaggagcgggacgauacucucacaauccugcucaaggcgacgcugcuggccguguccggcguuuacccgcucagcauccccgccacccuguucgugugguacuucuggcagaagaagaagcagcgcucagggguccugugggauacccccagcccgcccgagguagagcgggcaguacuggacgauggcauuuaccgcaucaugcagcggggccuccuagggaggucucaggucggggugggcguguuccaggaaaacgucuuccauacgauguggcacgugacgcggggcgccguccugauguaccaggggaagcgcuuggagcccagcugggcgucagucaagaaggaucugaucuccuacgguggcggcuggcggcuacagggcucauggaacaccggggaggagguccaagugaucgccgucgagcccggcaagaaccccaagaacgugcagaccgcccccgggacguucaagacccccgagggcgagguuggagccaucgcccucgacuucaagccugggacgagcgggucccccaucgucaaccgcgagggcaagauugugggccuguacggcaacgggguggucacaacguccggaaccuacguuagcgcgaucgcccaggccaaggccucccaagaggggccgcugcccgagauagaggacgagguguuucggaagcgcaaccucaccaucauggaccugcaccccggaagcggaaagacgcggcgcuaccugccggcgauaguccgggaggccaucaagcgcaaguugcggacgcugauacuggcucccacccgcgugguggccagugaaauggccgaggcgcuaaagggcaugcccauacgcuaucagaccacagccgucaagucagaacacacaggcaaggagaucguagaccucaugugccacgccaccuucaccaugcggcugcuaucacccgugcgcgucccgaacuacaacaugaucaucauggacgaggcccacuucaccgaccccagcuccaucgcugcgcggggguacaucuccacucgcguaggcaugggggaggccgccgccaucuucaugacggccacgccacccggcuccguggaggcuuucccgcagagcaacgccgucauccaagaugaggaacgggacaucccggagcggucauggaacagcggcuacgaauggaucacugacuuccccggcaaaacggugugguucgugcccucaaucaagagcggcaacgacauugccaacugccugcguaagaaugggaagcgggucauucagcugagccggaagaccuucgacaccgaguaccagaaaaccaagaauaaugacugggacuacgucguaacgacugacaucagcgagaugggcgcaaacuuccgcgcggaccgggucaucgauccgcgccggugcuugaagcccgucaucuuaaaggacgggcccgagagggucauccuggccggccccaugccuguaaccguggccagcgccgcgcagcgccgcgggcggaucggccgcaaccauaacaaggagggcgaccaguacaucuacauggggcagccgcucaacaacgacgaagaccacgcgcacuggacggaggccaagaugcuuuuggacaacauaaacacgcccgaaggcaucauccccgcccucuuugagccagagagggagaaauccgcggccaucgacggggaguaccgccugcgcggcgaagcgcggaagaccuuugucgaguugaugcgccgcggggaccuccccguguggcuguccuacaaggucgccucggagggcuuccaauacagcgaccgccgguggugcuucgacggcgagcgcaacaaccagguccuggaggagaacauggacguggagaucuggacgaaggagggggaacggaagaagcucaggccucgguggcuggacgcccgcaccuacuccgauccccuagccuuacgggaguucaaggaguucgccgcgggccggcggagcguguccggcgaucugauccuggagaucggcaagcucccgcagcaucuaacgcagcgcgcccagaacgcgcuggacaaucucgucaugcugcacaauagcgagcagggcgggcgggccuaccgccacgcgauggaggagcugccugacacuaucgagacccucaugcuccuggcgcucauugcagugcucacagggggggugacgcuguucuuccucuccggccggggccugggcaagacaucgaucggccuccucugcguaauggcguccagcgugcugcuguggauggccuccguggagccacacuggaucgcggcauccaucauccucgaguucuuccuaaugguccugcucauccccgagccggaccgccagcggacgccucaagacaaccaacuggccuacguugugaucgggcuccucuucaugauccugaccgucgcggccaacgagaugggccuccucgagaccacgaagaaggacuuggguaucggccauguggcgguggaaaaccaccaccacgccaccauguuagacgucgacuuacaccccgccuccgcauggacccuguacgccguggcgaccacgauuaucacuccgaugaugcgucacaccauugagaacaccaccgccaacaucucgcugacugccaucgccaaccaagccgcaauccuaauggggcuugacaaaggcuggccuaucucgaaaauggacaucggcgugccgcugcucgcccugggcugcuauagccaggucaacccucugacccuaaccgccgccgugcugaugcugguagcccacuacgcaaucaucggaccggggcuccaggcaaaagccacccgggaggcccagaagcgcaccgcggccggcaucaugaagaaccccaccguugacgggauaguggccaucgaccucgaucccguagucuacgacgccaaguucgagaagcagcuggggcagaucaugcucuuaauccuuugcaccucccagauucugcuuaugcgcacgaccugggcccugugcgaaucaaucacacucgcgaccggcccauugacgacccugugggagggauccccgggcaaguucuggaacacgacgaucgcagugagcauggccaacaucuuccgggggucuuaccucgcuggcgccggccuagcguucucgcugaugaagucacucgggggcgggcgccggggcacgggggcccagggcgagacccugggcgagaaauggaagcgccaacugaaccagcucuccaagagcgaguucaacaucuacaagcgguccgggaucauggagguggaccgcagcgaagcgaaggagggccuaaagcgcggggagacaacccgucacgccgucucgaggggcaccgccaagcugagaugguucguggagcggaaccuggucaagcccgaggggaaggucaucgaccucggcugcggucgcggaggcuggagcuauuacugugccgggcugaagaaggugacagaggugaagggauacaccaagggcgguccugggauggaggagcccaucccgauggccaccaauggguggaaccugguaaagcuccacuccggcaaggacguguucuucacgccgcccgagaagugcgacaccuugcugugcgacaucggagagagcucccccaacccgaccaucgaggaaggccggaccuuacgcguauugaagauggucgagcccuggcugcggggaaaccaguucugcaucaagauccuaaaccccuacaugcccagcguuguggagacguuagagcaaaugcaacgcaagcacggcggcaugcuggugcggaacccacucucccgcaacagcacucacgagauguacuggguuaguugcgguaccggcaacauagugagcgccgucaacaugaccagccgaaugcugcugaaccgcuucaccauggcccaccgcaagcccacguacgagcgggacguggaucucggggcaggcacccgccauguggccguagagcccgagguggccaaccuggacaucaucggccagcggaucgagaacaucaagcacgagcacaagagcacguggcacuacgaugaggacaaccccuacaagacgugggccuaccacggguccuacgaggucaagccgagcggcucagcgagcuccauggugaacgggguagucaaacugcugacgaagcccugggacguuauucccauggugacccagaucgcgaugaccgauacgacgcccuucggccagcagagagucuucaaggagaagguggacacccggaccccgaaggccaagcgcgggaccgcacagaucauggaagucacggcccgguggcuguggggcuuccucuccagaaacaagaagccccggauuuguacccgcgaggaguucacccggaaaguccgcagcaacgccgcgauaggcgccguuuucguagacgagaaccaguggaauuccgccaaggaagccgucgaggacgagcgguucugggaccucgugcagaaggagcgcgagcugcauaagcaggggaagugcgcaaccugcguguacaacaugaugggcaagcgggagaagaagcugggugaauucggcaaggccaaggggagccgugccauuugguauauguggcucggcgcccgguuccuagaguucgaggcccugggcuuuaugaacgaagaccacugguucucgcgcgagaacagcuuguccggggucgagggcgaaggucugcacaagcugggcuacaucuuacgggacaucagcaagauccccggggggaacauguacgcggacgacacagccggcugggacacccgcaucaccgaagacgaccugcagaacgaggccaagaucaccgauauaauggaaccggagcacgcccugcuugccacguccaucuucaagcugaccuaccagaacaagguggugcggguccaacgccccgcgaagaacgggacggugauggacgugaucagccgccgggaccagaggggcucugggcaggucggcaccuacggccugaacacguuuaccaacauggaggcccagcugauccggcagauggagagugaggggauuuuccugcccuccgagcuggagacacccaaccucgccgaacgcgugcuggacuggcuggaaaagcacggaguggagcggcucaagcgcauggccaucucgggugacgacugcgucguaaagccgaucgacgaccgguuugccaccgcgcugacggcccugaacgauaugggcaagguucguaaggacaucccccagugggagcccuccaagggauggaacgacuggcagcagguccccuucugcagccaccacuuucaccagcucaucaugaaggacggccgggaaaucguggucccgugcaggaaccaggacgagcuggucgggcgggcgcgcguaucccagggggcgggcuggucacugcgggagaccgcuugccucggcaagagcuacgcgcagauguggcaacugauguacuuccaucgccgggaccugcgccuagccgccaaugccaucuguucugcggucccagucgacugggugcccaccagccggaccacguggaguauacacgcccaccaccaauggaugaccaccgaggacaugcugucuguuuggaacagaguuuggauugaagaaaaccccuggauggaggacaaaacccacguaucaagcuggggcgacguucccuaccuggggaagcgggaggaccaguggugcggcucccucaucggccugacggcccgcgccaccugggcaagcaauauucagguugcgauaaaucaggugcgucggcugaucgggaacgagaacuacuuagauuacaugaccaguaugaagcgcuucaagaacgagggcgacccggaaggggcccugugguga

SEQ ID NO: 24150 - RNA, 9879 nt, Artificial Sequence
  derived and/or modified CDS sequence (opt11) from DENV-1__FJ024457__SS-prME
agcgugaccaugcugcucaugcugaugcccaccgcccuggccuuccaccucaccacgcggggcggggaaccccacaugaucgugaguaagcaggagcggggcaaaagccugcuguuuaagacaagcgcaggggugaacaugugcaccuuaaucgcuauggacuugggcgaguuaugugaagacacgaugacuuauaagugcccccggauaaccgagacggagcccgaugacguggacugcuggugcaacgccacggauaccuggguuaccuacgggaccugcagucagacuggcgagcaucgucgagacaagcgguccguggcccucgcgccccaugugggccuggggcuagagacccgcacggaaaccuggaugagcuccgagggcgcuuggaaacagauccagcgggucgaaacgugggcacucaggcaucccggguucaccgugaucgcuuuauuccuagcacaugccaucggcaccucaauuacccagaagggaaucaucuucauccucuuaaugcuggugacgccguccauggccaugcguugcgucggcaucggcagccgagacuucguggagggacuguccggcgccaccuggguggacgucgugcuggagcacgggucguguguaacaaccauggccaaggacaagcccacgcuggacaucgagcuacugaagaccgaggucaccaauccggccgugcugcguaagcucugcaucgaggcgaagaucagcaacaccacgaccgacagucgaugcccgacacagggcgaggccacccuuguggaggagcaggaugccaacuuugucugccgccgcacguucguggacaggggcugggggaacgguugcgggcuguucggcaagggcuccuuaauaacuugugccaaguucaagugcgugaccaagcuggaggggaaaaucguccaguacgagaaccugaaguacagcgugaucgugaccguccacacgggcgaccaacaccagguugggaacgaguccaccgagcacggcaccacugcaaccaucacgccccaggcgcccacgaccgagauacagcucaccgacuacggagccuuaacucuagacugcaguccccgcacaggccucgauuucaacgagaugguacugcugaccaugaaggaaaagucauggcucguccacaaacaaugguuucucgaccugccccuccccuggaccagcggggccucgacgucccaagaaaccuggaaccggcaggaucugcuggugacguucaaaaccgcccacgccaagaagcaggaggucguggugcuaggcagccaggagggggcgaugcacacggcccugaccggggcaaccgagauccagaccuccggcacaaccaccaucuucgccgggcacuuaaagugccgccucaagauggacaagcugacccugaagggcaugaguuacgucauguguacgggguccuucaaguuagagaaggagguagccgagacccagcacggcaccgugcugguccagaucaaguaugagggcaccgacgcgcccugcaagauccccuucagcacgcaggacgagaagggggucacacagaauggccggcugaucaccgcgaacccgaucgugaccgacaaggagaagcccgucaacauagaggccgaaccgcccuuuggggaguccuacaucgugaucggcgccggcgagaaagcgcugaagcucucuugguucaagaagggguccaguaucggcaaaauguucgaggccacagccaggggggcccgccgcauggcuauccugggcgauaccgcgugggacuucggcuccauuggugggguguuuaccagcgucgggaaguuggugcaccagaucuuuggcaccgccuacggggugcuuuucuccggggucagcuggaccaugaagaucgguaucggugugcugcugacauggcucggccugaauucccguucaaccucccugagcaugaccugcaucgccguggggcuagucacccuguacuuaggcgugauggugcaggcggacuccgggugugucaucaauuggaagggccgggagcucaagugcgggagcggcaucuucgugaccaacgaagugcacaccuggaccgagcaguacaaguuucaggccgacagcccgaagcgccugagcgcggccaucggcaaggcaugggaggagggggucugcgguauacggagcgccacccgccuggagaacaucauguggaaacagaucuccaacgagcucaaucacauccugcuggaaaacgacaugaaguucacuguggucgugggggacguggcagguauccucgcgcagggaaagaagaugauccggccccagcccauggaauacaaauauagcuggaaauccuggggcaaggccaagauaaucggcgccgacgugcagaauaccaccuucaucauagacgggcccaacaccccggaaugcccagacgaccagcgcgccuggaacauaugggaggucgaggacuacggcuuugggauauucacgaccaacaucuggcugaaguuaagggacagcuacacccagguuugcgaccaccgccucauguccgcggccaucaaagauagcaaggccguacaugccgacaugggcuacuggaucgaguccgagaagaacgagacauggaagcuggcacgggcgagcuucaucgaggucaagacgugcaucuggccgaaaucccacaccuuguggagcaacggggugcuugaauccgaaaugaucauccccaagaucuaugggggcccgaucucgcagcauaacuaccgccccggguacuucacucaaaccgccggucccuggcaccuggggaagcuggagcuggacuucgaccugugugaggguacgaccguggucguggaugagcacuguggaaaccgggggccgucccugagaaccaccacgguuaccggcaagaucauccacgaguggugcugccgguccugcacccugccgccucuccgcuuccgcggggaagacggcugcugguacgggauggagauccgcccagucaaggaaaaggaggagaaccuggugaaguccauggugagcgccggcucgggcgaggucgacuccuucagccucggucugcugugcaucuccaucaugaucgaggaagugaugcggagccgguggucacgaaagaugcucaugacuggcacgcuggccguuuucuuccugcucaucauggggcaacugaccuggaacgaccugauccgccucugcaucauggucggcgccaacgcgagcgaccgcauggggaugggcaccaccuaccuggcccugauggcuacguucaagaugcggccgauguuugccguuggccuccuguucaggcgccugaccucacgugaggugcuccugcugaccaucggguugagccuggucgccuccguagagcucccuaacagccucgaggagcugggcgacgggcuggcgaugggcaucaugaucuugaagcuccugaccgauuuccagagccaccagcucugggccacgcugcugagcuuaaccuucaucaagaccaccuucucucugcacuacgccuggaagaccauggccaugguucugagcauagugagccucuucccacugugccucagcaccaccucccagaagaccacguggcuacccgugcuacugggcagccucgggugcaaaccgcugaccauguuccugaucgcggagaacaaaauuuggggccggcgcuccuggcccuugaacgaggggaucauggccgucggcaucguuagcauccuucuuucuucccuccuuaagaacgacgucccacuggcugguccacucaucgccggaggaaugcugaucgcauguuaugucaucagcggguccagcgcggaucugucccucgaaaaggccgcggaggugagcugggaggaggaggcugaacacuccggcgcuagccacaacauccugguugaaguccaggacgacggaaccaugaaaauuaaggacgaggagcgugacgacacccugaccauccuccugaaggcgacgcugcucgccguguccggcguuuacccgcugagcaucccggcaacccuguucgucugguacuucuggcagaagaagaagcagcguuccggggugcucugggacacccccagcccgccggagguggagcgggccguccuggacgacggaaucuaccgcaucaugcagcggggccugcuggggcggucccaggugggcguggggguauuccaagagaacguguuccacaccauguggcaugugacgcguggcgcaguccucauguaccaggggaagcgccuggagcccagcugggcguccgugaaaaaggacuuaaucucuuauggcggcggcuggcggcuucaggggucauggaacaccggggaggaggugcagguuauagccguggagccaggcaagaacccuaagaacgugcagacugcgcccggcaccuucaaaacgcccgaaggugaggucggcgcgaucgcucuggacuucaaacccggaaccagcggcucccccaucgugaaccgcgagggaaaaaucgugggccuuuacggcaacggggucgugaccaccagcgggacguacgugagcgccaucgcccaggccaaggcgucccaggagggaccccuccccgagauugaggacgaggucuuccggaagcgcaaccugacuaucauggaccuucaccccggcagcggcaagacacggcgcuaccucccggcgaucgugcgggaggcaaucaaacgcaagcugcgcacccugauccucgcacccacgaggguaguugcgagcgagauggcagaggcgcugaagggaaugcccauccgcuaucagaccaccgccgucaagucugagcacacggguaaggagaucguggaccugaugugccacgccacauucaccaugcggcuacugucccccguccgugucccuaacuacaacaugauuauaauggacgaggcccacuucaccgacccaaguuccaucgccgcgcggggguacaucagcacccgcguuggcaugggcgaggccgcggcuauuuucaugacggccacgccacccggaucggucgaggcauucccgcagagcaacgccgugauccaggaugaggagcgggauauccccgagcgguccuggaacagcggguacgaguggaucacggacuuccccggaaagaccgugugguucgucccuuccaucaagucgggcaaugacauugccaacugccugcgaaagaaugggaagcgcgugauacagcucuccaggaagacauucgacaccgaauaccagaaaaccaagaacaacgauugggacuacgugguuaccacggacaucagcgagaugggcgccaacuuccgcgcggaccggguaaucgacccccgccggugccuaaagcccgugauacugaaagacgggcccgaacgcgugaucuuggccggccccaugccggucaccgucgcguccgccgcucaacggcgcgggcggaucggccgcaaucacaacaaggagggugaccaguacaucuauauggggcagccguuaaacaacgacgaggaccaugcgcauuggaccgaggcuaagaugcugcucgacaacaucaauacccccgagggcauuauacccgcccucuucgaaccggagcgcgaaaaguccgccgcgaucgacggggaguaccgguuacgcggcgaggcgcggaagacguucguggagcucaugcgccgcggggaccugcccgugugguuguccuauaaggucgccucggaaggcuuccaguacagcgaccgccgguggugcuucgacggcgagaggaacaaccagguguuggaggagaacauggacgucgagaucuggaccaaggagggggagcguaagaaguugcgcccccgguggcuggacgcacgaaccuacuccgacccgcuggcccugcgagaguucaaggaguucgccgcgggucgccgcagcgucucgggggaccugaucuuagaaaucggcaagcugccgcagcaccugacccagagggcccagaacgcccucgacaaccugguuaugcugcauaacagcgagcagggcgggcgggccuaucgccacgcgauggaggagcuccccgacacgaucgagacccucaugcuacucgcccugaucgccgugcucaccggcggggucacccucuuuuuccugagcggccgggggcuggguaaaacuagcaucggacuccugugcgucauggccuccucugugcugcuauggauggcauccgucgagccccacuggaucgcggccagcaucauacuggaauucuuccugauggugcuccugauccccgagccggaccgccagcggacgccccaggacaaccagcuggccuacgugguaaucgggcuccuguucaugauccugacaguggccgccaacgagaugggccugcuggagaccaccaagaaggaccuggggaucggccacguagcggucgagaaccaucaccacgccgccaugcucgacguggaccugcaccccgccucggccuggacguuguacgcgguggccaccaccauaaucaccccgaugaugcgccauacgaucgagaacaccaccgccaacauuagccucaccgccaucgccaaccaagcggccauccugauggggcuagauaagggcuggcccaucuccaagauggacauuggcgucccucuccuggcacuaggguguuacagccaggugaacccccucacgcugacagccgcggugcugaugcucgucgcccacuacgcaauaaucggcccgggguugcaggccaaggcaacacgcgaggcgcaaaaacggaccgccgcuggcaucaugaagaaccccacgguggaugggaucguggccaucgaccuggaccccgucgucuacgacgcuaaauucgagaagcagcucggccagauaaugcugcucauucucuguaccucccagauccuguugaugcgcaccaccugggcgcucugcgagagcaucacacuggcaaccggcccccucaccacccuuugggagggauccccggguaaguuuuggaacacgaccaucgccguuagcauggccaacaucuuccgggggucuuaccuggccggcgcgggacuggccuucagccucaugaagagucucgggggugggcgccgggggacgggggcccagggcgaaacccugggggagaaguggaaacgccagcucaaccagcuguccaagagcgaguucaacaccuacaaacgguccgguaucauggaagucgacagauccgaggccaaggagggccugaagcgcggggagaccacuaaacacgcggugucccgcggaaccgcuaagcuccggugguucguggagcgcaaccugguuaagcccgaggggaaggucaucgacuuaggaugcggccgagggggcuggagcuacuacugcgccgggcugaagaaggugacugaggucaagggcuacaccaagggcggccccgggcacgaggagcccaucccgauggcgaccuacggguggaaucucgugaagcugcacuccggcaaggacguguuuuucaucccacccgagaagugcgacacccugcucugcgacaucggggaguccuccccaaacccgacaaucgaggagggccgcacccugcggguccuuaagaugguggagcccuggcuucgcgggaaucaguucugcaucaaaauccucaaccccuacaugcccucggugguagagacccuggagcagaugcagcgcaagcacggcggcauguuagugaggaacccgcuuucccggaacagcacacacgagauguacugggugucgugcggaaccggcaacauaguaagcgccgugaacaugaccucccgcauguuacucaaccgcuucaccauggcgcaccgcaagccuaccuacgaacgcgauguggaccugggggcuggcacucggcacguugccguggagcccgagguggccaaccuugacaucaucggccagcgcaucgagaacaucaagcacgagcacaagagcacguggcacuacgacgaggacaacccuuacaagacaugggcauaccauggguccuaugaagucaagccgagcgguuccgcgagcagcauggugaacggggucgugaagcuccugaccaaacccugggauguuauccccauggucacccagaucgccaugacggacaccacccccuuugggcagcaacggguguucaaagagaagguugacacccgcacaccgaaggccaagcgggguacugcccaaaucauggaagucaccgccaaguggcuguggggcuucuuaucccgcaacaagaagccucggauaugcacccgcgaggaguucacucggaaggugcgcagcaaugcggccaucggcgcuguguucgucgacgagaaccaguggaacagcgccaaggaggccguggaggaugagcgguuuugggaucugguacaccgcgagcgggagcugcauaagcaggggaagugcgcgaccugcgucuacaacaugaugggcaagcgcgagaagaagcucggugaguucggcaaggcuaaggggagccgggccaucugguacauguggcuuggcgcccgguuucuggaguucgaggcccucggcuucaugaacgaggaucacugguucucacgggagaacucccuguccggcguagaaggagaagggcuccacaagcucggauacauccugcgcgacaucagcaagauacccggaggcaacauguacgccgacgauaccgccggcugggacacccggaucacggaagacgaccugcagaaugaggcccgcaucaccgacaucauggaaccggagcacgcccuccuggcgcgcuccaucuucaagcucaccuaccagaacaaaguugucagggugcagcgccccgccaagaacgggaccgugauggacgucauaagucggcgagaccagcggggcuccggccagguugggacguacggccucaacaccuucaccaacauggaggcucagcugauccgccagauggagagcgaggggauauuuucacccucagaacuggagacucccauccucgcggagcgcgugcuugacuggcuggagaaauacggagucgagcgccucaaacggauggccaucucuggggacgauugugugguuaagcccaucgacgaccgguuugcgaccgcacugaccgcccucaacgacaugggcaagguccguaaggacaucccccagugggagcccagcaagggcuggaacgacuggcaacagguccccuucugcucccaccacuuccaccagcucaucaugaaggacggccgcgagauagucgucccgugccggaaccaggacgagcuggugggccgcgcccgggucagucagggcgccggguggagccugcgcgagaccgcgugccucgggaagaguuacgcccagauguggcagcugauguacuuccaccggcgcgaccugcggcucgccgccaaugcgauuugcagcgccguccccguggauuggauccccaccagucgcacaacguggagcauccacgcccaucaucaguggaugacgaccgaagacaugcuauccguguggaaccgcgucuggaucgaggagaaucccuggauggaggacaagacgcacaucagcuccuggggcgauguaccguaucuggggaagagagaagaccaguggugcggcagccucauuggccugaccgcgcgggccacaugggcgacaaacauccagguugccaucaaucagguacggcgccugaucgggaacgagaacuaccuugacuacaugaccuccaugaagcgguucaagaacgagagcgaccccgagggcgcccugugguga

SEQ ID NO: 24151 - RNA, 9879 nt, Artificial Sequence
  derived and/or modified CDS sequence (opt11) from DENV-1__FJ205881__SS-prME
agugugacgaugcuguugcugcuaaugcccaccgcccuagcguuccaccugaccacccggggcggggagccccacaugaucguuucuaagcaggaacggggcaagucucuccuguucaagacgucggcagggguuaacaugugcacacugaucgccauggacuuaggcgagcuuugcgaggauaccaugaccuacaagugcccccgcaucacagagaccgagcccgaugacguggacugcuggugcaacgccaccgacaccugggucaccuacgggacgugcagccagacaggugagcacaggcgggauaagcgguccgucgcucuagcgccccacgugggucuggggcucgagacccguaccgagaccuggaugucuagcgagggcgccuggaagcagauacagcgggucgagacgugggcauuacggcaccccggguucaccgugaucgcccuguuccucgcccacgcgaucgggaccagcauuacccagaaggggaucaucuucauacugcuuaugcucgugacgccuuccauggcaaugcggugcguaggcaucggcagccgggacuucguggagggccugagcggugccaccuggguggacgucguguuggagcacgggaguugcgugacuaccauggcuaaggauaagcccacccucgacaucgagcuguuaaagacagaggucaccaaccccgccguacuccguaagcugugcaucgaggcgaagaucucaaauaccacuacggacagccgcugccccacgcagggggaggccacgcucguugaggagcaggaugccaacuucgucugucggcgcacuuucguggaucggggcugggggaacggcugcggucuguuuggaaaggggucccugauuacgugcgccaaauucaaaugcgugacuaaacuggagggcaagaucguccaguaugagaaccuuaaguacagcguuaucgugaccguccauacgggggaccagcaucagguugggaacgagaguacugaacacgguacaaccgccaccauuacgccccaggcgcccaccaccgaaauccaacugaccgacuacggggccuuaacgcucgacugcucgccccgcaccggccuugacuucaacgaaaugguucugcuaaccaugaaggagaagucuuggcugguucacaagcagugguuccuggaccucccacugcccuggaccagcggggcaagcacgucccaggaaacguggaauagacaggaucuucucgugaccuucaagacagcccacgcgaagaagcaggaggucguggugcuggguagccaggagggcgcgaugcacacggcccuaaccggggccacggagauccagacauccgggacgacaaccauauucgccgggcaccucaagugcaggcugaagauggacaagcugacccucaagggaaugagcuacgucauguguacgggguccuucaagcuggaaaaggagcuggccgagacccagcacgggaccgugcuaguucagaucaaguacgaggguaccgaugcucccugcaaaauucccuuuagcacacaggacgagaagggggucacacagaacggccggcucaucaccgccaacccgaucgugaccgacaaggagaagcccgugaacaucgaggccgagccccccuucggggaguccuacaucgucauaggcgccggcgagaaggcgcugaagcuguccugguucaagaaaggguccagcaucgguaagauguucgaggccacggcgcguggggccaggaggauggccauacucggcgacaccgcgugggacuuuggguccauuggcgguguguucacgagcguggguaagcuaguccaucagaucuuuggcaccgccuacgggguacuguucuccggcguauccuggacgaugaagaucgguaucgggguccuccugaccuggcuuggacucaauucccgcucgaccucguugagcaugaccugcaucgccguuggccugguaacacucuaccugggcgucauggugcaggccgauaguggcugcgugaucaacuggaagggccgggagcugaaguguggaagcggcaucuucgucaccaacgaggugcacaccuggaccgagcaguacaaguuccaagccgacagcccuaagaggcucuccgcggccauaggcaaggccugggaggaaggaguuugcggcauccggagcgccacccgccuggaaaacauaauguggaagcagaucuccaacgagcugaaucacauacuccuggagaacgacaugaaguucacggucguaguaggggacgucgcaggcaucuuagcgcaagggaagaaaaugauucggccucagcccauggaguacaaguacagcuggaaguccuggggcaaggccaaaaucaucggcgcugacguccagaacacgaccuucaucauagacgggcccaacaccccggagugccccgacgaccagcgugccuggaacaucugggagguggaagacuacggcuucgggaucuucacgaccaacaucuggcucaagcuucgcgacucauacacccaggucugcgaccaccgcuuaauguccgcggccaucaaggacagcaaggcgguucacgccgacaugggcuacuggaucgaguccgagaagaacgagaccuggaagcucgcaagagcgaguuucauugaaguuaagacgugcauuuggcccaaaucccacacccuguggaguaacggcgugcuggaguccgagaugaucauacccaagaucuaugggggcccgaucucacagcacaacuaccgcccuggguauuucacccaaaccgcuggacccuggcacuugggaaagcuggagcuggauuucgaucucugcgagggcacgaccguggugguagaugagcauugcgggaaccgcgggccgucauuacgcaccaccacggugacuggcaaaaucauccacgaguggugcugccggagcugcacccuaccgccguugcgguucagaggggaagacggcuguugguacgggauggagauacgccccgugaaggaaaaggaagagaaccugguaaaauccauggucagcgccggcagcggggaaguagacuccuuuucgcucgggcucuuguguaucagcaucaugaucgaagaggucaugcggagucgcuggucccggaaaaugcugaugacgggcacgcuugccguguucuuccuguuaaucauggggcagcugacguggaacgaccugauccgccugugcauuauggugggcgccaacgcgagcgaucgaauggggaugggcaccaccuaccucgcccugauggcgaccuucaagaugcggccuauguucgccgucggcuuacucuuccgacggcugaccuccagagagguccuucuccugaccaucgggcugagucucguggccagugucgaacuccccaacagccuggaggagcucggggaugggcuggcgaugggcaucaugaucuuaaagcuccugaccgacuuccaaagccaccagcugugggccacguuacugagccugaccuucauuaagaccaccuucucgcuccacuacgccuggaagacgauggccaugguccugagcaucgucucccuguuuccccucugccugucgaccaccucccaaaagaccacguggcugccgguguugcucggcagccuagggugcaagccgcucaccauguuccugaucgcggagaacaaaaucuggggacggcguuccuggccccuaaacgaagggauuauggcagugggcaucgucagcauucuccugaguucgcuccuuaaaaacgacgugccccuggccggcccccugauugccggcggcaugcucaucgccugcuacguuaucucaggguccucugcggaccucuccuuagagaaggccgccgagguaagcugggaggaggaggccgagcacagcggcgcgagucacaacauccucguggagguucaggacgacgguaccaugaagaucaaggacgaggagcgggacgacacccugaccauccugcucaaggcgacgcugcucgccgucuccggcguguacccgcucucuauccccgccacauuauuugugugguacuucuggcaaaagaagaaacagcgcuccgguguccugugggauacccccaguccgcccgaggucgagcgggcagugcuggacgacggcaucuaccgcaucaugcagcggggcuugcuggggcgcucccaagucggaguggguguguuucaggagaacguguuucacacaauguggcacgugacgcggggcgccgugcugauguaccaaggcaagcgccucgagcccagcugggcguccgucaagaaggaccugaucagcuacggcggcggguggcggcugcagggcucuuggaauaccggagaagagguccaagugaucgccgucgagccuggcaagaaccccaaaaacgugcagaccgcccccggaaccuucaagacgcccgagggcgagguuggcgccaucgcccucgacuucaagccaggcacgagcggcucccccaucgucaaccgcgaggggaagaucgucggccucuauggcaaugggguggucacgaccagcggcacauacguuuccgcgaucgcccaagccaagaccucccaggaggggccgcugcccgaaaucgaggacgaaguguuccggaagcguaaucucacgaucauggaucugcaucccggcagcgggaagacuagaagauaccugccggccaucguccgggaggcgaucaagcgcaagcuucgcacguugauccuggcccccacccgagucguggccucugagauggccgaagcguuaaagggcaugccgauccgauaucaaaccaccgcggucaagagcgagcacacggggaaggagaucguagaccugaugugccacgccaccuuuaccaugaggcugcucucccccguacgcgucccgaacuauaacaugaucaucauggaugaggcccacuucaccgaccccagcuccaucgccgcccggggguacaucuccacgcgcgugggcaugggugaggcggcagcgauuuucaugaccgccacgccucccggcagcguggaggccuucccgcaaagcaaugcggucauacaggaugaagagcgggacauacccgagcgcaguuggaacagcggguacgaguggauaacagacuuccccggcaagacggugugguucguuccgucaaucaagucuggcaacgacaucgcuaauugccugcggaagaaugggaagcgcgucauccagcuuucaagaaagaccuucgacaccgaauaccagaagaccaaaaacaacgauugggacuaugucgugaccaccgacaucagcgaaaugggcgccaacuuucgcgccgaccggguuaucgacccgcgccggugcuuaaagccugugaucuuaaaggacgggcccgagcgcguaauccuggcgggccccaugccugucaccgucgccuccgccgcccaacggcgcggccgaaucggccgcaaccacaacaaggagggcgaucaguauaucuacauggggcagccccucaacaaugacgaggaccacgcucacuggacggaagcuaagaugcugcuggacaauaucaauacgcccgaggggaucauacccgcccuuuucgaaccagagagggagaaauccgcggcgaucgacggggaguaccggcuuagaggcgaggccaggaagaccuucgucgagcugaugcgccgcggggaccuucccguuuggcuguccuacaagguggcgagcgagggcuuucaguacagcgaccgccgguggugcuucgacggcgagcgcaacaaccaaguccuggaagaaaacauggacguugagaucuggaccaaggagggggagcggaagaagcugcgcccgcguuggcuggaugcccgcaccuacucugacccccuggcccuacgggaguucaaggaguucgcagcuggccgccggagcguguccggggaccugaucuuagagauuggcaaacucccgcagcaccugacgcagcgcgcgcaaaacgcccuggacaacuuggucaugcugcacaacagugagcagggagguagggccuaccgccacgcgauggaggagcugcccgauaccaucgagacccucaugcuacuggcgcucauagccgugcucaccggcgggguuacccuguucuuccuaucagggcggggguugggaaaaacuucuaucggacugcuaugcgucauggcauccagcguccugcuguggauggcauccguggaaccccacuggaucgccgcgaguaucauccuugaguucuuccucaugguauugcucauccccgagcccgaccgccagcggacgccccaggacaaccaacuggccuacguggugaucgggcuccucuucaugauccugaccgucgccgccaacgaaaugggcuuacucgaaaccacgaagaaggaccuggggaucggccacguagccguugagaaccaucaccacgcggccaugcuggacguggaccuccaccccgccuccgcguggacccuguacgccgucgcuaccacuauuaucacaccgaugaugcggcacaccaucgagaauaccacggcgaauaucagccugacggccaucgccaaucaagccgcgauccucaugggguuagacaagggcuggccgaucuccaagauggauauuggcgugccccuguuggcccuggguugcuacagccaagucaauccccucacccuaaccgcagcuguccugaugcugguugcgcacuacgccauaaucggccccgggcuccaggccaaggccacccgcgaagcacagaagcggaccgccgcgggcaucaugaaaaaccccaccgucgacgguaucguggccaucgaccuggaccccgugguguacgacgccaaguuugagaagcagcuuggacaaaucaugcuccugauccuguguaccucucagauccuccugaugcgcacuacgugggcccugugcgaaagcaucacacucgcaacuggcccccugaccacgcugugggaagggucucccggaaaauucuggaacaccacgaucgccgucagcauggcuaauaucuuccgcgguuccuaccucgcgggcgccggcuuagcguucagccugaugaagagucucgguggcgggcggcggggaaccggggcucagggggagacguuaggcgagaaguggaagcgccaguuaaaccagcuaucgaagucugaguucaacaccuauaagcggucggggaucauggagguugaccgcucggaagcgaaggaggggcugaaacgcggggagaccacgaagcacgccgucucccgcgguacggcgaagcugcggugguucguggaacgcaaccuggugaaaccggaggggaaagucauugaccucggcugcggccgcggcggaugguccuacuauugcgccggguuaaagaagguaacggaggugaagggguacaccaagggcggccccggccacgaagaaccgaucccuauggccacguacggguggaaccugguuaagcuccacuccggcaaggacguguucuucauaccgccugagaagugcgauacucuguugugcgacaucggggaguccucccccaacccgaccaucgaagaaggcagaacccuccgagugcuuaagauggucgagcccuggcugcgaggcaaccaauucugcaucaagaucuuaaaccccuacaugcccagcguggucgagacccuggagcagaugcagaggaagcacggcggcaugcugguccgcaacccgcucucccgaaauagcacccaugaaauguacugggugucaugcgggacgggcaauaucgugagcgcagugaacaugaccucccgcaugcugcugaacagguucacuauggcccaccggaagcccaccuacgagcgcgacguggaucucggggcgggcacaaggcacguggccgucgagccggagguggccaaccuggacaucaucggccagcgcauagagaacaucaagcacgagcacaaaagcaccuggcacuaugacgaggacaaccccuauaagaccugggcuuaucacggguccuacgaggugaagccgagcggcuccgccucuucgauggucaaugggguggucaagcuucucacaaagcccugggacgucaucccaauggugacgcagaucgcgaugaccgauaccacuccguucggacaacagcgggucuuuaaggagaaaguggacacgcgcaccccgaaagccaagcgugggacggcacagauaauggaggugaccgccaaauggcuguggggguuucuaucccgcaacaagaagccccggauuugcacgcgcgaggaguucacucggaagguccgcucuaacgccgcgaucggcgccguguucguggacgagaaccaguggaauuccgccaaagaggccgucgaggacgagcgguucugggaucucguacaucgggaacgggaguuacacaagcagggaaagugcgcuaccugcguguacaacaugaugggcaagcgugagaagaaguugggggaguucggcaaggccaaggggagccgagccaucugguacauguggcucggcgcccgcuuccuggaguucgaggcccugggcuucaugaaugaggaccacugguuuucccgggagaacagucuauccggggucgaaggcgaagggcugcacaagcugggcuacauccuccgcgacaucaguaagauccccggcggcaacauguacgcggacgauaccgcagggugggacacgcggaucaccgaagacgaccuccagaacgaggcccgaaucaccgacauaauggagccggaacacgcccugcucgccaaguccaucuucaaguugaccuaucagaacaaagucguacgcguccagcggcccgcgaaaaacgggacggucauggacgugauaucgcgccgggaccagcgcggcuccgggcaggucggcaccuacggccuaaauaccuucaccaacauggaggcccagcucauccggcagauggagagcgaggggaucuuuucccccagcgagcuugagacuccuaaccuggccgaacgcguacucgacuggcuggagaaguauggcguggagcggcucaaacgcauggccauauccggagacgacugcguaguuaaaccgaucgacgacagauucgccaccgcgcucaccgcccugaacgacaugggcaagguuagaaaggacaucccccagugggagcccagcaagggcuggaacgacuggcagcagguccccuucugcucacaccacuuccaccagcuaaucaugaaagacggccgggagaucguggugccuugcagaaaccaagacgagcucgucggccgugcgcgcgugucacaaggggccggcuggagccugcgggaaaccgccugucuggggaaguccuacgcgcaaauguggcaguuaauguauuuucaccgccgggaccugcgccuugccgcaaacgcaaucugcagcgcggugcccgucgacuggauccccacgagccggaccacguggagcauccacgcucaccaccaguggaugacaacggaggacauguuaucgguguggaacagagucuggaucgaggaaaaccccuggauggaggacaagacccacaucucaagcuggggcgacgugccguaccuggguaagcgcgaggaccaguggugcgguagccugaucggacucacggcccgggccacuugggcgaccaauauacagguugcgaucaaccaggugcgccggcugaucgggaacgagaacuaccuggauuacaugacgucaaugaagcgcuucaagaacgaaagcgaccccgagggcgccuuaugguga

SEQ ID NO: 24152 - RNA, 9879 nt, Artificial Sequence
  derived and/or modified CDS sequence (opt11) from DENV-1__FJ205882__SS-prME
agcgucaccaugcuacucaugcugaugcccacggcccuagcuuuccaccugacuacacgggguggggaaccccacaugaucgugagcaagcaggaacggggcaagucucugcuuuucaagacaagcgcgggcgugaacaugugcacuuuaaucgccauggaccugggcgaacuaugcgaagacacuaugaccuacaagugcccgcgcauaaccgaggccgagcccgacgacguggacugcuggugcaacgccaccgauacauggguaaccuauggaaccuguucacagacuggugagcaccgccgcgacaagagaaguguggcccucgcaccccauguuggcuuagggcuugagacgcgcaccgagaccuggaugagcucggagggcgccuggaagcagauccagaggguugagacgugggcacugcgccaccccggguucaccguuaucgcccuguucuuagcgcaugcgaucggcacuagcaucacccagaaagggaucaucuucauccuccugauguuggugacccccuccauggccaugcgcugcgucggcaucggcucacgcgacuucguggagggguugucgggcgccacauggguggaugucgugcuggaacaugggagcugugugacaaccauggcaaaagacaagcccacgcuggacauagaacuccuaaagaccgaggucaccaacccugcggugcugaggaagcucugcaucgaggcgaagauuuccaauaccacuacggauagucgcugucccacgcagggcgaggcgacccuaguggaagaacaggacgccaauuuugucugucggcgcaccuucguggaccgaggcugggggaacggcuguggccuguucggcaaggggagucucaucacgugcgcuaaguuuaagugcguaaccaaguuagagggcaagaucguucaguacgagaaccugaaguacucaguaaucgugaccguacacacuggagaucagcaccagguugggaacgaguccacugaacacggcaccaccgcgaccaucacgccccaggcccccaguacggagauacagcucaccgauuacggggcccugaccuuagauugcaguccacggacgggacuagacuuuaacgaaaugguccugcugacgaugaaggagaaguccuggcucgugcacaaacagugguucuuagacuuaccccucccuuggacgagcggggcgucaacuagccaggagacauggaaccggcaggaccuacuggugacguuuaaaaccgcccacgccaagaagcaggagguuguggugcucggcagccaggagggagccaugcacaccgcuuuaacgggggccaccgaaauccagacguccggcacgacgacgaucuucgcuggucacuugaagugcagacucaaaauggacaaacuuacgcugaagggcauguccuacguaauguguaccgggagcuucaagcucgagaaagagguggcggagacccagcacggcacgguccuaguacagaucaaguacgagggcacugacgcccccugcaagaucccuuuuuccacucaagacgagaaggguguaacgcagaacggccggcuuaucacggccaaccccaucgugaccgacaaggagaagccugucaacaucgaggccgaaccgcccuucggggaaagcuauaucgugaucggcgcuggcgagaaggcccugaagcucuccugguucaaaaagggcagcucaauaggcaagauguucgaggcaaccgcccguggggcaaggcgcauggcgauucucggggacacugcgugggauuuugggagcaucgggggcguuuucacgucggucgggaagcucguacaccagauauucgggaccgccuauggggugcuguucuccggcguauccuggaccaugaagauugggaucggcguacugcugaccuggcucggccugaacagccgcuccacgagccugucgaugacuugcauugccguaggccucgucacacuguaccuuggcgugaugguucaggccgacagcggcugcgucaucaacuggaagggacgggagcuaaaaugugggucuggcauauucgucacgaaugaggugcacacguggaccgagcaauauaaguuccaggcggauuccccgaaacgacucagcgcagccauuggcaaggccugggacgagggggucugcggcauucggagugccacgcgccuagagaauaucauguggaaacagaucucuaacgagcucaaccauauucuauuggagaacgacaugaaguuuaccguuguggucggagacguggcggguauccucgcucaggggaaaaagaugauacggccccaaccaauggaguauaaguauuccuggaaguccuggggcaaagccaaaauaaucggcgccgacgugcagaacaccacuuucauuaucgacgggccuaacaccccugagugcccggacgaccaacgugcguggaacauauggaaaguugaggaccauggcuuuggaaucuuccccaccaauaucuggcugaagcugcgggacucuuacacccagguuugcgaccaccgccucaugagcgcugcuaucaaggauuccaaagccgugcacgccgacaugggcuacuggauagaaagcgaaaagaacgagacguggaaacucgcccgagccuccuucaucgaggucaaaaccuguaucuggcccaaaagccacacucugugguccaacggagugcucgaaagcgagaugaucauaccgaagaucuacggagggccuauaucccagcacaauuaucgcccuggguauuuuacucagacggcuggcccuuggcaccuggggaagcuggagcucgacuuuaaccuaugcgaggguaccaccgucgugguggacgagcacugcggcaaccgggggcccagccugcgcaccacgacggugaccgguaaaaucauccacgagugguguugccguagcugcaccuuaccgccccuccgcuucaagggggaggacgggugcugguaugggauggagauccguccagugaaggagaaggaggaaaaccuggucaaaagcauggucuccgcagguuccggggaggucgauagcuucagccucggacugcugugcaucagcaucaugauagaggaagugaugcgcucccgguggagccgcaaaaugcucaugacaggcacacuggcgguguucuuccugcuaaucaugggacaguuaacuuggaacgaccugauccggcucuguaucauggucggugcgaaugcaagugaccgcauggggaugggcacaacguaccuggcgcuaauggccaccuucaaaaugcgcccgaugcuggccgugggguuacuguuccggcggcugacguccagggagguguugcugcuuacgauuggguugucccucgucgcuagcguggagcugcccaacuccuuagaagaauuaggcgacgggcucgccauggguaucaugauccugaaacugcucacggacuuccagucccaccagcuaugggcuacguuacucucccugacuuucaucaagaccacguauucuuugcacuaugcauggaaaaccauggcgaugguguuauccauagugagccuguucccuuuaugccuauccacgaccagccaaaagacgacuuggcugccuguguugcucggcucccuggggugcaagcccuuaacaauguuccuaaucgccgagaauaagaucuggggccgaaaguccuggccucugaaugaggggaucauggccguaggcaucgucagcauccugcucuccucacugcugaaaaacgacgucccuuuagccggaccguuaaucgccggaggcaugcuaaucgcgugcuacgucaucuccgggagcuccgccgaccucucccuggagaaagcagcagagguguccugggaggaggaggcggaacauagcggcgcgucccacaacauccuaguagagguccaagacgacgguaccaugaagauuaaggacgaggagcgggacgacacgcuuacaaucuuacugaaagccaccuuacucgccguaagcggcguguacccucuaucaauccccgcaacccuuuuugucugguacuucuggcagaagaagaagcaacgcagcggggugcugugggacacccccucgccgcccgagguugagcgggccguccuggacgacggcauuuaccgcaucaugcaacggggccugcugggacgcucucaaguggguguggggguuuuucaggagaacguguuccacacaauguggcauguaacccggggcgcgguccuaauguaccaggggaagcgccuggagcccuccugggcaagcgugaagaaggaccugauauccuacggcggcggguggcggcuucaggguagcuggaacaccggggaagagguucaagucaucgccguggaaccgggcaaaaacccgaagaacguacagaccgcacccggcacguucaagacuuccgagggcgaggucggcgccaucgcgcucgacuucaagccaggcaccagcgguucaccuaucgugaaucgugaagggaagauagugggccucuacggaaauggcgucgugaccacguccggcacauacguaucggccaucgcccaggcaaaagcgucccaggagggcccgcucccagagaucgaaaaugaaguuuuucggaaacgcaaccugaccaucauggaucuucacccggguagcggcaagacccgccgcuaccugccggcuaucgugcgggaggccauaaagcgcaaacugcggacgcucauccucgcccccacccggguagucgcuuccgagauggccgaggcgcuaaaagggaugccuauccgcuaccagaccaccgcugucaagagcgagcacacuggcaaggagaucguggaccucaugugucacgcaaccuucaccaugcggcuucugucccccguccgcguuccgaacuacaacaugaucauaauggacgaagcccacuuuaccgaucccagcuccauugcggcgcggggguacauuucuacgcgcgugggcaugggggaggcugccgccauuuucaugaccgcgacaccgcccggauccguagaggccuucccgcaaucuaacgccguuauccaggacgaggaacgggacauccccgagcgcucuuggaacagcggauacgaguggauuaccgauuuccccgguaagaccgugugguucgucccguccaucaagagcgggaacgacauugccaauugccuucguaagaacggaaagagggugauccaguuaucccggaagaccuucgauacagaauaccagaagaccaaaaacaacgacugggacuacgugguaacaacggacaucuccgagaugggcgcuaauuuccgcgcagacagagugaucgacccgcgccggugccugaagccugugauucucaaagauggacccgaacgcguaauccuggccggcccuaugccggugaccguugcuuccgccgcacagcggcgcgggaggauuggccgcaaucacaauaaggagggcgaccaguacauauacaugggccagccacuaaauaaugacgaagaucacgcacacuggacggaggcgaaaaugcuccuggacaacauuaacacacccgagggcaucaucccagcccuguucgagccggagcgcgagaagucggccgcgaucgacggggaguaccgccuccgcggcgaggcucgcaagaccuuuguggaacugaugcgccgaggggaccugcccgucuggcucagcuacaaggucgcgucggagggcuuccaguacuccgacaggcgauggugcuucgauggcgagcgcaauaaccagguccuggaagagaacauggacguugagaucuggacaaaggagggagaacggaagaagcugcgaccaagguggcucgacgcccgcacguacucggacccucuggcccuacgugaguucaaggaguucgcggccggccgcaagagcgucucuggggaucucauccuggagaucgguaagcugccccagcaccugacgcagcgggcccagaacgcucuggacaaccuuguaaugcuccauaacagcgagcagggagggcgcgcguaccggcacgcgauggaggaacuuccugacaccaucgaaacccugaugcuccuggcccugauagcuguucucacuggcggggucacgcuauucuuucugucgggucgcggguuaggaaagaccuccauaggcuugcuuugcguuauggcgucaucggugcuccuguggauggccucggucgagccacauuggauugccgccagcaucauccuggaguucuuccucauggugcuguugauacccgagccggaccgccagcgcacgccacaagauaaucagcucgccuauguggugaucggacugcuguucaugaucuugaccguggccgcgaaugagaugggcuuguuggaaaccaccaagaaggacuuagggauuggccacguggcggucgaaaaccaccaucacgcugccaugcuggauguagaccugcacccugccuccgcguggacucucuacgccguggcgaccacuaucauaacacccaugaugcgccacacgauagagaauaccaccgccaacaucagccugacagccaucgcuaaccaggccgcaauccuuaugggacucgauaaaggcuggccgauuuccaaaauggacaucgggguaccccugcucgcccuuggcuguuauagccaggugaacccccugacccugaccgcggccgugcuuaugcucguugcccauuaugccaucaucgggccagggcugcaggcuaaggcaacccgcgaggcgcaaaaacggacggccgccggcaucaugaaaaaucccaccguggaugggauaguggcgaucgaccuagaucccguaguguacgacgcgaaguucgagaagcagcucggccagaucaugcugcucauccugugcacuucccagauccugcucaugcgcacaacgugggcccugugcgagagcaucacacuggccaccggcccccucaccacccugugggaaggguccccggguaaauuuuggaacacgacgauugccgugagcauggcuaacaucuuucgagggucauaccuggcgggcgcgggccuugcuuuuucguugaugaaauccuuaggugggggacgacgcgggacgggggcccaaggcgagacgcucggagaaaaguggaagcgacagcugaaucagcuguccaaaagcgaguucaacaccuauaagcguuccgguauuauggagguggaccggagugaggccaaggagggcuuaaaacgaggggagaccaccaaacacgcggugaguagagguacagcgaaguuacgcugguucguggaaagaaaccuaguaaagcccgaaggcaaagugaucgaccugggaugcggacgcggcggcuggucauacuacugcgccgggcuaaagaaggugaccgaagucaagggcuacacaaagggagggcccgggcaugaggagcccauaccgauggccacuuacggguggaaccuuguaaaacuacacuccggcaaggauguauucuucaucccgccagagaaaugcgacacguuacugugcgacauaggggagucaucccccaaucccaccaucgaggaaggccguacccugcgcgugcucaagauggucgagcccuggcugcgggguaaccaguucuguaucaagauccugaaccccuacaugccaaguguagucgagacacucgagcagaugcagcgcaagcacggcggcauguuaguacgaaacccgcugucccgcaacaguacccacgagauguauuggguguccugcgggaccgguaacaucgucagcgcgguaaauaugaccucacgcauguugcugaaccgcuuuaccauggcucaccggaaacccaccuacgagagagacguggaccugggagccggcacgcgccaugucgcgguagagcccgagguggcgaacuuagacauaaucggccagcggaucgagaacauuaagcacgagcauaagagcacuuggcauuacgaugaggacaacccuuacaagacaugggcauaccacgguuccuacgaggugaagccgagcggcagcgcguccaguaugguuaacggggucguuaagcugcugacgaagcccugggaugugauaccgauggucacgcagaucgcgaugaccgauaccaccccauuuggccaacagcgcgucuuuaaggagaagguggacacucggaccccgaaggccaagcgcgggaccgcccagaucauggaagugaccgcaaagugguuauggggcuuucuguccagaaacaagaaaccccgcaucugcacgcgcgaggaguuuacgaggaaggugcgguccaacgccgccaucggcgcgguguuuguggaugagaaucaauggaacuccgccaaagaagccguagaggaugagagguuuugggaccugguccaccgggagagggagcuccacaagcaagggaagugcgcuacgugcguauauaacaugaugggcaagcgggagaagaagcugggggaguucggaaaggccaaggggagccgcgcgaucugguauaugugguuaggcgcgcgguucuuggaguucgaggcgcuagguuuuaugaaugaggaucauugguucucaagggaaaauaguuuauccgggguggagggcgagggguuacauaaguuggguuacauccuacgggauaucaguaagaucccugggggcaacauguacgcggacgacaccgccggaugggauacccgcauaaccgaggacgaucuccaaaacgaggccaagaucaccgacaucauggagccagaacacgcgcuacuggccaagagcaucuucaagcuaaccuaccagaacaaggugguccgggugcagaggccagcuaagaauggaacggugauggaugucaucagccggcgcgaccagagaggcucuggccagguggggaccuacgguuugaacaccuucaccaacauggaggcacaacugauccggcagauggagagcgaggggauuuucuccccaucagagcucgaaacgccaaaccuggccggccgcguccuggacuggcucgaaaagcacgggguggagcggcugaagcgcauggccaucuccggagacgauugcguggugaaaccaaucgacgaccgguucgcaaccgcucuaaccgcccugaacgauauggggaaaguccgcaaggacaucccucagugggagcccagcaagggcuggaacgacuggcagcaggucccauucugcagccaucacuuccaucaguugaucaugaaggacggccgugagauagucguaccaugccgaaaucaggaugagcucgugggacgcgcccgcgugucccagggcgcgggguggucccugagagagaccgccugucugggcaagagcuacgcucagauguggcaacugauguacuuccacaggcgggaucugagacuggccgcgaaugccaucuguuccgccguaccgguggacuggguucccacgucucggacgacuuggagcauccacgcacaccaucaguggaugacgacugaagauaugcuauccgucuggaacagaguguggaucgaggagaacccauggauggaggacaagacccacaucagcuccuggggagaugugccuuaccucggcaagcgugaggaccaguggugcgggagccugaucggccugaccgcacgggcgaccugggcgacgaacauccagguagccaucaaccaggugcggcgccuuaucggcaacgagaacuaccuggacuacaugaccuccaugaagcgcuucaagaacgaaucagaccccgaaggggcucugugguga

SEQ ID NO: 24153 - RNA, 9879 nt, Artificial Sequence
  derived and/or modified CDS sequence (opt11) from DENV-1__FJ390388__SS-prME
agcgucaccaugcugcuaaugcugaugcccaccgcccuugccuuccaccucaccaccaggggcggggagccacauaugauagugagcaagcaggaacggggcaaaagccugcuguucaagacaagcgcuggggugaacauguguaccuugaucgccauggaucugggcgagcugugcgaagacaccaugaccuacaagugccccagaaucaccgagaccgaacccgacgacguggacugcuggugcaacgccacggacaccugggugaccuacgggaccugcagccagacgggcgagcaccggcgcgacaagagguccguggccuuggccccccacgugggcuuagggcuggagacccgcacagaaaccuggaugagcuccgagggcgccuggaagcagauccagcgggucgagacgugggcacucaggcaccccggguucaccgugauagcccuguuccuggcacacgcgaucggcaccagcaucacccagaaggggaucaucuucauccuacugaugcuugugacgcccagcauggccaugcgcugcgugggcaucggcagccgcgacuucguagaggggcucuccggcgccaccuggguggacgucgugcuggagcacgggagcugcgugaccaccauggcaaaggacaaacccacucuagacaucgagcuccucaagaccgaggucacuaaccccgccgugcugcggaaacuaugcaucgaggcgaagaucuccaacaccaccaccgacucacgcuguccgacccagggcgaggccacucugguggaggagcaggacgccaacuucguuugucggcgcacauucguggaccggggcugggggaacggcugcgggcuguucggcaaggggagcuuaaucacaugcgccaaguucaagugcguuaccaagcucgagggcaagauaguccaguaugagaaccugaaguacagcgugaucgugaccguccacacgggcgaccagcaccaaguggggaaugagagcacagagcacggcaccaccgccacuaucacgccccaggcccccaccaccgagauccagcucaccgacuacggagcccugacguuagacugcagcccccgcacuggccucgacuucaacgagauggugcuccugaccaugaaggagaaguccuggcucguacacaagcagugguuccuggaccugccccuccccuggaccagcggggccagcacgucccaggagaccuggaaccgacaggaccugcuggugaccuucaagaccgcccacgccaaaaagcaggaggucguggugcucggcagccaggagggcgcgaugcacacggccuugaccggggccacagagauccaaaccuccggcacgacgacaaucuucgccggccaccucaagugcaggcucaagauggacaagcucacccugaaaggcaugagcuacgucaugugcacgggcuccuucaagcucgagaaggagcuggccgagacccagcacggcaccguucugguacaaaucaaguaugagggaaccgacgcgccgugcaagauccccuucucgacgcaggacgagaagggggucacccagaauggccgguuaaucaccgccaacccgaucgugaccgacaaggagaagcccgugaacaucgaggccgagccgcccuucggggagucauacaucgucaucggcgccggcgagaaggcgcucaagcugagcugguucaagaagggguccagcaucgguaagauguucgaagccacggcccgcggugcccggaggauggcgauccugggcgacaccgcgugggacuucggcuccauuggcggcguguucaccagcguggggaaacucguccaccagaucuucggaacagcguacggggugcuguuuuccggcgucagcuggacgaugaaaaucgggaucggcguccugaugaccuggcucggccugaauucccgcagcaccucccucagcaugaccugcaucgccgucgggcucguaacgcucuaccugggcgucauggugcaagccgacuccgggugcgugauuaacuggaagggccgggagcucaagugcgggucuggcauauuugucacgaacgagguacacacauggaccgagcaguacaaguuccaggccgauaguccgaaacgccuguccgcagcuaucggcaaggccugggaggagggggugugcggcauccggagcgccacccguuuggagaacaucauguggaagcagaucuccaacgagcuuaaccacauccugcuugaaaacgacaugaaguuuacugucguggugggggacgucgccggcauccucgcucaagggaagaagaugauccggccccagcccauggagcacaaguacucguggaaguccugggguaaggccaagaucaucggcgccgacgugcagaacaccaccuucaucaucgacgggcccaacaccccggaaugcccugacgaccagagagcauggaacaucugggagguggaagacuacggcuuugggaucuucaccaccaauauuuggcuuaagcugcgggacagcuacacccaggucugcgaccaccgccucauguccgcggccaucaaggacagcaaggccguucacgccgacaugggcuacuggaucgaguccgagaagaacgagaccuggaagcuggcccgggcuagcuucaucgaggugaagacgugcaucuggcccaagucccacacccugugguccaacggcguccucgaguccgagaugaucauccccaagauauacgggggaccgaucucacagcacaacuaccgccccgguuauuucacccagaccgccggccccuggcaccuagggaagcuggaguuggacuucgaucugugugagggaacgaccgugguggucgacgagcauugcggcaaccgggggccgucccugcguaccacaaccgugaccggcaagaucauccacgaguggugcugccggagcugcacccuaccuccccuccgcuuccgcggggaagauggcugcugguaugggauggagauacgccccgucaaggagaaggaggagaaucugguaaaguccauggugagcgccggcagcggcgagguggauuccuuuucucucgggcugcuguguaucuccaucaugaucgaagaggucaugcggucgcgcuggagccggaagaugcucaugaccggcacgcuggccguguucuuccugcucaucguggggcagcuuacguggaaugaccugauccgccucuguauaauggucggcgccaacgcgagcgaccguauggggaugggcaccaccuaccuugcccugauggccacguucaagaugcggccgauguucgccguggggcuccuguuccgccggcugaccuccagagagguucucuuacuaaccaucgggcucagccuggucgccuccguggagcugcccaacucccucgaggaacucggcgacgggcuggcgauggggauaaugauccuuaaguugcugacagacuuccaaucccaucagcucugggccacucugcucagccucaccuucauuaagaccacauucucccugcauuacgccuggaagacgauggccaugguccugagcgucgucuccuuauucccucugugccuuagcaccaccucccagaagaccacguggcuccccgugcugcugggcagccuggggugcaagccacuuaccauguuccugaucgcagagaacaaaaucuggggccggcgcuccuggccccugaaugaggggauaauggccgugggcaucgucagcauccugcugagcucccuccugaagaacgacgucccgcuggccgggccucucauagccggcggcaugcucaucgccugcuacgugauuagcggguccagcgcggaccugucccucgagaaggccgccgaaguaagcugggaagaagaggccgagcacuccggcgccagccacaacauccuggucgagguccaggacgacgggacgaugaagauaaaggacgaggagcgagacgacacccugaccauccuccugaaggcgacgcuguuagccguguccggcgucuacccgcugagcauccccgccacccuguuugugugguacuucuggcagaagaagaagcagcgcuccggggugcucugggacacccccagcccccccgaggucgagcgggccgugcuagacgacggcaucuaccggaucaugcagcggggccuguuagggcgcucccaggugggcgucgggguguuccaagagaacgucuuccacaccauguggcacgucacgcggggcgccguguugauguaccaggggaagcggcuggagcccagcugggcguccgugaagaaggaccugauaagcuacggcggcggguggcggcuccagggcuccuggaauaccggggaggagguccaggugaucgcaguggagcccgguaagaaccccaagaacguccagaccgcccccgggaccuucaagacgcccgaaggcgaggucggcgccaucgcccuggacuucaaacccgggaccagcggcucccccaucguuaaucgcgagcguaagaucgucgggcuguacggcaacggaguggucacaaccagcgggacguaugucagcgcgaucgcccaggccaaggccucccaggagggcccgcuccccgagaucgaggacgagguuuuccgcaagcgcaaccugacuaucauggaccugcaucccgggagcggcaagacccgcagguaccucccggcgaucgugcgcgaggccaucaagcguaaacugagaacucugauccucgcacccacgcgcgucguggcauccgagauggcugaggcgcugaaggggaugcccaucagguaccagaccaccgccguuaagagcgagcacaccgggaaggagaucgucgaccugaugugccacgccacguucaccaugcgccuucugucccccgugcgggugcccaacuacaacaugaucaucauggacgaagcccacuucaccgaccccagcuccaucgcugcgcgcggcuacaucagcacccgggucgggaugggcgaggccgccgcgaucuucaugacggccaccccgcccggcuccguggaggcguucccgcagucgaacgcagugauacaggacgaggagcgcgacauccccgaacgguccuggaauagcggcuacgaguggaucaccgacuuccccggaaagaccgucugguucgugcccaguaucaaaagcggcaacgacaucgccaacugccugcgcaagaacggcaagcgggugauccagcucucccgcaaaacguucgacacugaguaccagaagacuaagaacaacgacugggacuacgucgucaccacggacaucagcgagaugggggcuaacuuccgggcggaucgcgugaucgacccgcggcggugccugaagcccguaauccuuaaggacggccccgagcgagugauccucgccgggcccaugccggucaccgucgcgagcgccgcgcagcgccggggccgcauagggcgcaaccacaacaaggaaggcgaucaguacaucuacaugggccagccccugaacaacgacgaggaccacgcgcacuggaccgaggccaaaaugcugcucgacaacaucaacacccccgaggggaucauccccgcccuguucgagccggagagggaaaaguccgccgcuaucgacggcgaauaccgccugcgcggggaggcgcgcaagacguucguagagcucaugcggcgcggcgaccugcccgucuggcugucauacaagguggccagcgagggguuccaguacagcgaccggagguggugcuucgacggcgaacggaacaaccaggugcuagaggagaauauggacgucgaaaucuggaccaaagagggcgagcgcaagaagcugcguccccgcuggcuggacgcccggacauacuccgacccccucgcccugcgcgaguucaaggaguucgccgcaggccggcggagcguguccggcgaccugauccucgagaucgggaagcugccgcagcaccugacccagcgggcccagaacgcccucgacaaccuggucaugcugcacaacuccgagcaggguggccgcgccuacaggcacgcgauggaggagcuccccgacacuaucgagacccucaugcugcucgcccugauagccguccuuacugggggagugacucucuucuuccuguccggccgcggccuggggaaaaccucuaucggccuccugugcgugauggccuccagcguccugcucuggauggccuccguggaaccccacuggaucgcggccagcauaauccuggaguucuuccugaugguccucuuaauccccgagccagaccggcagcgcaccccccaggacaaccagcuggccuacguagugaucggccucuuauucaugauccuuacgguggccgccaacgagauggggcucuuagaaaccacuaagaaggaccugggcauugggcacgucgcaguggagaaucaccaccacgccgccaugcucgacguggaccuucaccccgcauccgccuggacgcuguacgcggucgccaccaccauaaucaccccgaugaugcgccacacgaucgagaacaccaccgccaauaucagccucacagccaucgcgaaccaggcggcaauacugaugggccuggacaaaggauggcccaucuccaaaauggacaucggcgugccgcuacuggcccuaggcuguuacagccaggugaacccccucacgcugacagccgcgguccugaugcucguagcccacuacgccaucaucgggccggggcugcaggccaaggccacccgggaagcgcaaaagcguaccgccgccgggaucaugaagaaccccacgguggacggcaucgucgccaucgacuuagaccccgugguuuacgaugccaaguuugagaagcagcucggucagaucauguugcugauccucugcaccucccagauccuguuaaugcggaccaccugggcgcucugcgagagcaucacacuggccaccggcccacugacgacccucugggagggcuccccagggaaauucuggaacacgaccaucgccgucagcauggccaacaucuuucgcggaucguaccuggccggggcgggccuggccuuuagucucaugaagucccugggcggaggcagacgcgggaccggcgcccagggggagacccugggugagaaguggaagcggcagcuuaaucagcuguccaagagcgaguucaacacguacaagcgcuccgggaucauggagguggaccgaagcgaggcgaaggagggguugaagcggggcgagaccaccaagcacgcggugagccgggggaccgccaagcucaggugguucgucgagcggaaccucguuaagcccgagggcaaggugaucgaccuggguugcggccgcggcggguggagcuauuacugugcaggccugaagaagguuacggaagugaagggguacacuaagggugggcccggccacgaggaaccuauaccgauggccaccuacggcuggaaccucgugaagcugcacuccgggaaggacgucuucuucaucccgcccgaaaagugcgacaccuugcucugugacaucggcgagagcucucccaacccgacgaucgaggagggacgcacccugcgcgugcugaagaugguggagccauggcuccggggcaaccaguucugcaucaagauccugaaccccuauaugcccagcgucguggagacccuggagcagaugcagcgcaagcacgggggcaugcucgugcggaauccgcugucccgcaacagcacccacgaaauguacugggucuccugcggcacggggaacaucgugagcgccguuaacaugacgucccgcaugcugcucaaccgguucaccauggcccaccgcaagcccaccuacgagcgggacgucgaccugggcgcggggacccgccacguggccgucgagcccgaagucgccaaccuugauaucaucggccagcggauugagaacauaaagcacgagcacaaaagcacguggcacuacgaugaggacaaccccuacaagaccugggccuaccacggcuccuacgaggugaaaccaagcgggucugcgagcagcaugguaaacggcguggugaagcugcugaccaagcccugggacgucauccccauggugacgcagaucgccaugacggacacgacccccuucggucagcagcgaguuuucaaggagaaggucgacacccggaccccgaaggcuaagcgcggcaccgcccagauuauggaggugacggcuaaguggcuguggggguuccuauccagaaacaagaaaccgcgcaucugcacccgggaggaguucacgcgcaaggugcggagcaacgcagcuaucggugccgucuucguggaugagaaccaguggaacuccgccaaggaggcgguugaggacgagcgcuuuugggaccugguccacagagagcgcgagcugcacaaacagggcaagugcgcgaccugcguguacaacaugauggggaagagggagaagaagcuaggcgaguucgggaaggccaagggcucucgcgccaucugguacauguggcugggggcacgguuccucgaguucgaagcucucggcuucaugaacgaggaucacugguucucacgcgagaacucgcuguccggcgucgaaggggaaggcuugcacaagcucggguacauucugcgggacaucagcaagauccccggagggaacauguacgccgaugacacggccggcugggacacccggaucaccgaggacgacuuacagaacgaggcgcguaucaccgacauaauggagccggagcacgcccuccuggcgaaguccaucuucaagcugaccuaccaaaacaaggucgugcgugugcaacgcccggccaaaaaugggaccgucauggacgugaucagccgacgcgaucagcguggguccggccaaguggggacguacggccucaacaccuuuaccaauauggaggcccagcugauccggcaaauggagagcgagggcauauucucccccagcgaacuggagacgcccaaccucgccgagcggguccuggacuggcuggagaaguacgggguggagcgccucaagcggauggcuaucuccggagacgauugcguggucaaaccgaucgacgaccgcuucgccacggcccugaccgcccugaacgacauggggaaggugcggaaggauauuccccagugggagcccagcaagggcuggaacgacuggcaacagguccccuucuguucccaccacuuccaccaacucaucaugaaggacgggcgcgagaucgucgugccgugcagaaaccaggacgaacugguggggcgcgcccgggucucgcaaggcgccggguggucgcugcgcgagaccgccugccucggcaaguccuacgcccagauguggcagcugauguacuuccaucgaagggaucuucggcucgcggccaacgccaucugcagcgccgugcccguggacuggauccccaccucccgcacgaccuggucgauucacgcccaccaccaguggaugaccaccgaggacaugcuguccgucuggaacagggucuggaucgaggagaaccccuggauggaggacaagacgcacaucagcuccuggggcgacgugccguaccugggcaaacgggaggaccaguggugcgggucgcucaucggccuuaccgcgcgcgccacaugggcgaccaacauacaggucgccauaaaccaggugcgucgccugaucggcaacgagaacuaccucgauuacaugaccuccaugaagcgguucaaaaacgagagcgaccccgagggggccuuaugguga

SEQ ID NO: 24154 - RNA, 9879 nt, Artificial Sequence
  derived and/or modified CDS sequence (opt11) from DENV-1__FJ024464__SS-prME
agcguuaccaugcugcugaugcugaugcccaccgcccuggccuuccaccucaccacgcguggcggugagccccacaugaucgugagcaagcaggagcggggaaagagccugcuguucaagaccagcgccggagugaacaugugcacccucaucgccauggaccugggcgagcuaugcgaagacacgaugaccuacaagugcccccggauuaccgagaccgagcccgacgauguggacugcuggugcaacgcuacagacaccugggugaccuacgggaccugcagucagacgggcgagcaccggcgggacaagcggagcguggcccuagcuccgcaugugggccugggucuggagacccgcaccgagaccuggauguccucggagggcgcguggaagcagauacaacggguugagacgugggcacuccggcaccccggguucaccgugaucgcccuguuccuggcccacgcgaucgggacgagcaucacucaaaaggggaucaucuucauccuccugaugcuggugacgccguccauggccaugcgaugcguuggcaucggcagccgcgacuucguggagggccucuccggugccaccuggguggaugucgugcuagaacauggaucaugcgugaccaccauggcgaaggauaagcccacgcuagacauugaguugcugaagaccgaggucacgaaccccgccgugcucagaaagcucuguaucgaagcaaaaauauccaacacuacgaccgacagccgcugcccgacccagggcgaagccacacugguggaggagcaagacgccaacuuugucugucggcggaccuucguggaccggggcuggggaaacggcugcgggcuguucggcaagggcucccucaucacgugcgcuaaguucaagugcgugacaaagcuggaggggaagaucguccaguacgagaaccuaaaguacagugugaucgugaccguucacacgggcgaccagcaccaggucgggaaugaauccaccgagcacggcaccacugcgaccaucacgccacaggcgcccaccaccgagauccaacucaccgauuacggugcccugaccuuggacugcagcccccgcacuggccucgacuucaaugagaugguuuuguuaacuaugaaggagaaguccuggcuuguccauaagcaaugguuucuggaccugccccuaccuuggaccagcggggccagcacgucccaggaaacguggaaccggcaagaucugcuggugacguucaaaacggcccaugccaaaaagcaggaggucguuguguugggcagccaagagggcgcgaugcauacggcucugaccggagcgaccgagauacaaaccaguggcacgaccacaaucuucgcggggcaccugaagugccgccuaaagauggacaaacugacccugaaaggcaugagcuacgucaugugcacuggguccuucaagcucgaaaaagagcuggccgagacccagcacggcacaguacuggugcagaucaaguacgaaggcaccgacgcccccugcaagaucccguucagcacgcaggacgagaagggggucacccaaaacggccgccucaucaccgcgaauccuaucgugaccgacaaggaaaagcccgugaacaucgaggccgagccucccuuuggagaguccuacaucgucaucggcgccggcgagaaggcacucaaguugagcugguuuaagaagggguccagcaucggcaagauguucgaggccacggcgcguggcguaaggcgcauggccauccugggcgacacggccugggacuucggguccauaggcgggguguucaccucagucgggaaacuagugcaucaaaucuuugggaccgcuuacggggugcucuucuccggugucaguuggacgaugaagaucgggauaggcgugcugcucaccuggcugggccugaacucccgaagcacuucccugagcaugaccugcauagccgugggacugguuaccuuauaccucggcgugauggugcaggccgacuccggcugcguaaucaacuggaagggccgggagcugaaaugcgggucgggcaucuucgugaccaaugagguccacaccuggacggaacaguacaaguuccaggcggacagcccgaagcgcuuaucagccgcuauaggcaaggcaugggaggagggggucugcggcauacggagcgccacccgccuagagaacauuauguggaagcaaaucagcaacgaacugaaccacauacugcucgagaacgauaugaaauucacggugguggucggggacguggcaggcauccuggcacaggggaagaagaugauccggccccaacccauggaauauaaguacagcuggaaguccuggggcaaggcuaagaucaucggcgccgacgugcaaaauaccaccuucaucaucgacgggcccaacacuccggagugccccgaugaccagagggccuggaacaucugggaggucgaggacuacggcuuugggaucuucacaaccaauauuuggcugaaguuacgcgacagcuauacccaggucugcgaccaucgccugauguccgccgcgaucaaggacucuaaggcagugcacgcagacaugggcuauuggauagaaucugagaaaaacgaaaccuggaagcucgcccgggccaguuucaucgagguaaagacguguauuuggccaaagucccacacccucuggagcaacggcguccuggaauccgagaugaucaucccuaagaucuacgggggcccgaugucccagcacaacuaccgccccggguauuucacccaaaccgcgggccccuggcaccugggcaagcuggagcuggacuuugaccugugcgagggcacgaccguggucguggaugagcacugugguaaccgggggccgucguuacgcaccacuacggucacuggcaaaaucauucacgaguggugcugccggagcugcacccugccgccccugagauuccggggggaggacggcuguugguacggcauggaaauccgccccgucaaggagaaggaggagaaccucgucaaguccauggugucagccggcagcggcgaggucgacuccuucagccugggccugcucugcaucuccaucaugaucgaggaggugaugcggagcagauggagccggaagaugcugaugaccggcacgcuggcaguguucuuuuugcugaucauggggcaacugaccuggaacgaccugauccgccugugcaucauggucggcgccaacgccucggacagaaugggaauggggaccaccuaucuggccuugauggccacguucaagaugcggccuauguuugccgucggacuacuauucagacggcugaccucccgcgaggugcugcuucucaccaucggacugagccuggucgcgucgguagagcuccccaacagucuggaagaacugggcgacggacucgccaugggcaucaugaucuugaagcugcucacggauuuccagucucaucagcugugggcgacgcuucucagccugaccuuuaucaagaccaccuucucccugcacuacgccuggaagacaauggccauggugcucagcauagugucccuguuuccccugugcuuaucgacgaccucucagaagaccacuuggcugcccgugcuguuaggcagccucgggugcaagccguugaccauguuccucauugcagagaacaagaucuggggccggcgcuccuggccccugaacgaggggaucauggcggucggaauaguaaguauccuccuuaguucucugcugaagaacgacguuccucuagccgguccccugauagcaggcggcaugcuuaucgcgugcuacgucaucagcgggucaagcgcagaccuaucccuggagaaagcggccgaaguuagcugggaggaggaggccgagcacuccggcgccagucacaacauucuuguggagguccaggacgacggcaccaugaagauuaaggacgaggaacgggacgacacuuuaaccauccugcucaaggccacgcuccuggcgguguccggcguguacccgcugagcauccccgccacccucuucguaugguacuucuggcagaagaagaagcaacgguccggugugcugugggauacccccucgccgcccgaggucgagagagccguccuggaugacggcauuuaccgcaucaugcaaaggggccugcucggcagaucccaggucggcgugggcguauuccaggagaacguguuccacaccauguggcacgugacgagaggggccgucuugauguaccaggggaagcgccuggagcccagcugggccuccgugaagaaggaccucauaucauacggcggcggguggcggcugcagggcuccuggaacaccggggaagagguucaggucauagcgguagagcccgguaagaaccccaaaaauguucagaccgccccggggaccuucaagacccccgagggcgaagucggcgcaaucgcccuggacuucaagcccgggaccagcggaucccccaucgugaaccgcgagggaaagauuguaggccucuauggcaacgggguugugacuaccagcggcaccuaugugagcgcaaucgcgcaggcuaaggcgucccaggaggggccgcugccggagaucgaggacgaggucuuccggaagcgcaaccugacgaucauggaucuccaucccggcagcgggaagacccggcguuaccucccagcuaucgugcgggaggccaucaagcgcaagcugaggacccuaauccuggcccccacgcgggugguagccagugagauggccgaagccuuaaaaggcaugcccauccgcuaccagaccacggcggucaagagcgaacacaccggcaaagagaucguggaucucaugugccaugcuacauucaccaugcgccugcugucccccguucgcgugccgaacuacaacaugaucauaauggacgaggcccacuucaccgaccccagcaguaucgccgcccggggcuacaucucuacacgcgugggcaugggggaagcggccgccaucuucaugacggccacgccgccgggcaguguagaggccuucccccagagcaacgccgugauccaggacgaggagcgggacauccccgagcgcuccuggaauagcggguacgaguggaucaccgauuuccccggcaagaccguuugguucgucccauccauaaagucaggcaacgacaucgccaacugccuacgaaagaacgggaagcgcgugauccagcugucccggaagacguuugacacggaguaccagaagaccaagaacaacgacugggacuacguggucaccacggauauaagcgagaugggcgccaauuuccgggcugaccgggugaucgacccacgcaggugccuuaagccggugauccucaaggacgggcccgagcgcgucauccuggcgggccccaugcccguaaccguggccuccgccgcccagaggcgcgggcgaaucgguaggaaccacaauaaagagggcgaccaguacaucuacauggggcaaccauugaacaaugacgaggaccacgcccacuggaccgaggcgaagaugcuccucgacaacaucaacacaccggagggcaucauccccgcccuguucgagccggagcgcgagaagucggcggccaucgacggcgaguaccggcuccgcggcgaagcccggaagacguucguggagcugaugcguaggggggaccugcccguguggcucucauacaaggucgccucggagggauuccaguacucugaccgccgguggugcuucgacggcgagcgcaacaaccaagugcuugaggagaacauggacguagagaucuggacuaaggagggggagcguaagaagcugcgcccccgauggcuagacgcgcgaaccuacagugacccccuggcacugcgggaauucaaggaguucgccgccggcaggcggucggucuccggggaucuuauucuggagauuggcaagcucccccagcaccucacccaacgcgcacagaacgcucuggauaaccuagugaugcuccauaauagcgagcaaggagggagagccuauaggcacgccauggaggagcugcccgacacuauugaaaccuugaugcuccuggcgcugaucgccgugcuaaccgggggggucacccuuuuuuuccuguccgguagagggcucggcaagaccagcauaggccugcugugcgugauggccuccagcgugcuccuguggauggccucuguugagccccacuggaucgccgcgagcauaauccuggaauucuuucuaaugguguugcugauccccgagccggaccgacagcggacgccccaggacaaccagcuugccuacguggucauugggcugcuguucaugauccucaccguggccgccaacgagaugggccugcuggaaacaaccaagaaggaucucgguaucggccacguggccgucgagaaccaccaucaugcggccaugcucgacgucgaccugcacccggccucggccuggacccucuacgccguggcgaccaccauuaucaccccgaugaugaggcauacgaucgagaauaccaccgccaacaucucucugaccgcgaucgccaaccaggccgcgauccucauggggcucgacaagggauggcccaucucaaagauggacaucggagugcccuugcuggcccucgggugcuauagccaagugaacccccugacauugaccgccgccgugcuaaugcugguagcgcacuacgcaaucauaggcccgggguugcaggccaaagccacuagggaagcacagaagcguaccgcggccggcaucaugaagaaucccacagucgacgggaucguggcgauagaccucgaccccguugucuacgaugccaaguuugagaaacagcuaggccagaucaugcugcucauccucugcacaucccagauccugcucaugcgcaccaccugggcccuaugugaaagcaucacacuggcgaccggccccuuaaccacccugugggaagguucaccggguaaguuuuggaacacgaccauugccgugagcauggccaacaucuucaggggcuccuaccuggcuggugccggccucgccuucagcuugaugaaauccuugggaggcgggaggcgggggaccggcgcgcagggagagacccucggcgagaaguggaagcgccagcuaaaccaacugagcaaaucugaguucaauacuuacaagcguuccgggauuauggaaguggaccgcucggaggccaaggagggacucaagagaggggagaccacaaagcacgccgucucccgcggcaccgcgaagcugcggugguucguggagcgcaaucuggucaagcccgagggcaaggugaucgaccugggcuguggccgcgggggcuggagcuacuacugcgccgggcugaagaagguaacggagguuaagggguauacaaagggcggcccuggucaugaggagccuaucccgauggccacauacggguggaaccuggugaagcuccacucuggaaaggacguguucuuuaucccuccugagaagugcgacaccuuacuuugcgauauaggggaaucgucccccaauccgacgaucgaggagggccgcacccugcgggugcuuaagaugguggagccguggcugcgggggaaccaguucugcaucaagauccugaaucccuacaugcccucuguggucgaaacccucgagcagaugcagcggaagcacggcggcaugcuggugcgcaauccccugucccggaauagcacucacgagauguacuggguguccugcggaaccggcaacaucgucuccgccgugaacaugacgucccguaugcucuugaaccgcuucacgauggcccaccggaagcccacguacgagcgcgauguggauuugggggcggguacccggcacguggccguggagcccgaggucgccaaccucgacaucauaggucagaggaucgaaaacauaaagcacgagcacaagagcacuuggcacuaugacgaggacaaccccuacaagaccugggccuaccacggguccuacgaggugaagccuagcggcuccgccagcagcaugguaaacggggucgugaaacuauuaaccaagcccugggacguuauccccaugguuacccagaucgcgaugacggacacaacccccuucggccagcagcggguguucaaggagaagguggacacccguacgccgaaagccaagcggggaaccgcccaaaucauggaggucaccgccaaguggcucuggggauuccugagucgcaacaagaaaccccggauuugcaccagagaagaauuuacgcgcaagguccgcucaaacgccgcgaucggcgcgguuuucgucgacgaaaaccaauggaacuccgccaaggaggccguggaggacgaacgguucugggaccuagugcaccgcgaacgggagcuccacaagcaaggcaaaugcgcgaccugcgucuacaacaugaugggaaagcgggagaagaagcucggggaguucggcaaggcuaaggggagccgggcuauaugguacauguggcuuggugcucgcuuccucgaguucgaggcgcugggguucaugaacgaagaccacugguucucccgggagaacagccuguccgggguggagggcgaggggcuacauaaauugggcuacauccugcgcgacauuagcaagauccccgggggcaacauguaugcggacgacaccgccggcugggacacacggaucacggaggaugaccuacagaaugaggcccgcaucaccgacaucauggagccggagcacgcccugcuggccaagagcauuuucaaguugaccuaccagaacaaagugguccgcguacagcggcccgcaaagaacggaaccgugauggauguaaucucgcgccgggaccaaaggggcucuggccagguggggacguacggcuugaacaccuuuacaaacauggaggcccagcugauccggcagauggagagcgaggggauuuuuucccccagcgagcucgagacccccaaccuggccaaacgcguguuggacuggcucgagaaauacggcguagagcggcugaagaggauggccauaagcggggacgacugcguggugaaaccgaucgacgaccgcuucgccacggcuuugaccgcccuuaaugacaugggcaagguacgcaaggauaucccacagugggaacccagcaagggguggaacgacuggcagcagguccccuucugcucccaucacuuucaucaacugaucaugaaggacgguagagagaucguggucccuugucgaaaucaggacgaguuaguggggcgggcccgugucagccaaggggccggcuggagccuucgggagaccgccugccuaggcaaaucuuaugcgcagauguggcagcugauguauuuccaccgccgggaucuccggcuggcagcaaaugccaucugcagcgcggucccuguggauuggauccccaccuccagaacgaccuggaguauccacgcccaccaccaauggaugacuacagaggacauguugagcguguggaaccgcgucuggaucgaggaaaaccccuggauggaggauaagacccacaucagcuccuggggcgacgugccguaccucgggaagagggaggaccaauggugcggcagccucaucggccugacagcacgugcaaccugggccacaaacauucagguggcgaucaaccagguccgccggcucaucggcaaugagaacuacuuagauuacaugacguccaugaagcgcuucaagaacgaaagcgaccccgagggcgcucugugguag

SEQ ID NO: 24155 - RNA, 9879 nt, Artificial Sequence
  derived and/or modified CDS sequence (opt11) from DENV-1__FJ410191__SS-prME
agcguuaccaugcuguugaugcuaaugcccaccgcccuggccuuccaccucacgacccggggcggggagccccacaugaucguguccaagcaggaacggggcaagucccugcuguucaagaccuccgcuggcgugaacaugugcacgcugaucgccauggaccuuggugaguuuugcgaggauaccaugacuuacaagugcccccguaucaccgaggcugaacccgacgauguggauugcugguguaacgccacagacaccuggguuaccuacgggaccugcagccagaccggcgagcaccgacgcgacaagcgguccguggcccuggcgccccaugugggccucgggcuugaaacgcgcaccgagaccuggauguccuccgagggcgccuggaagcagauccaaaagguagagaccugggcccuacgacacccgggguuuacggugauagcccucuuuuuggcgcacgccaucggcaccucgaucacgcagaaggggaucauuuucauucuccuuaugcuugugacccccuccauggccaugcgcugcgucggcaucggcagccgggacuucguagaggggcuauccggcgccacuuggguggacgucguguuagagcaugggagcugcgugaccaccauggccaaagacaagccuacccuggacauagagcuacucaagaccgaggucaccaaccccgccguguuacgcaagcugugcaucgaggccaagauuuccaacaccaccacggauagccgaugcccgacccagggcgaagccacccucguugaggagcaggacgcgaacuucgucugcaggcggaccuucguggaucgcggcuggggcaacgguugcgggcuguuugggaagggguccuuaaucacgugcgcuaaguucaaaugcgugaccaaacucgaaggcaaaaccguucagcacgagaaccugaaguacagcgugaucguuacaguccauacaggcgaccagcaccaagugggcaacgagucaaccgagcacggcacgaccgcgacgaucacaccccaggcccccagcaccgagauccagcuuaccgacuauggggcccucacccuggacugcagcccccggacgggccuggacuucaacgaaaugguauuauugacaaugaaggagaaguccugguuggugcacaagcagugguuccucgaccugccucugccguggacaagcggggcgucaaccucacaagaaacuuggaaucgcaaagaccuccuggugaccuucaagacagcucacgcgaagaagcaggaagucguugugcuggggucccaggagggcgccaugcacaccgcacuuacgggugccaccgagauccagacuagcggcacaacgaccaucuucgccgggcaccugaagugccggcucaagauggacaagcuaacuuuaaaggggaccuccuacgucaugugcacagggaguuucaagcuggagaaggagguggcggagacccagcacgguacuguucucguacaaaucaaauacgaaggcaccgacgcacccugcaagauucccuucagcacgcaggacgagaaaggggugacccaaaacggcaggcugaucaccgccaacccgauaguuaccgacaaggagaagcccgugaacauugaagccgagccgcccuuuggcgagagcuacaucgugauuggcgcuggugagaaggcccugaaacugucgugguucaagaagggcagcuccaucgguaaaauguuugaggccacggcucguggggcucgccggauggcgauccucggugacaccgccugggacuucgggagcaucggcggcguguucacauccgucgggaagcugguacaccaaaucuucggcaccgccuacggggugcuguucagcggcgucuccuggacuaugaaaaucgggaucggggugcuccugaccuggcugggccucaacagccgcuccaccagcuuauccaugacgugcaucgccguggggcugguuacguuauaccugggcguaaugguacaagccgauucgggaugcguaauuaauuggaagggcagggagcugaagugugggucaggaaucuucguaaccaacgaaguacacacauggaccgagcaauacaaguuucaggcggacaguccgaagcggcucucggccgcgaucggcaaggccugggaggagggcgucuguggcauccgcuccgcuaccagacuggaaaacaucauguggaaacagauaucuaaugagcugaaccacauccuuuuggagaacgacaugaaauuuacggugguugugggggacguggcgggcauccuggcccaggggaaaaagaugauacgcccacagccaauggaguacaaguacuccuggaaauccuggggcaaggccaaaaucaucggagcugacgugcagaacacuaccuucaucauagaugggcccaacacacccgagugccccgacgaccaaagggcguggaacauaugggaggucgaggacuaugguuuugggauuuucacgacaaacaucuggcucaagcuacgcgacaguuacacccaggugugcgaccaccggcugaugagcgcugccauaaaagacaguaaagccguucacgccgacaugggauacuggauagagagcgagaagaaugagaccuggaaacucgcgcgggcauccuuuauugaggucaagacguguauauggcccaagagccacacacuguggaguaacggcguccuggagagcgagaugauuauccccaagaucuacgggggcccgaccucccaacacaacuaccggccagguuacuuuacccaaacggccggccccuggcaccucgguaaacuggaacuggacuucgaccucugcgaaggcaccaccguggucguagacgagcacugcggcaaccgcgggccgagccugcggacuaccaccgugaccggcaagaucauccaugaguggugcugcagauccugcacccugccgccccugagguuuaagggggaggacggcugcugguacgggauggagauccgcccagucaaggagaaggaggagaaucuagucaaaagcaugguuagcgccggcuccggagaggucgacagcuucucccugggauuguuguguaucagcaucaugaucgaggaagugaugcggucccguuggagccggaagaugcugaugacggggacccucgccguguucuuuuugcugaucauggggcagcucacuuggaaugaccugauccgcuugugcaucauggucggugccaacgccagcgaccggaugggaaugggcaccacguaucucgcccugauggcaaccuucaagaugcgcccgauguucgccguggggcuccuuuuccgcagguuaaccagccgcgaggugcugcuccugaccaucggucuuucccucguggccagcguggagcugccaaauucccuggaggagcucggcgauggacuggccauggggaucaugauccucaagcuccuaacggacuuccagagucaccagcugugggccaccuuauugucccugaccuucaucaaaaccacguuuagccuccacuacgcauggaagaccauggcaaugguccuguccauagugagccuguuuccccucugccugucaacaaccagccagaagacgaccugguuacccguguuacugggaucccuggggugcaaaccccucaccauguuccuuauugccgagaauaagaucuggggccgcaaaucuuggccccugaaugaggggaucauggccguaggcaucgugagcauccuccucuccucccuucucaagaacgacgugccccuggccgggccccugaucgccgguggcaugcucauagcgugcuacgucaucuccggcagcagcgcugaccugagcuuagagaaagcugcugagguguccugggaggaagaggccgaacacagcggggcuagccacaacauccucguggaaguacaggacgaugggaccaugaagaucaaggacgaggagcgcgacgauacccugacgauccugcucaaagcuacccugcuggcggugagcggaguuuauccgcucaguaucccggccacacuguucguaugguacuucuggcagaagaagaagcagagaagcggcgugcugugggacacccccaguccacccgagguggagagggcgguccucgacgacgguaucuaccggaucaugcagcgcgggcugcucgggcggucgcagguaggaguggggguuuuccaggaaaacguauuccacacgauguggcacgugacccgcggcgcaguccuuauguaccaagggaagcggcuugagcccucaugggccucuguaaagaaagaccuaaucuccuacggcggaggguggcgccuacagggcaguuggaacacgggggaggaggugcaagugauugcuguggagccgggcaagaaccccaagaacgugcagacagcacccgggacuuuuaagaccagugagggggaggucggcgcgaucgcgcucgacuucaagcccgggacaaguggcucucccaucgugaaccgugaggggaagaucgugggccucuacggcaacggggucgugaccacgucgggcaccuacgucagcgccaucgcccaggccaaagcgucccaggaggggccccugccggagauagaggacgaggucuucagaaaacggaaccucaccaucauggaccuccauccgggcagcgggaagacccgccgcuacuuacccgccaucguccgcgaggcgaucaagcggaagcuaagaacgcugauacuggccccgacgcgcguggucgcguccgagauggcagaggcucucaagggcaugccaauccgcuaccagacuacggccguaaaaggagagcauacggggaaggagaucguggaucugaugugccacgcaaccuuuacuaugcgccugcucagccccgugcguguccccaacuacaacaugauuauaauggaugaagcccacuuuaccgacccguccucgaucgcggcucgcggcuacaucucuacgcgggucgggaugggcgaggcugcggccauauuuaugacagcgacgccacccgguagcgucgaggccuucccccaguccaacgcugugauccaggacgaggagcgcgauauccccgagcggagcuggaacucgggcuaugaguggaucaccgacuucccaggcaagaccgugugguucguccccucaaucaaguccgggaacgacauugcgaacugucugcgcaagaacggcaagagggugauucagcugagccgcaagaccuucgacacugaauaucaaaagaccaagaacaacgacugggacuacgugguaacgaccgacaucuccgagaugggggcaaacuuucgggccgaccgcgugaucgacccccggcgcugccucaagccggucauccugaaggacggccccgaacggguuauacuggccgggcccaugcccgugaccgucgccucggccgcucagcgacggggcagaaucggcaggaaccacaacaaggagggggaccaguacaucuacauggggcagccgcucaacaaugacgaggaccacgcccacuggaccgaagccaaaaugcugcuugacaacauuaacacccccgaggggaucaucccugcccucuucgaaccggaacgcgagaaguccgccgcgaucgacggcgaguaccggcuuagaggggaggcccgcaagaccuuuguggaacucaugcgccgcggcgaccuccccguaugguuaucauauaaaguugcauccgagggcuuucaauacucugaccggcgguggugcuucgauggcgagcggaacaaccagguguuggaagagaacauggauguggagaucuggaccaaggagggcgagcggaagaagcuccggccuagguggcuggacgcccggaccuacagcgacccccuggcccuccgcgaguucaaggaauuugcggccgggcgccgcuccgucucgggggauuugauccuggagaucggcaaacuuccccagcaccugacgcagcgggcccagaacgcccuggacaacuuagugaugcugcacaacucggaacagggaggucgcgcguaccggcacgccauggaggagcucccggacaccauugagacccucauguuacuggccuugaucgccgugcugaccgguggcgucacccuguuuuuccucucagggcgcggccuggggaagacguccaucggguugcucugcguaauggccagcuccgcgcugcuguggauggccagcguugagccgcauuggaucgccgccuccaucauccucgaguucuuccugaugguccucuugauccccgaacccgaccgccagcguaccccucaggacaaccagcuggccuacgucgugaucggccuacuauucaugauccucacagucgcagcuaacgaaaugggacugcucgagaccacgaaacgagaccugggcaucggacacguggccguggagaaccaccaccacgccgccaugcuggacguggaccugcaucccgcgagcgccuggacccuguacgcuguagccaccaccaucaucacgccaaugaugcggcauaccaucgagaacacuaccgccaacaucucccugacagcgauagccaaccaggccgccauccucaugggccuggacaagggcuggccuaucagcaagauggacaucggggucccacugcucgcgcuugguuguuacucccaggucaacccacuuacccucaccgccgcggugcugaugcugguggcccacuaugcgaucaucgggcccggcuugcaggccaaggccacccgggaagcgcagaagcgcaccgccgccgguaucaugaagaacccgaccgucgacggcauaguggccaucgaccuggacccuguugucuacgacgccaaguucgagaagcagcugggccagauuaugcugcugguacuaugcacgagccagauccuacuaaugcgcaccacgugggccuuaugcgaauccaucacccucgccaccgggcccuugaccacgcucugggagggcagccccgggaaguuuuggaacaccaccaucgccguguccauggcaaauaucuuccguggauccuaccucgcaggcgccgggcuggcguucagccuuaugaaaaguuuaggcggaggcagacgcggaaccggcgcgcaaggcgagacucugggagagaaguggaagcgccagcugaaccaacucaguaaguccgaguucaacaccuacaaacggagcggaauaauggaagucgaccgcuccgaggcgaaggaggggcugaagcggggcgagaccacgaaacaugccgugagccgcgggacugccaaguuacggugguucguggagcgcaaccucgucaaaccggaaggcaaggugaucgaccugggcugcgggcggggcggauggucauauuacugcgccggccugaagaagguuaccgaggugaaaggguacaccaagggugguccgggucacgaggagcccaucccgauggcgaccuacggguggaaccuagugaagcuccacagcgggaaagacguauucuuuaucccgcccgagaagugugacacguugcugugcgauaucggcgaguccagccccaauccgaccaucgaagaggggagaacucuccguguuuuaaagaugguggagccguggcugaggggcaaccaauuuuguaucaagauccucaaccccuacaugcccuccguggucgagacccuggagcagaugcagcggaagcacggcgggaugcugguacgcaacccccuuagccgaaauuccacacacgagauguacuggguuucgugcggcacggggaacaucgucuccgcugugaacaugaccagccgcaugcugcugaaccgguucaccauggcacaccgcaaaccgacuuacgagcgcgacguagacuuaggggccggcacucggcacgucgccguggagccggaggucgcgaaccuggacaucauaggucagagaauugagaauauuaaacacgagcacaagucgaccuggcacuacgacgaggacaauccauacaagaccugggccuaccacggaucguacgaggucaaaccuuccgguagcgccagcuccauggugaacggcguggugaaacugcucacaaagccgugggacgugauccccauggucacgcagaucgcaaugaccgacaccacccccuucggacaacagcgugucuucaaagaaaagguggacacgcgaacacccaaagcgaaacgagggaccgcgcaaaucauggaagucacggccaaguggcuguggggcuuccugagccgaaauaagaagccgcggauuugcacgcgcgaggaauuuacccggaaagugagguccaacgcagccaucggugcaguguucguugacgagaaucaguggaacagcgccaaggaggcuguugaggacgaacgguucugggaccucgugcaccgugagcgagaguuacauaagcagggcaagugcgcgacuugcgucuacaacaugauggggaagcgcgagaaaaagcuaggggaguucggaaaggccaaggguuccagggcgaucugguacauguggcucggcgcccguuuccuggaguucgaggcacugggcuucaugaacgaagaucauugguucuccagggaaaacagucucuccggcguugagggggagggccugcauaagcugggauacauccuucgagacauauccaagaucccgggcggcaauauguacgcagacgacaccgcuggcugggauacgaggauuaccgaggacgaccugcagaacgaggcaaagaucacugacaucauggagcccgagcaugcacugcuugcaaagagcauuuuuaagcugacuuaccaaaauaaggugguccgcguccagcggccagccaagaacggaacgguuauggaugugaucagucgucgcgaccaacgggggagcggccaggugggcaccuacgggcugaacaccuucaccaacaucgaggcccagcucauccgccagauggaguccgaggagaucuucagcccgucagagcuggaaacgcccaaccuggcgggccgggugcuagacuggcuggagaagcauggugucgagcgccuaaagcguauggccaucucgggcgacgacugcguggugaaacccaucgacgaccgauucgccaccgccuugaccgcccugaacgacauggggaagguccggaaggacauuccgcagugggagccauccaagggcuggaacgacuggcagcagguccccuucuguagccaccauuuccaccagcugauuaugaaggacggcagggagaucguggugccuugucggaaccaagacgagcucgugggccgagcgcggguuagccaaggcgcgggguggucccugcgcgagaccgcgugccuagggaaauccuacgcacagauguggcagcucauguacuuccaccggcgggaccugcggcuagcugccaaugccaucugcagugccgucccgguggacugggugcccaccagucgcaccaccugguccauccacgcccaccaccaguggaugaccacggaagacaugcucagcgucuggaaccggguguggauugaggagaaccccuggauggaggacaagacccacauauccucguggggcgacgugcccuaccuggguaagcgcgaagaccaguggugcggcuccuuaauugggcucaccgcgcgugcaacaugggcgaccaacauccaggucgccaucaaccaagugcgccgccucaucgggaacgagaacuacuuagacuacaugacgucgaugaagcgguucaagaaugaguccgauccugagggggcccucugguga

SEQ ID NO: 24156 - RNA, 9879 nt, Artificial Sequence
  derived and/or modified CDS sequence (opt11) from DENV-1__FJ432723__SS-prME
agcgugaccaugcugcucaugcugaugccgaccgcccuggcauuccauuugacgacgcgagggggggagccgcauaugaucgugacgaagcaagagagggggaagagccugcuauuuaagaccagcgcgggcgugaacaugugcacccucauagccauggacuugggugagcugugcgaggauaccaugaccuacaagugccccagaaucacggaggcugagcccgacgacgucgauugcuggugcaacgccacggacacuuggguuaccuacgggaccugcucccagacgggagagcaccggcgcgacaagcggagcguggcccuugccccccacgucggccuagggcuggagacccguacggagaccuggauguccagcgagggcgcguggaagcagauacagagagucgagacaugggcccucagacaccccggguucaccgugauugcccuguuccuggcccacgccauugguaccuccaucacccagaaggguauaaucuucauucuccugaugcuggugacgcccagcauggcaaugcguuguguaggcaucggcucccgugacuuuguggaggggcucucuggagcuacuuggguggacgucgugcuggaacaugggucuugcgugaccaccauggcaaaggacaagcccacgcuggacauugagcuccugaagaccgaggucaccaacccagcggugcuacgaaagcucugcaucgaggccaagaucagcaacacaacgaccgacucucgcugcccuacucagggcgaggcaacccugauggaggagcaagaugcgaacuucguaugccgacgaacauucgucgaccggggcuggggaaacggcugcgggcuguucgguaaggggagccucauuacgugcgcaaaguucaaaugcguuaccaaguuggaggggaagaucgugcaguaugagaaucugaaauauucaguuauuguuacagugcacacgggcgaccaacaucaggucgguaacgagagcacagagcacggcacaacggccacuaucacgccgcaggcaccgaccuccgagauucagcucacggacuauggggcgcugacucuagauugcucgccccgcacaggacuagacuucaacgagauggugcugcucacaaugaaggagaaguccuggcucguccacaaacagugguuccuggacuuaccuuuacccuggaccagcggggccuccaccagccaggagaccuggaauaggcaggaccugcugguaaccuucaagaccgcccacgcgaaaaaacaggagguaguugugcucggcagccaggagggagccaugcauaccgcccugacgggugcaaccgagauucagaccagcggcaccacaacuauauucgcagggcaccugaagugucgccucaagauggacaagcugacccuuaagggcaugagcuacgugauguguaccggcuccuucaagcucgagaaggaggucgcggagacgcagcacgguaccgugcuagugcagaucaaguaugaggggaccgacgccccgugcaagauccccuuuaguacucaggaugagaagggggugacgcagaacggacggcugaucaccgccaacccgaucgucaccgacaaggaaaaacccgucaacauagaagcagagccgcccuucggggaguccuacaucgugaucggcgcgggagagaaggcccugaagcucagcugguuuaagaagggauccagcaucggaaagauguucgaggccacagcccgcggggcccggcgaauggcgauccucggcgacacggccugggacuucgggaguaucggcggcguguucacuagcguggggaagcugguucaccagaucuuuggcacagcguacgggguucuguucuccggcgugucuuggacaaugaagaucggcaucggcguccuccugaccuggcucggccugaacucccgcaguacgucacugagcaugaccuguaucgccgucggauugguuacccuguaccucggcgucauggugcaggccgacuccgggugcgugaucaacuggaaggggcgagagcucaagugcggguccgggaucuucgucacuaacgaggugcacaccuggacugagcaguacaaguuccaggcggacagcccgaagcgccuguccgccgcgaucggcaaagcgugggaggaaggggugugcgggauccggagcgccacccggcuggagaauaucauguggaagcagauauccaacgagcucaaccacauccugcuugagaacgacaugaaguucaccguaguugucggggaugucguggggauccuagcgcagggcaagaagaugauccggccccaacccauggagcauaaguacagcuggaaauccuggggcaaggccaagaucaucggggccgacguucagaacacgaccuucaucaucgaugggcccaacaccccggagugccccgacgaccagcgugcuuggaauaucugggagguagaagacuacggcuuugggauuuucaccacaaauaucuggcugaagcugcgggacagcuacacccaggugugcgaccauagacucauguccgcggcaaucaaggacagcaaggccgugcacgccgacaugggcuacuggaucgagucugagaagaacgaaaccuggaaacuggcccgggcgucauuuaucgaaguaaagaccuguaucuggcccaagucccacacauuguggagcaacggugugcucgaguccgagaugaucauucccaagaucuacggggggccgaucagucaacacaacuaccgccccgguuacuucacccagaccgccggcccuuggcaccuugggaagcuggagcucgacuucgaccugugcgagggcacuacgguggucguagacgagcacugcggcaaccgggggccaucccuacgcaccaccaccgugacgggcaagauaauccacgaguggugcugccgcagcugcacucugccgccccuucgcuucaagggggaagacggcugcugguacgguauggaaauccggcccguaaaggaaaaggaggagaaccuaguaaagaguauggucuccgcgggcagcggggaggucgauuccuucagccucgggcuguuauguaucucgaucaugauugaggaagugaugcgcagccgcuggucacgcaagaugcucaugaccggcacguuggccguguuuuugcuccucaucauggggcaacugacguggaaugacuugauccggcugugcaucauggucggcgcgaacgcaucggaccgcauggggaugggcacgacguaccuggcccucaucgcuaccuucaagaugcgcccgauguuugccgugggucugcucuuccggcgccucacauccagagaggugcugcuccucaccaucgggcugagccuggucgcgaguguggaacucccgaacagccuggaggagcugggugacgggcucgcgaugggcauuaugauccugaagcugcugaccgacuuccagucccaccagcugugggccacccuccugagcuucacguucauaaagaccacuuuaucccugcacuacgccuggaaaaccauggccaugguccuuagcaucgugucccuguucccucugugccucagcacgaccagucagaagaccacuuggcugccugugcugcuaggcagucuggggugcaaaccgcugacgauguuucucauugcggagaacaagaucuggggccgcaagucguggccacugaacgagggcauuauggccguuggaguggugagcaucuuacucagcucccugcuuaagaacgacguuccacucgccgggccuuuaaucgccggcggcaugcuaaucgccugcuacgugauuaguggcuccagcgcggacuugucccuggaaaaggccgccgaggugagcugggaggaggaggccgagcacuccggcgccucgcauaacauuuuggucgaagugcaggacgacgggacuaugaaaaucaaggacgaagagcgggacgacacccucaccauccugcugaaggcgacccuccuggcaguuuccggcguguacccgcuaagcauccccgcgacccuauucgugugguauuucuggcagaagaagaagcagagaucaggcgucuuaugggacacccccucgccgccugagguagagcgagcugugcuggacgacggcauuuaucgcauuaugcagcgggggcugcucgggcgcucccaagugggcgucgggguguuccaggagaauguguuucauacuauguggcacguaacacguggcgccgugcuaauguaucaggggaagaggcuggagccuucgugggcguccgugaagaaggaccucaucucuuauggcggcggauggcgguuacaggguucguggaauacgggcgaggagguacagguuauagccguggaaccugggaagaacccaaagaacguccagaccgccccugggacauucaagacucccgagggcgagguuggcgcgaucgcucuggauuucaagcccggaacgucgggcagucccaucgugaaucgcgaggggaaaaucgucggccucuacggcaacggggugguaaccaccaguggcaccuacgucagcgcuauagcccaagcaaaggccucccaggaggguccgcugccagagaucgaggacgaaguauuccggaaacggaaccugacgaucauggaccuccacccuggcagcgggaagacccgccguuaucugccugcgaucgugcgggaggccaucaagcgcaagcugcggaccuugauccuggcccccacccgcguaguggccuccgagauggccgaggcacugaaggggaugccuauccgguaucaaacgaccgccgucaaaagcgaacacaccggcaaagagauuguagaccucaugugucaugccacauuuacgaugcgacuccugucucccguucgcgugccgaacuacaacaugauuauuauggaugaggcccacuucacugaccccagcucuaucgccgcacgaggguacaucaguacccgcgucggcaugggggaggccgccgcgauauucaugacugcgacaccgcccggcucugucgaggcguucccgcaauccaacgcaguuauacaagacgaggagcgcgauauucccgagcgcuccuggaauagcggguacgaguggaucacagacuucccuggcaagacggucugguucgugcccagcaucaagagcggcaacgauaucgcaaacugccuaaggaagaacgggaagaggguaauucagcugucaagaaagaccuucgacacggaauaccagaagaccaagaacaacgacugggauuacgugguuaccaccgacaucagcgaaaugggcgccaauuuccgcgcggaccgcguuaucgacccccgcagaugucugaagccaguaauccugaaggacggccccgaaagagugauauuggccggaccaaugccggucacgguggccuccgccgcccagagacgcgggcggaucgggcgaaaucacaauaaggagggcgaccaguacaucuacaugggccagccucugaauaacgacgaggaccaugcgcacuggaccgaagccaagaugcuucucgacaauauuaacaccccagaggguauaauacccgcccuguucgaaccggagcgggaaaaguccgccgccauugauggugaguaccgccuucgcggcgaggcgcggaagacuuucguugagcugaugaggcgaggggaccuccccgucugguugucuuacaagguugccagcgagggcuuccaguacagcgaccgacgguggugcuucgacggcgaacgaaacaaccagguacuggaagagaacauggacgucgagauuuggaccaaggagggugagcgcaagaagcuccgcccacguuggcucgacgcccguaccuauucagacccgcuggcccugcgggaguuuaaagaguucgccgccggccgccggagcguaucgggugaucucauacuugaaaucggcaagcugccgcagcacuuaacccaaagggcccagaacgcccucgauaaccuggugaugcuccacaacagcgagcagggagggcgcgcguaucggcacgcgauggaggaacugcccgauacgauugagacgcugaugcuccuggcccugauugccguccucaccggcggggugacucuguucuuccuauccggccgggggcucggaaaaacuaguauagguuuacuguguguuauggccuccucaguccuacuguggauggccuccgucgagccccauuggaucgccgccagcaucauccuggaguucuuccuaaugguguuguugauacccgagccggacaggcagaggacgccucaggauaaucagcucgccuacgucgugaucggguugcuauucaugauacucacggucgccgcaaacgagaugggccugcuagagaccaccaagaaagaccucgggaucggucacgucgcggucgagaaucaucaccaugccaccaugcuggauguggaucugcaccccgccuccgcguggacacucuacgcgguagcgacuaccaucauaacaccgaugaugagacauacgauagagaacacaaccgccaacaucucacugaccgcuaucgcgaaccaggcggcgauccugaugggucuugacaagggcuggcccauuuccaagauggauaucggcgugccccuucuggcucucgguuguuacagccaggugaacccccugacgcugacggccgcaguccucauguuagucgcacacuacgccaucauuggaccgggacuacaggccaaggcuacccgggaggcccaaaaacgcaccgcggcgggcaucaugaagaaccccaccguagaugggaucgucgcaaucgaccucgauccagugguguacgacgcaaaguucgaaaaacagcugggucaaaucaugcugcucauccuaugcaccucucagauuuuacucaugcgcaccaccugggcccugugcgaauccaucacgcuugcgaccggucccuuaaccacccucugggaagggucuccgggcaaguucuggaacacgaccaucgcggucagcauggccaauauuuuccguggauccuaccuggccggcgcuggacuugcguucagccugaugaagucucugggggguggucgucgggggaccggggcccagggggagacccuaggcgagaaguggaagcgccagcugaaccaacuguccaagagcgaguucaacacguacaagcgguccgggaucauggagguugaccguucggaggcuaaggagggccucaaaaggggggagacaaccaggcacgccguaucccggggcaccgcgaagcugcgcugguucgucgaacguaaccugguaaagccggaggggaaaguaaucgaccuggguugcggucgugggggcuggucuuacuacugcgccgggcucaagaaggucacugaggugaagggguacaccaagggcgggccgggccacgaggagcccaucccgauggcaaccuacggguggaaccuggugaagcugcacuccgggaaggacgucuuuuuuacuccccccgagaaaugugauacucuacugugugacaucggggagagcucccccaaucccacuauagaggaggggcggacccuccgaguuuuaaagaugguggagcccuggcugcggggcaaccaguucugcaucaagaucuugaacccuuacaugcccagcgucguggagacccucgaacagaugcagagaaaacacggcggcaugcuugugagaaacccacugucccgcaacagcacacacgagauguacugggucagcugcgggacgggcaacaucgugagcgcggugaauaugacgucccggaugcucuugaauagauucaccauggcucaucgcaagccaaccuaugagagagacguagaccugggggcaggcacgcgucacguagcuguugagcccgagguagccaauuuagacauaauaggccaaaggauagaaaacaucaagcacgaacacaagaguaccuggcacuacgacgaggacaaccccuacaagaccugggcguaucacgggucuuacgaggugaaaccaucugguucagccucgagcauggucaauggcguggugaaguugcugacuaagcccugggacguaaucccaaugguaacgcagaucgcuaugaccgacaccacgccuuucggccagcagcgaguguucaaagagaaggucgacacgcggaccccgaaggccaagcgcgggaccgcccagauaauggaggugacagccaaguggcuauggggauuccugagccgcaacaagaagccccgcauuugcacgcgggaggaauucaccagaaaggugcggucgaacgcagcgaucggcgccgucuucguggaugagaaccaguggaacagcgcuaaggaggccguggaggaugagcgcuucugggaccuuguucagaaggagagggagcuccauaagcaggggaagugcgcaacuugcgucuacaacaugaugggcaagcgagaaaagaagcugggggaguucgguaaggccaaagggucacgggcuauuugguacauguggcugggcgcucgcuuccucgaauucgaggccuuaggcuucaugaacgaggaccacugguucagucgggagaacagcuuauccggaguggaaggcgaggggcuacacaagcugggauacauccugcgcgacauuucgaagauccccgggggcaacauguacgcggacgacaccgccggcugggacacaagaaucaccgaggacgaccuccaaaacgaggccaagaucacugacauaauggaaccggagcacgcccugcuggccaccuccaucuucaaacuaacuuaccagaacaaggucgugagaguacagcggcccgccaaaaacggcaccgugauggauguaaucagucgccgcgaccagcggggcuccggccaggucgguaccuacgggcugaacaccuucacgaacauggaagcccagcugauucgacaaauggagagugaggguauauucuugcccggcgagcuggagacgccgaaucuggccgaacgggucuuagacuggcuagaaaaguacgggguggagaggcugaagcggauggccauauccggugaugacugcguagucaaaccaaucgacgaucgcuuugcgaccgcgcucaccgcccugaaugacauggggaaggucagaaaggacaucccccagugggagcccagcaaggguuggaacgacuggcagcagguccccuucugcucccaccacuuccaccagcugaucaugaaggacggacgggagaucgucgugccaugucggaaccaggacgaguuagucgggcgcgcucgggucagccagggugccggauggagccugagggagacggcgugccugggcaagagcuacgcgcagauguggcagcucauguacuuccacaggcgugaccuccgacuggccgccaacgcuauauguucugcggugcccguugacugggucccuaccagccgcaccacuuggagcauccacgcccaucaucaguggaugacgacagaggauaugcucaguguguggaaccggguguggaucgaggagaaccccuggauggaggacaagacccacgucucguccuggggcgacguuccguaccugggaaaacgggaggaucaguggugcggaagccugaucgggcucacugccagagccacgugggccucuaacauccaggucgcgaucaaccaggucagacgacucaucggcaacgagaacuaccuggacuauaugacgaguaugaagcguuuuaagaaugagggggaccccgagggagccuuaugguga

SEQ ID NO: 24157 - RNA, 9879 nt, Artificial Sequence
  derived and/or modified CDS sequence (opt11) from DENV-1__FJ410192__SS-prME
ucagugaccaugcuguugauguuaaugccaaccgccuuggccuuccaccugacaacgagagggggggagccacacaugaucguuagcaagcaggagcgagggaagagccuacuguucaaaacuagcgccgggguuaauauguguacccucauagccauggacuuaggcgagcugugcgaggacaccaugaccuauaagugcccccgaaucacagagaccgagcccgacgacguggacugcuggugcaacgccaccgacaccugggugaccuacggaaccugcagccagacgggcgagcaccggcgagacaagcggagcguugcauuggccccucacguuggcuugggguuggaaacccgcaccgaaaccuggaugagcucugagggcgccuggaagcaaauacagcgggucgaaacaugggcccucagacacccgggguucacagugaucgcccuuuuccuggcccacgcuaucgggaccucaaucacccaaaaggggaucaucuuuauccuccugaugcuggucacucccuccauggccaugcggugcgucggcaucgggagccgcgauuucguugaggggcucucuggcgccacguggguggacgugguacuggagcacggaaguugcgugacuacaauggccaaggauaagcccacgcuggacaucgagcucuuaaaaacugaagugacgaaccccgccguccuucgcaagcucugcaucgaggcaaagaucuccaauacgacgacagacagccgcuguccgacccagggcgaagcuacccugguggaagagcaggacgcuaacuucgugugccggcgcaccuucguagacaggggcuggggaaacggcugcgggcuuuucggaaaggggucccucaucacuugugccaaguucaagugugugaccaaacuggagggcaagaucguucaauacgagaacuugaaguacagcgugaucgugacaguccacacgggcgaccagcaccagguugggaacgaaucaaccgagcacggaaccaccgcgacuauuacgccacaagcccccacgaccgagauacagcucaccgacuacggugcccugacucuggacugcagccccaggaccggauuagauuucaacgaaaugguccugcugacgaugaaggaaaaguccuggcucgugcacaagcagugguuccuggaccugccucucccauggacuagcggggccuccacgucacaggagaccuggaaucggcaggacuuauuggugacguucaagacagcccacgccaagaagcaagagguggugguccucggcagucaggagggcgcgaugcacaccgcccugaccggugcgaccgagauccaaaccuccggcacuaccacaauuuucgccggucaccugaagugccgccucaagauggacaaacugaccuugaaggguaugagcuacgucaugugcacggguuccuucaagcuugagaaagagcuggccgagacccagcacggcaccgugcuggugcagaucaaguacgaaggcaccgacgcgcccuguaagaucccguuuagcacgcaggacgagaaaggggucacucagaacggccgccugauaaccgcuaacccgauagucaccgacaaggagaagccgguaaauaucgaggcagagccccccuuuggagaaucauacaucgugaucggugccggcgagaaggcgcucaagcugagcugguucaagaagggcuccagcauuggcaagauguucgaggccacggcccgcggcgcucgccgcauggccauccugggugauacugcgugggacuucgguagcaucgggggcguguucaccucggucggcaagcucguccaccagauuuucggcacggccuacggggugcuguucaguggcgugagcuggaccaugaagaucgggaucggcguccugcucaccuggcugggccugaacucccgcucuacaucgcucaguaugaccugcaucgccguggggcuggugacgcuguaccucggcgucaugguccaggccgacuccggcugcgugaucaacuggaaagggcgggagcugaagugugggucuggcaucuucguaacuaaugagguccacaccuggaccgaacaguacaaguuccaggccgacuccccgaagcgauuauccgcggccaucgggaaggcgugggaagaggggguaugcggcaucagaagcgcaacgagacuagagaacaucauguggaagcagauauccaaugagcugaaucacauccugcuugagaacgauaugaaauucacggucguggucggcgauguugccggcauccuagcgcaggggaagaagaugauccggccucaacccauggaauacaaguacuccuggaaguccuggggcaaggccaagaucaucggugcggaugugcaaaacaccaccuucauuaucgacgggcccaauaccccggagugcccggacgaccagagggccuggaacaucugggaaguggaggacuacggcuuugggaucuucacgacaaauaucugguugaagcuccgggacagcuauacccagguuugcgaucaccgccugauguccgcggcaauaaaggacucgaaagcggugcaugcagacauggguuacuggauagaguccgagaaaaacgagacuuggaaguuagcacgggcuagcuucauagaaguuaagacgugcaucuggcccaagucccacacccucuggagcaacggcguccuggaguccgagaugauaauacccaagauauacggcggaccgaucagccagcacaacuaccgccccggguacuucacccaaaccgccggccccuggcaccucggcaaacucgaacuggacuucgaccugugcgaggguacgaccgugguagucgacgaacacugcggcaaccgcgggccgucccuacguacuaccacugugaccggcaagaucauucacgaguggugcugucgcagcuguacccugccgccccuacgcuuccgcggggaggacggcugcugguauggaauggagauucgcccagucaaagagaaggaggagaaccucgucaaaucuauggugagcgccggcaguggcgaaguugacuccuuuucacuggggcucuugugcaucaguaucaugaucgaagaggucaugaggagccgcuggucccggaagaugcugaugaccggcacgcuggccguguucuuccuccugaucauggggcagcugaccuggaacgaucuaaucagacuguguauaauggugggugccaacgcgagcgaccguauggggaugggcacuaccuaccuugcccucauggccacuuucaagaugcggccgauguucgccgugggacugcuguuccgccggcucaccuccagagagguguuacugcucaccauaggacugucgcugguggcaagcgucgagcucccuaacagccuagaggagcugggcgacgggcucgcgaugggaaucaugaucuuaaagcugcugacugacuuccagucgcaccagcugugggcgacgcugcucucccuuacauucaucaagaccacguucagcuugcacuacgccuggaagacuauggccaugaucuugagcaucgugucgcuguucccccucugccucagcaccacaucccagaaaacuaccuggcugcccguccugcuaggcucgcuugggugcaagccgcugacgauguuccucauugcggagaacaagaucuggggccgucgcuccuggccgcuuaacgaagggaucauggcagugggcaucguuagcauccuucucagcucacugcugaagaacgacguaccgcucgccggaccacugaucgcgggcggcaugcugaucgccugcuacgugauaucagggaguagcgcggaccucucccuggagaaagcugccgaagugagcugggaggaggaggccgagcacaguggcgcaagccauaacauccuggucgaggugcaggacgacgggaccaugaaaauuaaggaugaggagcgggacgauaccuuaaccauccugcucaaggcgaccuugcuagcggugaguggcgucuacccuuuaagcaucccggcgacccucuuugugugguauuucuggcaaaagaagaagcagcgcaguggggugcugugggauacucccagcccgccggagguugagcgggcugugcuugacgacggcauauaccgcaucaugcagcggggccugcuuggacgcucccaggucgggguaggcguguuccaggagaauguguuccacaccauguggcauguaacgcgcggcgcgguguugauguaccagggcaaacgccuggagccuagcugggcguccgugaagaaagaccucaucagcuacggcgguggguggcggcugcagggauccuggaauaccggggaggagguucaggucaucgccguggagccagguaaaaaccccaagaacguacagaccgcuccuggaaccuucaagacgcccgagggcgaggugggcgccaucgcccucgacuucaaacccgggacaagcgggucccccaucguaaaccgcgaggggaagauugucggccucuacggcaacgggguggugacuacuagcggcacuuacguuagcgcgauugcccaggcaaaggccucccaggaggggccgcuacccgaaaucgaggacgagguguuucggaagcgaaaccugaccauaauggaucuccaccccggcagugguaagaccagacgcuaccugccggcgauagugcgggaggccaucaaacgcaaguugcgcacccuuauccuggcaccaacgcgggucguggcauccgagauggccgaggcgcuaaagggcaugcccauccgcuaucagaccaccgccgugaagagcgagcacaccggcaaggagaucguugaccucaugugccacgccacuuucaccaugcggcugcuuuccccggugcgaguuccgaauuauaacaugaucaucauggacgaggcccacuuuacagacccuagcaguaucgccgcgaggggguacauuucgaccagagucgggaugggugaggccgcugccaucuuuaugacugccacgccgcccggcuccguggaagcguucccgcagucuaaugccgugauccaggacgaggagcgagauauacccgagcgcaguuggaacagcggguacgaauggaucaccgacuuccccgggaagacggucugguucgugcccucaauaaagagcggcaaugacauugcuaauugcuuacgaaaaaacgggaagcgcgugauccagcugucgagaaagacguuugauacagaauaccagaaaacuaagaauaacgacugggacuacgucgugaccacggacaucuccgagaugggugcaaauuuucgcgcggaccggguaauugacccucgccggugucuuaagcccgucauccugaaggaugggcccgagcgcgugauccuggccggccccaugccggugaccguggccuccgcggcccaacggagggggcggauaggccgcaaucacaacaaagagggcgaccaguacauuuacaugggccaaccucugaacaaugacgaggaccacgcgcacuggaccgaggccaagauguuacuggacaauauuaacacaccugaggggauaaucccggcccuguuugagccggagcgggagaaguccgccgccaucgacggggaguaccggcuacgcggcgaggcgcggaaaacguucguggagcugaugcgccgcggugaccugccgguguggcucuccuacaagguggcgucggagggcuuccaguacagcgaccgccgguggugcuucgauggggagcgcaauaaccaaguacuggaggagaacauggaugucgaaauuuggaccaaggagggggagcggaagaaguuacgcccccgguggcuggacgcccgcacauacuccgacccacuagcccugcgggaguucaaggaguucgcagcggggcgacgaucgguauccggggaccugauacuggagauuggcaaguuaccgcagcaccucacccagcgggcccagaacgcacuugacaaucuaguaaugcuccacaacucugagcagggcgggcgggcuuaucgucacgcuauggaggagcugcccgacacgaucgagacccugaugcuccuggcccuuauugcgguucucaccggcggcgugacccuuuucuuccugucuggccggggucucggcaaaaccucgauaggacuauuaugcgugauggcuuccucagucuugcucuggauggcgucgguggagccgcacuggaucgcggcaucuaucauccuugaguucuuccucaugguucugcugauccccgagcccgaccgccaacggacuccucaagacaaccagcucgccuaugucgugauagggcugcuguucaugauacucaccgucgcggcgaacgagaugggcuugcuggagaccaccaaaaaagaccuggggaucggccacguagcgguggagaaccaccaccacgccgcuaugcuagacguggaccuacaccccgccucggccuggacguuauacgccgucgcgaccaccauaaucacccccaugaugcgccacacaaucgaaaauaccaccgccaacaucagccugaccgccauugccaaccaggcugcuauccuaaugggcuuagauaagggcuggccgauaagcaaaauggacaucgguguaccccugcuggcacucggguguuacagccaggugaacccacugacacuuaccgccgcggugcucaugcucguggcccacuacgccaucauaggcccgggccugcaggccaaggccacacgcgaggcgcagaaaaggaccgcugcgggcaucaugaagaaccccacgguggacggcaucguugccaucgaccucgaccccguggucuaugacgccaaguucgaaaagcaacugggccaaauaauguuacucauccuguguaccucccagauacuacucaugcggaccaccugggcgcugugugagagcaucacucuagcaacuggcccacuaaccacccugugggaaggaucccccggcaaguuuuggaacacgaccaucgccguuucgauggccaacauauuccggggauccuaccuagcaggggcgggucucgccuucagccuaaugaagucccucgggggcgggcgcagggggacaggcgcccagggcgagacccucggcgagaaauggaagcgccagcugaaucagcucucaaagagugaauucaauaccuauaagcggucagguaucauggagguagauagaagcgaagccaaggagggucucaagcgcggggagacuaccaaacacgcagugucacgcgggaccgccaaacugcggugguucguagagcgcaaccuggugaagcccgaaggaaaggugaucgaccugggcugcggcagaggcggguggagcuacuacugugccgggcucaaaaaggugacggaggugaaaggauacacaaaaggcggccccggacacgaggagcccauaccuauggccaccuacggguggaaccuggugaaacugcacucggguaaggacgucuucuucaucccccccgagaagugcgacacccuccugugcgacaucggggagagcuccccgaacccgacgaucgaagagggcaggacguugcgcgugcuaaagaugguggagcccuggcugcgcgggaaccaguucugcaucaagaucuuaaaccccuacaugccauccgucguggagacucucgagcagaugcagcggaagcacggcggcaugcuggugaggaacccgcuaucgcggaacagcacucacgaaauguacugggucuccugugggaccggcaacauagucagcgccgugaacaugacgucucgcaugcuacugaaccgcuucaccauggcacaccguaagccaaccuacgagcgcgacgucgaccugggggcgggcacccggcacguggccguggaaccggagguagccaaccucgauaucaucggccagcgaauugaaaacauaaagcacgagcacaaaagcacguggcacuacgaugaggacaacccuuacaagaccugggccuaucacggauccuaugaagugaagccgagugguagcgcgagcagcaugguaaauggcgucgugaaguugcugacgaagcccugggacgucauccccauggugacccaaaucgcuaugaccgacaccacacccuuuggccagcagcguguguucaaagagaaaguggacacccgcacgccgaaggccaagcgugggaccgcccagauaauggaggucaccgccaaguggcucuggggcuuccucucccgcaacaagaagcccaggauauguacccgcgaggaguucacucgcaaggugcgcagcaacgcggcgauaggagcugucuucguggacgagaaccaguggaacagcgccaaagaggccguugaggacgagcguuucugggaccugguccaccgcgagcgggaguuacacaagcaggggaagugcgcaaccugcguguacaacaugauggggaaacgagagaaaaagcuaggagaauucggcaaggccaaagguagcagagccaucugguacauguggcugggcgcccgcuuccuggaauuugaggcucuuggguucaugaacgaggaccacugguucuccagggagaacagccuguccggggucgaaggcgaagggcuccacaagcuugguuauauacuuagggacaucagcaagaucccugggggcaacauguacgccgacgacacugcaggcugggacacacguaucacggaggacgaucugcagaacgaagcccgcauaacugacaucauggagccggaacacgcucuacuggcgaagucuaucuucaaacucaccuaccagaacaagguugugcgcgugcagagccccgccaaaaacgguacagucauggacgugaucucccggcgagaccagcggggcagcggccaagugggaacguauggucugaacaccuucacuaacauggaggcgcagcugauccggcaaauggagagugaggggaucuuuagcccgucugagcucgagacacccaaccuugcagagcggguccuugacuggcucgaaaaguacggcguggagagacugaaacguauggccauaagcggggacgacugcgucgugaagccgaucgaugaucgcuuugcgaccgcucugacagccuuaaaugacaugggcaaagugaggaaggacaucccccagugggagcccuccaagggguggaacgacuggcagcagguccccuuuuguagccaccauuuccaccagcugaucaugaaggauggccgagagauuguugugccgugcagaaaucaggacgaacugguaggccgcgcccggguaucgcagggggcuggcuggucgcuccgugaaacggcuugccuuggaaagagcuaugcccagauguggcagcugauguacuuucaccggcgcgaucuacggcuagccgccaacgcgaucugcuccgccguuccaguggauuggauacccaccagccgcacgaccugguccauucaugcccaccaccaguggaugacuacagaggacaugcugucugucuggaaccggguauggaucgaagagaaccccuggauggaagacaaaacgcacaucuccuccuggggcgacgugccuuaccucgggaagcgcgaggaccaguggugcggaucccuaaucggccugacggcccgcgccaccugggcgaccaacauucaggucgccaucaaccaggugcggcgccuaaucgggaacgagaacuaccuggacuacaugacaagcaugaagagauuuaagaacgaauccgacccugagggugcccuaugguga

SEQ ID NO: 24158 - RNA, 9879 nt, Artificial Sequence
  derived and/or modified CDS sequence (opt11) from DENV-1__FJ410194__SS-prME
agcgugacgaugcugcucauguuaaugcccacggcccuggccuuccaccucaccacuagggguggggaaccccauaugaucgucagcaagcaggaacggggcaagagcuugcuauucaagacgagcgccggggugaacaugugcacccucaucgccauggacuugggcgaacugugcgaggacacaaugacuuacaagugcccgcgcaucaccgagaccgagcccgacgacguugacugcuggugcaacgccacggauaccugggugaccuacgggaccugcagccagacuggugagcaccggcgcgauaaacggagcgucgcccucgcgccgcacgugggccuggggcuggaaacccgcaccgaaaccuggaugagcuccgagggcgcguggaaacagauccagcgggucgagacgugggcccuccgccacccaggguucaccgugaucgcccuguuccuggcccacgcgaucggcaccagcaucacccagaaggggaucaucuucauccucuugaugcuggugacgcccuccauggccaugcggugugucggcauaggcagucgggacuucguggaggggcugucaggugccacguggguggacguggugcuggagcaugggagcugcgugaccaccauggccaaggacaagcccacgcuggacaucgaacugcuaaagacugagguaaccaaccccgccgugcugaggaagcucugcaucgaggcgaagaucuccaacaccacgaccgacagccgcugccccacgcaaggcgaggccacccugguggaggaacaggacgcaaacuucgucugccggcguacguucguggaccgggguugggguaacggcugcgggcuuuucggcaaggggucccucaucacuugcgccaaguucaagugcgugaccaagcuggagggcaaaauaguccaguaugagaaccugaaguacagcgugauugugacuguccacacgggcgaccagcaccagguggggaacgagucgacugagcacgggaccacggccaccaucacgccccaggcgcccaccacugagauccagcugaccgacuacggggcccugacgcuggacuguucaccccgcaccggccucgacuucaaugagaugguccugcugacgaugaaggagaaguccuggcucgugcacaagcagugguuccuggaccugccacuccccuggaccagcggggcgagcacgucccaggaaaccuggaaccgacaggaccuccuggugacguucaagaccgcgcaugccaagaaacaagaggucguagugcucgguagccaagagggggcgaugcauacggcccugaccggugccaccgagauacagaccuccggaacgacaaccauauucgccggucaccucaaaugccgucucaagauggacaagcucacccugaaggguauguccuacguuaugugcacgggguccuucaaacuugagaaggagguggccgagacccagcauggcaccgugcuggugcaaaucaaguacgagggaaccgacgcgcccuguaagauccccuucagcacgcaggaugagaagggggugacccaaaacggccggcugaucaccgccaacccgaucgugacugauaaggaaaaacccguuaacaucgaggccgagccacccuucggggaguccuacaucgucaucggcgcaggcgaaaaggcgcugaagcucagcugguucaagaagggguccuccaucggcaagauguuugaggcgacggcccgcggugcccggcgcauggccauccugggcgacaccgcgugggacuucggguccauaggcggcguguucaccuccgucgguaagcugguucaccagaucuucggaaccgcguacgggguacucuucuccggcgucagcuggacgaugaagaucgggauaggcgugcugcugacauggcucggucugaacucccguagcacaucccugagcaugaccugcauagccguggggcucgucacgcuguaccugggcgugaugguacaggccgacuccggcugcgucauuaacuggaagggcagggaacucaagugcggcagcggcaucuucgugacaaacgaggugcacaccuggaccgagcaauacaaguuccaggcggacaguccuaagaggcuguccgcagccaucggcaaggccugggaggaaggggugugcggcauccggagcgccacccgccuggagaacauaauguggaagcagaucuccaacgagcucaaccacauccuuuuagagaaugacaugaaguuuacggugguggucggggacguggcgggcauccucgcgcaggggaagaagaugauccggccccagcccauggaguauaaauacagcuggaaaucguggggcaaggccaagauaaucggugcagacgugcaaaacacaacuuucaucaucgacgggcccaacaccccggagugccccgaugaccagcgcgccuggaacaucugggaggucgaggacuacgguuucgggaucuucacaaccaacaucugguugaaacugcgggacagcuacacccaagugugcgaccaccgccugauguccgcggccauuaaggauuccaaggccgugcacgccgacaugggcuacuggauagaguccgagaagaaugagaccuggaagcuggcccgagcgucuuucaucgagguaaagacuugcauauggcccaagagccacaccuuauggagcaauggcgugcucgaguccgaaaugaucauucccaagauuuacgguggccccauuagccagcacaacuaccgcccgggguacuucacgcaagccgccggccccuggcauuuagggaaguuagaacucgauuucgaccugugcgaggggacgacgguggugguggaugaacauugcggcaaccgagggccguccuugcgcacaacaacugugacuggcaagaucauccacgaguggugcugcagaagcugcacccugccuccccuccgcuuuagaggggaggauggaugcugguacggaauggagauccguccggucaaggagaaagaggagaaccuggugaaguccauggugagcgcaggcucgggcgagguagacuccuucagucucgggcugcugugcaucuccaucaugaucgaggagguuaugcggucgagguggucucggcgcaugcucaugaccggcacccuggcgguguucuucuuacucauaauggggcaacugacguggaacgaccugauccgccucugcaucauggucggugcgaacgccagcgaccgaauggggaugggcacaaccuaccuggcacugauggcaacguucaagaugcgcccgauguucgccgugggccuccuguuccgucgccugacgucccgggaaguguuacugcugaccauagggcucagccucguugcguccguggagcugcccaacagccucgaggagcugggcgacgggcuggccauggggauuaugauucucaagcugcugaccgacuuccaaucccaccagcucugggccacccuguuaagccucacguucaucaaaaccaccuucucccugcauuacgccuggaagaccauggcgauggucuuaagcaucgugucccucuuucccuuaugccugagcacgacuucccagaagacgaccuggcuccccgugcuguugggcagccucggguguaagccgcugacgauguuccugaucgccgagaacaagaucuggggcagacgguccuggccccucaaugaggggauaauggcugucggaaucgugagcauccugcugagcagucuccugaaaaacgacgugccccuagcagggccacucaucgccgguggcaugcugaucgcgugcuacgucaucagcgguuccuccgccgaucugucccuagagaaggccgccgaagugagcugggaggaggaggcugagcacuccggcgcgagccacaauauccugguggagguccaagaugacgggaccaugaagaucaaggacgaagaacgcgaugacacgcugaccauccuccugaaggccacacuacucgcgguguccggcguguacccacuaagcauuccggcuacgcuguucgugugguacuucuggcagaagaagaagcagcgguccggggugcucugggacaccccauccccgcccgagguagaacgcgccguccuggacgacggaaucuaccggaucaugcagcgcggccugcuggggcggagccaggugggcgugggggucuuccaggagaauguguuccacaccauguggcacguuacccgcggcgcgguccucauguaccaggggaagcggcuggagcccagcugggcauccguuaagaaggaccugaucagcuacggcggcggcuggcgcuugcagggcuccuggaacacgggcgaggagguccaggucauugccguggagcccggcaagaacccaaagaacgugcagaccgcccccgggacuuucaagacccccgaaggcgaggucggcgccaucgcgcuagacuuuaagcccgggacgagcggcuccccgauugugaaccgggaggggaaaaucguggggcuguacggcaaugggguagugaccaccagcggcacauacguuagcgccaucgcccaggcuaaggcgucccaggaggggccacuccccgagaucgaagacgaggucuuccgcaaacggaaccugacgaucauggauuugcaccccgguagcgggaaaacacgccgguaccucccagccaucgugcgcgaggccaucaagaggaagcugcgaacccugauccucgccccgacccgcgugguagcauccgagauggcggaagcccuaaagggcaugcccauccgguaccagacgaccgccgucaaauccgagcacacugggaaagaaaucguggaccucaugugccacgccaccuucacgaugcgccucuugucccccguccgggugccgaacuacaauaugaucaucauggacgaagcccacuuuaccgacccgucgagcaucgcagcucgcggguacaucagcacgcgcgugggaaugggggaggcagccgccaucuucaugacagcgacgccgcccggcuccguggaggccuucccgcaaaguaacgccgugauccaggacgaggagcgcgacauucccgagcgguccuggaacagcggguacgaguggaucaccgacuuucccggcaagacugugugguucguucccucgaucaagagcggcaacgacauagccaacugccugcgcaagaacgguaagcgggugauccagcuguccaggaaaaccuucgauacugaauaccagaagaccaagaauaacgacugggacuacguggucaccaccgacauaagcgagaugggcgcgaacuuccgggccgaccgggucaucgauccgcggcgcugccugaagcccgugauacugaaggacggucccgagcgggucauccucgccggccccaugccgguuacggucgccuccgccgcgcagcgccgggggcgcaucggccgcaaccacaacaaagagggagaccaauauaucuacaugggucaaccccugaacaacgacgaggaccaugcccacuggaccgaggccaagaugcugcucgacaacaucaacacgccggaaggcaucauccccgcccucuucgagccagagagggagaaguccgccgcuaucgacggggaguaucgccugagaggggaggcacgcaagacguucguggagcucaugcggcgcggggaccugcccguguggcuuuccuacaaagucgccagcgagggcuuccaguacagcgaucggcgcugguguuucgacggcgagcggaacaaucaggugcucgaggagaacauggacguagagaucuggacgaaggagggggagagaaagaagcugcgaccccgguggcuggacgcccgaaccuacuccgaccccuuagcccugcgcgaguucaaggaguucgccgccggacggcgcagcgucuccggagacuugauuuuagaaaucggcaagcuaccgcaacaccugacacagcgggcccagaacgcucucgauaaucuggucaugcuccacaacagugagcagggugggcgcgcauaccggcacgccauggaggagcuacccgacacuaucgagacgcucaugcugcucgcccuuaucgcugugcugaccggcggggucacacucuucuuucuguccggccgcgggcuaggcaagaccagcaucggucuccugugcgucauggccuccucaguucugcuguggauggcguccguagagccgcacuggaucgccgccagcaucauccuggaguucuuccugaugguacuccugauacccgaaccggaccggcagcguacgccucaggacaaccagcucgccuacguggucaucggguuacuguucaugauccugacgguggccgcgaaugagaugggccuccuugagacgaccaagaaggaccucgggaucggccacguggcuguagagaaccaccaucaugccgccaugcucgacguggacuuacaccccgccuccgcuuggacccuguacgccguggccacuacaaucaucaccccuaugaugagacacaccaucgagaauacgacggcaaacaucagccucaccgccaucgcgaaccaggccgccauccuaauggggcuggacaagggcuggcccauauccaagauggacaucggcgucccccugcuggccuuggggugcuauucucaggugaauccccucacccugacggcagccgugcucaugcucgucgcccacuaugccauaauagguccggggcugcaggccaaggcgacccgggaggcucagaaacgaaccgccgcaggcauaaugaaaaaucccaccguagacgggauaguggccaucgaccuggaccccgucguguacgacgcgaaguucgagaagcagcucggccagauuaugcuauugauccucugcacgucccagauccugcugaugagaaccaccugggcccucugcgaaucaaucacgcuggccacgggcccccugaccacacucugggaggggaguccggggaaguucuggaauaccacgaucgccguaagcauggccaacaucuuccgcggguccuaccuggcgggcgccggacuggccuucagccucaugaaaucccucggagggggucggcgggguaccggcgcccagggcgagacgcuaggcgagaaauggaaacggcagcucaaccagcuguccaagagugaguucaacaccuacaagcgcuccgggaucauggaggucgauaggagugaggccaaggagggucugaagcgcggggagacgaccaagcaugccgugucccggggcaccgccaaacuccgcugguucguggagcggaaccuggucaaaccagaggggaaggugaucgaccugggcugcggccgagggggcuggucguacuacugcgccgggcugaagaagguuaccgaggucaaaggcuacacuaagggcgggccgggacacgaggagcccauccccauggcaaccuacggguggaaccugguuaagcugcccuccggcaaagacguguuuuucaucccgcccgagaagugcgacacccuccucugcgacaucggggagagcuccccgaacccuacgaucgaggagggucggacgcugcgcguccugaaaaugguggagcccuggcuccgggguaaccaguuuugcauuaaaauccugaaucccuauaugccgagcguggucgagaccuuggagcagaugcagcgcaagcacggcggcaugcucgugcggaacccccucucgcgcaacagcacccacgagauguacuggguguccugcgguacaggcaauaucgucagcgcggugaauaugacguccagaaugcuguuaaaccgguuuaccauggcccacaggaagcccaccuaugagcgggacguggaucugggugcgggaacccgucacgucgccguagaaccagagguggcaaaucuggacauaauaggccagcggaucgagaacaucaagcacgaacacaagagcaccuggcacuacgacgaagacaacccguacaagacgugggcguaucacggguccuacgaggucaagcccagcggcuccgcgagcucaauggugaacggggucguaaaacuccugacaaagcccugggacgugauccccauggucacccagaucgccaugaccgacacaaccccguucggacagcagcgcguguuuaaggagaagguggacacccggaccccuaaggcuaagcgcgguacggcccagauuauggaagucaccgcgaagugguuauggggcuuccucucccggaacaagaagccccgcaucugcacccgggaggaguucacgaggaaggugcggagcaacgccgccaucggggcaguguuugucgacgagaaccaguggaacagugcgaaggaagcaguggaagacgagcgcuucugggaccugguacaccgggagcgagagcugcacaagcaggggaagugcgcaacgugcguguacaacaugauggguaagcgggagaagaaacuuggagaguuuggcaaagccaaggggucgcgcgccaucugguacauguggcugggugcgcgguuccuggaguuugaggcccucggcuucaugaacgaggaucacugguuuuccagggagaauagcuuaagugggguggagggcgaggggcugcacaagcuaggcuacauccuucgggacaucagcaagauccccggaggcaacauguacgcggacgacacggccggcugggacacccgcaucacggaggaugaccugcagaacgagccccgcauaacggacauaauggaacccgaacacgcccuccuggcgaaguccauauucaagcugaccuaccagaacaaggucguccgcgugcaaagccccgccaaaaauggaaccgugauggacgucauaucccggagagaccagcgcgguagcggccagguggggaccuacggccucaacacguuuaccaacauggaggcccagcugauccggcagauggaguccgaggggaucuuuucgccguccgagcuggaaacccccaaccuagccgagcgcgugcuggauuggcuggagaaguacggcguugagaggcucaaacguauggccaucagcggggacgacugcgugguuaagcccaucgacgaccgguucgcgaccgcccugacggcccugaacgacaugggcaagguccgcaaggacaucccccagugggaaccgucuaagggguggaacgacuggcagcaagugccuuucuggagccaccauuuccaucagcucaucaugaaggacggcagagagaucgugguccccugccgcaaccaggacgagcuggugggccgugcacgcgugagccaaggggcagguuggucccugcgggagaccgcgugccucgcaaagagcuacgcccagauguggcagcuaauguauuuccaccgcagggaccugcgccucgcugcgaacgcaaucugcucagccgucccaguggacuggaucccgaccagccggaccacgugguccauacacgcccaccaccaguggaugaccaccgaggauaugcugucuguguggaaccggguauggaucgaagagaaccccuggauggaggacaagacccauaucuccagcuggggcgacguuccguaccugggcaagcgcgaggaccaguggugcgggagccucaucggccugacggcgcgggcgaccugggccaccaacauccaggucgcaaucaaccagguccgccgguugaucgguaacgagaauuaucucgacuacaugaccagcaugaagcgcuucaagaacgaguccgaccccgagggggcccugugguga

SEQ ID NO: 24159 - RNA, 9879 nt, Artificial Sequence
  derived and/or modified CDS sequence (opt11) from DENV-1__FJ432725__SS-prME
agcgugaccaugcuacucaugcugaugcccaccgccuuagcguuccaccucacgacucgaggaggggaaccccacaugaucguaagcaagcaagagcggggcaagagccugcuguucaagaccucggccggggugaacaugugcacccucaucgccauggaucugggcgagcugugcgaagacacuaugaccuauaagugcccccgcaucaccgagaccgaacccgacgacguagacuguuggugcaacgccacggacaccugggucaccuaugggacgugcagccagacuggggagcaccggcgcgauaagcgguccguggcuuuggcgccgcaugugggacugggccuggagacccgcaccgagaccuggaugagcucagaaggggccuggaagcaaauucagcggguggagacgugggcccuacgccaccccggguuuacggucaucgcacuguuccuugcccacgcgauuggcaccagcaucacccagaaagguaucaucuucauucuccugaugcuggugacgccuuccauggccaugcggugcgugggcaucggcagcagggacuucguggagggccucucaggugccaccuggguggacgucgugcuagagcacgggagcugcgucaccacuauggcuaaggacaagcccacguuggacaucgaguugcucaagacggaggucaccaacccggcgguucugcgcaagcucugcaucgaggcuaagaucucgaauaccaccaccgacagucgcugcccgacccagggcgaagcgacgcugguggaggagcaggacgccaacuuugugugccggcgcacuuucguggaccggggcuggggaaacgggugcgggcuguucggcaaggggucccucaucacaugcgccaaguucaagugcgugacuaaguuggagggcaagaucguccaguacgaaaaccucaaauauucggugaucgugaccguccacacgggugaccagcaccagguggggaacgaauccaccgagcacggcacuaccgccaccaucacaccccaggcuccuaccaccgagauccagcucaccgacuacggggcccugacgcuugacuguagccccagaaccggccucgacuucaacgagaugguacugcugaccaugaaggagaaaaguugguuaguccacaaacaaugguuucuggauuugccccugcccuggaccagcggggccucgacgucccaggaaacuuggaaccggcaggaccugcugguuacguucaagacugcccacgccaagaagcaggaggucguaguccucggcucucaggagggugcgaugcauacagcccugaccggggccaccgagauccaaacaagugguacgacaacuaucuucgccgggcacuuaaagugccgucugaagauggacaagcugacccugaaggguaugaguuacgucauguguacaggauccuucaagcucgaaaaagagguggcagaaacccaacacggcaccguguugguccagauuaaguaugaaggcaccgacgccccgugcaagauccccuuuagcacucaggacgagaagggggugacccagaacggcaggcugauaaccgccaacccgaucgugaccgacaaggaaaagcccgucaacaucgaagccgaaccgcccuucggggagaguuacaucgugaucggcgccggcgagaaggcguugaaacucagcugguucaagaagggguccucgaucggcaagauguucgaggccacggcccgcggggcccggcggauggccauucugggcgacaccgcgugggauuucggguccaucgguggcguguucaccagcguuggaaagcuggugcaccaaaucuucggcacugccuacgggguccuguucuccggcgucagcuggacgaugaagaucgggaucggcguacugcuuaccuggcucggccucaacucccgaagcacgucacugagcaugaccuguaucgccguugggcucgucacgcuuuaccugggggugaugguccaggcugacucggggugcgucaucaacuggaagggcagggagcucaaaugcgggagcggaaucuuugucacaaacgaggugcacacauggacggagcaguauaaguuccaggcugacagcccgaagcgccuguccgcggcaaucggcaaggcuugggaggagggcgugugcggcauccggagcgccacccgccuagaaaacaucauguggaagcagaucuccaacgagcucaaccacauccugcuagagaacgacaugaaguucaccgugguagucggggauguggcuggcauucuugcgcaagguaagaagaugauucggccccagcccauggaguacaaauacagcuggaaguccuggggaaaggccaagaucaucggagcggacgugcaaaacaccaccuucaucaucgacgggcccaauaccccggagugccccgacgaccagcgugcuuggaacaucugggagguggaggacuacggguucgggauuuucacgacgaacauauggcuaaaacuccgggacagcuacacacaggugugcgaccaucgucuaauguccgcugccauaaaggacucgaaagcugugcacgccgacaugggcuacuggaucgaguccgagaagaacgaaaccuggaaacuugcccgggccagcuuuaucgaggucaagacuugcaucuggccaaagucccauacccuguggagcaacggcgugcuggagagugagaugaucaucccgaagaucuaugggggccccaucagccagcacaacuaccguccgggcuacuucacccaggcagccggaccauggcaccugggaaagcuggagcucgacuucgaccuaugcgaaggcacaacgguggucgucgacgagcacugugguaaccgggguccgucccugcgcaccaccaccgugaccggcaagaucauucacgaguggugcugccggagcugcacccugccaccccuccgguuccgcggggaagauggcugcugguacggaauggagauccgccccguuaaggagaaggaggagaaccuggugaagucaauggugagcgccggaagcggugagguagacaguuucagcuuagggcuacugugcaucuccaucaugaucgaggaagugaugaggagccguugguccaggcgcauguuaaugacgggcacccuggccguguucuuccuccuaauaauggggcaacugacguggaacgaucugauccgccuuugcaucauggucggcgcgaacgccagcgaccggauggggaugggcacgaccuaccuggcccugauggcaaccuucaagaugcgccccauguuugccgugggacuccuguuucggcgccuaacgucccgggagguccuccugcugacgaucgggcucagccuagucgcguccguagagcugcccaacagccucgaggaacugggggacgggcuggcaaugggcaucaugauacuaaagcugcugaccgacuuccagucccaccaacucugggcgacgcugcugagucucacguucaucaagaccaccuucucccuccauuaugccuggaaaaccauggcgaugguccugagcaucgucucccuuuuccccuugugccugagcacaaccucccagaaaacgaccuggcugcccguguugcucgguagccucgggugcaagccgcugacgauguuccugaucgcugagaacaagaucuggggacgccggaguuggccgcucaacgaggguaucauggccguuggcaucgugagcauucugcugagcucccuccugaagaacgaugugccacuggccgggccacucaucgccggcggcaugcugaucgcaugcuacguuaucucggggagcagcgccgaccugucacucgagaaggcugcagaggugagcugggaggaagaggccgagcacuccggcgccagccacaacauccuaguggaaguccaggaugacgggacuaugaagauuaaggacgaggagcgugacgacacccugaccauccuccugaaggcuacacugcucgccguaaguggcguguacccucuaucuauucccgccacgcuguucguaugguacuucuggcagaagaagaagcagcguucaggggugcucugggacacccccagcccgcccgaaguggagcgcgccguccuagacgacggcaucuaccggaucaugcagcgcggccuauuagggagaagccaggugggcgugggaguguuucaggagaacguguuccacaccauguggcacgugacccgaggcgcggugcuuauguaccaggggaagcgccucgagccgagcugggccuccgucaagaaagaccugauaucauacggcggcggguggaggcuccaggguucguggaacacgggcgaggagguccaggucaucgcuguagagccggguaaaaacccuaagaacgugcaaaccgcccccgggacguucaagacuccggaaggugagguuggggccauugcuuuagacuucaagcccgguacgagcggaucucccaucgugaaucgggagggaaagauugugggccuguaugguaacggggucguaacuacaagcggcaccuacgugagcgccaucgcccaagccaaggcgucgcaggaggggccgcucccagagaucgaagacgaagucuuccgcaaacggaaccugacuaucauggaccugcauccuggcagcgggaagacccgucgguaccugccggccaucgugcgcgaagcuaucaaacgcaagcuacggacucuuauccuugcucccacccgcguggucgccuccgagauggcggaggcccugaagggcaugcccauccgguaccagacgacugccgucaagagcgagcauaccggaaaggagaucguagaccuuaugugccacgccaccuucacgaugagacuccuuagccccguccgcgugccgaacuacaacaugaucauuauggacgaggcgcacuucaccgauccgagcuccaucgcggcccgcggguacaucagcacacgcgucggcaugggggaggccgccgccaucuuuaugaccgcgacgccgcccggcuccgucgaggccuuuccucagucaaacgccguaauccaggacgaagaacgcgauauccccgaacggucguggaacagcggguacgaguggaucaccgacuuccccggcaagaccguuugguuuguccccuccaucaagagcgguaacgacauugccaacugucugcgcaagaacgggaagcggguaauacagcucuccaggaagaccuucgauacggaguaccagaagacuaagaacaaugacugggauuacguggucaccaccgauaucuccgagaugggcgcgaacuuuagggccgaccgcguaaucgacccgcggcggugucugaagcccguaauccugaaggacgggcccgagcgagucauccucgcuggcccaaugcccgucaccgucgccuccgcugcgcagcgucggggacgcaucggccgaaaccauaacaaagagggcgaccaguacauuuauauggggcagccccugaacaacgacgaggaccacgcccacuggaccgaggccaagaugcuguuagacaacaucaacacccccgagggcaucaucccagcacuguucgagccugagcgggaaaaguccgccgcgauagacggggaguaccgccugcgcggugaagcccgcaagacauucguggagcucaugcggagaggggaccuccccgucuggcuauccuacaaggucgccagcgagggcuuccaguacucagaccggcgauggugcuucgacggcgagcgcaacaaccaggugcuggaggagaacauggacguggagaucuggacgaaggagggggagcgcaagaagcugaggccgcgcuggcuggacgcucgaaccuauuccgacccccuggcccugcgagaguucaaagaguuugcugcaggccggcgcucaguaucuggagaccugauccucgaaaucgggaaguugccgcagcaccuuacccagcgggcgcagaaugcacuugauaacuugguaaugcugcacaacagcgaacagggcggccgugcguaccggcaugccauggaggaguuaccagacaccauagagacgcucaugcugcucgcccugaucgccggcgugaccgggggagucacccuggucuuccucagcgggcgcggccugggcaaaaccuccaucgggcuucucugcgugauggccuccucugucuuauuauggauggcguccguggagccccacuggaucgccgccucgauuauauuggaguucuuucugauggugcugcuuauccccgaaccggaccggcagcgcacgccccaggacaaucagcuugcguacgucgugauaggccuucucuucaugauccugacgguggccgcgaacgagaugggacuacucgagaccaccaagaaggaccugggcauagggcacgucgccgucgagaaccaccaccacgccgccaugcuggacguggaucuccacccagccuccgcguggacuuuauacgccgucgccaccaccaucaucaccccgaugaugcgccacacgaucgagaacaccaccgccaacaucagccugaccgcgaucgcgaaccaggccgccauccugaugggucuggccaagggcuggcccauuuccaaaauggacaucggggugccccugcucgcgcugggcuguuacagccaggugaacccccugacccucacggcccccguccugaugcugguugcccacuacgccaucaucggacccggccuccaggccaaggcgacgcgcgaggcccagaagcguacagccgcaggaauaaugaagaaccccaccguggauggcauuguagccaucgaccuugaccccgugguguacgacgcgaaguucgagaagcaacugggccagaucaugcucuuaauacugugcacuucccagauccucuugaugcggaccaccugggcccugugugagucgaucacccucgccacggggccgcugaccacguuaugggaggggucccccggcaaauucuggaacaccaccaucgcggucagcauggccaacaucuucaggggcuccuaucucgcgggagcagggcuagccuucagccuaaugaaguccuuaggcgggggccggcgcgggacgggcgcccagggcgagacuuuaggugagaaauggaagcggcagcugaaccaguuaagcaaaagcgaguucaacaccuacaagagauccggaaucauggagguggaccggucugaggcgaaggaggggcugaagcgcggcgaaacgaccaagcacgccgugucccgagggacugccaagcugcgaugguucgucgagcggaaccucgugaagcccgaggggaaggugaucgaccugggcugcggacgcggggguuggagcuauuacugcgcgggccugaaaaaggucaccgaaguaaaaggauacacuaagggcggccccggacacgaggaaccgaucccgauggcaaccuacggauggaaccugguuaagcugcacucggggaaggacgucuucuucauaccacccgagaagugcgacacccuucuaugcgacauuggcgaaagcucaccgaaccccaccaucgaggaggggcggacccuccgcgugcucaaaaugguggaacccuggcugcggggcaaucaguucuguaucaagauucugaaccccuacaugccgucugucguggagaccuuggaacagaugcagcgcaagcacggugggaugcugguucggaacccgcucucccgcaauagcacccacgagauguauugggucagcugcggaaccgggaacaucgugagcgcggugaacaugaccucccguauguuacucaacagguuuacgauggcccaucgcaagcccacguacgaacgggacgucgaccucggagccggcccccgccacguggccguggagccggaggucgccaaccuggauaucauagggcagcgcauugagaacaucaagcacgagcacaagagcaccuggcacuacgaugaggacaacccauacaaaacaugggccuaucacggcucauacgagguuaagcccaguggcuccgccagcagcauggucaauggcgucguaaagcugcucacgaagcccugggaugucaucccgauggugacccaaaucgccaugaccgacaccacgccauucgggcaacagagaguuuuuaaagaaaaggucgacacccguacgcccaaggccaaacguggcaccgcgcagaucauggaggugacggcgaaguggcuauggggcuuccugucccggaacaagaagccgcgcaucugcacccgggaggaguucacccguaaggugagaagcaacgccgccauuggggcuguuuucguggaugagaaccaguggaacuccgcgaaggaagccguugaggacgagcgcuucugggaccucggccaccgggagcgcgaacuccacaaacaggggaagugcgcaaccugcgucagcaacaugaugggcaagcgggagaagaaacuuggggaguucggcaagcccaaggguucgcgcccuaucugguacaugugguuaggagcacgguuccucgaguucgaggcccugggauucaugaacgaggaccacugguucagccgggagaacucccuuagcgggguagagggcgaggggcugcacaagcugggcuacauucuucgagacaucuccaagauccccgggggcaacauguaugcggacgacacggccggcugggacacccgcaucacugaggacgaucugcagaacgaggccagaauuaccgacaucauggagccggagcaugcauuacucgccaagagcaucuucaagcugacguaucagaacaagguuguccgggugcagcggcccgccaagaaugggacugugauggauguaauaucaagccgggaccagcgcggcuccggucagguggggaccuacggccucaauacguucacgaacauggaggcccagcucaucaggcagauggagagcgaagggauauucagucccuccgagcuggaaaccccuaaccuggccgagcgcguucuugacugguuagagaaguauggcgucgagcgguugaaacgcauggcaaucuccggggacgacugcguggugaagccgaucgaugaucgguucgcaaccgcgcuuaccgcucugaacgacaugggcaagguccgaaaggacauuccacagugggagcccagcaaggguuggaacgacuggcagcaggucccguucugcagccaccacuuccaucagcugaucaugaaggaugggcgugaaauaguggugccgugccgcaaccaggacgagcuugugggcagagcacgggugucccaaggcgccggcuggagccuccgggagacggccugccuggggaaguccuaugcgcaaauguggcaacucauguacuuccaccgccgggaccugcgccuagcggccaacgcgaucugcagcgcgguccccguggacuggaucccaaccuccagaaccaccuggagcauacacgcccaucaccaguggaugacgaccgaggacaugcucucuguguggaaccgcgucuggauagaggagaaccccuggauggaggacaaaacccacaucagcuccuggggcgacguaccguaccugggcaagcgugaggaccaguggugcgggucucugaucggucuuaccgcccgggccacgugggccaccaauauccagguggccaucaaccaggucagacggcugaucgggaacgaaaacuaccuggacuacaugaccuccaugaagcgcuucaagaacgagagcgacccugagggcgcacucugguga

SEQ ID NO: 24160 - RNA, 9879 nt, Artificial Sequence
  derived and/or modified CDS sequence (opt11) from DENV-1__FJ432729__SS-prME
ucagugacgaugcugcucaugcuuaugcccaccgcccuggcuuuccaccucaccacccggggcggcgaaccacacaugaucgugacuaaacaggagcggggcaaaagccuguuauucaaaaccagcgccggggugaacaugugcacgcucaucgccauggaccugggcgaacugugcgaggacacuaugaccuacaaaugcccccggaucacugaggccgagcccgacgacguggacugcugguguaacgccacggauacuugggucaccuaugggaccugcagccagacgggcgaacaucgacgcgacaagcggucaguugcccucgcaccccacgugggccugggccuugaaacgaggacggagaccuggauguccagcgaaggcgccuggaaacagauccagcggguagaaacgugggcccuccgccaucccggguuuaccguuaucgcccuguuccuugcgcaugugauaggcaccuccaucacucagaaggggaucaucuucauccucuuaauguuggucacgcccagcauggccaugcguuguguggggaucggcucccgcgacuucguggaggggcucagcggugccacuugggucgacguuguuuuagagcacggguccugcguuacuaccauggccaaggacaagcccacguuagacauagagcuccugaagaccgaggucaccaauccggccgugcugcggaaacuaugcaucgaggcgaagaucagcaauaccacgaccgacucccgcugccccacccagggcgaggccacgcuaauggaggagcaggacgccaauuucgucugccggaggacguucguggacaggggguggggcaacggcugcgggcuguucggcaaggggagcuuaauuacaugcgccaaguucaagugcgugacuaagcuggagggcaagaucguccaguaugagaaccugaaguacuccgugaucgugaccguccacacuggcgaccaacaccagguggggaacgaaucaaccgagcacggcaccaucgccacgauuacgccgcaggcgccuacguccgagauccagcucaccgacuacggggcccugacucuggacugcagcccccgcaccggccucgacuuuaaugagaugguccugcugacaaugaaagagaaauccuggcucgugcacaagcagugguuccuggaccucccgcuccccuggaccagcggggccagcacaucccaggagaccuggaaccggcaggaccuucucgugacguucaagacggcucaugccaagaagcaggaggucgugguguugggcucgcaggagggggcgaugcacaccgcucugacgggggccacggagauccaaacauccggcacaacgaccaucuuugccgggcauuuaaagugucgccucaagauggacaagcugacccugaagggcaugaguuacgucaugugcaccggguccuuuaaacucgagaaggagguggccgagacacagcacggcaccgugcugguccagauaaaguaugagggcaccgacgcgcccugcaaaauccccuucucuacccaagacgaaaagggugugacccaaaacggccggcucauaacagccaacccgaucgugaccgauaaggagaagcccgucaacaucgaggccgagccgcccuucggggaguccuacaucguaaucggcgccggcgagaaagcgcucaaacugaguugguucaagaaaggguccagcaucggcaaaauguucgaggccaccgccagaggggcuagacgcauggccauccugggugauaccgcgugggacuucggaucgaucggugggguuuucacuagcgucgggaagcuggugcaccagaucuucgguaccgccuacggaguccuguucaguggagugagcuggacaaugaagauagggaucggugugcuguugacuuggcucgggcugaacucccgcagcaccucccugagcaugacuugcauugccgucggucucgugacgcuguaccugggcgugaugguucaggccgauuccgggugcgucaucaacuggaagggccgggaguugaagugcgggagcggaaucuucgugaccaacgaggugcacacguggaccgagcaguacaaguuccaagccgacagccccaagcgccuaucugcggccauaggaaaggcaugggaggagggggucugcgggauucggagcgccacccgccuagagaacaucauguggaagcagauuuccaaugagcucaaccauauccuuuuagagaacgacaugaaauucacugucguggucggugacguggugggaauccuggcucaggggaaaaagaugauucggccccaaccaauggagcacaaauacucguggaaaucauggggcaaggcgaagaucaucggcgcggacguccagaacaccacguucaucaucgacgggcccaacaccccggagugucccgacgaccagcgcgccuggaacauaugggagguggaagacuacggcuucgggauuuuuaccaccaacaucuggcugaagcuacgggacagccauacccaggugugcgaccauagacucaugucggccgcgauaaaggacucuaaggccguccacgcagacaugggcuacuggauugagagugaaaagaacgagacauggaagcuggcgcgggccagcuuuaucgaagugaaaaccuguaucuggccaaagucccauacccuguggagcaacggcgugcucgagagugagaugaucauccccaagauuuacgggggcccgaucagccagcauaacuaccgucccgguuacuucacgcagaccgcgggacccuggcaccuggggaagcuggagcucgacuucgaccuuugcgagggcaccaccgugguuguggaugagcacugcggaaaccgggggccgagccugcggacaacgacggucaccggcaaaaucauacacgaguggugcugccggagcugcacgcugccgccccuucgcuucaagggggaggacggcugcugguacgggauggagauccgacccgugaaggagaaggaggagaacuuaguuaaguccauggucuccgcgggcagcggggaaguggacuccuucagccucgggcugcugugcauuuccaucaugaucgaggaggugaugcgcucccggugguccaggaagaugcucaugaccggcacgcuggcggucuucuuacuguugaucaugggacagcucacauggaacgaccugauccggcuguguaucauggugggggccaacgccagugaccgcauggggauggggacgacguaccuggcguuaauggccaccuucaagaugcgccccauguucgccgugggacugcuuuuucggagacuuaccucgcgggaggugcuacugcuaaccaucgggcugucgcugguggccagcgucgaacuacccaacucacuggaggagcuuggugacggacucgccaugggcaucaugauccucaagcugcucaccgauuuccagucucaucaguugugggcgacucugcucagccugaccuucaucaagacgacauugucccuccacuacgccuggaagaccauggccauggugcuguccaucguuucccuguucccccucugccugagcaccaccagucaaaagaccacguggcugcccguccuacugggcagccugggguguaagccgcucgccaugcuguugaucgcggagaacaaaaucuggggccgcaaguccuggccccucaacgaggguaucauggccguuggcguagucucuauucuguugagcucccuacugaagaacgacgugccacuggccgggccccucaucgccggcgggaugcugaucgccugcuacgugaucagcggguccagcgcggaucugagucucgagaaggccgccgaggucagcugggaggaggaggccgagcauuccggcgcaagccacaacauccugguagaggugcaggacgacgggaccaugaagauaaaggacgaggagcgggacgacacccugaccauuuugcugaaggcgaccuuacucgccgucucaggcguguauccgcugagcauccccgcuacgcuguucgugugguauuucuggcagaaaaagaagcagcgcuccggaguccuaugggacacuccuagcccgccggagguggagcgggccgugcucgaugaugguauuuaccgcaucaugcagcggggucugcuggggcgcucccaagucggaguaggaguguuccaggagaacgucuuccacacuauguggcacguuacccgaggcgcaguguugauguaucaggggaagcggcuggaacccaguugggccuccgucaagaaggaucugaucucuuauggaggaggguggcggcuccaaggcuccuggaacaccggggaggagguccaggugaucgccgucgagccuggcaagaaccccaagaacguucagaccgcccccgggacguuuaagacccccgagggcgagguuggcgccaucgcccuggacuuuaagcccgggaccagcggcucacccauugucaaucgcgaggguaagauagugggccuguacggcaacgggguggugacgacgagcgguaccuacguguccgcgaucgcccaggccaaggcaucccaggagggcccgcuccccgagaucgaggacgagguuuuucggaagcgcaaccuuaccauuauggaucugcaccccgggagcggaaagacccggcgcuaccuccccgcgauaguccgggaagccaucaagcggaagcugcggacgcugauccucgcccccacccgcgugguggccucggagauggcagaggcuuuaaagggcaugccuauccgcuaccagaccaccgccgucaagagcgagcacacgggcaaggagaucguggaccuaaugugccacgcgaccuuuaccaugcggcucuugucgcccgugcgcgucccgaacuacaacaugaucaucauggacgaggcccacuucaccgaccccagcuccaucgccgcgcggggguacaucuccacacgcgugggcaugggggaagccgccgccaucuucaugaccgccacgccacccggcuccguggaggcguucccgcaaagcaacgcuguaauccaggacgaggaacgggacauacccgagagguccuggaauagcggguacgaauggaucaccgacuuccccggcaagacggugugguuugugcccuccaucaagagcggcaacgauaucgcgaacugccuaaggaagaauggcaagcgcgucauccagcucagucggaagacauucgacaccgaguaucagaagaccaaaaacaacgauugggacuauguggugacgaccgacaucagcgaaaugggcgccaacuuccgagcggaucgggucaucgauccgcgccggugccugaaaccggucauacugaaggacgggcccgaacgcgucauccucgcgggccccaugccggucaccguggccuccgccgcccagcggcgcgggagaauaggccgcaaccacaacaaggagggcgaccaauacaucuacauggggcagccguugaauaacgaugaggaccacgcgcacuggaccgaagccaagaugcuucucgacaacauaaacacacccgaggggaucauccccgcccuguuugagccugagcgggagaaguccgccgccaucgacggggaguaccgccuacgcggcgaggcacggaagaccuucguagaguuaaugcgccgaggggaccugcccguguggcuguccuauaaaguggcuagcgagggcuuccaauauagcgaucgccggugguguuuugauggcgagcgcaacaaccagguccuggaggagaauauggacguagagaucuggaccaaggagggugagcgcaagaagcugcgcccccgcuggcucgacgcccgcacuuacagcgacccccucgcccuccgugaguucaaggaguucgccgcgggacgccggagcguguccggggaccugauccuggagaucggcaagcucccgcagcaccucacucagcgcgcccagaacgcccuagacaaccuggucauguuacauaacagcgagcaaggcgggcgcgcauaccgccacgcgauggaggagcuccccgacaccaucgagacgcugaugcugcucgcucucaucgccgugcugacuggcggggugacacucuucuuccugagcggccguggucugggcaagaccagcaucggccuccucugugucauggccagcagcgugcuguuguggauggccucgguggagccccacuggauagcggccagcauuauccuagaguucuuccugaugguccuccugauacccgagccggaccgccagcguacaccccaggacaaccagcuggccuacguggugaucgggcuccuguucaugauacuaaccgucgccgcuaacgagaugggccuccuggaaacuaccaagaaggaccuggggaucgggcacguggcgguagagaaccaccaucacgccacgaugcucgauguugaccuacaccccgccuccgcguggacccuguacgcaguugcgacaacgauuaucaccccgaugaugcgccauacuaucgaaaacacuacggccaacaucagcuuaacugcgauagccaaccaggccgcuauccuaaugggcuuggacaagggcuggcccauuucuaagauggauaucggcgugccccuccuggcccuggggugcuacucgcaaguaaacccccuuacccucacggccgcggugcugaugcugguggcgcacuacgcaaucaucgggccgggguugcaagccaaggccacgcgggaagcccagaagcgcaccgcagcaggcaucaugaagaaccccacugucgacgggaucgucgccaucgaccuggaccccguggucuacgacgccaaguuugagaagcagcucgggcagauuaugcugcugaucuugugcaccucccagauccugcuuaugcgaacgaccugggcacuaugcgagagcauuacccuggcgaccggcccccugacgacccucugggagggguccccgggcaaauucuggaacacuaccaucgccgugagcauggcaaacaucuuccgugggagcuaucuggcuggcgcuggcuuagccuucagccucaugaagucucucgggggcgggcgcagaggcaccggggcccagggggagacccugggcgagaaguggaagcgccagcucaaccagcugucaaagagcgaguuuaauauauacaagcgguccgggaucauggagguggacaggagcgaagccaaagagggccugaagagaggggaaacuacgcgccacgccgucucccgcgggacugcgaagcuccgcugguucguggagcguaaccucgugaagcccgaggggaaggugaucgaccuugggugcggccgcgggggcuggagcuacuacugugccgggcugaagaaaguuaccgaggucaagggauacacgaagggcgggccaggccacgaggagcccaucccgauggccacguaugguuggaaccucgucaagcugcacuccgggaaggacguuuucuucacuccgcccgagaagugugacacccugcucugcgacaucggggaaagcucucccaaucccacaauugaggagggccggacccugagaguucugaagauggucgagcccuggcuccgggggaaccaauucugcauuaagauccugaacccguauaugcccucagugguggagacuuuagagcagaugcaacgcaaacacggcggcaugcucguccggaacccgcugagucgcaauagcacccacgagauguauugggugucaugcgguacaggcaacaucgucagcgcugucaacaugacuucccggaugcuucucaaccgcuucaccauggcccaccgcaagccgacguaugaacgagauguggaccugggggcgggcacucgccacguggccgucgagcccgagguggccaacuuagacauuaucggccaacggauugagaacaucaagcacgagcacaaaucuacuuggcacuacgacgaggacaaccccuacaagaccugggccuaccacggguccuacgaggucaaaccgucagguucugccagcagcaugguaaacgggguggucaagcucuuaacuaagccaugggaugugauccccauggugacccagauagcaaugaccgacaccacgccuuucggccagcaacgggucuucaaggagaaaguggacacccggacaccaaaggcgaagcgagggaccgcccaaauaauggaggugacggcccgguggcuguggggguuccucucccggaacaagaagccccggaucugcacgcgugaagaguuuacccgaaagguccgcagcaacgccgcgauaggcgccguguucguggacgagaaccaguggaacuccgccaaggaggccgucgaggacgagcgguucugggaucuggugcagaaggagcgcgaguuacacaagcaggggaagugcgcgacaugcguguauaacaugaugggcaagcgggagaagaagcucggggaguucgguaaggccaaggggagccgcgccauaugguacauguggcugggcgcgagguuccuggaguucgaggcccucggcuucaugaacgaggaccauugguucucccgcgagaacagccugagcggggucgagggcgaggggcuacacaagcucggcuauauccuacgggauaucagcaagaucccagggggcaacauguacgcggacgacaccgccggcugggacacccgcauaaccgaggacgacuugcagaaugaggcgagaaucacagacauaauggagccggagcacgcacuucuggcaacgucgaucuucaaacugacuuaccaaaauaaaguggugcgcguccagcgccccgcgaagaacgggaccgugauggacgugauuucccggagggaccagcggggcucuggucaggucggcaccuauggccuaaauacguucaccaacauggaagcccagcugauccgccagauggagagcgagggaaucuuccugcccucugaacucgagacccagaaccucgcggaacgggugcuggacuggcucgagaaguauggcguggaacgccugaagcggauggccaucagcggggaugacugcgugguaaaaccaaucgacgaccgcuucgccacugcuuuaaccgcccucaaugacauggguaaggugcgaaaggacaucccgcagugggagcccuccaagggcuggaacgauuggcagcaaguccccuucugcagccaccacuuucaccaacugaucaugaaggacggacgcgagauuguggugccaugccggaaucaggacgagcuggucggcagggcccgagugagucagggcgccgguuggucccuccgggaaacagcuugccugggaaagagcuacgcgcagauguggcagcugauguacuuccaccggcgcgaccuccgucuagccgcgaacgccaucugcuccgcagugccggucgacugggugcccacuagccgcacgacgugguccauucacgcgcaucaccaguggaugacgacagaggacaugcugucgguguggaaccgcgucuggaucgaggagaacccguggauggaggauaagacgcacgugagcagcuggggagacgugcccuaccuugggaaacgcgaagaccaguggugcggcucccugaucggccugacggcccgcgccaccugggcaagcaacauccaggucgcgauaaaccagguucggcgccuuauugguaacgagaacuaucuggacuacaugaccuccaugaagcgcuucaagaaugagggcgacccggaaggagccuugugguga

SEQ ID NO: 24161 - RNA, 9879 nt, Artificial Sequence
  derived and/or modified CDS sequence (opt11) from DENV-1__FJ432730__SS-prME
agcgugaccaugcugcucaugcuaaugcccacggcacuggccuuccaccucaccacccgggggggggagccccacaugauugugucaaagcaggagcgggggaaaagccugcuguucaagaccagcgccggagugaacaugugcaccuuaaucgccauggaccugggcgaguucugcgaagacacgaugaccuauaaaugcccccgcaucacagaggccgagcccgacgacgucgacugcugguguaaugccaccgacacgugggugaccuacggcaccugcagccagacgggcgaacaccggcgagacaagcgguccguugcccucgcgccccacgugggcuugggacuagagacacgcaccgagacguggaugagcuccgagggcgcauggaagcagauacagcgaguggagacuugggcccugaggcaccccggguucacugugaucgcccucuuccuggcgcacgcuaucggcaccucuaucacccagaaaggcauuaucuucauccugcugaugcucgugacacccuccauggcgaugcggugcguagguaucggcagccgugacuucguggaagggcuguccggggccacguggguggacgucgugcuagagcaugggagcugcgucacgaccauggccaaggacaaaccaacccuugacauagagcuguugaaaaccgaggucacaaaccccgcggugcugcggaagcugugcaucgaggccaagaucuccaacaccaccacggacagccgcugcccaacccaaggagaggccacacucgucgaggaacaggacgccaacuucgucugccggcgcaccuuuguggaccgaggcugggggaacggcugcgggcuguucggcaaggggucucugaucacgugcgccaaguucaagugugugaccaagcuggagggcaagacgguucaguacgagaaccuuaaauacagcgugaucgugaccguccacacaggcgaucagcaccagguggggaacgaguccaccgagcacgguaccaccgcgacaaucacgccccaggcucccucgacggagauccagcugaccgacuacggggcccucacccuggauugcagcccccggacgggucuggauuucaacgagaugguccuccugaccaugaaggagaaguccuggcugguccacaagcagugguuucucgaccugccgcugccauggaccuccggcgccagcacuagccaagagacguggaacagaaaggaccuccuggucaccuuuaagaccgcccaugcgaagaagcaggaggucguaguccugggcucgcaggagggcgccaugcacaccgcccuaacgggggcuaccgagauccagaccagcggcaugaccacgaucuucgccgggcaccugaagugccgccugaagauggacaagcucacccugaaggguaugaguuacgucauguguaccgggaguuuuaagcuggagaaggagguggcggaaacccaacacggcacagugcucguccagauaaaguacgagggcaccgacgcccccugcaagauccccuuuuccacccaggacgagaagggggugacccagaacgggcggcuaauuacugcgaacccgaucgugacggauaaggagaagcccgucaacaucgaggccgagcccccguucggcgagagcuacaucgugaucggggcaggcgaaaaggcccugaagcucuccugguucaagaaggguagcuccaucgggaagauguucgaggccaccgcccgcggugccagaaggauggcgauccucggcgacaccgccugggacuuugggagcaucggcggcguuuuuaccagcgucgguaagcuggugcaccagauuuucggcaccgccuaugggguuuuguucaguggcgucuccuggacaaugaagaucggcaucggcgugcuccugaccugguuaggacuaaacagccgcuccacgagccuguccaugacgugcaucgccgugggccuggucacgcucuaccugggcgugauggugcaagccgauaguggaugcgucaucaacuggaagggccgggagcugaagugcgggaguggcaucuucgucaccaacgaggugcacacguggaccgagcaguacaaguuccaggcagacuccccgaagcgccucagcgccgccaucggcaaggccugggaggagggggucugcggcauacgguccgccacccgacuggagaauaucauguggaaacagauaagcaacgagcugaaccacauccuucuugagaacgacaugaaguucacuguggugguaggggacguagcgggaauacuggcccagggcaagaagaugaucaggccccagcccauggaguacaaguacuccuggaaguccuggggcaaggccaagaucaucggcgccgacguucagaacaccacauucaucaucgacgggcccaacaccccggaaugccccgacgaccaacgcgcguggaacaucugggaggucgaggauuacggcuucggaauuuucaccaccaauaucuggcugaagcugcgggacuccuacacacaggugugcgaccaccgccugaugagcgccgcaaucaaggacucaaaggccguucaugccgacaugggcuauuggaucgaaagcgagaagaacgagacguggaagcuagcacgugcgucauucauugagguaaaaaccugcaucuggcccaagagccacacccuaugguccaacggcgugcuggagagcgagaugaucauacccaagauauacgggggcccgaucucccagcauaacuaucgacccggguacuucacucagacggccggucccuggcaccucggcaagcuggagcuggauuucgaccucugcgagggcaccaccguggugguggacgagcacugcgggaaucggggaccgucacugagaacaacuaccgugaccgggaagaucauccacgaguggugcugucgauccugcacgcucccuccccugcgcuucaagggggaggacggcugcugguacgggauggagauccggcccgucaaggagaaggaggagaaccugguuaagagcaugguuucugccggcuccggcgaggucgauagcuucucgcuggggcuccugugcauaucuaucaugaucgaggaggugaugcgcucccgguggagccgcaagaugcugaugaccggcacucucgccguguucuuccuccugaucauggggcagcucaccuggaacgaccugauccgguuaugcaucauggucggcgcgaacgccuccgaucgcauggggauggggacgaccuaccucgcccugauggccaccuucaaaaugcggccgauguucgccgugggccuccuguuccggcgccugaccagccgggaggugcugcuccugacgaucggguuaucccucgucgcguccguggaacugcccaacucucuggaagaacucggcgacgggcucgccaugggcauaaugauccugaagcucuuaaccgacuuccagagccaccagcucugggccacccugcugucccucaccuucaucaagacgaccuucagccuccacuacgccuggaaaaccauggcgauggucuugucaaucguuagccuguuuccacugugccuguccaccacaagccagaaaaccaccuggcugcccgugcuccucggcucccuggggugcaagccgcucaccauguuucugaucgccgagaacaagauauggggccgcaagagcuggccccuuaacgaggggaucauggccguuggcaucgugagcauacugcuguccucucugcucaagaacgacguuccccuagcagggccccugauugccggcggcaugcucauugcgugcuacgucauaucagggucauccgccgaccugagccuggagaaagccgcagaagugucaugggaggaggaggccgaacacagcggcgcgucccacaacauccugguggagguccaggacgacgggacgaugaagauuaaggacgaggagcgggaugacacacugaccauucugcucaaggccacccugcuggcggugagcggcgucuacccgcucagcauccccgccacccuguucgucugguacuucuggcagaagaagaagcagcgcagcggggugcugugggacacgccaagcccgcccgagguagaacgagccguccuggacgacggcauuuacaggauuaugcagcggggccugcugggccggucacaggugggugugggggucuuucaggaaaacguuuuccacaccauguggcacgugacgagaggggccguccuaauguaccaggggaagcgccucgagcccuccugggccagcguuaagaaggacuuaaucuccuacggcggaggguggcggcugcagggcagcuggaacaccggggaggaagugcagguaauugcgguugagcccgguaagaaccccaaaaacgugcagacggcccccgggaccuucaagaccucugagggcgaggucggcgccaucgcacucgacuuuaagcccggcacaucgggcagccccaucgugaaccgcgaggggaagaucgugggccuguacggcaacggggucgucacaaccuccggaacauacgugucugccauugcccaagcgaaggcgucccaagaggggccccugccugagaucgaggacgaggucuuccguaagcgcaaccucaccaucauggaccugcaccccggcagcggcaagacgcggcgcuaucucccagccauaguucgagaggccaucaagcguaagcuccggacccugauccuggcuccgacccgcguugucgccuccgagauggcugaggcccucaagggcaugcccauucguuaccagacaacggccgugaagagcgagcacacuggcaaggaaaucguggaucugaugugccaugccacauucaccaugaggcugcugucccccguacgcguacccaacuauaacaugaucaucauggacgaggcacacuucacggacccgagcuccaucgcggcacggggguacauaagcacccgcgucggcaugggggaggccgccgccauauuuaugacggcgacgccgccuggauccgucgaggccuucccccaaagcaacgccguuauccaggacgaggagcgggauaucccggaacgcagcuggaauagcggguacgaauggaucacggauuuccccggcaagaccgugugguuuguccccuccaucaagagcggcaacgacauugccaacugucucagaaagaaugggaaacgcguuauccaacugucucggaaaacuuucgacaccgaguaccaaaaaacgaaaaauaacgacugggacuacguggucaccacagacaucagcgagaugggcgccaauuuucgugccgaucgggugaucgacccacgccggugccucaagccggugauccugaaggacgggcccgaacgcgucauccuagcgggccccaugcccgugaccgucgccagugccgcccagcggcgugggcggaucggccguaaccacaacaaggagggcgaccaguacaucuacauggggcagccgcucaauaaugaugaagaccacgcucacuggacggaggccaaaaugcugcuugauaacauuaacacccccgagggcaucauacccgcgcucuuugaaccggagcgggaaaaguccgcugcgaucgacggggaguacaggcugaggggcgaggcccggaagaccuucguggaguugaugcgccgcggggaccugcccguauggcugucguacaagguagccuccgagggcuuccaguacagcgaccggcgguggugcuucgacggcgagcggaacaaccagguccuggaggaaaacauggacguugagaucuggaccaaagaaggggagcggaaaaagcuacgcccgcgguggcucgacgcucgcacguacuccgacccccuggcccuccgggaguucaaggaguucgcggccggccgccggagcguguccggggauuugauccuggagaucggcaagcucccgcagcaccugacccaacgcgcgcagaacgcccuggacaaccucgugaugcugcacaacuccgagcagggggggcgggcguaccgccacgccauggaggaacugccggacaccaucgagacccuaaugcugcuggccuugauagccgugcugacaggcggggucacacuguucuucuuguccggccgggggcugggcaaaaccagcaucggccugcucugcguaauggccucgagcguucugcuguggauggcauccgucgagccccacuggaucgccgccagcaucauucucgaauucuuccugauggugcuacucauacccgagcccgaccgccagcggacuccgcaggacaaucagcuggccuauguggucauagggcuccucuucaugauccugaccguugccgcgaacgagaugggccugcucgagacaaccaagaaggaccuggguaucggccacguggccgucgagaaucaucaccacgccgccaugcuggacguggaccugcaccccgccuccgcauggacccuauaugccguagccacuacgaucaucacccccaugaugcgccacaccauagaaaacaccacggccaacaucagccugacagcaauugcgaaccaggccgccauccucauggggcuggauaagggcuggccgaucuccaagauggacaucggcgucccccugcucgcacucgggugcuacagccaggugaacccccucacccucaccgccgccgugcugaugcuggucgcccacuacgccaucaucggcccugggcuccaggcuaaggccacgcgggaggcccagaagcgcaccgcugcaggcaucaugaagaacccgacgguugacgguaucguggccauugaccucgaccccguuguguaugacgcgaaguucgagaagcaguuaggccagaucaugcuccugaucuuaugcaccucccagauccuccugaugcgcacgaccugggcccugugcgaaagcaucacccuggccacggggccccugacgacacugugggaagggucccccgggaaguuuuggaacaccaccaucgccguguccauggccaacaucuuccgggggagcuaccucgcgggcgcuggccuggccuucucccugaugaagucgcucgggggugggcgccguggcacgggggcccagggcgagacccuaggcgagaaauggaagcgccagcugaaccaacucuccaaguccgaauucaacaccuauaagcgguccgguaucauggaggucgaucgcagcgaggcgaaggagggcuuaaagcgcggggagaccacgaagcaugccgugucacgcggcaccgcuaagcuucggugguucguggagcgcaaucucguaaaaccugaagggaaagugauagaccugggcugcggcagagggggguggagcuacuauugcgccgggcugaagaaggugaccgaggucaagggguauaccaaggguggacccggccacgaggagccaaucccaauggccaccuaugguuggaaccuggugaagcuccacuccggcaaggacgucuuuuucauaccgcccgagaagugcgacacccuacugugcgacaucggggagagcucccccaaccccaccaucgaggagggccgcaccuuacggguccugaagaugguggagccgugguugcgcgggaaccaguuuuguaucaaaauacucaaccccuacaugccgaguguggucgagacgcuggagcagaugcagcggaagcacggcggcaugcuggugcgcaacccccucucccggaacucuacacacgagauguacuggguauccugugggaccgggaacaucgucagcgcggugaacaugacuucgcgcaugcuuuuaaacagguuuaccauggcccaucgcaagcccacguacgagagagacguggaccucggggccgggaccagacaugucgccguggagcccgagguggccaaccuggacaucaucggccagaggauagagaacaucaagcacgagcacaagagcacauggcacuaugacgaggacaaucccuacaagacuugggcguaccacggcuccuaugaggucaagccuagcggcagcgccucuucgauggugaacggggucgugaagcugcucacgaagccgugggacgugaucccuauggucacccagauagccaugaccgacaccacaccuuucgggcagcaacgcguguuuaaagagaagguagauacccggacccccaaggccaaacggggcaccgcccagaucauggaggucacggcgaaguggcugugggguuuucugucccgcaacaagaagccgcgcaucuguacccgcgaggaauucacccggaaggugcgcagcaacgcugccaucggcgcaguguucgucgacgagaaccaguggaacuccgcgaaggaggccguggaggaugagcgguuuugggaccucgugcaucgcgagcgggagcuccauaagcaggggaaaugugcgacuugcgucuacaacaugaugggaaagcgggaaaagaagcugggggaguucggcaaggccaaggggucucgggcgaucugguacauguggcucggcgcgcgcuuccuggaguucgaggcccucggcuucaugaacgaggaccacugguucucccgggagaacagccucuccgggguggagggcgaagggcugcauaagcugggcuacauacucagagacaucagcaagauucccgggggcaacauguacgccgacgacacagccggcugggauacccggaucaccgaagaugaccugcagaacgaggccaagaucaccgacaucauggaaccggaacacgcgcugcucgccaagucgaucuucaagcugacguaccagaacaagguggugcgcguccagcggccggccaagaacgggaccgugauggacgucaucagccgccgcgaccagcggggcagcggucaggugggcacauauggccucaauacguucacgaacauggaagcucagcucauacgccagauggagucggaggggaucuucuccccgagcgagcuggagacccccaaccuggccaggcgcgugcucgacuggcuggagaagcacggcgucgagcggcugaagcgcauggcgauauccggggacgacugcgugguuaagcccaucgacgaccgguucgccaccgcccucaccgcccugaacgacaugggaaagguccgcaaggacauuccgcagugggagcccagcaaaggguggaacgacuggcagcaaguccccuuuugcagccaccacuuucaccagcugauuaugaaggacggccgcgagaucgugguccccugccgcaaccaggacgaacucgugggccgggcgcgcgugucccagggggcaggcuggagccugcgggaaacagccugccuggggaagucguacgcccagauguggcagcucauguacuuucaccgccgggaccugcgccuggccgcgaacgccauuuguagcgccgucccgguggacuggguucccaccucccggaccaccuggagcauacacgcccaccaccaguggaugacgaccgaagacaugcucucugucuggaaccgcguguggauagaggagaaccccuggauggaggauaagacccauaucagcuccuggggugaugugcccuaccuugggaagcgggaggaccaguggugcggcagccugaucggccucaccgcccgcgcgacgugggcaaccaacauccaagucgccaucaaccaggugcgccggcugaucgggaacgagaacuaccuggauuacaugaccuccaugaagcgcuucaagaacgaguccgacccggagggggcccucugguga

SEQ ID NO: 24162 - RNA, 9879 nt, Artificial Sequence
  derived and/or modified CDS sequence (opt11) from DENV-1__FJ432732__SS-prME
ucagucacuaugcugcucaugcuaaugcccaccgcccuggccuuccaccucacgacucggggcggggagccucacaugauugucucgaagcaggaacgaggcaagagccuacuuuucaagaccucggccggggugaacaugugcacccugaucgccauggaccugggcgagcugugcgaggacaccaugacuuacaagugucccagaaucaccgaaaccgagcccgacgacguggauuguuggugcaacgccaccgacacaugggugaccuauggaaccugcagucaaacgggcgagcaccggagagauaagcgguccgucgcccucgcgccucaugugggcuuagggcuggagacccguaccgagacguggaugagcuccgaaggcgcguggaagcagauccagcggguugagacuugggccuuacgacaccccggguuuaccgugaucgccuuauuccuggcccaugugaucggcaccagcauuacccaaaaggggauuaucuucauccuccugaugcuggucacgccguccauggcgaugcggugcgugggcaucggcagccgcgacuuuguggaggggcucuccggcgccaccugggucgacguggugcuggaacacgggagcugcgucaccacgauggccaaagauaagcccacgcuggacaucgaacuccugaagaccgaggugaccaaccccgccguacugcggaaguuaugcauugaagccaagaucaguaacaccaccaccgacagccgcugcccgacccagggugaggcgacuuuggucgaggagcaggacgccaacuucgugugccgucgcacauucguggaccggggcugggggaauggcugcggguuauucggcaaggggucccuuaucacgugcgccaaauuuaagugcgucacaaagcuugagggcaagaucguacaguacgagaaccugaaguacagcgugaucgucacugugcacacgggcgaccagcaccaaguuggaaacgaguccaccgagcacgguacgacagccacuaucacgccgcaggccccuaccaccgagauucagcucaccgauuacggggcgcugacgcuggacugcagcccucgcaccggauuagacuuuaaugaaauggugcuacugacaaugaaggagaagaguuggcucgugcacaagcagugguucuuagaccugccgcucccguggacaagcggagccagcacaucccaggaaaccuggaacagacaagaucugcuggugaccuucaagaccgcccacgccaagaagcaggagguagugguccucggcagccaggagggcgccaugcacacggcgcucacgggggccaccgagauccagaccuccggcacuaccaccaucuucgcuggccaccugaaaugccgccucaagauggacaagcugacccugaaaggcaugagcuacgugaugugcacgggguccuucaagcucgagaaagagguggccgagacccaacacggaacuguccuggugcagauuaaguacgagggcaccgacgccccguguaagauccccuucagcacgcaggaugagaagggggucacccagaacggccgguuaauaacugcgaacccaaucgucacagacaaggagaaaccggucaauaucgaggccgaaccgcccuucggggaauccuacaucacaaucggcgccggcgagaaggcccugaagcucagcugguucaagaaggggucuagcaucgggaagauguuugaggcgaccgcccgcggggcccggcgcauggccaucuuaggcgacacggccugggauuucggcucaaucggcggaguguucaccagcguaggaaaacuggugcaccagauuuucggcacagcguacgggguccuguuuagcggcgucagcuggaccaugaaaaucgggauaggcguccuccugaccuggcucggccugaacuccaggagcacuucccugucaaugacguguauagccgugggucucguuacccuuuaccugggagugauggugcaggccgacagugggugcguuaucaacuggaagggucgggaauuaaaaugcggaagcgguauauucgugaccaacgagguccacaccuggaccgagcaguacaaauuucaggccgacagccccaaacgccuguccgccgcgauuggcaaggcaugggaggaagggguuugcggaauacggagcgcuacgcgccuggaaaauaucauguggaaacagauauccaacgagcucaaccacauacugcuggagaacgauaugaaguucaccguggugguaggggacguggcaggcaucuuugcccagggaaaaaagaugauccgaccccaacccauggaguacaaauacagcuggaagagcuggggcaaggcuaagaucaucggagccgacgugcagaacacgaccuuuaucaucgacggccccaacacgcccgaaugccccgacgaccagcgagccuggaauauaugggaggucgaggacuacggcuucgggaucuucacgaccaacaucuggcucaagcugcgggauucuuacacccaggugugcgaccaccgccucauguccgccgcgauaaaggacagcaaggcgguucaugccgacaugggcuacuggauugaauccgagaaaaacgagacuuggaagcuagccagggccagcuucaucgaggucaaaaccuguaucuggcccaagucacacacacuuuggagcaacggcguucucgaauccgagaugaucauaccuaaaaucuacggggggccgaucagccagcacaacuaccgacccggauauuucacccaaacugcggggcccuggcaucucgggaagcuggagcuggauuucgaccuuugcgaagggaccaccguggucguugacgaacacugcggcaaccgggggccgucccugcgcaccacgaccguaacgggaaagaucauccacgaguggugcugccggaguugcacccugccgccccugcgcuuccgcggggaggacggcugcugguaugggauggagauacggcccgucaaggagaaggaggagaaucuggugaaguccaugguaagcgccggcagcggcgaggucgacuccuuuucgcuaggacuccugugcaucuccaucaugaucgaggaggucaugcggagccguuggagccggaagaugcugaugacuggcacacucgcaguguucuuccugcucaucauggggcaacucaccuggaaugaccugauccgccugugcauaauggucggagcgaacgccagcgaccguauggggaugggcacaacguaccucgcucugauggccaccuucaagaugcgacccauguucgcggugggccuccucuuucgccgguuaaccaguagagagguguugcuacugacaauagggcugagccuagucgccuccguggaguugcccaacagccuggaggagcucggcgacgggcuggcgaugggcaucaugauccugaagcuccucacagacuuccagucucaccagcugugggcgacccuccugucccugacuuuuaucaagacaacguucucguuacacuaugccuggaagaccauggcaauggugcuuagcaucguauccuuguuuccacucugccugagcaccaccucccagaagacgaccuggcuuccugugcuccuggguagccuggggugcaagccgcucaccauguuccugaucgccgagaacaagaucuggggccggcgcucuuggccacugaacgaggggauaauggcggucggcauagugagcaucuuacucagcagucugcucaaaaacgacgugccgcucgccgggccccugauagccggcggaauguugaucgccugcuacgucaucucuggguccucagccgaccugucccuggaaaaggcggccgaggugagcugggaggaggaagcagagcacuccggcgccucacacaacauccucgucgaaguucaagacgacgguaccaugaagaucaaggaugaggagcgggacgauaccuuaacgauacugcucaaggcgacccugcuggcgguguccggcgucuauccgcucuccauccccgccacccuuuucgucugguauuucuggcaaaagaagaaacaacgcuccggggugcugugggauacgccgagcccgcccgaaguggagcgcgccguccucgacgacggcaucuaccgcaucaugcagagagguuugcuggggcgcucucaggugggcgucggugucuuccaggagaaugucuuucacacgauguggcacgugacucggggcgccguccugauguaucaaggcaagcgccucgagcccagcugggccuccgucaagaaagaccugaucucauacggcggcggauggaggcugcagggguccuggaacacaggggaggaagugcaggucaucgcgguggagcccgguaagaaccccaagaacgugcagaccgcccccgggacauucaagaccccugaaggcgagguuggggccaucgcccucgauuucaagcccgguaccagcggcucccccauagugaaccgcgaggggaagauugugggccuguacgguaacggggucgugaccacgagcgguaccuacgugagcgccauugcgcaagccaaggccucccaggaggggccacugccagaaaucgaggacgagguuuuccggaagcggaaucucaccauuauggaccugcaucccggcagcgggaagacccggcgcuaucugccggccaucgugcgggaggcgauuaaacgcaagcuaagaacacuuauccuggcgccaacccgugucguggccucagagauggccgaggcccucaagggaaugcccauccgcuaccagacuaccgcggucaaaagcgagcacacgggcaaagagaucguggaccuuaugugccacgccaccuucaccaugcgacugcucagucccguccgcgugccuaacuauaauaugauuaucauggacgaagcccacuucaccgacccaagcuccauugccgcccggggguacaucucgacgcgcgugggcaugggggaggcggccgccaucuucaugacggccaccccacccggaucgguugaggcuuucccgcagagcaacgcggugauccaggacgaggagcgggauauccccgaacgcucguggaauagcggguacgaguggauaaccgacuucccaggcaagacggugugguucguccccuccaucaagagcgggaacgacauugcaaacugccugcggaagaauggaaagcgcgugauccagcugucccggaagaccuuugacaccgaguaccagaagacgaagaacaacgacugggauuauguggucacgaccgacaucuccgagaugggcgcaaacuuccgcgcagaccgggugaucgacccgcguagaugccucaaaccagucauccugaaggacgggccugagagggucauccuggcgggccccaugccugugaccguagccuccgccgcacagcggcgagggcggaucggccggaaccacaacaaggagggcgaccaauacauuuauaugggacaaccacucaacaacgacgaggaccacgcacacuggaccgaggcgaagaugcugcuggacaacaucaauacucccgagggcauuauccccgcccucuucgagccggaacgcgaaaagucggccgccaucgacggggaauaccggcugaggggcgaagcacggaagacguucguagagcugaugcgccgaggggacuugcccguuugguugucguacaagguggcaagcgagggauuccaguacagcgaccgucgauggugcuucgacggcgagcgcaacaaccaggugcuggaagagaacauggacguggaaaucuggaccaaggagggggagcggaagaagcuccgcccacgguggcucgacgcccgcaccuacucagauccuuuggcccuccgggaguuuaaggaauucgcugcuggccgcagaagugucuccggggaccugauccuagagaucggcaagcucccgcagcaucugacgcagcgcgcccagaacgcgcuagauaaccucgugaugcugcacaacagcgagcagggcgggcgggccuaccgccacgccauggaggagcugccagacaccaucgaaacccugaugcugcuggcgcugauagcagugcuuacaggcggggucacucuguucuuccucucuggccgcgggcuggggaagacguccaucggucugcucugugugauggccuccagcguccugcucuggauggccaguguggagccccacuggaucgccgcgagcaucauccuggaguucuuccucaugguucugcucauccccgagcccgaucgccagcggacuccccaggacaaccagcuggccuaugugguuaucggacugcuauucaugauccugacgguggcggccaacgagaugggccugcucgagacuacuaagaaggaccuggggaucggccacguagccgucgagaaccaccaccacgcggcuaugcuggauguggaccuucaccccgcauccgccuggacccuauacgccguggcgacaaccaucaucacgccgaugaugcgccacacgaucgaaaacaccacggcaaacaucagccugacggcaaucgccaaccaagccgcaauccuuauggggcuggacaagggcuggcccaucuccaagauggacauuggcgucccccugcuggcccuggggugcuacagccaagucaacccccugacccucaccgcggccguguuaaugcucguugcucacuacgccaucaucggcccagggcuccaagcaaaggccacccgcgaggcccaaaagcggacggcggcaggcaucaugaagaaccccacaguggacgggaucgucgccaucgauuuagaccccgucguguacgacgcgaaguuugagaaacagcugggccagauuaugcuccugauccugugcacgucucaaauccuucuaaugcgcacaacaugggcccugugcgagaguaucacacucgccacaggcccccugaccacccugugggaggguuccccgggcaaguuuuggaacaccaccaucgccgugagcauggccaacaucuucagggggucuuaccucgccggcgccggccuagcguucuccuuaaugaagaguuuggggggcgggcgcaggggcaccggggcgcagggagagacgcugggcgaaaaauggaagcggcagcugaaccagcucuccaaaagcgaguuuaacacguacaagcguagcgggaucauggaggucgaucgcagcgaagccaaggagggccugaagcgcggcgagaccacaaagcaugccguaucccgcggcacggcgaaacugcguugguucguggaacguaaucucgucaagcccgaggggaaggugaucgaccugggcugcggcaggggcggauggagcuacuacugugccgggcuaaagaaggugacugaggugaagggguacacaaaggguggcccgggccacgaagagcccaucccgauggcaaccuacggguggaaccuggugaagcuccacuccggcaaggacguguucuuuaucccucccgaaaaaugcgauacgcugcugugcgacauuggugagucuucccccaacccuacuauagaggagggccguacccuccggguccugaaaaugguggagcccuggcucaggggcaaccaguucugcauuaaaauccucaaccccuacaugccgagugugguggagacacuggagcagaugcagcggaagcacggcggcaugcugguucgcaauccucuaucucggaauuccacgcacgaaauguacuggguauccugugggacgggcaacaucgucagcgccgugaacaugacaucccgcauguugcugaaccguuucacaauggcccaccguaagcccaccuacgaacgcgacguggaccucggggcgggaacccggcacgucgccguggagcccgagguggccaaccuagauaucaucggccagcggauugaaaacaucaagcacgagcacaagucaacauggcacuacgacgaagacaaccccuacaagaccugggccuaccacggguccuacgagguaaagccauccggcucagccucuagcaugguuaacggggucgugaaacuucuuaccaaacccugggacguaauacccauggucacgcagaucgcgaugaccgauaccacccccuucggccagcagcggguguucaaggagaagguggacacacgaacucccaaggccaagagagggacagcccaaaucauggagguaaccgccaaguggcuguggggcuuucugucccgcaacaagaaaccccggaucugcacgcgcgaggaguuuacccggaaagugcgcuccaacgccgcgaucggugcgguguucguagacgagaaccaguggaacuccgcgaaggaggccguggaggaugagcgcuucugggacuuaguacaccgcgagcgggagcugcacaaacagggaaagugcgcuaccugcgucuauaacaugaugggcaagcgcgagaagaagcugggggaauucggcaaagcaaaggggagcagagccaucugguauauguggcucggggcccguuuccuggaguucgaggcgcugggauucaugaacgaggaccauugguucucccgugagaacagccucuccgggguggagggcgaaggccugcacaagcugggcuauauccuccgcgauauuagcaagauccccgggggcaauauguaugccgacgacaccgccggcugggauacgcgcaucaccgaggacgaccugcagaaugaggcccgaaucaccgacaucauggaaccggagcacgccuugcucgccaagaguauuuucaagcugaccuaccagaauaagguggucagaguacagcggcccgcgaagaacgggacggugauggaugucaucucacgccgggaucagagagggagcggucagguggguacuuacggccugaacaccuucaccaacauggaggcccagcugaucagacagauggagucggagggaauauucucccccucggaguuagagacaccaaaccuugccgagagagugcuagacuggcuggagaaguacggcgucgagcgucugaaacgcauggccaucuccggggacgauugcguggugaagccgaucgaugacagauucgccaccgcguugaccgcccuuaacgacaugggcaagguccgcaaggacaucccccagugggagcccucaaagggguggaacgacuggcagcagguccccuucugcucgcaucacuuccaccagcugaucaugaaggauggcagagagauuguagugccgugccgcaaccaggacgagcucguaggccgcgccaggguuagccagggcgcaggcuggagccuaagagagaccgccugccuggggaaguccuacgcgcagauguggcaguuaauguacuuccaccgcagagaccugcgccuggccgccaacgcuaucugcagcgcgguccccguagacuggaucccaacgucccggaccaccugguccauucacgcgcaccaccaguggaugaccacugaggacaugcucuccguguggaaccgcguuuggaucgaagagaaucccuggauggaggacaagacccauaucuccuccuggggcgacgugccguaccuggggaaacgcgaagaccagugguguggcagccugauuggccucaccgccagagccacgugggccaccaauauccaggucgccaucaaccagguccgacggcugaucgggaacgagaacuacuuggauuacaugacuuccaugaagagauucaagaacgaguccgaccccgagggggcccucugguga

SEQ ID NO: 24163 - RNA, 9879 nt, Artificial Sequence
  derived and/or modified CDS sequence (opt11) from DENV-1__FJ432733__SS-prME
agcguaacuaugcugcucaugcuuaugcccaccgcccuagccuuccaccucaccacccgggguggggaaccccacaugauagugaccaaacaggagcggggaaagagccugcuauucaagaccagcgccgggguuaauaugugcacccucaucgccauggaccucggcgagcugugcgaggacaccaugaccuauaagugcccacggaucaccgagguggagcccgacgacguagacugcuggugcaacgcgacggacaccugggugaccuacggaaccuguagccaaacgggagagcaccggcgcgauaagcggagcguggcccucgcuccccauguaggccugggcuuggagacccgcacagagaccuggauguccagcgagggcgccuggaagcaaauccagcguguugaaacgugggcccuccgccaccccggcuucacagugauagccuuguuucuggcccauguuaucggcacauccauuacccagaagggaaucauauucauccuccugaugcucgugacgcccagcauggcgaugcggugcgugggcaucgggucccgggacuucgucgagggucucagcggggccaccuggguugacgucguccuggagcacggcagcugugugaccaccauggcgaaggacaagccgacgcuggauaucgaacuucugaagaccgaaguuacgaauccugccguccugcggaaguugugcauugaggcuaagauuucuaacacaacaacugacucccgcugccccacccagggcgaggcaacccuuauggaagagcaagacgcaaacuucgugugcagacgcacguuuguggaucgcggguggggaaacggguguggccuguucggcaagggcagccucaucacgugcgccaaguucaaguguguuacaaaacuggagggcaagauaguccaguacgagaauuuaaaguacuccguaauagugaccguucacacgggcgaccagcaccagguagggaacgagagcaccgaacauggcaccaucgccaccaucacgccacaggcgccuacgucugagauacagcucacagacuacggggcgcugacgcuugacugcagcccccgcacuggccucgacuuuaacgaaauggugcugcuuacgaugaaggagaaauccuggcucguccacaagcagugguuccuggaccucccauuacccuggacgucuggggcgucgaccagccaggagaccuggaaucggcaggaccugcugguaacguucaagacagcacacgccaagaagcaggaggugguaguucucggcucccaagaaggcgccaugcacaccgcgcucaccggggccacggagauccagaccuccggcaccaccacgaucuucgccggucaucugaaaugccgccucaagauggauaagcugacgcugaagggcaugucauacgugauguguacgggguccuucaaacucgagaaggagguggccgagacccaacacggcacgguccucgugcagauuaaguaugaaggcaccgaugcaccauguaagauccccuuuaguacacaagacgagaagggggugacccaaaacgggcgucugaucacggcgaacccgaucguuacggacaaggaaaagcccguaaacaucgaggccgagccgccauucggggaauccuacauugugaucggugccggcgagaaggcccugaagcucagcugguucaagaagggguccagcaucggcaagauguucgaggcgacugcccgcggugcccggcggauggcuauuuugggcgacaccgcgugggacuucggguccauagggggagucuucacuucaguagggaaacuggugcaccaaaucuucggcaccgcguacggaguccucuucuccggggugagcuggaccaugaaaaucgggaucggcguucugcugacguggcucggucuuaauucccggagcaccucguugagcaugaccugcaucgcggucgggcuugugacauuauaccugggcgugaugguccaggccgauagcgggugcgugaucaacuggaaggggcgggaacucaagugcgguaguggcaucuucgugaccaacgagguacacaccuggaccgaacaguacaaguuccaggcagacagcccgaagcgccugagcgccgcaaucggcaaagccugggaggaagguguguguggcauucggucagcaacacgccuggagaacauuauguggaaacaaaucuccaacgagcucaaucacauucuacuggagaacgacaugaaguuuaccguggucgugggugauguggucggcauccucgcccaggggaagaaaaugauacguccgcagcccauggaacacaaguauuccuggaaauccuggggcaaggccaagauuaucggcgcggacgugcagaacaccacguucauaauagacgggccuaacacgccggaguguccagacgaccagcgagccuggaacaucugggaggucgaggacuacggcuucgggaucuucacgacuaacaucugguuaaaacugcgggauagccacacgcaaguuugugaccaccgccucauguccgccgccaucaaggauaguaaggcgguacaugccgacaugggcuacuggauugagucagagaagaacgaaacuuggaaguuagcccgcgccagcuucaucgagguaaagaccuguaucuggcccaagucccauacccuuuggagcaacggcguccucgaguccgagaugaucauccccaaaaucuacgggggcccgauaucacagcacaacuaccgcccaggguacuucacgcaaaccgcagggccauggcaucuggguaaguuggagcucgauuucgacuuaugcgagggcaccaccguuguggucgacgagcauugcggcaaccgggggccgagccugcgcacgaccaccgugacaggcaaaauaauccacgaguggugcugccggagcugcacucugccgccccuacgcuucaaaggggaggacggcugcugguacgggauggagauccgucccgucaaggagaaggaggagaaccucgucaagagcauggucucggccggcucgggugaaguggacaguuucagucuugggcuuuugugcauuuccaucaugaucgaagagguuaugcgaagcaggugguccaggaagaugcugaugaccggaacacuggcggucuuccuguuacugaucaugggacaacucaccuggaacgaccugauccggcuuugcaucauggugggcgccaacgccucggaccgcauggggaugggcaccacauaccuggcccucauggcgacuuucaaaaugcgcccgauguucgccgucgggcuguuauuccggaggcucaccucucgggaggugcugcuacucacgaucggacugagccuugucgcauccguggagcucccaaacagccuggaagaguuaggggacgggcuagccaugggcauaaugauccugaaacugcucaccgacuuccagucccaccagcuuugggcuacccugcugagccucacuuucauaaagacgacccugucccuucauuaugccuggaagacgauggccauggugcugagcaucgucucccuauucccgcucugucugucuaccacuucccagaagaccaccuggcuucccgugcuccugggcagccuggggugcaaaccgcuggccaugcugcugaucgccgagaacaaaauuuggggacgcaaguccuggccccucaaugaggguauuauggcggugggcgucgugucuauccugcugucaucccuccuuaagaacgacgugccccuugccgggccccucaucgcgggugggaugcugaucgcauguuacgugaucagcggcuccagcgccgaucugucccucgagaaggcggccgaaguaagcugggaggaagaggccgagcacuccggugcuucgcacaacauccugguugagguccaggacgauggcacuaugaaaaucaaggacgaggagcgggacgauacacuaacaauccuccugaaggcgacgcuucucgcagugucuggcguguauccgcugucuauccccgccacacuguuuguuugguauuucuggcagaagaagaagcagcgcucggggguacugugggacacccccagcccgcccgagguggagagggccguucuugacgauggaaucuaccgcaucaugcaacggggccugcucggucgcucccaggugggggugggggucuuccaggagaacguguuucacacgauguggcacguaacacggggcgccguccuaauguaccaggggaagcgacuggagcccaguugggccuccguaaagaaagaccucaucaguuacgguggcggguggcgccugcagggcagcuggaauaccggggaagaagugcagguuaucgcgguggagcccggcaagaacccaaagaaugugcagaccgcccccgggacguucaagacccccgagggagaggucggcgcgaucgcccuggauuucaaacccgggaccucgggcuccccgaucguaaaccgcgaaggaaagauaguuggccuguacggcaacggugucgugaccaccagcggaacuuacgugagcgcaaucgcucaggcaaaagccucccaggaggggccgcuccccgagaucgaagacgagguguuccggaagcgaaaccugaccaucauggacuuacaucccgguuccgggaagacucggagauacuugcccgccaucgugcgggaggcgauaaagcgcaaacuccggacgcuuauccuggcacccacucgcgugguagccuccgagauggccgaggcccugaagggcaugccgauccgcuaucaaacuaccgcggugaaaagcgagcacacagggaaggagaucgucgaccugaugugccaugccacguucaccaugagacuccugucccccgugcgcgugccuaacuacaacaugaucaucauggacgaagcccacuuuacggacccgagcucgaucgccgcccggggguacaucucaacgcgcgugggcaugggggaagcggcugccaucuucaugaccgccacgccgcccgggagcgucgaggcauucccccaaagcaacgcggugauccaggacgaggagcgggacauccccgaacgcuccuggaauagcggguaugaguggaucaccgacuucccuggaaagacagugugguucgucccguccaucaagucaggcaacgacauagccaauugcuuaaggaagaacgggaagcgcgugauucagcuaucccggaagaccuucgacacugaguaccagaagacuaagaacaacgauugggacuacguugucacuacugauauuagcgagaugggcgcgaacuuccgugccgaccgggugauagacccacgccggugccugaagcccgucaucuugaaggacgggcccgaacgcgucauucucgcgggcccgaugccggugacggucgcguccgccgcccagcggagggggcggaucggacgcaaucacaacaaggagggcgaucaauacaucuauauggggcaaccccuaaacaacgacgaggaccacgcacauuggacggaagcuaagaugcuguuagacaacaucaauacgccugagggcaucaucccugcccuguucgagccugagcgggagaaauccgccgcuaucgacggggaauaccgcuugcgcggugaggcuagaaagacauucguugaacucaugcggcgcggggaccuccccguguggcuuuccuacaaggucgcgagcgagggauuucaguauagcgaccgccggugguguuucgacggcgagaggaacaaccagguccucgaggagaacauggacguggagaucuggaccaaggagggugagcguaaaaaacugcgcccccgguggcuggaugccaggacuuauucagacccacucgcccugcgggaguucaaggaauucgccgcugggagaagaagcguuuccggcgaccugauuuuggagauaggcaagcugccgcagcaccugacucagcgcgcgcagaacgcccucgacaaccuagucaugcugcacaacucagagcaaggcgggcgggccuaccggcacgccauggaggagcuuccggacacgauagaaacacugaugcugcuugcgcugauugccguccuaaccggcgggguuacccuguucuuucuguccggccgugggcuggguaagaccuccauuggccuccugugcguuauggccucuagcguguugcucuggauggccuccgucgagccccacuggaucgcugccagcaucauacuggaauucuuccuuauggugcuccuaauccccgagcccgaccggcagagaacgccccaggacaaccagcucgcguacguggucaucgggcuccuguuuaugauccugaccguggcugccaacgagauggggcuccuagaaacgacgaagaaggaccuggggauagggcacguggccguagagaaccaccaucacgcgacgaugcucgacguggaucuccaccccgccuccgccuggacccucuacgcuguugccacuacgauuaucaccccgaugaugcgccauacaaucgaaaacacuacggcgaauauaagccuuacggccaucgcaaaccaggccgcuauccuaauggggcuagacaagggcuggcccauauccaaaauggacaucggcguuccacuccuggcgcugggcuguuacagccaggugaacccucucacgcucaccgccgccguccugaugcucgucgcgcacuacgcgaucauuggaccggggcugcaggcuaaggccacgcgcgaggcucagaagcgcaccgccgcaggcaucaugaagaaccccaccguggauggcaucgucgccauagacuuggaccccgucguguaugacgccaaguucgagaagcagcucggccagauuaugcuguugauucucugcacuagucagauacuacugaugcgcacuaccugggcccuuugugagucuaucacccuggccaccgguccccugacgacccuaugggaggguucccccggcaaguucuggaauaccaccaucgcaguaucaauggcgaacaucuuccgcggguccuaccuggcuggcgccggacuggccuuuucgcuaaugaagagccuagggggagguagacgggggacgggggcgcagggcgagacccugggcgaaaaguggaaacgccagcuaaaccagcuguccaaaagcgaauucaacaucuacaagcgguccgggaucauggaggucgaccgcuccgaggcgaaggagggucugaagcgcggggagacuacccgacacgccgugucccggggcacggcgaagcuccgcugguuuguggagcguaaccuggucaagcccgaggguaaggugaucgaccugggcugcggucgcggagguuggagcuauuauugugcggggcugaagaaggugaccgaagucaagggcuacaccaagggcgggccuggccacgaagagcccaucccgauggccaccuauggguggaaccuagugaaacugcauucgggcaaagacguguucuucaccccgccagagaagugcgacacauuacucugcgacaucggggagucaucucccaaccccaccaucgaggaaggccggacccugcgcguucugaagaugguugagccuuggcuccgggggaaccaguucuguauuaagauccugaauccauacaugcccucggucgucgaaacccuggagcaaaugcagcguaaacauggaggcaugcucguacggaacccgcucucccggaauagcacccacgagauguacuggguauccugcgggaccggcaacaucguuucggccgugaauaugaccagccguaugcugcucaaccgcuuuaccauggcgcaccggaaacccacguacgagcgggacguggaccugggggccggaaccaggcacgucgcggucgagccggagguugcgaaccuggacaucaucggccagcggaucgagaacaucaagcaugagcauaagagcaccuggcacuacgacgaggacaacccauauaagaccugggccuaccacggguccuacgaggucaagcccagcggcucugcuagcagcauggugaacggggucgugaaguugcuaacgaagcccugggacgugauccccauggucacucagaucgccaugaccgacaccacacccuucggccagcagcgcguauucaaagagaaagucgacacccggacaccuaaagcuaagcgcgggacggcccagaucauggaggugacugcccgauggcuguggggcuuccucagucguaacaaaaagccgcggaucugcacacgcgaagaguucacccggaagguccgaucuaacgccgcaaucggggcgguuuuuguugacgaaaaccaguggaacuccgccaaagaggccguggaagaugaacgguucugggaccugguucagaaggaacgagaguuacacaagcaggggaagugcgcaacgugcgucuacaauaugaugggcaagcgcgagaagaaguugggugaauucgguaaggcgaaggggagccgcgccauuugguauaugugguugggagcucgguuccuggaguucgaggcccucggcuuuaugaacgaggaccauugguucucccgagagaacagccugucuggaguggagggcgagggccugcacaagcucggcuacauucuacgggacaucucgaaaauccccgggggcaauauguacgcagacgacaccgcgggcugggacacaaggaucaccgaagacgaccugcaaaacgaggcacggaucaccgacauuauggagccagaacacgcccuccuggccacgucaaucuuuaaacugaccuaucagaacaaggugguaagagugcagcgccccgccaagaauggcaccgugauggaugucauaucccggagggaccaacgaggcuccggccaagugggcaccuacggacucaauacguuuaccaauauggaagcgcagcugauucgccaaauggagagugaggggaucuuuuugcccuccgagcucgagacccaaaaccuggccgagcgggugcuggauuggcuagagaaguacggcguugaacgccugaagcggauggccaucuccggggacgacuguguggugaagcccaucgacgacagauuugccaccgcccugacggcgcugaaugacaugggcaaggugcggaaggacaucccgcagugggaaccauccaagggguggaaugacuggcagcaaguccccuucuguagccaucacuuccaccagcuaauaaugaaggacggcagagagaucguggugcccugucggaaccaggaugagcucgugggccgcgcccgggugucccaaggggcgggcuggagccuccgcgagaccgccugccugggcaaaagcuacgcccagauguggcaacugauguacuuucaccgucgcgaccuccggcuggcagcaaacgcaaucugcagcgccgucccgguagacugggugcccacgucccgcacuacgugguccauccacgcgcaucaccaguggaugaccacagaggacaugcugagcgucuggaaccggguguggauugaggagaaucccuggauggaggacaagacccauguuaguucuuggggugacguccccuacuugggaaagcgcgaggaccaguggugcggaucccucaucggacugacggcuagagccaccugggccucaaauauccagguggcgaucaaccaggugcggcgccucaucgggaacgagaacuaccuggacuacaugaccuccaugaagcgguuuaagaacgaaggcgacccggagggagcgcugugguga

SEQ ID NO: 24164 - RNA, 9879 nt, Artificial Sequence
  derived and/or modified CDS sequence (opt11) from DENV-1__FJ410196__SS-prME
agcgugacgaugcuauuaaugcugaugcccaccgcguuagcguuccaccucaccacccgggggggcgagccccacaugaucgugagcaagcaggaacgggggaagucgcugcucuucaagacgucagccggggucaacaugugcaccuugaucgccauggaccucggcgagcuaugcgaagacacaaugaccuacaaaugcccccguaucacggagaccgagcccgacgauguggacugcuggugcaacgccacugacaccuggguuaccuaugggaccugcagccagacuggagagcaucggcgcgacaagcguuccguggcucucgcgccccacguuggcuuagggcuggagacccgcaccgaaaccuggaugagcagcgagggcgcguggaagcagauucagcggguggagacgugggcccuccgccacccaggguuuaccgugauugcccuguuccuggcccacgcaaucggcaccagcaucacccagaagggaaucaucuucauacuccugauguuaguuacgcccucgauggccaugcguugcgucggcaucggcucucgcgacuucguugaggggcucucaggcgcuacauggguggacgucguucuggagcacgggagcuguguuaccaccauggccaaggacaagcccacacuggacaucgagcucuuaaagaccgaagucacgaacccagccgugcuacggaagcugugcaucgaagcgaagaucuccaacacaacgaccgacagccgcuguccgacgcagggcgaggcaacccucguagaagagcaggaugcgaauuucgucugccgacgcacauucguugaccggggcugggguaacggcugcgggcuguucggcaagggcucgcuaaucacgugcgccaaguucaaaugcguaacuaagcuggagggaaagaucguccaguaugagaaccuaaaguauagcgugauaguuacuguccauacgggugaccagcaccagguuggcaacgaauccacagagcacgggaccacagccaccauaacaccccaggcgccgaccaccgagauacaacucaccgacuacggggcccugacgcuggacugcagcccccgcaccggccucgacuucaacgagaugguccuucugaccaugaaggagaaguccuggcucgugcacaagcagugguuccuggacuugcccuugccuuggaccagcggggcuuccacgucccaggagaccuggaacaggcaggaccuucuggugaccuucaagaccgcgcacgcgaagaagcaggagguagugguguugggcagccaggagggcgcgaugcacacggcccugaccggagccaccgagauucagaccuccggaacgaccaccaucuucgcugggcaccugaagugucgccuuaagauggacaagcugacccugaagggcaugagcuacgugaugugcacgggaucguucaagcuugagaaagagguggccgagacccagcacgguaccgugcucgugcagaucaaguacgagggcaccgacgcgcccugcaagaucccauucagcacacaggacgagaagggggugacccagaacggacggcugaucaccgcaaauccgaucgugaccgacaaagagaagcccgucaauaucgaggccgagccgcccuucggggaauccuacaucguuaucggcgccggugagaaggcacugaagcucagcugguucaagaaggggucauccauuggcaagauguucgaggccacggcccgcggggcccggcgcauggcaauccugggcgauaccgcuugggacuucggguccaucgguggaguguucaccucugucgggaagcuggugcaccagaucuuuggcaccgccuauggaguccuguucuccggagucucauggacaaugaagaucgguauuggaguauugcugacguggcucggacugaacucccgaagcaccucccugagcaugacaugcaucgccguggggcucgucacucuguaucuuggcgugauggugcaggcagacuccgggugcgucauaaauuggaaaggccgagaacuaaagugcgggagcgggauuuucgucacgaacgagguacacaccuggaccgagcaguacaaauuccaggccgacagcccgaagcgccuguccgcugcuauaggcaaggcuugggaggagggggucugcggaauucgcuccgccacccgccuggagaauaucauguggaagcaaaucucgaacgagcucaaccacauccuacuggagaacgacaugaaauucacgguugugguaggggacguugccggcauccucgcacaagggaagaagaugaucaggccccagcccauggaguacaaguacaguuggaagaguuggggcaaggccaaaaucaucggugccgacgugcagaacacaaccuuuaucaucgaugggcccaacacuccggagugucccgacgaccagcgcgccuggaacaucugggagguagaggacuacggguucgggaucuucacuaccaacaucuggcugaagcugagagacagcuacacccaggugugcgaucaucgccucaugucugcggccaucaaggacagcaaagcaguacacgccgauaugggcuacuggauagagucggagaagaacgagacguggaagcuggcccgggcgagcuucauugaggucaagacguguaucuggcccaagucccauacccuguggagcaacggcgugcucgaguccgagaugaucaucccaaagaucuaugguggcccgaucagucaacauaacuaccgccccgguuacuucacgcaggccgcuggccccuggcaccuggggaagcuggagcucgacuuugaccugugugaaggcaccacggucgucguggacgagcauugcggcaacagagguccgucuuugcguacuaccaccgugacgggaaagaucauccacgaguggugcugccgaagcugcacucugccgccacuccgcuuccgcggcgaggacggcuguugguacgggauggagauccgccccguuaaggagaaagaggagaaccuggugaaauccauggugagugccgguagcggcgaggucgacuccuucagccucgggcugcuaugcauauccaucaugauugaagaggugaugcggucccgguggucccgacgcaugcucaugaccgggacccuggccguguucuuccuguuaauaauggggcaauugacguggaaugaucugauacgccuauguaucauggucggagcgaaugcgagcgaccguauggggauggggaccaccuaccuggcccuaauggccaccuucaagaugcgcccuauguucgccgugggauugcuguucagacgccugacgucccgggagguucugcugcucaccaucgggcucaguuuagucgcgucgguggaacugcccaacagccucgaggagcugggggacggacuggccaugggcaucaugauccucaagcuauugaccgauuuccagucccaccaacucugggccacccugcugucccucacguuuauuaagaccaccuucucccugcacuaugcuuggaagaccauggcgaugguacugagcauugugucccucuucccccugugccugucuacgacaucgcagaagacaaccuggcugccggugcugcugggcagccucgggugcaagccucugacaauguuccucaucgcagagaauaagaucuggggccgccgguccuggccccucaacgaggggaucauggccgucggcaucgugagcauccugcugagcucguuauuaaagaaugauguaccccuggccgggccccucaucgcaggaggcaugcugaucgccugcuacgucaucucuggguccagcgccgaccugagucuagagaaggcugccgaggugucgugggaggaggaggcagagcauaguggcgcgagccacaauauucuaguggagguccaggacgacgggacaaugaagaucaaggacgaggagagagacgacaccuuaaccauccuccugaaagcaacuuugcuugccguguccggcguuuacccgcugagcauccccgcuacacuguucgucugguacuucuggcagaagaagaagcagcggucgggggugcucugggacacccccagcccgcccgaggucgagcgcgcagucuuggacgacggcaucuaccggauaaugcagcgcggcuuacuuggccggucccaggugggcgucgggguuuuccaagagaacguguuucacacaauguggcacguuacgaggggcgcggugcuuauguaccaagggaagcgccucgagcccagcugggccuccgugaagaaggaccugaucagcuacggcgguggguggcgccuccaagguaguuggaacacgggggaagaggugcaggucaucgcuguggagcccggcaagaaccccaagaacgugcagaccgccccagggaccuucaagacgcccgagggcgaggucggcgccauugcgcuggacuuuaaaccagggaccagcggcucccccauagugaaucgggaggguaagaucgugggccuguacggcaacggagucgucaccacuagcggaacuuacgugagcgccaucgcccaggccaaggcgucccaggaggggccgcuccccgaaaucgaggacgagguauuccgcaagcggaaccugacgaucauggacuuacaccccgguagcgggaagacccgacgguaccucccggccaucguccgcgaggccaucaaacgcaagcugcggacccugauccucgcccccacccgaguagucgccuccgagauggcugaagcccugaagggcaugcccauccgguaccagacaaccgccgucaagagugagcacaccggcaaagaaaucguagaccugaugugccacgccacuuucacgaugcgccuguugucucccguccggguuccaaauuacaacaugauuaucauggaugaagcucauuucaccgacccguucucgaucgcggcccgcggguacauuuccacccguguaggcaugggggaggccgcugccaucuucaugaccgcgacaccgcccggaagcgucgaggccuuuccacaauccaacgccgugauccaggacgaggagcgcgacauucccgaacggagcuggaacuccgguuaugaguggaucacagacuuccccggcaagaccgugugguucguccccagcaucaagucuggcaaugauaucgccaacugccugcgaaagaacgggaaacgggugauacagcuuucucgcaaaaccuuugacacggaguaccagaagaccaagaacaacgacugggacuacguggucaccaccgacaucuccgaaaugggcgcgaacuuccgggcagaccgcgugaucgauccaagaagauguuuaaagcccguaauccugaaggauggucccgaacggguuauccucgcaggacccaugccugugaccgucgccucagccgcacagcgccgggggcgcaucggucgcaaccacaacaaggagggcgaucaguacaucuacaugggacagccccugaacaacgacgaggaucacgcacacuggacugaagccaagaugcugcucgauaacaucaacaccccggagggcaucauccccgcccucuuugagccggaacgggagaaguccgccgcuaucgacggggaguaccgccugcggggcgaggcccgcaaaaccuucguggaguuaaugcggcgcggggaucuacccgucuggcugagcuacaaggucgccuccgagggcuuucaguauagcgaccgucgcuggugcuuugacggcgaaagaaacaaccaggugcuugaggaaaacauggacguagagauuuggacgaaagagggggagcgcaagaagcuacggccccgcuggcuggacgcccguaccuauagcgauccccucgcccuccgggaguucaaggaauucgcggccggcaggcgcuccgucagcucggaucugauuuuggagaucggaaagcugccgcaacaccugacccagcgcgcccagaacgcccucgacaacuuggugaugcugcacaacagcgagcaggguggccgcgcguaucggcacgcaauggaggagcuccccgauacaaucgagacgcuaaugcugcucgcacucaucgcagugcugaccgggggcguuacccucuuuuuccuguccggccgcggccuugggaagaccuccaucggucuccugugcgucauggccagcagcguguugcuguggauggcgucugucgagccccacuggaucgccgcuagcaucaucuuagaguuuuucuuaaugguacuccugauccccgagccggaucggcagagaacgccccaggauaaccagcuagccuacguggucauaggccuccuguuuaugauccugacggucgccgcgaacgagaugggguugcuggagaccaccaagaaggaccuuggcaucgggcacguggccgucgaaaaucaccaccacgccgcgaugcucgacguggaccugcaccccgccuccgcguggacccuguacgccguggcuacgaccaucaucacgcccaugaugcgccauaccaucgagaauacgacugcuaacaucagccucaccgccaucgcgaaccaggcggccaucuugaugggccuggacaagggguggcccaucaguaagauggacaucggcgucccccuccuggcccugggcugcuacagccaggugaacccccucacgcugacagcggcggugcugaugcucguugcccacuacgcgaucauaggaccaggccuucaggccaaggcgacaagggaggcccaaaagcgcacggccgcagggauuaugaagaaccccacaguggacggcauuguggcuaucgaccuggacccugucguguacgacgcgaaguucgaaaagcaacucgggcagaucaugcuucugauccugugcacgucccagauccugcugaugcggaccaccugggcccuaugcgagagcaucacccuggccacgggcccccugacuacucucugggaggggucaccggggaaguucuggaacacgacgaucgcugugagcauggccaacaucuucaggggcuccuaucuagcgggugcaggccuggccuuuucgcucaugaagucccugggcgggggccggcgagggaccggcgcacagggggagacccugggcgagaaguggaagcggcagcugaaccagcuguccaagagcgaguucaacaccuacaagcgcucugguaucauggaggucgaucggucagaagcgaaagagggacugaagcgcggugagacgaccaaacaugccgugucccgugggacggccaaguugcgcugguuugucgaacggaaccuugucaagcccgagggcaaggugaucgaccuggggugcggccgcggcggguggagcuacuacugcgccggcuuaaaaaaagugaccgaggucaagggauacacgaagggcgggcccggacacgaggagcccauuccgauggccaccuacggcuggaaccucgugaaauuacauuccggcaaggacgucuucuuuaucccacccgaaaagugcgacacccugcucugcgacaucggcgagagcucccccaauccaacuaucgaggaagggcggacgcugcgcgugcugaagaugguggaacccuggcucagaggcaaccaguucuguaucaagauauugaacccguacaugccaucgguggucgagacgcuggagcagaugcagcgcaaacacggaggcaugcucgugcgaaacccgcugucccgaaacagcacccacgagauguacugggugucaugcggcaccggcaacaucgucucugcggucaauaugacuucucguaugcugcucaaucgguucacgauggcccaccguaagcccacuuacgagcgggauguagacuugggcgccgggaccaggcacguugcagucgaaccggagguggcgaaccuggauaucauugggcagcggaucgagaacaucaagcacgagcacaagucuacauggcacuacgacgaagacaaccccuacaagacgugggcguaccacggcuccuacgagguuaagccgagcgggucggcgagcagcauggugaacggcgucguaaaguuacugacaaagcccugggacgugauccccauggucacccagauugccaugaccgacacgacccccuucgggcagcaacgcguguucaaggaaaagguggacacccggaccccgaaggccaagcgcggcacugcacagaucauggaggugaccgcgaaguggcuguggggguuccugucccggaacaagaaacccagaaucugcacccgggaggaauucaccagaaagguacggagcaacgcggccauaggcgccgucuuuguggacgagaaccaguggaacagcgcgaaggaggcaguggaggacgagcgcuucugggaccuggugcaccgggagagggaacugcacaagcagggcaaaugugccacgugugucuacaauaugaugggaaaacgggaaaagaagcucggcgaguucgggaaagccaaggggucucgcgccaucugguauauguggcugggcgcacgguuccuggaguucgaagcccucggcuucaugaacgaggaccacugguucucacgcgagaacagccugucggguguggagggggaaggccuacacaagcucgguuacauccuucggggcaucucaaagauccccgggggcaacauguacgccgacgacacagccgguugggacacgcgcauaaccgaggacgaccuucagaacgaggcccgcaucacggacaucauggaaccagagcacgcgcuccuagccaagucaaucuucaagcugacguaccaaaacaaaguagugcgggugcagcgcccugccaagaacgggacggugauggaugucauuucgcggcgagaccagcggggauccgggcaggugggaaccuacggcuugaacacguucaccaacauggaggcccagcucaucaggcagauggagagcgaagggaucuucuccccaagcgagcuggagaccccgaaucucgccgagaggguauuagacuggcuggagaaauacggcguugagcgcuuaaagcggauggcaaucuccggcgaugauugcgugguaaagccgaucgacgaccgcuucgccaccgcccucaccgcccugaacgacauggguaagguccggaaggauaucccccagugggagcccagcaagggguggaacgacuggcagcaggucccguuuugcucgcaucacuuccaccagcuuaucaugaaagacggcagggagauuguggucccaugccggaaccaggacgagcucgugggucgggcccgggugucacagggagcgggcuggucucuacgcgagaccgcuugucuagggaagaguuaugcccaaauguggcagcugauguacuuccaccggcgcgaccugcggcucgcagcgaaugcgaucugcagcgcggugccgguggacuggauccccaccucccgcacaacguggucgauccacgcccaccaccaguggaugacaaccgaggacauguugucaguuuggaaucgcgucuggaucgaggaaaauccuuggauggaggacaagacccacaucagcuccuggggcgacgugcccuaccuagggaagcgggaagaucaguggugcggcucuuugaucggccugacggcccgcgcuaccugggccaccaacauccaggucgccaucaaccagguccgucgccucauugggaacgagaacuaccucgacuacaugaccuccaugaagcgguucaagaaugagagugaccccgagggcgccuuaugguga

SEQ ID NO: 24165 - RNA, 9879 nt, Artificial Sequence
  derived and/or modified CDS sequence (opt11) from DENV-1__FJ432734__SS-prME
agcgugacaaugcugcucaugcugaugcccaccgcccuagcguuucaucugaccacgcgcggcggggagccccacaugaucgugagcaaacaggagaggggcaaaagccugcucuucaagaccuccgccggugugaacauguguacccucauagcaauggacuugggggagcugugcgaggacacgaugaccuacaaaugcccgcgcaucaccgaagccgagcccgaugauguagacuguuggugcaaugccaccgauacgugggugaccuacgguacaugcagccagacuggugaacauaggcgcgacaagcgguccguggcucucgcgccucauguuggacuugggcuggagacgcgcacugaaaccuggaugucgucggagggugccuggaagcagauccagcggguugagacauggguacuccgccaccccggguucaccgugauagcccuuuuucuggcacacgcgauuggcacuagcaucacucagaaggguaucaucuucauccuccugaugcuggugacccccuccauggccaugcguugcgucggcaucgguagccgcgacuucguggagggacuguccggcgccacgugggucgacguggugcuagagcacgguucuugcgugaccacgauggccaaggacaagcccacccuggacaucgagcuguugaagacggaggucaccaaucccgccgugcugcgcaagcuauguaucgaggcgaagauaucaaauaccaccacggacagccgaugcccgacucagggcgaggccacccucguggaggagcaggacgccaauuucgugugcagacgcaccuucgucgaccggggcuggggcaauggcugcgggcuuuucgggaaaggcucguugaucacuugcgccaaauuuaagugugucaccaagcuggagggcaagaucguccaauacgagaaccugaaguacagcgugaucgucaccgugcacaccggcgaccagcaccaggucgggaacgagucgacggagcacgguaccaccgccacaauaacgccccaggcccccaccaccgaaauccaauugaccgauuacggggcgcucacccuggacugcagcccccgcacgggccucgacuucaacgagauggugcugcugacaaugaaagaaaagucauggcuugugcacaagcagugguuccuggaucugccgcucccuuggacgagcggggccagcaccucgcaggagacuuggaacagacaggaccugcuggucacuuucaagaccgcccacgcgaaaaagcaggagguggugguccugggaucucaggagggcgcgaugcacacagcccugacgggggccacagaaauccaaaccuccggcaccacgaccaucuucgcggggcaccugaaaugucgucucaaaauggacaagcuaacccugaaggggaugagcuacgugaugugcacggggagcuucaaauuggagaaggaaguggcugagacccagcacgggaccguccuugugcaaaucaaguacgagggcaccgacgcgcccugcaagauccccuucagcacucaggaugagaagggggugacgcagaauggacggcugaucaccgccaacccuauuguaaccgauaaggagaaaccaguaaacauugaggcggaaccgccauucggggagucguauaucgugaucggggccggggagaaggcgcugaaacuaagcugguucaagaagggcuccagcaucggcaagauguucgaagccacugcacgcggagcccgaagaauggccauccugggcgacacagcgugggauuucggguccauaggcggcguguucaccagcguggggaagcuggugcaccagauauuuggcaccgccuauggggucuuguucuccggcgugucuuggacaaugaagaucgggauaggcgugcugcuaaccuggcugggucugaacuccaggagcaccucccugagcaugaccugcaucgccgucggccucgucacacuguaccugggcguuaugguccaggccgacucagggugcgucaucaauuggaagggcagagaguugaaguguggaagcggaaucuucgugaccaacgagguccacacguggaccgagcaguacaaguuucaagccgauuccccgaagagacuguccgcggccaucggcaaagcgugggaggagggaguuugcggaauacggagcgccacccgacuggagaacauuauguggaagcagaucagcaacgagcucaaccacauccuccuagagaacgacaugaagcucaccguggucgugggggauguggcagguauccuggggcagggcaaaaagaugauccggccgcagcccauggaguacaaguauagcuggaaguccuggggcaaggcuaagauaaucggggccgacgcccaaaacacgaccuucaucauagauggccccaacacaccggagugcccugacgaccagcgagccuggaacaucugggaagucgaggacuauggcuucggcauguucaccaccaacaucuggcugaaacuacgggacagcuacacccaggugugcgaccauaggcugaugucagcagcgauuaaagauagcaaggccguacaugccgacaugggcuacuggaucgagagcgagaagaacgagacuuggaaguuagcuagagccaguuucaucgaagugaagaccuguaucuggcccaagagccacacgcucuggucgaacggggugcuggagagcgagaugauuauccccaagauauauggcgguccaaucucccaacacaacuaccggcccgguuauuucacgcagaccgcugggcccuggcaccugggcaaguuagagcucgacuuugaccugugcgagggaaccacgguaguuguugacgaacacugcgguaacaggggcccgucccugcgcaccaccaccguuacgggaaagaucauccacgaauggugcugccggaguugcacccugccgcccuugcgcuuccggggagaggaugggugcugguacggcauggagauucgccccgucaaggaaaaggaggagaaccucgugaaguccauggugucagccggcagcggggaagucgacuccuuuagcuuaggccugcucugcaucuccaucaugaucgaagaggugaugcgaagcagauggucccgcaagaugcugaugacagggacccuagccgucuucuuccuccugaucaugggccagcuuacguggaacgaccucauccgcuuaugcaucauggucggggccaacgcuagcgaccguauggguaugggcacaaccuaccuggcccucauggccaccuucaagaugcggccgauguuugccguggggcugcuguuccgcaggcucacgucccgcgaggugcuucugcuuaccaucggccugucacuggucgccuccguagagcuccccaacucccuggaggagcugggggauggccucgcgaugggcaucaugauacucaagcuguuaaccgacuuccagucccaccagcugugggccacccuacucagucugacguucaucaagaccaccuucucacuucacuaugccuggaagaccauggccaugguccucagcauagugucucuguucccgcugugccuuagcacgaccucccaaaagaccaccuggcuccccguguuacucgggagccuuggaugcaaaccgcucacgauguuccuuaucgcggagaacaagauaugggggcgcaagaguuggccucugaacgaaggcauuauggcagucgggaucguaagcauacugcucagcagucugcugaagaacgacguucccuuggccggcccacugaucgccggcgggaugcugaucgccugcuacgucauaagcggcagcucggcugaccucagucuggagaaggccgccgaggugucuugggaggaggaggcagaacacuccggggcaucccacaauauacugguggagguacaggaugauggcacuaugaagaucaaggacgaggaaagagacgacacacucaccauccuguugaaggcgacccuacuggccguguccgggguguacccuuuaagcaucccugcaacccucuucgucugguauuucuggcaaaagaagaaacaacguuccggcgugcugugggacacacccagcccgccggaagucgagcgcgcuguccuggacgacggcaucuaccggaucaugcagcgcggccuacucggccggucccagguuggcgugggcguauuccaggagaacguguuccacaccauguggcacgugacccgcggcgccgucuugauguaccagggcaaacggcuggagcccagcugggcauccgugaagaaagaccuaauuuccuacggagggggcuggcgccucagaggguccuggaacacgggcgaagagguccaggucauagccgucgaaccggggaagaauccuaagaacgugcagaccgcccccggcaccuuuaagacgcccgagggcgagguuggagcgaucgcacuggacuuuaagcccggcacaagcgggucccccaucgugaaccgcgagggcaagauagugggucucuacggaaacggcguugugaccaccagcgggaccuacgugagcgcgaucgcccaggccaaagccucccaagagggcccguuaccugagaucgaggaugaagucuuucgaaaacgcaaccugacgaucauggaucuccacccagggagcggcaagacccggcgguaccugccggcgaucgugcgggaggcgauaaaacgcaagcugcgcacgcugauucuggcacccaccagaguggucgccagugaaauggccgaggcauugaagggcaugcccauuagguaucaaacuaccgccgucaagagcgagcacacggggaaggagaucguugaccugaugugccacgcaacauucacgaugcggcugcuuucccccguacgcgugccuaacuacaacaugaucaucauggacgaggcccacuucacugaccccagcuccaucgcagcaaggggcuacaucagcacccgcguggggaugggcgaagcggccgcuaucuucaugacugcaacgccgccgggguccguugaggcauucccgcaaagcaacgcgguuauacaagacgaggagcgggacauccccgaacgauccuggaacagcggcuacgaguggauaaccgacuucccgggaaaaacaguaugguucguccccucgauaaaaagcgguaacgauaucgcgaacugccuccggaaaaauggcaaacgcguuauccaguuaucccgaaagaccuucgacacugaguaccaaaagaccaaaaacaacgacugggacuacguggugaccaccgacaucagcgagaugggagccaacuuccgggcggaccgcguuaucgacccgcggcggugccugaagccagugaucuuaaaggacggaccugagcgcguaauccuugccgggcccaugccaguuacgguggcuuccgccgcgcagcggagaggccguauaggccggaaccacaacaaagagggggaccaguacauuuacauggggcagccccugaacaacgacgaggaucacgcgcacuggaccgaagccaagaugcugcuggauaacaucaacacccccgaggggaucauacccgcgcuuuucgagcccgagcgcgagaaauccgcagcgguggacggcgaguaccggcuccggggggaggcgcgcaagaccuucguggagcugaugcgccggggggaccuccccgucugguuauccuacaagguggcuagcgagggcuuccaguacagugaccggcgguggugcuucgacggggagcguaacaaucaaguacuugaggagaacauggauguggagauuuggacuaaagagggcgaacggaagaaguuacgcccaagguggcucgaugccaggaccuacuccgauccccuggcucugcgggaguuuaaggaguucgccgcggggcguagauccguguccggcgaccucauucuggagaucggcaagcugccacagcaucucacccagagagcccagaacgcucuggacaaucuggugaugcuacacaacagcgagcagggcgggcgggcuuaccgucacgcgauggaggagcuacccgacaccauugagacgcugaugcucuuggccuuaauugcuguacucacggggggcgugacccuguucuuucuguccgggcgggggcucggcaaaacuagcauagggcugcucugugugauggcguccagcguccuccuguggauggcuuccguggagccucacuggaucgcggccucgauuauccuggaauucuuucucauggugcuucugauccccgagccggaccgccagaggacuccccaggauaaccaguuggcuuacgucgugaucggccuccuguucaugauccucaccguggccgccaaugagauggggcugcuggagaccacgaagaaggaccucgguaucgggcacguggcgguggaaaaucaucaucacgccgccaugcuggacguggaucugcaccccgcgucagccuggacucucuacgccguggcaaccaccaucaucaccccgaugaugaggcauaccaucgagaacacgaccgcgaauaucagcuuaaccgcgauugccaaucaggcggccauacuuaugggccucgacaaaggauggccgaucaguaagauggauaucggggugccccuauuggcccuuggcugcuacagccagguaaacccacugacccugaccgccgcgguccucaugcugguggcccacuaugccaucaucgggccaggccugcaggccaaggccacccgagaggcgcagaagcggacggccgcagggauuaugaagaacccgaccguggauggcaucgucgccaucgaucuggaccccgugguguacgaugccaaguucgagaagcagcuggggcaaaucauguugcuaauccugugcacgucccagauacuucucaugcgcacgaccugggcgcuaugcgaaagcauuacgcuugccacgggucccuugacgacccugugggaaggguccccugggaaauucuggaauaccacaaucgccgucagcauggccaacaucuuccggggcuccuaccuggcaggcgcggggcucgccuuuucccugaugaagucucugggcgggggccgucgggggaccggcgcacaaggcgaaaccuugggggagaaguggaaacgccaacugaaccagcuaucaaaaagcgaauucaacaccuacaagcggagcggcaucauggaggucgaccgaagcgaggccaaggagggacucaagagaggcgagacgacuaaacaugcgguaucucgcgggacagccaaguuaaggugguucgucgagaggaaucuggucaagcccgaaggcaaggugaucgaccucggcugcgggcggggaggcuggagcuacuacugugcuggccucaaaaaggugacggaggugaagggauacacuaaaggcggccccgggcacgaggaaccgauaccgauggccacuuacggauggaaccuggugaaguuacacuccgggaaggacguguucuucaucccgcccgagaagugcgacacccuccugugugauaucggugagucgucccccaacccgaccauugaggaggggcguacgcugcggguguuaaagauggucgagccuuggcugcggggcaaucaguucuguauuaagauccugaaccccuauaugccuagcgucguggagaccuuagagcaaaugcaacggaaacauggcggaaugcuugugcgcaacccguugucacggaacagcacacacgaaauguacugggucuccuguggcaccgggaacaucgugucugcagugaacaugacgucccgcauguuacuuaacagauucacuauggcgcaccggaaacccaccuacgagcgcgacguugaccugggcaccggaaccaggcacguggcaguggagccagaagucgccaaccucgauauuaucgggcagcgcauugagaacauaaagcacgagcacaagagcacguggcacuacgacgaagacaacccguacaagaccugggccuaccacggauccuacgagguaaagccgagcggcuccgcaagcuccauggugaacggcguggugaagcugcugacaaagccaugggacgucauccccauggugacucagaucgcgaugacggauaccacccccuucgggcagcagaggguguuuaaggagaaggucgacacgcgcacgccgaaggcaaagcggggcacagcccagaucauggaggugaccgccagaugguuguggggauucuugucaagaaauaagaagccccgcauaugcacccgggaagaguucacgcgaaagguccggaguaaugccgcgaucggcgccgucuucguggaugaaaaccaguggaacagcgccaaggaggccguggaagaugagcgcuucugggauuuaguccaucgcgagcgggagcuucacaaacagggcaaaugcgcgaccugcguguauaacaugauggggaaacgggagaaaaaacugggggaguuugggaaagccaagggcagcagggccaucugguacauguggcuaggagcaagauuccuugaguucgaggcccugggguuuaugaaugaggaccacugguucucccgcgagaacucacuguccggcguggagggggagggccuccacaaacugggguacauccugcgggacaucucaaagauaccaggcggcaacauguacgcggacgacaccgcggggugggauacacgcaucacggaagacgacuuacagaacgaggcgaagaucacggauauuauggaaccggaacacgcccugcucgccaaggcuaucuucaaacucaccuaccagaacaaggucgugcgcgugcagcggccugccaagaacggcacgguuauggacgugaucucccgacgcgaucagcgcgggagcggacaggugggcacguauggccugaacaccuucaccaauauggaggcccagcugauacggcaaauggaguccgagggcaucuucagccccucagaacuggagacccccaaccuagcagagcgcgcccuagacuggcucgagaaguauggggucgagcgcuuaaagcgcauggcgaucucaggugacgacuguguggugaagccgaucgacgaucgguucgccacggcgcugacggcucucaacgacauggggaagguacgaaaggacaucccccagugggagcccuccaaaggguggaacgacuggcagcagguccccuucugcagccaucacuuucaccagcugauuaugaaagauggccgggaaaucguggucccgugccgaaaucaggacgaacugguggggcgggcgagagugucccaaggcgcuggguggucacuccgagagacugccugccugggcaagagcuacgcucagauguggcagcuaauguacuuccaucgcagagaccugcguuuggcagcgaaugccaucugcuccgcuguccccguagacugggugcccaccagcagaacgacguggucuauccacgcccaccaccaguggaugaccacugaggacaugcucucggucuggaaccguguguggaucgaggaaaaccccuggauggaggacaaaacgcacaucagcagcugggaggacgugccguaccucgggaagagggaagaucagugguguggguccuuaaucgggcugaccgcacgggcuacaugggccaccaauauccaggucgcgauuaaccaggugcgacgucuaaucgggaaugaaaacuaccuggacuacaugaccagcaugaagcgguucaagaacgagacugauccagagggagcucugugguag

SEQ ID NO: 24166 - RNA, 9879 nt, Artificial Sequence
  derived and/or modified CDS sequence (opt11) from DENV-1__FJ432735__SS-prME
agcgugacaaugcugcuaaugcugaugcccaccgcccuggccuuccaccucacgacccgcggcggggaaccccacaugaucgugucuaagcaggaacggggcaagagcuugcuguucaagaccagcgcgggggugaacaugugcacccucaucgcgauggaccugggggaauucugugaggacacgaugaccuacaagugcccccgcaucaccgaggccgagccggacgacguggacugcugguguaacgccaccgacacgugggugaccuacgguaccuguagucaaaccggggagcaccggcgcgacaaacgauccguggcccuggcgccccacgugggacucgggcuggagacgcgcaccgaaaccuggaugagcucggagggcgcauggaaacagauccaacgaguggagaccugggcccugcgccaccccggguucaccgugaucgcccucuuccuugcgcacgcgaucggcacuagcaucacccagaaggggaucaucuucauccugcucaugcuggugacccccuccauggccaugcggugcgucggcauaggcagccgcgacuuuguugaggggcuguccggcgccacguggguggacgucgugcucgagcacgggagcugcguaaccaccauggccaaggacaagcccacccuagacaucgaguuauugaagacggaggucaccaacccagcggugcugaggaagcuaugcauagaggccaaaaucaguaacaccaccacggauagccgcugcccgacccagggagaggccacccucguugaggagcaggacgccaacuucgucugccggcgcacuuucguggaccggggcugggggaacggaugcgggcuguucggcaagggguccuuaaucacgugcgccaaguucaagugcgugaccaaacucgagggcaagaccguccaguacgagaaccugaaguacucggugaucgugacgguccacacaggcgaccagcaccagguagggaacgaguccaccgagcacggcaccacugccaccaucacgccccaggcccccagcaccgagauucagcuaaccgacuacggggcacucacccuggacugcucgccccggacgggccuggacuucaacgagaugguccuacugaccaugaaggagaaaucuuggcuggugcacaagcagugguuccucgaucugccgcugcccuggaccaguggggcaucgaccagccaggagacguggaaccggaaggaccuccuggugacguuuaagaccgcccacgcgaagaagcaagagguagugguguugggcucccaggagggugccaugcacaccgcccucacgggggccaccgagauccagacgagcggcacuacgaccauuuucgccgggcaccugaaaugccgccugaagauggacaaacucacccugaaagguauguccuacgucauguguaccgggagcuucaagcuggagaaggagguugcggagacgcagcauggcaccguguugguccagaucaaguacgagggcacagacgcccccugcaagauccccuucucgacccaagaugagaaaggggugacacagaacggccgccugaucaccgccaacccgaucgugaccgacaaggagaaacccguaaacaucgaagccgagccgcccuucggagagagcuacaucguuaucggcgcgggcgagaaggcccugaagcuguccugguuuaaaaaggggagcuccauuggcaagauguucgaggccaccgcccgcggggcccggcgcauggcgauccucggcgacacggcuugggacuucggcagcaucggcggcguguucaccuccgucgggaagcuggugcaccagaucuucggcaccgccuacgggguguuauucagcggcgucaguuggaccaugaagauagggaucggugugcuccugacguggcugggccucaacagccgcuccacuagccugucaaugaccuguaucgccgugggacuggucacccucuaccugggcgugauggugcaggccgacucugggugcgugaucaauuggaagggcagagagcugaaaugcggaagcggcaucuucguaacgaacgagguacacaccuggaccgagcaauacaaguuccaggcggacuccccuaagcgcuugucagccgccaucggcaaggcgugggaggaaggggucugcggcauccgguccgcuacccgccuggaaaacaucauguggaagcagaucagcaacgagcugaaccacauccuccuggagaacgacaugaaguucaccgugguugucggggacguggcggguauccuggcccaggguaaaaagaugauccggccccagccaauggaguacaaguacaguuggaaguccuggggcaaggccaagaucaucggggccgacgugcaaaacacgaccuucaucaucgacgggccaaacaccccggaguguccggacgaccagcgcgcauggaacaucugggagguugaagacuacggcuucgggaucuucaccacgaacauauggcuuaagcugcgggauuccuauacccaggugugcgaccaccgcuugaugagcgccgccaucaaggacuccaaagcugugcacgccgacaugggcuacuggaucgaaagcgagaagaacgagaccuggaaacucgccagagcauccuucaucgaggucaagaccugcaucuggcccaagagccacacgcugugguccaacggcguguuagagagcgagaugaucauucccaagaucuacggcgggccgaucucccagcacaacuaccgccccggguacuucacacagaccgccggcccguggcaccucgggaaacuggagcuggacuucgacuuaugcgagggcaccacgguggucguggacgagcauugcggcaaucgggggccgagccugcgcaccaccaccgugacgggcaaaaucauucacgaauggugcugccgguccugcacccugccgccccuucgcuucaagggggaggauggcugcugguacgggauggaaauccggcccgucaaggaaaaggaggagaaucugguuaagagcauggugagcgccggcuccggcgaggucgacagcuucucccugggucuacugugcauuagcaucaugaucgaggaagugaugcgcucccgguggucccgcaagaugcugaugaccgguacccucgccguguucuuccugcugaucauggggcagcucacguggaaugaccugauccggcugugcaucauggucggcgcgaacgccuccgaccgcauggggauggggaccaccuaccucgcccugauggccaccuucaagaugcgcccgauguucgccgugggccuccuguuccggcgccuuacgagccgggaggugcugcuccugaccaucgggcugagccucgucgcgagcguugagcugcccaacucgcuggaagagcuaggcgauggccuggccaugggcaucaugauccugaagcuccugaccgacuuccagagccaccagcugugggccacacuccugucccugacguucaucaagaccaccuuuagccuccacuacgccuggaagacgauggcgaugguccuguccaucgugagccuguuuccccucugccuguccacgaccagccagaagaccaccuggcugcccguccuccugggcucccugggcugcaagccgcucaccauguuccugaucgccgagaacaagaucuggggccgcaagagcuggccccuuaacgaggggauaauggccgucggcaucgucagcauccuccuuuccagccugcucaagaacgacgugccccuggccgguccccugauagccggcggcaugcucaucgcguguuaugucaucuccggaagcuccgccgaccuaucgcuugagaaggccgccgagguguccugggaggaggaggccgagcacagcggcgcuucccacaacauucucguggagguccaggacgaugggaccaugaagauaaaggacgaggagcgggacgauacccugaccauccugcucaaggccacccugcucgccgugagcgguguguacccgcucucaauacccgccacgcuguucgucugguacuucuggcagaagaaaaagcagcguagcggggugcugugggacacucccagcccgcccgaaguggagcgcgccguccucgacgacggcaucuaccgcaucaugcagcggggccuccugggacgcagccaagugggcgucggcguauuucaggaaaacguguuucauaccauguggcacgugacccggggcgcgguccugauguaccaggguaagcgacuggagcccuccugggccagcgugaagaaggaccugaucuccuacggcggcggguggagacugcaaggcagcuggaacacgggggaggagguacaggucauagcaguggagcccggcaagaaccccaagaacgugcagaccgcccccggcaccuucaagaccuccgagggggaggucggcgccaucgcgcucgacuucaagccugggacgagcggcucgcccauagugaaccgcgaggggaagaucgugggccuguacggcaauggggucgugaccaccucaggaaccuacgugagcgccaucgcccaagccaaggcgucucaggaggguccccugccugaaauugaggacgaggucuuccggaagcgaaaucucacgaucauggaccuucaccccggcagcggaaagacacgccgcuaccugcccgccauugugcgggaggccauaaagcgcaagcuccggacgcugauccuugcccccacccgcguggucgccuccgagauggcggaggcucucaagggcaugcccauacgcuaccagacgaccgccgucaagucugagcacaccggcaaggagaucguggacuugaugugucacgccaccuucaccaugcggcugcucucccccguccgcgugcccaacuacaacaugaucaucauggaugaggcccacuucaccgacccgagcuccaucgcggcccggggguacaucagcacacgggugggaaugggcgaagccgccgccaucuucaugaccgcgacgccacccggcuccgucgaggccuucccccagucgaacgccgugauucaagaugaggagcgggacaucccggagcgcuccuggaacaguggguacgaguggaucaccgacuuccccggcaagaccgugugguuuguccccuccaucaagagcggaaacgacaucgccaacugcuuacggaagaacgggaagcgcgugauccagcugucccgcaagaccuucgacacggaauaccaaaagacaaagaacaaugacugggacuacguggucaccaccgauaucagcgagaugggcgcgaacuuccgcgccgaccgcgugauugaucccaggcggugcuuaaaaccggugauccugaaagacgggcccgagcgcguuauccuggccggcccgaugcccgugacggucgccuccgccgcgcaacggagggggcggaucggcaggaaccacaacaaagagggcgaccaguauaucuauauggggcagccgcucaacaacgacgaggaccacgcccacuggaccgaggccaagaugcugcuggacaacaucaacacgcccgagggcaucaucccggccuuauucgagcccgagcgggagaaauccgcggcuaucgacggggaguaccgccugcgcggcgaggcucggaagaccuuuguggagcugaugcgccgcggggacuuaccggugugguugucuuacaaggucgcauccgagggcuuccaguacagcgaccgccgguggugcuucgauggcgagcgcaacaaccaggugcuagaggagaacauggacguggagaucuggacgaaggagggggagcggaagaagcuccgcccccggugguuagaugcccgcacauacuccgacccccuggcccuccgggaguucaaggaguuugcggccggccgccggagcgucuccggggaucuaauacuggagaucggcaagcucccccagcaccugacgcagaaggcccagaacgcccuggacaaccucgugaugcugcacaacagcgaacagggagggcgcgcguaucggcacgccauggaggagcugccggacaccaucgagacgcucaugcugcuggcccucaucgccgugcugacggggggcguaacccuguucuuccucuccggcagggggcugggcaaaaccagcaucggccuacugugcgugauggccuccucggugcugcucuggauggcguccgucgagccacacuggaucgccgccagcaucauccucgaguuuuucuugauggugcugcucauucccgagcccgaccgacagcgcaccccgcaggacaaucagcuggccuacguggucaucgggcuccucuucaugauccuaacgguggccgcgaacgagaugggccugcucgagacuaccaagaaggaccuggggaucggccacguagccgucgagaaccaccaccacgcggccauguuggacguugaccuccaccccgccuccgcguggacccuguacgccguggcaacgacgauuaucacccccaugaugaggcacaccaucgagaacacgaccgcaaacaucagccugacagccaucgcgaaccaggccgccauccucauggggcuggacaagggcuggccgauuuccaagauggacaucggcgucccccugcucgcccuggggugcuacagccaggugaauccccugacccucacggcggcggugcuaaugcuggucgcccacuacgcuaucaucggccccgggcuccaggccaaggcgacccgcgaggcccagaagcggaccgccgcugggaucaugaagaacccgaccguggacgggaucguggccauugaccuggaccccgucguguacgacgcgaaguuugagaagcagcugggccagaucaugcuccugauccuuugcacgagucagauccuacugaugcgcaccaccugggcacucugcgagagcaucacccucgccacgggaccccugaccacccugugggaggggucccccggcaaguucuggaacaccacuaucgccgucagcauggccaacaucuucagggggagcuaccucgcgggcgccggccuggcauuuucccugaugaagucucucggcggcggucggcgcggcaccggggcccagggugagacccugggagagaaguggaagcggcaacugaaccagcucaguaagagugaguucaacaccuacaagcgcuccgggaucauggaggucgaccggagcgaggcgaaggagggccugaagcgcggggagacgaccaagcacgcgguaucaaggggcaccgccaagcugcgcugguucguggagcgaaaucucgucaagccggaggggaaggucaucgaccugggcuguggccgcgggggcuggagcuacuacugcgccggacugaagaagguuacugaagucaagggcuauacaaagggcgggccgggucacgaggagcccauccccauggccacuuacggguggaaccuggugaagcuccauuccggcaaggacguguucuucaucccgcccgaaaagugcgacacccugcugugcgauaucggggaaagcucacccaaccccaccaucgaggagggacggacgcuccgcgugcugaagaugguggagccguggcugcgggguaaccaguucugcaucaagauccucaacccuuacaugcccaguguagucgagaccuuggaacagaugcagcgcaagcacggcggcaugcuggugcggaacccccucucccgcaacagcacccacgaaauguacuggguguccugugguacgggcaacaucguaucagcgguuaacaugaccucccggaugcuacugaaccgcuucacgauggcccaucggaagccgaccuacgagcgggacguggaccucggggccggcacccgccacgucgccguugagcccgaggucgccaaccuggacaucaucggacagcggaucgagaacaucaagcacgagcacaagagcaccuggcauuacgacgaagacaaccccuacaagaccugggcguaccacggguccuacgaagucaagcccagcggcagcgccuccucuauggugaacggagucgugaagcuguugacgaagccaugggacgugauccccaugguaacccagaucgccaugacagacacgacgcccuucggccagcagcgcguauucaaggaaaagguggacacccggacccccaaggccaagcgcgggacggcccagaucauggaggucaccgcuaaguggcuguggggcuuccugucccggaacaagaagccucgcaucugcacccgggaggaauucacacguaaagugcggagcaaugccgcgaucggcgccguauucguggacgagaaccaguggaacuccgcgaaggaggccguggaagacgagcgcuucugggaccucguucaccgggagcgcgagcugcacaagcaggggaagugcgccacgugcguguacaacaugaugggcaaacgggagaagaagcugggggaauucggcaaggccaagggcagccgcgccaucugguacauguggcucggcgcgcgguucuuggaguucgaggcucuggguuucaugaacgaagaccacugguucucccgcgagaacagccucucugggguggagggcgaggggcugcacaagcugggauacauccuccgggacaucagcaaaaucccaggggguaacauguacgccgacgacaccgccggcugggacacccgcaucaccgaggaugaccugcagaacgaggccaagaucacggacauaauggagcccgagcacgcgcuucuagccaagucaaucuucaagcugaccuaccagaauaaggugguccgagugcagcgcccggcaaagaacgggaccgugauggaugucaucagccggcgcgaccagcgcggcuccggccaggugggcacauauggccugaacacguucaccaacauggaggcccagcucauccggcagauggagagcgaagggauauuuucgcccagcgaacuggagaccccuaaccuagccggccgcgugcucgacuggcuggagaagcacggggucgagcggcugaagcgcauggcgaucagcggagacgacuguguggugaagcccaucgacgaccguuucgccaccgcccucacugcccugaacgacauggggaaggucaggaaggacaucccgcagugggagcccaguaagggcuggaacgacuggcagcagguccccuucugcucacaccacuuucaccagcuuaucaugaaagacggccgcgagaucguggucccaugccgcaaccaggacgagcucguggggcgagccagggugucccagggcgcgggcuggagccugcgcgagaccgccugccugggcaaguccuacgcccagauguggcagcucauguacuuccaccgccgggacuuacgccuggccgcgaacgccaucugcagcgccguccccguggacugggugcccaccucccggaccacguggagcauccacgcccaccaucaguggaugaccaccgaggacaugcucuccgucuggaaccgcguguggauugaggagaaccccuggauggaggacaagacacacaucucguccuggggcgacgugccauaccuaggcaagcgggaggaccaguggugcggcucgcuuauugggcucacggcccgcgcgacgugggccaccaacauccaggucgccauaaaucaggugcgccgccugaucggcaaugagaacuaccuggacuacaugacuuccaugaagcgcuucaaaaaugagagcgacccggaaggggccuugugguga

SEQ ID NO: 24167 - RNA, 9879 nt, Artificial Sequence
  derived and/or modified CDS sequence (opt11) from DENV-1__FJ432736__SS-prME
agcgugaccaugcuccugaugcugaugcccaccgcacuagcuuuccacuugacuacccgcggaggggagccgcauaugaucguaagcaaacaggagcggggcaagagccugcuguucaagaccuccgcaggggugaacaugugcacacucaucgccauggacuuaggcgaacugugcgaggacaccaugaccuacaagugcccgcgcauaaccgaggccgagccagacgacguugauugcuggugcaacgcaaccgacacuugggucacauacgggaccugcagccagaccggcgagcaccggcgcgacaagcgguccguggcacucgcgccgcacgugggcuuagggcuggaaacgcgcaccgagaccuggauguccagugaaggcgccuggaagcagauccagcggguugagaccugggcccuccgucaccccggguucacggugaucgcacuguuccuggcccacgccaucggcaccagcauaacccagaaggggaucauuuucauccuccuuaugcuugugacccccucaauggcuaugcggugcgucgguaucgguagucgcgacuucguggaggggcucuccggcgccacguggguggaugucgugcuggagcacgggagcugcgucacaaccauggccaaagacaagcccacacuggauaucgagcuccuaaagacggaggucaccaaccccgcgguguuacggaagcucuguaucgaggcuaagaucaguaacaccaccacggacagccggugcccgacccaaggcgaggccacccugguggaggagcaggacgccaacuucgucugccgccguacguucgucgacagaggcugggggaacggcugcggacuguucggcaaggggucccuaaucacgugcgccaaauucaagugcgugaccaagcuggaaggcaagauuguacaauacgagaaccuuaaguacagcgugaucgucaccguccacacgggcgaccagcaccaaguggggaacgaguccacggagcauggcaccaccgcgaccaucacuccccaggccccaacgaccgagauccagcucaccgacuauggggcucugacccuggacugcagccccagaacgggccuugacuuuaaugagaugguucugcugaccaugaaggagaaguccuggcuggugcacaagcagugguuccuggaccuuccgcuccccuggaccagcggggccagcaccucucaggagacguggaaccggcaagaccuguugguuaccuuuaagaccgcccacgcgaagaagcaggaggucgugguucucggcagccaggagggcgccaugcauaccgcucugacaggugccaccgagauucagaccuccggcaccacgaccaucuucgccgggcaccuaaagugccgcuuaaaaauggacaagcuuacccugaagggcaugagcuacguuauguguaccggguccuucaagcucgaaaaggagguggcggaaacccaacacggcaccgugcugguccagaucaaauacgaaggcaccgaugcccccugcaagauccccuucuccacccaggacgagaagggggugacgcagaauggccggcugaucaccgcuaacccgaucgugacggacaaggagaagcccgucaacaucgaggccgaaccgcccuucggggaaucguauaucgugaucggcgcgggcgagaaggcacugaaguugaguugguucaagaagggguccagcaucggcaagauguucgaagccaccgcccgcggggcgcggcgcauggcgauacugggcgauacagccugggacuucggguccaucggcggcguguucacgucggucgguaagcugauccaccaaaucuucggaacagcauacgggguccuguucaguggagugaguuggaccaugaagaucgggaucggcguccugcugacguggcucggccuaaacagucgcagcacgucccucucaaugaccugcauagccguggggcucgugacccucuaucugggcgugauggugcaggccgacuccggaugcgugaucaacuggaaaggccgggaguugaaaugcgggagcggcaucuucgucacgaacgaggugcacaccuggaccgagcaauauaaguuccaagcggacagcccuaagcgccugucagcggccaucggcaaggcgugggaggaaggggugugcggcauacggagcgccacccgcuuggagaacaucauguggaagcagaucuccaacgagcucaaccacauccugcuggagaacgacaugaaacuaaccgucguggugggagacgucgcuggcauccuggggcagggcaagaagaugauccguccccagccuauggaguacaaguauagcuggaaguccuggggaaaggccaagaucaucggcgccgaugcccaaaacacgacauucaucauagacggccccaacaccccggagugccccgacgaccagcgcgcguggaacaucugggaaguggaagacuacggguuuggaaucuuuacgacgaacaucuggcugaagcuccgcgacagcuacacccaagugugcgaucaccgccugauguccgccgccaucaaggauagcaaggccguccacgccgacaugggcuacuggaucgagucggagaagaacgagaccuggaagcuggcgagggccucguucaucgagguuaagaccugcaucuggcccaagucccacacgcucuggagcaacgggguccuggagagugagaugaucauuccuaagauauacggagggccgaucagccagcacaacuaucgucccggcuaccuaacccaaaccgccggucccuggcaccucggcaaacuggagcuggauuucgaccucugcgagggaacgaccgucgugguggacgagcacugcgggaacaggggcccaucccugaggaccaccaccgucacaggaaagaucauccacgagugguguugccgcucuugcacccuacccccacugcgcuuccggggcgaggacgggugcugguacggcauggagauccgccccgugaaggagaaggaggagaacuuggugaaaucgaugguuucagccggccccggggagguugacagcuuuucccuaggccuucugugcaucucuaucaugaucgaggaggugaugcggucccguuggagccggaagaugcugaugaccgguacccucgccgucuucuuccugcuuaucaugggccagcucacguggaacgacuuaauccgucuaugcaucauggugggggcgaacgccuucgaccgcauggggaugggcacaacguaccucgcccugauggccaccuuuaagaugcggcccauguucgccgugggacuccuauuccgccggcugacgucccgcgagguucuucuccucacgaucggccugagccucguggcaaguguagaguuacccaacagccuggaggaacucggggacggccuggccaugggcaucaugauucugaagcuccugaccgauuuccagagucaccagcugugggccacccugcugagccugaccuuuaucaagaccaccuucucccuccacuacgccuggaagaccauggcgauggugcugagcaucgucucccuguucccccucugucuguccacgaccucccagaagaccacuuggcuccccguccuucuggggagccugggcugcaagccccucacgauguuccugauugccgaaaacaagaucugggggcggaaauccuggcccuuaaacgagggcaucauggccgugggaauagugucuauccuccuguccucgcugcucaagaacgacguuccacuggccggcccgcuaaucgcaggcggaaugcucaucgcguguuaugugaucagcgguaguagcgccgaccuuucccuggagaaggcggcagaagugagcugggaggaggaggcagagcacuccggggcgucgcacaacauccuaguugaggugcaggaugacggcaccaugaagaucaaggaugaggaacgcgacgacacgcugaccauucugcuuaaggccacacugcuggccgugagcggcguauacccccucagcauccccgccacgcuauucgugugguauuucuggcagaagaagaaacagcggucuggcguguugugggacacccccagcccgcccgagguugagcgggccgugcuggacgacggcaucuaccggaucaugcagcgcggccuccugggccggucccaggugggggucggcguauuccaggagaauguguuucacaccauguggcacgucacccgcggggcggugcugauguaccagggcaagcggcucgaacccagcugggccuccgugaagaaggacuuaaucucauacggcggggguuggcgcuuacgggggucauggaacacaggcgaggagguccaagugaucgccguggagcccgggaagaacccaaagaauguccagacugcccccggcaccuucaagacccccgagggcgaggugggugcaaucgcgcucgacuucaaacccggcacaucgggguccccgauugugaaccgcgaggguaagaucgucggccuguacgggaacggcgucgugaccaccucugggaucuacgucuccgcaaucgcccaggcgaaggcgagccaggagggcccccuccccgaaaucgaggacgagguguuccggaagcgcaaccucaccaucauggaccugcauccggggagcgguaagacgcggagguaccugcccgcuaucgugcgggaggccaucaaacgcaagcugcgcacccugauacuggccccaacccgcgucguggcuuccgagauggccgaagcucucaagggcaugcccauucgcuaccagaccacggccgucaagucagagcacaccgggaaggagaucgucgaccugaugugccacgccaccuucaccaugcggcugcucucgccggugcgggugcccaacuacaacaugauaaucauggacgaggcccauuuuacggaccccucauccaucgcggcccggggcuacauaagcacccgcgucgggaugggcgaggccgcugccaucuucaugaccgcgacgccgcccgggucuguggaggccuucccccagagcaacgccgugauccaggaugaggagcgggacauucccgagagauccuggaacagcggucacgaguggauuacggacuuccccggcaagaccgucugguucgugcccuccaucaagagcgggaacgacauugccaacugccugcguaagaacggcaagcgcgugauccagcugagccggaagaccuuugacaccgaguaccaaaagacgaagaacaacgauugggacuacguugucacgaccgauauaagcgagaugggcgcgaacuuccgcgcugaccgggugaucgauccccgccggugccuuaagcccguaauccugaaggacgggcccgagcgcgugauccuggccgguccuaugccggugaccgucgccuccgccgcgcagcggcgcggccggauaggccgcaaccacaacaaggagggggaccaguacaucuacaugggccaaccccucaacaacgacgaagaccacgcccacuggacggaggccaagaugcugcuggacaacaucaacacccccgaggggauaaucccagcccucuucgagcccgagagggagaaguccgccgcggucgauggcgaguauagacugcgaggggaagcgcggaagaccuuugucgaacugaugcgccgcggcgaccuccccguuugguuauccuauaagguggcgagcgagggguuccaguacagcgaccgcagguggugcuucgauggggagagaaacaaucagguccuggaggagaacauggacguggagauauggaccaaggagggcgagcggaaaaagcuccgcccacgauggcuggacgcgaggacguacagcgacccgcucgcccuacgggaguuuaaggaguucgcggccgggcgacggagcguguccggcgaccugauacuggagaucggcaagcucccucagcaccugacccaacgcgcucagaacgcccuggacaaccucgucauguugcauaacucugagcaaggcgggcgugcguacaggcacgccauggaggagcugcccgauaccauagagaccuugauguuacuggcccugaucgccguacugaccggcggcgugacucuguucuuccucuccgggcggggccuggguaagaccagcaucgggcugcucugugugauggccuccagcgugcuucuguggauggcguccguggagccccacuggaucgcagcgagcaucauucucgaguucuuccugaugguacugcucaucccggaacccgaccgccagcggacgccccaggacaaccagcuggccuacguggugauugggcuccucuucaugauccugaccgucgcagcgaacgaaauggggcugcucgagacgaccaagaaggauuuagggaucgggcacguggccguggagaaccaucaccacgccgcaaugcuggacguggaccuccacccugcauccgcguggacacuguacgccgucgccaccacgaucaucacccccaugaugcgccacaccaucgagaacaccacggccaacaucucacugaccgccaucgcgaaccaggccgccauacucauggggcuggacaagggcuggccuaucuccaagauggacauugggguaccauugcucgcccuggguugcuauagccaagugaacccgcuaacucucacagcggccgugcugaugcugguggcccacuacgccauaaucgggcccggucuccaggcuaaggcgacgcgcgaggcccagaagcggaccgcugccgggaucaugaagaauccuacagucgauggcaucguggcaauugaccuggacccugucgucuacgacgcaaaguucgagaagcaauuaggccagaucaugcucuuaauccuguguaccagccagauccuccugaugcgcacgaccugggcccucugcgagagcaucacccucgccaccgggccgcucacgaccuuaugggaaggcucgcccggaaaguucuggaacaccacuauagcuguuagcauggccaacauuuuucggggcuccuaccucgcgggcgccgggcuggccuucagccugaugaagucccucggcgggggccgccgagggacgggcgcacagggcgagacccugggagaaaaguggaagcgacaacugaaucagcucagcaagagugaguucaacacuuacaagcgguccggcauuauggagguggaccgcucugaagcgaaggaggggcugaagcggggcgagacaacgaagcacgccgucucccgcgggaccgcuaaacuccggugguucguggagcgcaaccuugugaagcccgaggguaaggucaucgaccucggcugcgggcggggcggguggaguuauuauugcgccggccugaagaaagugaccgaggugaagggcuacacuaagggcggccccgggcacgaggaaccgauacccauggccacauacggguggaacuuggucaagcuucacuccgggaaggacguguucuuuaucccgcccgaaaagugcgauaccuugcugugcgacaucggcgagagcuccccaaaccccacaaucgaggaggggcgcacccuccgggugcugaagauggucgaaccguggcugcgcggcaaccaguucugcaucaagauucucaaccccuacaugccaagcgucguggagacgcuggaacagaugcagcggaaacacggcggaaugcugguucgcaacccucucagucggaacagcacgcacgagauguacuggguguccugcgggaccgggaauaucgugagcgcggucaacaugaccucccgcaugcugcugaacagauucaccauggcccacagaaagcccacguacgagcgcgacguggaccucggcaccgguacccggcacguggccgucgagccugagguggccaaccuggacaucaucgggcaaaggauugagaacaucaagcacgagcacaagagcaccuggcauuacgacgaggacaacccguacaagacgugggcguaccacgguuccuacgaggugaagccaagcggguccgcgagcuccauggucaacggcguggucaaacugcugacuaagcccugggacguuauccccaugguaacacaaaucgcaaugaccgacacgaccccguucgggcagcagcgggucuucaaggagaagguggacacccggaccccaaaggccaaacguggcacggcccagaucauggagguaacugcccgcuggcuguggggcuuccugagccggaacaagaagccccgcaucugcacccgggaggaauuuacccgcaagguccggagcaaugcugccaucggugccguguucguggacgagaaucaauggaauuccgccaaggaggccgucgaggacgagcgcuucugggaccuugugcaucgggagcgcgaacugcacaagcagggcaaaugugccacguguguguacaacaugauggggaagcgggagaagaagcugggcgaauucgggaaggccaagggcagccgcgccaucugguacauguggcucggcgcucgcuuccuggaguucgaggcgcugggguucaugaaugaggaccacugguucucccgcgagaacagcuugucuggugucgagggggagggcuugcauaagcugggcuacauccuccgggacaucagcaagaucccggguggcaacauguacgccgaugacaccgccgggugggacacucgcaucaccgaggaugaccugcagaacgaggcuaagaucacggacaucauggagcccgagcacgcccugcuagccaaagccaucuuuaagcugaccuaccagaauaagguggugcgcguccagcggccagcuaagaacggaaccgugauggacgugaucucccgccgugaccagcgugguagcggccagguagguaccuacgggcugaacacguucaccaauauggaagcccagcuaauccggcagauggagucagagggaaucuucagccccuccgagcuugagacgccgaaucuugccgagcgcgcccucgacuggcuggagaaguacgguguggaacggcugaagcgcauggcuaucagcggcgacgacugcgucguaaagcccaucgacgaccgguucgccaccgcccucacggcccugaacgacauggggaaggucagaaaggacauuccccagugggagcccuccaagggcuggaaugacuggcagcagguuccguuuugcagccaccacuuccaucaauuaaucaugaaggacggccgggagaucgucgugcccugccgcaaccaagacgagcucguggggcgggcacgcgucucgcagggagccggguggucucuucgugagaccgcgugccugggcaaguccuacgcccaaauguggcagcucauguacuuucaccgccgggaccugcgccuggcagccaacgccaucugcagcgccgugcccguggacuggguuccaaccagccgaaccaccuggaguauacaugcccaccaccaguggaugaccaccgaggacaugcucagcguauggaaccgcguguggaucgaggagaacccguggauggaggacaagacccacaucuccagcugggaggacgucccuuaccuggggaagcgcgaggaccaguggugcggcucccugaucggccucacggcgcgggccaccugggccacgaacauccagguggccaucaaucagguccgcaggcugaucggaaacgaaaacuaccuagacuacaugacaaguaugaagcgcuuuaagaaugaauccgaccccgagggcgcgcucugguga

SEQ ID NO: 24168 - RNA, 9879 nt, Artificial Sequence
  derived and/or modified CDS sequence (opt11) from DENV-1__FJ410198__SS-prME
ucggugaccaugcugcucaugcugaugccaaccgcccuggccuuccaccucaccacaagagggggugagccccacaugaucgugagcaaacaggagcggggcaagagccuccuguucaagaccucggccggggugaacaugugcacccucaucgcgauggaccugggcgagcugugugaggacaccaugaccuacaagugcccccggaucaccgagaccgagcccgacgacguggacuguuggugcaacgccaccgacaccugggucaccuacggaaccugcagccagacgggcgagcacaggcgcgacaagcgguccguggcacucgcgccccacgucggcuuggggcucgaaacccgcaccgagaccuggaugagcuccgagggcgcguggaaacaaauccagcggguggagacgugggcauuaaggcaucccggguucaccgugaucgcccuguuccuggcccacgcgaucggcacaagcaucacgcagaaagggauuauuuucauccuccugaugcuggucacgcccuccauggccaugcguugcguaggcaucggcagccgggacuucguggaggggcucucaggcgccaccuggguggacgucgugcuggagcacgggagcugcgucacgaccauggccaaggacaagcccacgcuggacaucgaguuacugaagaccgaggugaccaaccccgccguguuacggaagcuaugcaucgaggcgaagaucuccaacacaacgaccgacuccaggugcccgacccagggggaggcaaccuugguggaggaacaggaugccaacuucgucugccggcgcacguucgucgaccggggcugggggaaugggugcgggcuguucggcaaggggagcuugaucacgugcgccaaguuuaaaugcgugaccaaguuggagggcaagaucguccaguacgagaaccuuaaauauagcgugaucgugaccguccacacgggggaucagcaccaggucgggaacgaguccacggagcacgguacuaccgccaccaucacgccccaggcgcccaccaccgagauucagcucaccgacuacggcgcccucacgcuggacugcagcccccgcaccggccucgacuucaacgagaugguccugcugacgaugaaggagaaaaguuggcucgugcacaagcagugguuucuggaccugccccuccccuggacuagcggggcaagcacaagucaggagaccuggaaccgccaagaccuccugguuacuuucaagaccgcacacgcaaagaagcaagaggucguggugcucggcagccaggagggcgcaaugcacacggcccugacuggcgccaccgagauccagaccuccgguacgaccacgauauucgcagggcaucuuaagugccgccucaagauggacaagcucacgcugaagggcaugucguacgucaugugcacggggucguucaagcucgagaaggagguggccgagacucagcacggcaccguguuagugcagaucaaguacgaagggacggacgcgcccugcaagaucccauucagcacgcaggacgagaaggggguuacccagaacggccggcugauaaccgccaacccgaucgugaccgacaaggagaaacccguaaacauugaggccgaaccgcccuucggggaguccuacaucgugauaggcgccggcgagaaggcgcuuaaacuuagcugguucaagaaggggucgagcaucgguaagauguucgaggcuaccgccagaggggcccggcguauggccaucuuaggcgacacggcgugggauuucggguccaucggcggcguuuucaccucagucgggaagcugguacaccagauuuucgguaccgccuacgggguccucuucuccggcgucagcuggacaaugaagaucgggaucggcguguuauugaccuggcucggccugaacucacgcagcaccucccugagcaugacaugcaucgccgugggccucguaacgcuguaccugggcguaauggugcaggccgacuccgggugcgucauuaacuggaagggccgggagcucaagugcggcuccggcaucuucgugaccaacgaggugcacaccuggaccgagcaguauaaguuccaggcggacuccccgaagcgacugucagcggccauugguaaggccugggaagaagggguaugcggcauccguagcgcuacccgccuggagaacaucauguggaagcagaucuccaacgaacucaaccacauccuccuggagaacgauaugaaauucacgguggugguaggggacguggccggcauccucgcgcaggggaaaaagaugauccggccccagcccauggaguacaaguacagcuggaaguccuggggcaaggcuaagauaauuggggccgacgugcagaacaccaccuucaucaucgacggaccgaauaccccggaauguccugaugaucagcgugcauggaacaucugggaggucgaggacuacggcuucggcauuuucacgacgaacaucuggcugaagcugcgggacagcuacacccaggugugugaccaccgccuaaugucggcggccaucaaggacucuaaggccgugcacgccgacaugggcuacuggaucgaguccgagaagaacgaaaccuggaagcuagcccgggccagcuuuaucgaggucaagacgugcauauggccaaagucccacacccuguggagcaacgggguacucgaaagcgagaugaucauccccaagaucuacgggggcccgauuagccagcacaacuaccgccccggauacuucacccagaccgccggccccuggcaccuggggaagcuggaguuggauuucgaucugugcgaaggcacaacagucgucgucgacgaacacugcggcaaccgggggccgucccuccgcacgaccacggugaccggcaagaucauccacgaguggugcugccgaagcugcacacugccuccccuccgcuuccgcggagaggacggcuguugguacgggauggagauccgcccagucaaggagaaggaggagaaccuggucaaguccauggugagcgcuggcagcggagaggucgacuccuucagccucgggcuccugugcauuuccaucaugauagaggaggugaugcggagccgcuggucccggaaaaugcucaugaccggcacgcuggccguguucuuucugcucauaauggggcaacugaccuggaacgaccucauccgccucugcaucaugguaggcgcgaacgcgagcgaccgaauggggaugggcaccaccuaccuugcccugauggccacguuuaagaugcguccaauguucgccgugggguugcuguuccgccggcugacuucccgcgaggugcuccugcugaccaucgggcuuucacuggucgccucuguggagcuucccaauagccucgaggagcugggagacggccuggcgaugggcaucaugauccucaagcugcugaccgacuuccagucccaccagcucugggccacgcugcugagccucaccuucaucaagaccaccuucuccuugcacuacgccuggaagacgauggccaugguccugagcaucgugagccucuucccccucugccucagcaccacgucacagaagaccacguggcuccccgugcugcuggguagccucgggugcaagccacugaccauguuucucaucgcugagaacaagauaugggggcggcgcaguuggccccucaacgaggggaucauggccguuggaauugugucaauccugcugagcucccuacucaagaacgacgugccccuggccgggccccuaaucgccggcggcaugcugaucgccugcuaugucaucagcggauccucggcggaccugucccucgagaaggccgccgaaguguccugggaggaggaagccgagcacagcggcgcuagucacaacauccugguugagguucaagacgaugggaccaugaagaucaaggaugaggaacgggacgacacccugacgauccuacugaaggcgacguuguuagccgucuccggcguguacccacucagcauccccgcaacacuguucguuugguacuucuggcaaaagaagaagcagcggucaggggugcucugggauacccccagcccgcccgagguuggccgagccguccuggacgacggaaucuaucgaaucaugcagagagggcuccuuggucgcucucaggucggggugggagucuuccaagagaacguauuucacaccauguggcacguuacuagaggggccguucucauguaccagggcaagcgccuggagcccagcugggcguccgugaagaaagaccugaucagcuauggcggcggcuggcgguuacaggggaguuggaacaccggagaggaggugcaggucaucgcuguggagcccgggaagaacccaaagaaugugcagacagcccccggcaccuucaagacgcccgagggcgaggucggggcaaucgcccuggacuucaagcccggcaccagcgggucucccauuguuaaccgcgagggcaagaucgugggccuguauggaaacggcgucgugaccaccagcgggacuuacgugagcgcgaucgcccaggccaaggccucccaggagggcccccuccccgagauagaggacgagguguuccggaagcgcaaucugaccaucauggaccugcacccaggaucuggcaaaacccggcgcuaccucccggcgauugugcgagaggccaucaaacgcaagcugcggacccugauccucgcccccacgcggguugucgcaucagaaauggccgaggcguugaagggcaugccaauccgcuaucagaccaccgccgucaagagcgaacacaccgggaaggaaauuguggacuugaugugccacgccacauucaccaugcgguugcuguccccugucagagugccgaacuacaacaugauuaucauggacgaagcccauuuuaccgacccuagcuccaucgccgcgcggggcuauaucagcacccgcguggggaugggcgaggccgccgccaucuucaugaccgccacgccgcccgggagugucgaggcguuuccacaaagcaacgcugugauucaagacgaggagcgagacauccccgaacgcuccuggaacagcggguacgaguggaucaccgacuuccccggcaagaccgugugguuuguccccuccauaaagagcgggaacgacaucgccaacugccuucggaagaacggcaaacgcgugauccaacucucccggaagacguucgacacggaguaccagaagaccaagaacaacgacugggacuacguuguaacgacugacaucagcgagaugggggcgaauuuccgggcggaccgggugaucgacccgcgccgguguuuaaagcccgugauccugaaggacgggcccgagcgcgucaucuuagccgggcccaugccgguaaccguggccuccgccgcccagcgccgcggccggaucggccgcaaccacaauaaggagggcgaccaauauaucuacaugggccagccccugaauaacgacgaggaucacgcgcauuggaccgaagccaagaugcugcucgacaauaucaacaccccagaggggaucauccccgcccuuuucgagccggaacgcgagaaguccgcugccaucgacggcgaguaucgccugcgcggugaggcgcggaagacuuucguggagcucaugcgccggggcgaccugccuguguggcuguccuacaagguugcuagcgagggcuuccaguauagcgaccgccggugguguuuugacggggagcgcaacaaccaggugcucgaggagaacauggacguugaaaucuggacgaaggagggagagcggaagaagcugcgcccacgguggcuagacgcccgcaccuacuccgacccccucgcccuacgggaguucaaggaguucgcggcggggcgcagaagcgucuccggcgaccuuauccuggagaucggcaaguugccgcagcaccugacccagcgcgcccagaaugcucucgacaaccuggugaugcugcacaacucagagcagggcgggcgggccuacaggcacgcgauggaggagcugcccgacacgaucgagacgcuuaugcugcuugcccugaucgccguacugacgggcggcguuacccucuucuuccuguccgggcgaggccugggaaaaaccagcauugggcuucugugugugauggccuccagcguacugcuuuggauggccuccgucgagccccacuggaucgcggccagcaucauccuggaguucuucuugaugguguuacugauccccgagccggacaggcagcggacgccucaggacaaucagcuggcuuauguggugaucggccuccuuuucaugauccuaaccguggccgcgaaugaaauggggcuccuggagaccacuaagaaggaucugggcauuggacacgucgcggucgagaaccaccaccacgccacuaugcucgacgucgaccugcaucccgccuccgcguggacccuguacgccguggcgaccacgaucaucaccccgaugaugcgccauaccaucgagaacaccaccgccaacaucagcuugacggccaucgccaaucaagcugcgauacucaugggucucgacaagggcuggcccauaucaaagauggacaucggggucccucuccuggccuugggcugcuacagccaggugaauccccucacgcuuaccgccgccgugcugaugcucgucgcccacuacgcuaucauugguccaggucugcaggccaaggcuacacgcgaggcacagaagcggacggcggccggcauaaugaagaaccccaccguggauggcaucgucgccauagaccuggaccccguuguguaugacgccaaguucgagaaacagcucggucaaaucaugcugcugauccucugcaccucccagauccuucugaugcgcacgacgugggccuugugcgagagcaucacccucgcgaccggcccccugaccacgcucugggaaggcuccccgggcaaguucuggaacaccaccaucgccgucagcauggccaacauuuuccggggcuccuacuuggccggcgcaggccucgcguucagccucaugaagucccuuggcggaggccgcagagggaccggcgcgcagggcgagacccugggggagaaguggaagcgacagcucaaccagcuguccaagagcgaguucaacaccuacaaacggucggggaucauggaggucgaucgcagcgaggccaaggaggggcugaaacggggugagaccacaaagcacgccgugucccgcgggacggcgaagcuccggugguucguggagcgcaaccuggucaagcccgagggcaaggugaucgaccuggguugcgggcggggcggguggagcuacuacugcgccggccugaagaaggugaccgaagucaaaggguacaccaagggcggccccgggcacgaggagccuaucccgauggccacguacggauggaaucucgugaagcugcacucugggaaggacguuuucuucaucccgcccgaaaagugcgacacccugcucugcgacaucggcgagagcucccccaacccgaccaucgaggaggggcguacccugcggguccugaagaugguugagcccuggcuccgcggcaaccaguucugcauaaagauccucaaccccuacaugccgagcgugguggagacccuggagcagaugcaacggaagcacggcgggaugcuggugagaaacccgcuuuccaggaacagcacccacgagauguauuggguguccugcggcacggguaauaucgucagcgccgugaacaugaccucccgcaugcugcucaaucgcuucaccauggcccaccggaagcccaccuacgagcgggacguggaccugggugcgggcacgcggcacgucgccgucgagcccgaaguggccaaccuggacaucaucggucaacgcaucgagaacaucaagcacgagcacaagucuaccuggcacuacgacgaggacaaccccuacaagaccugggcauaucauggcuccuacgaggucaagccgagcggguccgccagcagcauggugaacggcgucgugaaguuacugaccaagcccugggacgugauccccauggucacgcagaucgcuaugaccgacaccacccccuuuggucagcagagaguuuucaaggagaagguggauacgcguaccccgaaggccaagcggggcaccgcccaaaucauggaggucaccgccaaguggcuguggggcuuucucucccgcaacaagaaaccacggaucugcacgcgcgaggaguucacccggaaggugcguucuaacgccgccaucggugccguuuucgucgacgaaaaccaguggaacucggccaaggaggcuguggaggacgagcgcuucugggaccuggugcaccgcgagcgcgagcugcacaagcagggcaagugcgcgaccugugucuacaacaugauggguaagcgcgagaagaagcucggcgaguucgggaaagccaagggcagccgggccauaugguauauguggcugggcgcccgcuuccuggaguuugaggcccucggguucaugaacgaggaccacugguucucccgcgaaaacucgcuguccggugucgaaggggagggccuucacaagcucgguuacauccugcgcgacaucagcaacauccccggcggcaacauguacgcagacgacaccgccgggugggacacccggaucacagaggacgaccugcagaacgaggcccgcauaaccgacaucauggagccagagcacgcccucuuagccaaguccaucuucaaacugaccuaccaaaacaaagucguccgcgugcaacggcccgccaagaauggcacggucauggaugucaucucgcgccgggaccagagagggucaggacaggugggcaccuacggacucaacaccuucaccaacauggaggcacagcucauacggcagauggaaagcgagggcaucuucuccccaagcgagcuggagacacccaaccucgcggagagggugcuggacuggcuggagaaguacggggucgagcggcucaagcgcauggcaaucuccggggacgacugcguggugaagcccaucgacgacagguucgccaccgcccugaccgcccugaacgacaugggaaaggugcgcaaggacauaccccagugggagccuucgaagggcuggaacgacuggcaacagguuccguucugcucccaccacuuccaccaacucaucaugaaagacggacgggagaucguggugccgugccgaaaccaagacgagcugguggggcgggcccgcgugagccagggugccggguggagccugcgggagacugcuugccucggcaaguccuacgcacagauguggcagcugauguacuuccaccgccgggaucugcgccucgccgccaacgccaucugcucggcgguccccguggacuggauacccaccuccaggaccaccugguccauccacgcucaccaccaauggaugacuacggaggauaugcuguccguguggaaucgcgucuggaucgaggaaaaccccuggauggaggauaaaacccacaucagcuccuggggcgacgugccguaccugggcaagagggaggaccaguggugcggcucacucaucggccugacugcacgggccaccugggcaacgaacauucagguggccauaaaccagguccgccggcugauaggcaacgagaacuaucuagacuacaugacguccaugaagcgcuucaagaacgagagcgaccccgagggcgccuuaugguga

SEQ ID NO: 24169 - RNA, 9879 nt, Artificial Sequence
  derived and/or modified CDS sequence (opt11) from DENV-1__FJ410199__SS-prME
agcgucacuaugcuccucauguuaaugcccacagcacuggcguuccaccugaccacaagagguggggaaccccacaugauagucaguaaacaagaaaggggcaaaucacugcuauucaaaaccuccgcuggagugaauaugugcacacuuaucgcuauggaccuuggggaguucugcgaagacacaaugacauacaaaugcccccggauaacugaagccgaaccugacgacgucgacugcuggugcaacgcaacagacacauggguaacauacggaacguguucccaaacaggcgaacacagacgagauaagcggagcgucgcacuugcgccccauguaggucuagggcucgaaacccggacagaaacguggaugucaagugaaggugccuggaaacaaauacagcggguugaaacaugggcgcuucgccacccuggauucacagugaucgcucuguuccuugcccacgcaauaggcacaucaauaacacagaaaggcaucaucuucauauuacuuaugcuaguaacacccagcauggccaugcgguguguggggauugguagcagggacuuuguggaaggccuguccggugcuaccugggucgacguaguacuggaacacggcucaugcguaacaaccauggccaaagauaaaccgacguuagacaucgaacuccuaaaaacagaagucacaaacccagccguccuacgcaagcuaugcaucgaagcuaagaucuccaacacaaccacagacuccagaugcccgacucagggggaagccacauugguggaggaacaggaugcgaacuuugucugucgucggacguucguagaccgaggauggggaaacgguuguggccucuucggaaaaggcagcuuaaucacgugcgccaaauucaaaugugucacaaaacucgaaggaaaaaccguccaauacgagaaccucaaguacuccgugaucgugacaguacacaccggggaccaacaccaggugggcaacgaauccacagagcacgggaccacggccacaaucacaccgcaagcaccgucuaccgagauacaacuaacggauuacggcgcgcuaacccuagacuguaguccccggacgggcuuagacuucaacgaaaugguacugcugacaaugaaggagaaaaguuggcuaguacacaagcaaugguuccucgaucuuccacuaccauggacaucaggagccuccacuagccaggagacauggaaccgaaaagaccucuuagugacauucaagacugcccaugccaagaaacaagaaguggucguguuggggagucaagaaggagccaugcauaccgcauuaacaggggcaacugaaauacagacaucaggcacaacgacaaucuuugcaggccaccucaaguguagacuuaaaauggauaagcuaacacugaaaggaauguccuacgucauguguaccggcagcuucaagcuagaaaaggaaguggcagaaacacagcacgguaccgugcucguucagaucaaguacgaaggaacagaugcgcccugcaagaucccauucagcacccaagaugagaagggcguaacacaaaauggccgacucauaacggccaacccaauagucacggacaaagaaaaaccagugaacauagaagcagaaccgccauucggagaaucuuacauagucauaggugcgggggaaaaggcccucaagcugagcugguuuaagaagggcuccucaauugguaagauguuugaggcgacagcccgcggggcccggcgcauggccauacucggagacaccgcgugggacuucggcucuaucgggggaguauucacaucagugggaaagcugguccaccaaauauuuggcaccgcuuacgggguccucuuuaguggcguaagcuggaccaugaaaauaggcaucggcguccuacugaccugguuaggccuaaacucccgcagcaccuccuuaagcaugacgugcauagcagucggguuagucacacuguaccuuggcgugaugguccaagccgacagcggcugcgucaucaauuggaaaggaagagaacugaagugcgguucagguauauucgugacaaacgaaguacauaccuggacggaacaauacaaguuccaagccgauagcccuaagaggcuaucggcugcaauuggcaaagccugggaggaaggaguaugugggauacgcucggcaacacgccuggagaacauaauguggaaacaaaucagcaacgaauuaaaccauauacucuuggaaaaugacaugaaguucacggugguaguaggcgacguggcaggaauccuagcgcagggaaagaaaaugauacgcccccagcccauggaauauaaauacagcuggaaauccuggggaaaagcuaaaauaaucggagcagacguucaaaacaccaccuucaucauugacggacccaacacaccggagugccccgaugaucaaagagcguggaauauaugggaagucgaagacuacgguuucgguaucuucaccacaaacauauggcugaagcuaagggacagcuauacccaggugugcgaucacaggcuaaugucugcagcgaucaaagauagcaaggcggugcacgcagacaugggguauuggaucgaguccgagaaaaaugaaaccuggaaguuggcccgugcauccuucauagaggugaagacaugcaucuggccuaaaagccauacccuauggaguaacggggugcucgaguccgaaaugaucauacccaaaaacuauggagguccaauaucacaacacaauuaucggccuggguacuuuacucaaacugcggggccuuggcauuuaggaaaacuagaacuagauuucgaccuaugcgaagggacaacugucgucguggacgaacacugcggaaaucgggggccaaguuugcgcacgacaacagucacagguaagauaauacacgaguggugcugccgaagcugcacccuuccgccacucagguuuaagggagaagacgggugcugguauggcauggagauucggcccgugaaagagaaagaggaaaaccuggucaaaucgauggugucagccggcucgggcgaggucgacuccuucaguuuaggauugcugugcauauccauuaugauagaggaggugaugcgcagccgauggucgagaaaaaugcugaugacaggcacacuagcgguccuguucuugcuaauaauggggcaguugacaugguccgaccucaucaggcucugcauaauggugggcgcaaacgcaagugaccggaugggaaugggcacgaccuacuuggcgcugauggcgaccuucaagaugagaccgauguucgcaguaggacuacucuucagaagacuaaccucaagggaagugcuccuccugaccaucggacuauccuuagucgcgagcgucgaacuaccaaacucucucgaagaauugggcgacggccuggcaaugggcauaaugauucucaagcuccugaccgacuuucagucacaucaacucugggcuacccuccuaucccucacuuucauaaaaacaaccuuuucgcuccacuacgccuggaaaacaauggcaaugguacuaaguauugucagcuuauucccgcuaugcuuaagcaccacuucgcagaaaacuacauggcugccagugcuccucggcucgcucggaugcaaaccacuaacuauguuccugaucgccgaaaacaaaauuuggggaaggaaguccuggccucuaaacgagggaauaauggcgguggggauagucagcauccuucugucgucauugcuaaagaacgacguaccauuagcaggaccacuuaucgcgggaggaaugcucaucgccugcuacgucauauccgggagcagcgcggaccucucacuagaaaaagccgcggaagucucaugggaagaagaagccgaacacagcggugccagucacaacauccucguagaggugcaagaugaugguacaaugaagaucaaggacgaggaacgagacgauacacucacgauacuacuuaaagccacucuccucgcgguauccgggguuuacccacugagcaucccugcaacacuauucguaugguacuucuggcagaagaagaaacaacgcagcggggucuuaugggacacuccaucaccgccagaagucgaaagggccguacuagacgacggcaucuacagaauaaugcagcgcggacuacucgggcgcucgcaaguagggguaggcguuuuccaagaaaacgucuuccacacaauguggcacgugacacgaggugcggugcuuauguaccaagggaaaagguuggaaccaagcugggcuucaguaaagaaggaccuaaucucuuacggugggggauggcgccuccagggcuccuggaauaccggugaagaaguucaaguaaucgcuguagaaccaggcaaaaaucccaagaacguccaaacggcacccggaacauuuaaaaccagcgaaggcgaagucggcgccauugccuuggauuucaaacccggaaccagcgggagccccaucgucaaccgagaaggaaaaauugucggccucuacggaaacgggguugucacgacgucggguacauauguaucggcgaucgcccaagcaaaagcaucacaggaggggccccuuccagagauagaagacgagguuuuccggaagcgaaaccugacaaucauggaccuucauccaggaucagggaagacgcggaaguaccugcccgccauagugagagaagcgaucaaaaggaagcugcgaacgcuuauccuggccccgacaagggucguugcaagcgaaauggccgaggcucugaaagggaugccaauacgauaccaaaccacggcggugaaaagcgagcacaccggaaaagaaaucguagaccuaaugugucaugcgaccuucacaaugcggcuacuaucucccgugcgcgucccaaacuacaacaugaucaucauggacgaggcacacuucaccgacccgaguagcauagccgcucgaggcuauauuagcacaagagucggaaugggagaagccgccgccaucuucaugaccgcuacaccacccggcuccguagaggcauuuccccagucuaaugccgucauacaggaugaagaacgcgacauaccagaacggaguuggaacagcgguuaugaguggaucacagacuuuccaggcaagaccgugugguucguaccuucaaucaagucuggaaacgacauagccaacugccugcgaaagaaugggaaacgcgugauccaacucucucgcaaaacauuugauacugaguaucagaaaaccaaaaacaacgacugggacuauguggugaccaccgacauaagcgaaaugggcgccaacuuccgugcugaucgcgugaucgacccccggcgcugcuugaagccaguaauccuuaaggaugguccagaacgagugauccucgcaggaccgaugccuguuaccguggcaucagcugcacaacgacgagggagaaucgggcgaaaccauaacaaggaaggagaccaauauauuuacauggggcaaccacuuaacaacgaugaagaccacgcccacuggacagaggcgaagaugcuacuagacaacaucaauacaccugaaggcauaauaccagcauuguucgaaccagaacgagaaaaaucagccgcgaucgacggagaguaccguuugagaggcgaagcucgcaaaaccuucguagagcuuaugagacgaggagaccucccagucuggcuuucguacaagguugcaucugagggguuccaguacucagaucgccgcuggugcuucgauggagaacgcaacaaccaaguacuagaagaaaacauggauguagaaauauggaccaaggagggggagcguaagaagcuccguccgagauggcucgaugccagaacuuacagugacccacuugcccucagagaguucaaggaguucgcggccggaagacggagugugucaggggaccuaauacuggaaaucggcaaacugccacagcaccucacccaacgagcacagaacgcccuagacaaccuagucaugcuccacaauagcgaacaaggcgguagggcguacagacacgccauggaggagcucccagacacaauugaaacucucaugcucuuggcacuaaucgcaguauuaacaggaggagucacacucuucuuccuaagcggccgggggcuggggaaaaccagcauaggauugcuuugugucauggcgaguucgguccuacucuggauggccuccgucgagccgcauuggaucgcggcgagcaucauacuagaguucuuccucaugguucuacuaauacccgaacccgacagacaacggaccccacaggacaaccaacucgcguacgucgucauagggcuacucuucaugauucucacaguugcagccaacgagaugggccuacucgaaacgacuaaaaaggaucugggaauuggccacguugccguagaaaaccaucaucacgcagcuaugcuagacguagaucugcaccccgcauccgcauggacacucuacgcagucgccacgacaauaauaacaccaaugaugcgacacaccaucgaaaacacaacagcaaacaucagucugaccgccaucgccaaccaggcggcaauacugaugggguuagacaaaggcuggccaauaagcaagauggacaucggcguuccacuccuagcgcuuggaugcuacucccaaguaaauccacucacgcuaacagcagcagugcucaugcucguggcccacuaugcaauuaucgggcccggucuacaagcgaaagcaaccagagaggcccaaaagcgcacagcugcggggauuaugaaaaacccuacuguagacggcauugucgcgauagaccuugacccagucguguaugacgcaaaguucgagaaacaacugggccaaauuaugcuauuaauccugugcacgucucagaucuuacuaaugaggaccacaugggcgcuaugcgaaucaauuacacucgcaacgggaccccucacgacccugugggaaggaagccccgggaaguucuggaacaccacuauagccgucuccauggcuaacaucuucaggggguccuaccuagccggcgcgggacuggcuuuuucgcuuaugaaaaguuuaggcggcgggcggcggggcacuggagcacaaggagagacacuaggcgagaaauggaagcgacaacugaaccagcucagcaagagcgaguucaacaccuacaaacgcagcggcauaauggagguggacaggagcgaagcaaaggaagggcucaagcgaggcgagacgacgaaacacgccgugagccgggguacugcuaaauugcgaugguucguggaacgaaaucucgucaagcccgaagggaaggugaucgaucucggcugcggccgcggcggauggagcuacuauugcgcaggccuuaaaaagguaacggaagucaagggauacacaaagggcggcccgggacacgaggaacccauuccgauggccacguacggauggaaccucgucaaguuacacuccgggaaagacguuuucuucauaccacccgagaaaugcgacacccuccucugcgauaucggugaguccucgccaaauccgaccauugaagaaggccgcacacuucggguccucaaaauggucgaaccaugguuaagaggcaaccaauucugcaucaagauacuaaacccuuacaugccuagcguagucgaaacguuggaacagaugcaacgaaagcacggcggaaugcucguccggaacccucugagucgaaauagcacgcacgaaauguacuggguguccugcggaacuggaaacaucgugucggcgguaaacaugacaagucgaaugcuucuaaacagauuuacgauggcccaccggaagccaacauacgagcgggacguggacuugggggccgguaccagacacguagcaguugagccagagguggccaaucucgauauaauuggacaaagaaucgagaacauuaaacaugagcacaaaagcacauggcacuacgacgaggacaacccauauaagaccugggcauaccacggcuccuaugaggucaaaccaagcggcucagcguccuccaugguaaacggcguuguuaaacuacucacaaaacccugggacgucaucccaauggucacacagauagcaaugacagacacaacgccauucggacaacaaaggguguucaaggagaaaguagacaccagaacgccgaaggcaaagcgcgggacagcccaaauaauggagguaacagccaaauggcuauggggguucuuaucucgaaacaagaaaccacggauauguacgcgggaagaguucaccaggaaagugcggagcaacgcagcgaucggggccguauucguggacgagaaccaguggaacucagcuaaagaagcaguggaagacgaaagguucugggauuugguacaccgcgaacgagagcugcacaagcaagggaaaugcgcaacuugcguauacaauaugauggggaaacgagagaagaaauuaggagaguucgguaaagccaaaggaucaagggcaaucugguauauguggcucggcgcccgauucuuagaguucgaggcauuaggauucaugaacgaagaucacugguucucccgggagaacagucugagcggaguugagggugagggacuccacaagcugggcuacauacugagggacauauccaaaauaccgggcgggaacauguaugcggacgacaccgcaggcugggauacacgcauuacugaagacgaccuacagaaugaagccaaaaucacagacauuauggagccggaacacgcacuacucgcgaagucaauuuucaagcuaaccuaccaaaacaaaguuguaaggguccagcgacccgcgaaaaauggcacagucauggacguaauuagccgucgugaccaaaggggauccggccaagugggaaccuacgggcuaaacaccuucacaaacauggaagcccaacucauacgacaaauggagucagaaggaaucuucagccccuccgaacuagagacccccaaccucgcuggacgcguacuggacuggcucgaaaaacacggcgucgaacgccuuaagagaauggcgauuagcggagaugacugcguagucaagccaaucgacgacagguucgcgacagcccugaccgcacucaacgacaugggaaaaguacggaaagacaucccccaaugggagcccucgaagggcuggaaugauuggcagcagguaccauucuguagccaccacuuccaccagcuuauuaugaaggacggaagggaaauaguaguucccugccgaaaucaagacgagcuggucggccgggccagagucagucaaggagcgggauggagccucagagaaacggccugccuuggcaagucuuacgcccaaauguggcaguuaauguacuuucacagacgugaccuccgacuggccgccaacgcaauaugcucggcaguccccgucgacugggucccaacaucacgcacaacgugguccauacacgcgcaccaccaauggaugacaaccgaagacaugcucagcguuuggaauaggguuuggauagaagagaacccguggauggaagacaaaacgcacauuuccaguuggggagacgugcccuaccucggcaagcgcgaggaccaguggugcggaagccucaucggacugaccgcacgagccacaugggccacuaauauccaaguagcgaucaaccaaguacgacgccucauagggaacgaaaauuaccuggacuacaugaccagcaugaagagauucaagaaugagucggacccggaaggcgcacuaugguga

SEQ ID NO: 24170 - RNA, 9879 nt, Artificial Sequence
  derived and/or modified CDS sequence (opt11) from DENV-1__FJ432739__SS-prME
agcgugaccaugcugcucaugcuaaugcccacggcacucgcuuuucaccuuaccacgagaggcggggagccccauaugaucguguccaagcaggaacgcgguaagucccugcuguuuaagaccuccgcaggggugaacauguguacccucaucgccauggacuuaggcgaguucugcgaggacacgaugaccuacaaaugcccacgcaucaccgaagcugagcccgacgacguggacugcuggugcaacgccaccgacacuugggucaccuacgggaccuguagccagaccggcgaacaccggcgagacaagcgcuccgucgcccuggcgccccacgugggcuuaggguuagagacgcgcaccgagacuuggauguccucagagggggccuggaagcagauccagcgggucgagaccugggcccuacgccauccgggguucacggugaucgcccucuucuuggcgcaugcuaucggcaccagcaucacccagaaggggaucaucuucauucugcucaugcuggugacccccucuauggcuaugcggugcguaggcauaggcucaagagacuucguggaaggacuguccggcgccacguggguugacgucgugcucgaacacgggagcugcgugacgaccauggccaaggauaagccaacccuagacaucgaacugcucaagacggagguuacuaacccagcuguguugcgaaaauugugcaucgaggccaaaaucuccaacaccaccacggacagccgcugcccgacccagggcgaggccacccucgucgaggaacaggacgccaacuuugucugcagacgcacuuucguugaccggggcugggguaacggcugugggcuguucggcaaggggagccuuaucacuugugccaaguucaagugcgugacuaaacucgagggcaagacuguccaauacgagaaccugaaauacucggucaucguuaccguccacacgggcgaccagcaccagguugggaacgaguccacggagcacggcaccacggcgaccaucaccccccaggcccccucgaccgagauacagcugaccgacuacggugcccugaccuuggacuguucaccacggacgggccuggacuucaaugagaugguccuccugacaaugaaggagaaggccuggcuggugcacaagcaaugguuccucgaccugccgcuaccguggaccuccggagccagcaccucccaggagacguggaaucggaaggaccuauuggugacguucaaaaccgcacacgccaagaaacaagagguaguggugcugggcagccaggaaggcgccaugcauaccgcccucacuggcgccaccgagauccagaccagcggcaccacgacuauuuuugcggggcaccugaagugucggcugaagauggacaaacucacccugaagggcaugagcuacgucaugugcacuggcuccuucaagcuagagaaggagguugccgagacgcagcacgguaccguccucguacaaaucaaguacgaggggaccgacgcgccuugcaagauccccuucagcacccaggacgaaaagggugugacucagaauggccgccugauaaccgccaacccgaucguuacagauaaagagaaaccagugaacaucgaagcagagccgcccuucggggagaguuauaucgugaucggcgccggugagaaggcccugaaguuaagcugguucaagaaaggcucuaguauuggcaaaauguucgaggcaaccgcccgcggagcgcggcggauggccauacucggcgacacagccugggacuuuggguccaucggcgguguguucaccagcgucgggaagcuagugcaccagaucuucggcaccgcauacggggugcuguucucaggcgucuccuggaccaugaagaucggaauaggaguccuccuuacguggcuagggcucaacucccgaagcacuucccugagcaugaccugcauugcagugggccuggugacccuuuaccugggcguuaugguccaggcggacuccgggugcgucaucaacuggaagggucgggaacugaagugcgggagcggcaucuuugugaccaacgaggugcauaccuggaccgagcaguacaaguuucaggccgacagcccgaagcgucucuccgccgccauagguaaggcgugggaagaaggggucuguggcauccggagugcgacccgacuggagaacaucauguggaagcagauauccaacgagcugaaccacauccugcuggagaaugacaugaaguucaccguugugguuggggauguggccggaauucuagcccaagggaaaaagaugaucagaccucagccuauggaguacaaguacagcuggaagaguuggggcaaggcuaagaucaucggcgcggacguucagaacgccacguucaucaucgacgggcccaacaccccggaaugccccgacgaucagcgcgcauggaacaucugggaggucgaggauuacggcuucgggaucuucaccaccaacaucuggcucaagcugcgcgacagcuauacccaggugugugaccaccgccuuauguccgccgccaucaaggacagcaaagcggugcacgccgacaugggguacuggaucgagucggagaagaacgagaccuggaagcucgcccgggcgagcuuuaucgagguuaagaccugcauauggcccaaaucccacacccuguggagcaacggcgugcuggaguccgagaugaucauuccgaagaucuacgggggcccaaucagccagcacaacuaucgccccggguacuucacgcaaaccgccggccccuggcaucuagggaaguuggaacuggacuucgaccucugugagggcaccaccguggugguugacgagcacugcggcaaccgggggccgucccugcgcacgaccaccgugaccggcaaaaucauccacgaguggugcugccguagcugcacgcugccgccccugcgcuucaagggggaggacggcugcugguacgguauggagauuagacccgucaaagagaaggaggagaaccuggugaaguccaugguuucagcgggcucaggcgaggucgacuccuucagcuugggauugcuguguaucagcauuaugauugaagaggugaugcgcagccgauggucccguaaaaugcugaugaccggcauacuugccguguucuuccugcugauaauggggcaacucaccuggaaugaccugauccggcucugcauaauggucggcgccaaugccagcgaucgcauggggaugggcacgacguaccucgcccugauggcuaccuucaagaugcgcccgauguucgccgugggacuccuguuccgccgccugacuagccgggaaguucugcucuugaccaucggucugagccucgucgccucaguagagcugcccaacagccuggaagagcucggcgacgggcuggccaugggcauaaugauccugaaacuccugacggacuuccagucucaucaauuaugggcgaccuugcugagccugaccuuuaucaagaccacguucagucuccacuaugccuggaagacgauggcuaugguccugagcaucgugucccuguucccccucugccuuucaaccaccucccagaagacaacguggcuucccgugcuucuuggcagccuggggugcaagccucuaacaauguuccugaucgcagagaacaaaaucuggggccgcaaguccuggcccuuaaacgaggggaucauggccgucggcauagugagcauauugcugagcagccugcucaagaaugacgugcccuuggcugguccccuuaucgccggcgguaugcucaucgccugcuacgucaucagcggguccagcgccgaucuguccuuagagaaggccgccgaggugagcugggaggaggaagccgagcacucuggcgcgagccauaacauccucguggagguccaggacgaugggaccaugaagauaaaggacgaggagcgugaugacacgcuuaccauccugcuaaaggcgacgcugcuggccguaucgggcguguacccgcuuagcauuccagcaaccuuguuugucugguacuucuggcaaaagaagaagcagcgcuccgggguucugugggacacccccuccccgcccgagguggaacgggcuguccucgacgacgguauauaccgcaucaugcagcggggccugcuagggcgcucccaggugggcguggguguguuucaagagaacgucuuccacacgauguggcacgugacccgcggcgccguuuugauguaccaggggaagcgccucgaaccgagcugggccagugugaagaaggaccugaucagcuacggcggcgguuggcggcugcagggauccuggaacaccggggaggaggugcagguaaucgcgguggagccaggcaagaacccuaaaaacgugcagaccgcgcccgggacuuucaaaaccagcgagggcgaggugggggccaucgcccucgacuucaagccuggcacauccggcagucccauugugaaccgcgaggggaagaucgugggccuguaugguaacggggucgugaccacaagcggcaccuauguguccgccaucgcccaggcuaaagccagccaggagggcccucugccggagaucgaggacgaggucuuuagaaagcgcaaccucacaauuauggaccugcaucccgggucaggcaagaccagacgcuaccuucccgccaucgugcgggaggccauaaagcgcaagcuccggaccuuaauccuggcuccaacccgcguggucgccagcgagauggccgaagcccucaaagggaugcccauccgcuaccaaaccaccgccgugaaguccgaacacaccggcaaggagaucguggaccugaugugccacgcgaccuucaccaugcggcuguugagccccguccgcgugcccaacuauaacaugaucaucauggaugaggcccacuucaccgacccgaguagcaucgccgcccggggguacaucucgacgcgcgugggcaugggggaggccgcggccaucuucaugaccgccaccccgccaggcagcguggaggccuuuccgcaguccaacgccgugauccaggacgaggagcgggauaucccggagcgcagcuggaacuccgguuacgaguggaucaccgacuuccccggcaagaccgugugguucgugccaaguauaaagucaggcaacgacaucgccaacugccuccggaagaacgggaagcgcgugauccagcugagccggaagaccuucgauaccgaguaccagaagacuaagaauaaugacugggacuacguagucacgaccgauaucagugaaaugggcgcgaacuucagagccgaccgggugauugauccccgacguugcuugaaaccggugauccugaaggacgguccagagcgcgucauccuagcuggucccaugccugugacggucgccagcgccgcccagcggcgcgggcgaaucggccgcaaucacaacaaggaaggcgaccaguacaucuacaugggacagccgcucaacaacgacgaggaccacgcccacuggaccgaggccaagaugcuguuggacaauaucaacacgcccgagggcauuauacccgcacucuucgagcccgagcgggaaaaguccgccgcgaucgacggggaguaccgccugcgcggcgaagcccggaagaccuucgucgagcuuaugcgccgcggggacuugccgguguggcuguccuacaaggucgccucggagggcuuccaguacuccgaccgccggugguguuucgacggcgagcgaaacaaucaagugcuggaggaaaacauggacguggagaucuggacaaaggagggggagcggaagaagcuacgcccccgguggcuugacgcgagaacauacucggacccucuggccuugcgggaguucaaggaguucgccgcaggccgccguucugucagcggagaccugauccuggaaauaggcaaacucccccagcaccugacacagcgcgcccagaacgcccuggauaaccucgugaugcugcacaacuccgagcaaggcggccgggcauaccgccacgcgauggaggagcugccggacaccaucgagacguuaaugcuacuggcccugaucgcagugcugaccggcggggucacccuguucuuccucagcggacgggggcugggcaagacguccaucgggcugcucugugugauggcuagcuccguguugcuguggauggccagcgucgagccucacuggaucgccgccuccaucauccucgaguucuuccugaugguucuguuaauccccgagcccgacaggcagcggacaccgcaggacaaccaguuagcuuauguggucauuggguugcucuucaugauucugacaguggcugccaacgagaugggccugcuugagaccacgaagaaagaccuggggauuggccauguugccgucgaaaaccaccaccacgccgccauguuggacguagauuuacaccccgccagcgccuggaccuuauaugccguggcgaccacaaucaucacgcccaugaugcgccacacgaucgagaauaccaccgccaacaucuccuugacggccaucgccaaccaagccgcgauccucaugggucuggacaagggauggccgaucagcaaaauggacaucggugucccgcugcucgcccuggggugcuacucccagguaaacccccugacucuuaccgccgccgugcugaugcuggucgcccacuacgcaaucaucggcccaggguugcaggcuaaggccacccgggaggcucaaaagcgcacggccgcgggcaucaugaagaacccgaccguggacgggaucguggcgauagauuuagaccccguuguuuacgacaccaaguucgaaaagcagcuuggccagaucaugcuccuuauucugugcaccagccagauccuacuuaugcgcacgaccugggccuugugcgagaguaucacucucgccacuggccccuugacgacccugugggagggaagcccuggcaaguucuggaacaccacaaucgccguuuccauggcgaacaucuuccgggggagcuacuuggcuggcgccggguuagccuucagccugaugaaaucgcucgggggcgggcggcggggcacgggggcgcagggcgaaacgcugggcgagaaguggaagcgccagcugaaccaacucagcaagagcgaguucaacaccuacaagcgcucugggaucauggaagucgaccgaagugaggccaaggagggccugaagcgcggggagaccacgaagcacgccgugaguagaggcaccgccaagcugcggugguucguggagcggaaccuggucaagccggaggguaaggugaucgaccugggcugcggccgcggcgggugguccuacuacugugcagggcugaagaagguuacagaggugaagggguacaccaagggcggcccgggccaugaggaacccauccccauggccacuuacgguuggaaccuugugaagcuccauagcggcaaggacguguucuucauaccgcccgaaaaaugcgacacccuccugugcgacaucggggaguccagcccgaaccccaccaucgaggagggccgcacccucagggucuuaaagaugguggaacccuggcugcgcgggaaccaguucugcaucaagauccucaaccccuacaugcccaguguggucgagacucuggagcaaaugcagcggaagcacggagggauguuaguccgcaaccccuuaucgcggaacuccacccacgagauguacugggugagcuguggaaccggcaauauagucagcgccguaaacaugaccucgcgcaugcuacugaaccgcuucacuauggcccaccgcaagccgacguacgagcgugacgucgaucucggggccggcacccgccacgucgccguggagccagagguggcuaaccuggauaucauuggccagcgcauugagaacauuaagcacgagcacaagucuaccuggcacuacgacgaggauaaccccuacaagaccugggccuaucacggcucuuacgaggucaagcccuccggaagcgccagcuccauggugaacggggucguaaagcugcugacgaagccgugggauguaaucccaaugguuacgcaaauugccaugacggacacaacucccuucggccagcagcgcguguuuaaagagaagguggauacccggacacccaaggccaagcgggggacggcgcagaucauggaaguuacagccaagugguuguggggcuuccugagccgcaauaaaaagccucgcaucugcacccgcgaagaguucacccgcaaggugcgcucaaacgccgccauaggugcuguguucgucgacgagaaccaguggaacagcgccaaggaggccguggaggacgagcgguucugggaucucgugcaccgcgaacgggagcugcauaaacaggggaagugcgcgaccugcgucuacaacaugaugggaaaacgcgagaaaaagcugggcgaauucggcaaggccaagggcucccgggcuaucugguacauguggcucggugcucgcuucuuagaguucgaggcacugggguucaugaacgaggaccacugguuuagccgggagaacagucucagcggcguggagggcgaggggcugcauaagcugggcuacauccuccgugacaucuccaagaucccagggggaaauauguacgccgacgacacggccggcugggacacccggauuaccgaagacgaucugcagaacgaagcgaagauuaccgacauuauggagcccgagcaugcccugcucgccaaauccaucuuuaagcugacguaccagaauaaaguagugcgcgugcagcgaccggccaagaacgggaccguuauggacgucauaucccgccgcgaccagcggggaagcggccaagugggcacuuacggccugaauaccuucacaaauauggaggcccaacucauucgccaaauggaguccgaggggaucuucagccccuccgaacuugagacgcccaaccuugcggggcggguccucgacuggcuggagaagcacggggucgagcgacuuaagcggauggccaucucaggagacgauugcguggugaagcccauugacgaucgcuucgccacagcccucaccgccuugaacgacauggggaaggugcggaaggacauaccgcagugggagcccuccaagggguggaacgacuggcagcaggugccauucugcucgcaccauuuucaccaacugaucaugaaagacggucgcgaaauuguggugcccugccggaaccaggaugagcucguaggccgcgcuagagugagccagggugccgggugguccuuaagggagacggccugccugggcaagagcuacgcccagauguggcaguugauguauuuccaccggcgcgaccugagauuagccgcgaacgcaauuugcuccgccgucccgguggacugggugcccaccagccgcaccaccuggucaauccacgcucaccaccaguggaugacgacggaggauaugcucucagucuggaaccguguguggauagaggagaaccccuggauggaggauaagacucauaucucuagcuggggcgacguucccuaccuggggaaacgggaggaccaaugguguggcuccuuaauugggcucaccgcacgggcaacgugggccaccaauauccaggucgccaucaaccaaguccgccgauugaucggcaacgagaacuaucuggacuacaugaccagcaugaagcgguucaagaaugagaucgacccggagggggcccucugguga

SEQ ID NO: 24171 - RNA, 9879 nt, Artificial Sequence
  derived and/or modified CDS sequence (opt11) from DENV-1__FJ410201__SS-prME
agcgugaccauguuacucaugcugaugccgaccgcucuggcuuuucaccucaccacccgcgguggagagccgcacaugauugugagcaagcaggagagaggaaaaagccuuuuguucaagaccagcgccggggugaacauguguacccucaucgcuauggaccugggcgagcuuugcgaggacacgaugacuuacaagugcccucgcaucaccgaggccgaacccgacgaugucgacugcuggugcaacgccaccgauacguggguuaccuacgggacuugcucucagaccggugagcauaggcgcgacaagcgguccguagccuuagcaccccacgucgggcugggccuggaaacaaggacugagaccuggaugucuuccgagggcgccuggaaacagauccaacgggucgagacaugggcucuccgccaucccggguucacagugauagcacuguuccuggcgcacgcaauaggaaccagcaucacccagaagggcauuaucuuuauccuucugaugcuggucacccccuccauggccaugcggugcgucggcaucggaagcagggacuuugucgaggggcuuagcggcgccaccuggguggacgucgugcucgagcacgggagcugugugaccacuauggccaaagacaagcccaccuuagacaucgagcugcugaagacagaggucaccaauccugcggugcuccggaagcucugcaucgaggccaagauaucgaacaccaccacggauagccgcugcccgacucaaggagaggccacucugguggaggagcaagacgccaacuucgucugccggcguaccuucguggaccggggcugggggaacggcugugggcuguucgggaagggaucucucaucacgugcgccaaguucaagugcgugacuaaacuagagggaaagauuguucaguaugagaacuuaaaguacagcgugaucgugacuguccauaccggcgaccaacaucagguggggaacgaauccacagagcauggcaccacugcgaccauuacuccccaggcccccacgacggagauccaacuaaccgauuacggggcuuugacgcuggauugcagcccccguacuggccuggacuucaaugaaaugguccuguuaacaaugaaggagaaguccuggcuaguccacaagcagugguuccuugaccuaccccuccccuggacgucgggggcuucgaccucccaggagacguggaauagacaggaccugcuggugaccuuuaaaaccgcccacgcgaagaagcaggaagucgugguccucggcagccaggagggugccaugcauaccgcccugacuggggcaaccgaaauccagaccaguggcaccacaacuaucuuugccggccaccugaagugccgucucaaaauggacaagcugacacugaagggcaugagcuacgucaugugcaccgggagcuuuaagcuugagaaggagguugcggaaacgcagcacggcaccguccugguccagaucaaguaugagggcaccgacgccccaugcaaaauaccauuuagcacccaagacgagaaaggggugacgcagaacggccgccugaucaccgcgaaucccauagugacggacaaggagaaaccagugaauauugaggccgagccccccuucggggagagcuacaucgugauuggggcgggcgaaaaggcccugaagcucagcugguucaaaaaggggucaagcaucggaaagauguuugaggccaccgcccggggggcucggcggauggcaauccugggggacacggcgugggacuucgggucgaucggcggcguuuucaccucgguagggaagcuggugcaucaaaucuucggcaccgcauauggaguccucuucuccggggucuccuggacuaugaagaucggaaucgggguucucuugacguggcuuggucugaacagucguucaaccucccugucaaugaccugcaucgccguggggcucgugacgcuauacuugggcgugauggugcaggccgacuccgggugcgugaucaauuggaagggucgggagcugaagugcgguagcggcaucuucgugacuaaugaggugcacacauggaccgaacaguacaaguuucaggcugauagcccgaagcgccuguccgccgcgaucgggaaggccugggaggagggggucugcggcauacggagugccacacgcuuggagaacaucauguggaaacagauuuccaacgagcucaaucacaucuuacuggaaaacgauaugaaacucacugugguggucggggaugucgcgggcauucugggucagggcaagaagaugauccggccccagcccauggaguacaaguauuccuggaaguccuggggcaaagccaagaucaucggagccgacgcccagaacaccaccuuuaucaucgacggcccgaacacaccggagugccccgacgaccagcgcgcguggaacaucugggaaguggaggacuacggauucggcaucuuuaccacuaacaucuggcugaagcuccgugacagcuacacacaggucugcgaccaccgccugaugagcgccgccaucaaggacuccaaggccguccaugccgacaugggcuacuggauugaguccgaaaagaaugagaccuggaagcuugcgcgggccucauuuauugagguuaagaccugcauauggcccaagucccacacguuguggucgaacgguguucuggagagcgagaugaucauccccaagauauacggcgggccgaucucacagcacaacuaccgaccaggguacuucacccagacagcagguccguggcaccuuggcaagcucgaacuagacuucgaccugugugaggggaccaccguagugguugacgagcacugugggaaccgggggccgucucuacgcaccaccaccgugaccgggaagaucauucacgaguggugcugcagaucauguacccugcccccacugcgcuucagaggcgaagacgggugcugguacggcauggagauccgccccguuaaggagaaggaggaaaaccucguaaaaagcauggugucggccggcagcggagaagucgauuccuucagccuaggccugcucugcaucagcaucaugaucgaggaggugaugcgcucuagauggucccgcaaaaugcuuaugaccggaacccuugccguuuucuuccuccuaauuaugggccagcugacguggaaugaccucauccgccugugcaucauggugggagcaaacgccagcgaccgcaugggcaugggcaccaccuaucuagcguugauggcuacguucaaaaugcggccgauguucgccgucgggcuacuguuccgucggcucacguccagagaagugcuacuccucaccauagggcuuagccugguggcgucggucgaguugccaaacuccuuagaggaguugggcgacggccucgccauggguaucaugauccugaagcugcucaccgauuuccagucgcaccagcugugggccacccugcuaagccugacguucaucaagaccaccuucagucugcacuacgccuggaagaccauggcaaugguacucagcaucgucucccucuucccgcugugccuuaguacuaccucgcagaagaccaccuggcugcccguguuacucgggagccugggcugcaagccucugacgauguuccucaucgccgagaacaagaucugggggcggaaguccuggccccugaacgaaggaaucauggccguaggcauuguuagcauccugcucucuuccuuguugaagaacgacgugcccuuggccggcccccuaauagccggcggcauguuaaucgcgugcuacgugaucaguggcaguagcgcggaccucagccuggaaaaggcggccgaggucagcugggaagaagaggcugaacacagcggggccucacacaacauacugguagaggugcaggacgacggcacgaugaagaucaaggacgaggagcgcgacgacacccucacaauucuccugaaagccacccuccuggcggugucagggguguauccgcugucuauccccgccacccucuucgugugguacuucuggcagaaaaagaaacagcgguccggcguccugugggacaccccauccccgccugagguggagcgcgccguacuggacgacggcaucuaccguaucaugcaaagggggcugcucggccgaagccagguuggggugggcguguuccaggaaaacgucuuccauacuauguggcacguuacucguggggcggugcugauguaucagggcaagcggcuugagcccuccugggccuccgucaagaaggauuugaucagcuacggcggaggcuggcggcuuagagggaguuggaacacgggcgaggagguccaggugaucgccgucgagccaggaaagaaucccaagaaugugcaaacagcccccgguaccuucaagaccccagagggagaggugggggcgaucgccuuagauuucaagcccggcacaucugggucacccaucgucaaccgcgagggcaagauaguuggccucuacgggaacggcgugguaacaaccagcggcacuuacguaagcgccaucgcccaggccaaagcuucccaggagggcccuuugccggaaauagaggacgaggucuuccggaagcgcaaccugacgaucauggaccuccacccagggagcggaaagacacgccgcuacuuacccgccaucguccgagaggccaucaagcguaagcugcgcacccucauccuggcccccacccgggugguggccuccgagauggcagaggcacuaaagggcaugcccauccgauaccaaacgaccgcagucaagucugagcacacugggaaggagaucguggaccucaugugccacgccacguucacuaugcggcugcucucacccgugcgcguuccgaacuacaacaugaucauuauggacgaagcccacuucaccgaccccagcucgaucgcggcccggggcuacaucagcaccagaguggggaugggugaggcagcggccaucuucaugaccgcgacgccgccagggucagucgaggccuucccccagagcaaugccgugauccaagacgaagagcgcgauauccccgagaggaguuggaacagcgguuacgaguggauuaccgauuuccccgggaaaacagugugguucguaccuucaauaaagagcgguaacgauaucgccaauugccucagaaagaauggcaaacgcgugauccagcugucccggaagaccuuugauacggaauaccagaagaccaagaacaacgauugggacuacguagugaccaccgacaucucugagaugggagccaauuuccgcgccgaccgagucaucgacccgcgccggugccugaagcccgugauccucaaggauggaccagagcgcgugauccuggccggccccaugccagucacaguggccuccgcugcgcagcggcgcggccggauagggcgcaaccacaacaaagagggggaucaguauaucuauauggggcagccccuuaauaaugacgaggaccacgcgcacuggaccgaggccaagaugcuccuggacaauaucaacacccccgaggggaucauccccgcgcuauucgagccggaacgggagaaguccgccgccguagacggcgaguaccggcuccggggggaggcccggaagacauuuguagagcugaugcgccggggcgaccuccccguguggcugucuuacaagguggccagcgagggcuuccaguacagcgaucgccgguggugcuucgacggggagcgcaacaaucaggugcuggaggagaacauggacguugaaaucuggacgaaagagggugagagaaagaagcugcgcccccgcuggcucgacgcccgcaccuacuccgacccccuggcgcugagggaguuuaaggaauucgcggccgggagacggagcguuuccggggaccucaucuuggagaucgguaagcugccccagcaccucacccagcgggcgcagaacgccuuagauaaucuagucauguuacacaacagcgagcagggcggacgggcguaccgccaugccauggaggagcugccugauaccaucgaaacucuuaugcuccuggcgcugaucgcuguauugacggggggcgugacccucuucuuccuguccgggcggggccucggcaagacuagcaucgggcugcuaugcgugauggccuccucugugcuccuguggauggcguccgucgagccccauuggaucgcagccuccaucaucuuggaguucuuccuuauggugcuacugaucccugaaccggaccgccagagaacgccccaggauaaucagcucgccuacguggucauaggccugcuguucaugauccucacgguggccgcgaacgagauggggcuccuggagaccacuaaaaaagaccugggcaucgggcauguggccgucgagaaccaccaccacgccgccaugcuggacguggaccugcacccugccucggcguggacccucuacgcggucgcuacaacgaucaucaccccaaugaugcgccacaccaucgagaauacgaccgccaacaucagcuugaccgcuauugcaaaucaagccgccauucugaugggucucgacaagggcuggcccaucaguaagauggacauuggggucccccuacuggcucucggcugcuacagccaggugaauccccugacccugacagcggccguucucaugcugguggcccacuacgccauuaucgggcccggccuacaagcuaaagcaacccgcgaggcgcaaaagcggaccgccgccgguaucaugaaaaaccccaccguggacggcaucguugccaucgaccucgaccccguuguguacgacgcgaaguucgaaaagcagcugggccagaucaugcuccucauccuauguacgagccagauccugcuaaugcggaccaccugggcgcugugugaguccaucaccuuggccaccgggccucucacuacccugugggagggcuccccggggaaguucuggaacaccacaaucgccgugagcauggccaacaucuuucguggauccuaucuagcgggagccgguuuagcuuucagccugaugaagucccugggcgggggccgcagaggaaccggcgcccagggcgagacccucggggaaaaguggaagcgccaguuaaaccagcuguccaagagcgaguucaacaccuacaagcguuccggcauuauggaaguagaucguucagaggcgaaggaagggcucaagcggggcgaaaccaccaaacacgccgugucccgcgggaccgccaaacugcggugguuuguggaacggaaccuggucaagcccgaaggcaagguaaucgaucugggcugugggcggggugggugguccuauuacugcgccgggcucaaaaaagugacagagguuaagggguacacgaagggcggcccggggcaugaggaacccauuccgauggcaaccuauggcuggaaccuggugaagcuacacuccgggaaagacguguucuucaucccgcccgagaagugcgauacccucuugugugacauaggcgagagcuccccuaacccgaccaucgaggaggggcgcacgcugaggguccucaagaugguggagcccuggcugcgggguaaccaauucugcaucaagauccugaaccccuauaugcccagcgucgucgagacacucgagcagaugcagcggaagcacggcgguaugcuggugcgaaacccgcugucccggaacaguacccacgagauguacuggguguccugcgggaccgggaauaucgucagcgcgguuaauaugaccucccgcaugcuccugaaccgcuucacuauggcccacaggaagcccaccuacgagagggacgucgaccugggcaccggcacgcggcacguugccguggagcccgagguagcuaacuuggauaucauaggccaacgcaucgagaacaucaagcacgagcacaaguccacauggcacuacgaugaggacaacccguacaagaccugggccuaccacggcuccuacgaagugaaaccaucugguuccgcaagcuccaugguuaacggcguugucaagcugcucaccaagcccugggacgucauccccauggucacccaaaucgccaugacggacacaacgcccuucgggcagcaaaggguguucaaggaaaagguagacacccgcacgccgaaagccaagcggggcacggcucagaucauggaggucaccgcgcgcuggcucuggggcuucuugucgcggaacaagaagccccgcaucugcacucgagaggaguuuacgaggaagguacguagcaacgcugccaucggagccguuuucgucgacgaaaaccaauggaacuccgcaaaggaggcgguggaggacgaacgcuucugggaccuggugcaccgggaacgcgagcugcauaagcaaggcaagugcgcgaccugcgucuacaacaugauggggaagcgggagaagaaacugggugaguucgguaaggccaagggcucgcgcgcaaucugguacauguggcugggugcucgguuccucgaauuugaggcacugggguucaugaaugaagaccauugguucuccagggagaauagccuguccggaguggagggagagggccuccacaaacuuggcuacauccugcgggacauaagcaagaucccgggcggaaacauguacgccgaugacaccgcagggugggacacccgcauuacggaagacgaucuucaaaacgaggccaagaucaccgacaucauggagccagaacacgccuuauuagcaaaggcuauuuucaaguuaaccuaucaaaacaagguuguccgugugcagcggccagcgaaaaauggaaccgugauggacguuaucagucgccgggaccagcguggcagcggccaggugggaacguaugggcugaacacguucacaaauauggaggcccagcuaaucagacagauggaguccgagggcaucuucucccccucugagcuugagacccccaaccucgccgaacgcgcgcuggacuggcucgagaaguaugggguggaacgacugaaacgcauggcgaucagcggcgacgacugcguagugaagccgaucgacgaccgguuugccaccgcucugaccgccuugaacgacauggggaagguucgcaaagacaucccccagugggagcccuccaagggauggaaugacuggcagcagguccccuuuugcucucaccacuuccaccagcugaucaugaaggacggacgggaaauugucgugccgugccgcaaccaggaugaauuaguggggcgagcgcgcgucagccagggcgccggguggucacuccgggagaccgccugccuggggaagagcuaugcccagauguggcagcugauguacuuccaccgccgggaccugagacuggccgccaaugccaucuguucugcgguacccgucgauugggugcccaccagccggacgaccugguccauccacgcgcaccaccaguggaugaccaccgaggacaugcugagcguguggaaucgcguauggaucgaggagaaucccuggauggaggacaaaacgcacaucucuagcugggaggacgugccguaccucgggaagcgcgaagaccaauggugcggaucccugauuggacugaccgcgagggccaccugggccaccaacauccagguggccauuaaccaggugcgccggcucaucgggaaugaaaacuaccugaauuacaugaccagcaugaagcgcuucaagaacgaguccgacccugaaggcgcucuuugguaa

SEQ ID NO: 24172 - RNA, 9879 nt, Artificial Sequence
  derived and/or modified CDS sequence (opt11) from DENV-1__FJ410203__SS-prME
ucugugaccaugcugcucaugcugaugcccaccgcccuggcuuuccaccucaccacccgcggcggugagccacacaugauaguguccaagcaggaacggggcaagagccuguuauucaagaccuccgccggggugaacaugugcacccucauugccauggaccugggcgagcugugcgaggacacgaugacauacaaaugccccaggaucaccgaggccgagcccgacgacguggacuguuggugcaacgccacggacacgugggugaccuacgggacgugcucucagacaggcgagcaccggagagacaaacgguccguggcacuggcgccccacgugggccuugggcuggagacgcgcaccgagaccuggaugucaagcgagggcgccuggaaacaaauccagcgggucgagacuugggcccuccgccaccccggguuuacggugaucgcccuguucuuggcccacgccaucggcaccagcaucacccagaaggggaucaucuucauccuccuuaugcuggucaccccuagcauggcgaugcggugcgucggcaucggcagccgcgacuucguggaggggcucucaggcgccacguggguggacguugugcuggagcacgggagcugcgugaccaccauggccaaggacaagcccacccuggacaucgaacuccuaaagacggaggucaccaaccccgcggugcugcggaagcucuguauagaggccaagaucuccaacacuaccacggacagccgcugcccgacccagggcgaagccacccuggucgaggagcaggacgccaauuucguuugccggcgcaccuucguggaccggggcugggggaacgggugcgggcuguucggcaaggguucccuaaucacgugugccaaguucaaaugcgugaccaaguuggagggcaagaucguccaauacgagaaccugaaguacagcgucaucguuaccguccauaccggagaucagcaccaaguggguaacgaguccacugagcacggcaccaccgcgaccaucaccccccaggcccccacaaccgaaauacagcucaccgacuacggggcccugacccuggacugcucgccccgcacgggccucgacuucaacgagaugguucugcuaaccaugaaggagaagucauggcuaguccacaaacaaugguuccuggaccugccccuuccauggacgagcggggccucaaccucccaggagacguggaaccggcaggaccugcuggugaccuucaagaccgcccacgcgaaaaagcaggaggucguggugcucggcagccaggagggcgccaugcacaccgcccugacgggggcgaccgagauccagaccuccggcaccacgacuaucuucgccgggcaccugaagugccgccucaagauggacaagcugacccugaagggcaugaguuacgucaugugcaccggguccuucaagcucgagaaagagguggcggagacgcagcacggcaccgugcugguccagaucaaguacgagggcaccgacgcccccugcaaaauucccuucagcacgcaggacgaaaagggggugacgcagaacggccgucuuaucaccgcaaacccgaucgugaccgacaaggagaaacccguuaacaucgaggccgaaccgcccuuuggggaguccuacaucgugaucggggcgggcgagaaggcacugaagcucucuugguucaagaagggguccucgauuggcaagauguucgaggccaccgcccguggggcccggcgcauggcgauccugggcgacacggcuugggauuucggguccaucggcgguguguuuaccuccgucgggaagcugauccaccagaucuuuggcaccgccuauggaguccucuucuccggcgugagcuggaccaugaagaucgguaucgggguccugcugaccuggcucggccugaacucccgcagcaccucccugagcaugaccuguaucgccguggggcucgucacccuguaccugggcgucauggugcaagccgacuccgggugcguaaucaacuggaaggguagggagcucaagugugggagcggcaucuucgucacgaacgaggugcacaccuggaccgaacaguacaaguuucaggcggacagcccgaagcgccuaucagccgccauuggcaaggccugggaggaaggggugugcggcauccggagcgccacacgccuggaaaacaucauguggaagcagaucucaaacgagcugaaccacauccugcuggagaacgacaugaagcucaccgucgugguaggggacgucgcuggcauccuggggcagggcaagaagaugaucagaccccagcccauggaguacaaauacagcuggaaguccuggggcaaggccaagauaaucggagccgacgcgcagaacacgaccuucaucaucgacggccccaacacuccggagugccccgaugaccagcgcgcguggaacaucugggagguagaggauuacggguucggaaucuuuaccacaaacaucuggcugaagcuccgggacagcuacacccaggugugcgaccaccgccuaauguccgcugcuaucaaggacuccaaggccguccaugccgacaugggcuacuggaucgagagcgagaagaacgagaccuggaagcuagcgcgggccagcuucaucgaggugaaaacuugcauauggcccaaaucccacacgcucuggagcaacggggugcuggagucugagaugaucauccccaagaucuacggugggccgaucagccaacacaacuaccgccccggguacuucacccaaacggcgggucccuggcaccugggaaaacucgagcuggacuucgaccugugcgagggcacuacggucgugguggacgagcacugcggcaaccgggggccgucccuccgcaccaccaccgucacggggaagaucauccacgaguggugcugccggagcugcacccugccgcccuuacgcuuccguggcgaggacgggugcugguacggcauggagauccgccccgugaaggaaaaggaggaaaaccucguuaagucgauggucagcgccggcagcggggagguggacagcuucagcuuaggccugcucugcaucuccauaaugaucgaagaggugaugcgaucuagauggagucgaaagaugcugaugaccgggacccuggccgucuucuuuuuauugauuaugggccagcucacguggaacgaccucauccgccuguguaucauggugggagccaacgccuuugaccgcaugggcaugggcaccacuuaccuggcccucauggccaccuucaagaugcggccgauguucgcuguugggcuccuguuccgccggcucacgagccgcgagguacugcuacucacuaucggccugucccugguugcguccguggagcucccuaacucgcuggaggagcugggggauggccucgccaugggcaucaugauccugaagcugcucaccgauuuccagagccaccagcugugggccacucugcucucccugacguucaucaagaccaccuuuagccugcacuacgccuggaaaacaauggcgaugguccucagcaucgugucgcuguucccccucugucucuccacgaccagccagaagaccaccuggcugcccguccugcucgggucccuggggugcaagccgcugacgauguuccucaucgccgagaauaagauauggggacggaaauccuggccgcugaacgagggcaucauggcuguggggaucguguccauccugcucaguagucugcugaagaacgacgucccccucgcgggcccccugaucgccggcgggaugcugaucgcgugcuacgugaucuccggcagcucggcggacuugagccuggagaaagccgcagagguauccugggaggaggaggccgagcacagcggggcgucccacaacauucuggucgagguacaggaugacggcaccaugaagaucaaggacgaggagcgagacgacaccuugaccauccugcugaaagccacccuccuggcugugagcggggucuauccgcuguccauucccgccacgcucuucgucugguacuucuggcaaaagaagaagcagcggagcggaguguuaugggauacccccagcccgcccgaggucgaacgcgccgugcuggacgacggcaucuaccggaucaugcagcgcgggcugcucggccggagucaggugggggugggcguguuccaggagaacguguuucacaccauguggcacgucacacgcggugcgguguugauguaccagggcaaacggcuggagcccuccugggccucggugaagaaggaccucaucagcuacggcggcggcuggcgccuucgggggagcuggaauacgggcgaggagguccaggugaucgccguggagcccgggaagaaccccaagaacguccagaccgcccccggcaccuucaagacacccgagggcgaggugggggccauagcgcuggauuucaagccgggcacguccggcagccccaucgugaaccgggagggcaagaucguaggccucuacgggaauggagugguuaccaccucugggacuuacguuagcgccaucgcccaggccaaggcgagccaggaggguccacugcccgaaauagaggacgaggucuuucggaaaagaaaucugacaauuauggaccuccaccccggguccggcaagacccggcgcuaccugccggccaucgugcgggaggccaucaagcgcaagcugaggacccucauccucgcccccaccagggucguagccagcgagauggccgaagcccugaaaggcaugcccauccgauaccagacgaccgccgugaaguccgagcacaccgggaaggagaucgucgaucucaugugccacgccacauucacgaugaggcugcugagccccgugcgcgugccuaauuacaacaugaucaucauggacgaggcccacuucacugaccccuccagcaucgccgcccgaggcuacaucuccacccgcgucgggaugggcgaggccgccgccaucuuuaugaccgcuacgccgcccgggagcguagaggccuucccgcagucuaacgccguaauccaggacgaggagcgggacauccccgagcgcagcuggaacuccggccacgaguggaucaccgacuuccccggcaaaaccguuugguucguacccucuaucaaguccgggaacgacaucgccaacugccuccggaagaacgggaagcggguaauacagcugagccguaagaccuuugauacggaauaccagaagaccaagaacaacgacugggacuacgucgugaccacggacauaagugaaaugggggcgaauuuccgcgcagaccgggugaucgacccgcgccgaugccugaagcccgucauccucaaggacggccccgagcgcguuauccuggccgggccgaugccggugacugucgccagcgccgcgcagcggaggggccgcauuggcaggaaccacaacaaggagggggaccaguacaucuauaugggccagccccugaacaacgacgaggaccacgcccacuggaccgaggcaaagaugcuccuggacaauauuaacacccccgagggaaucauccccgcccuguucgagccggagcgcgagaaguccgccgcgguggacggcgaguaucggcuccgcggggaggcccggaagaccuucgucgagcugaugcgccggggcgaccugccaguguggcucucauacaagguggccuccgagggcuuccaguacagcgaccggcgguggugcuuugacggugagcgcaacaaucaaguccuggaagaaaauauggacguggagaucuggaccaaggaaggagagcggaagaaguuacguccccgguggcucgacgccagaaccuauagcgacccccuggcccugcgggaauucaaggaguucgcggccgggcgccgguccgugaguggcgaccucauccuggaaaucggcaagcugccccagcaccucacacagcgcgcccagaacgcccuggacaaccuagugaugcuccacaacuccgagcagggcgggcgggcguaccgccacgccauggaggagcugcccgacaccaucgagacauuaaugcuccuggcacucaucgccguacucaccgggggcgugacccucuucuuccugagcggacggggccugggcaagaccuccaucgggcugcugugcgucauggccagcuccgugcucuuauggauggcaaguguggaaccacacuggaucgccgcauccaucauccuggaguucuuccucaugguccugcugauccccgagccggaccgccagcggacgccccaggacaaccagcucgccuacguggugaucggccugcuguucaugauccucacggucgccgcgaacgagauggggcugcuggagaccacgaagaaggacuuaggcaucgggcacguugccguagagaaccaccaccacgccgcuaugcuggacgucgaccugcaccccgccagcgcguggacccucuacgccguggccacgaccaucaucacccccaugaugcgccacaccauugagaacacgaccgcuaauaucucccugaccgccaucgcgaaccaagccgccauccugaugggccuggacaagggcuggcccauaagcaagauggacaucggugugccccugcuggcucucggcuguuacucccaggucaacccccugacccugacggcugccgugcuaaugcugguggcccauuaugccauaaucgggcccggccuccaggccaaagcgacccgcgaggcccaaaagcggaccgccgccgggaucaugaagaaucccaccguugacggcauuguggccauagaucucgacccaguggucuacgacgcgaaguucgagaagcagcugggccagaucaugcuucucauacugugcacgagccagauccugcucaugcggaccaccugggcccugugcgaauccauaacgcuggccacggggccccucaccacccuuugggagggcagcccggggaaguucuggaacaccacgaucgccguguccauggccaauaucuuccggggcagcuaccuggcgggggccggucucgccuucucccugaugaagucccuaggcgggggccgccgggggaccggcgcccagggcgagacccucggggagaaguggaagcgccaacugaaucaacuuucgaaguccgaguucaacaccuacaagcggagcggcaucauggagguggaucgcuccgaggcgaaggaggggcucaagcggggugagaccaccaaacacgccgucucccgcgggacagccaaacugaggugguucguggaaaggaacuuaguuaagcccgaaggcaaggucauugaccugggcugcgggcguggugggugguccuacuauugcgccggccucaagaaggugaccgaggugaagggguauacgaagggcggccccgggcacgaggagcccaucccgauggccacguacggcuggaaccuggucaaauugcacagcgggaaggauguguucuucaucccgcccgagaagugcgacacccuccugugcgacauaggcgaguccagccccaacccgaccaucgaggaggggcgcacgcugcgggugcucaagauggucgaacccuggcugcgcggcaaccaauucugcauuaagauccucaaccccuacaugcccuccgugguggagacccuggagcagaugcagagaaagcacggcgggaugcuggucagaaacccauugagccggaacuccacucacgagauguacugggucagcugcggcaccgggaacaucguguccgcagucaacaugaccagccgcaugcugcugaaccgcuucacgauggcgcaccggaagcccaccuacgagcgcgacguggaccugggcaccggcacgcggcacguagccgucgagcccgaaguggccaaccucgacauuaucgggcaacgaaucgagaacaucaagcacgagcacaaguccacguggcacuacgacgaggauaaccccuacaaaaccugggccuaccacggcagcuacgaggugaagccguccgggagcgcguccucuaugguuaauggcguggugaagcucuuaaccaagcccugggaugugauccccauggugacccagaucgcaaugacggacacgacccccuucgggcagcagcgggucuucaaggagaagguugacacccgcacgccuaaggccaagcggggcaccgcccagaucauggaggugacagcgcgcuggcucuggggcuuccugucgcggaacaagaagccccgcauaugcacacgggaggaguucacgcggaagguccgguccaacgcggccaucggggccguguucguggaugagaaccaguggaauagcgccaaggaggcggucgaggacgagcgcuucugggaccucguccaccgggagcgcgaacuccacaaacagggcaagugcgcgaccugcguguacaacaugauggggaagcgcgagaagaagcugggugaguucgggaaggcgaagggcucccgcgcaaucugguacauguggcugggcgcucgguuucucgaauucgaggcgcucggguucaugaacgaggaccacugguucagccgcgagaacagccucagcggcgucgagggggagggucuccacaagcugggguauauccugcgggauaucuccaagaucccgggaggcaacauguacgccgacgacaccgcugggugggacacccgcaucacggaggacgaccuccagaaugaggccaagaucaccgacaucauggagccggaacacgcccugcuggccaaggccaucuucaagcucaccuaccagaacaagguggugcgcguccagcgucccgcaaagaacggcaccgugauggacgugaucagccgccgagaucagcgcggguccggccaggucggcacguacgggcugaacaccuucaccaacauggaggcccagcugauccgccagauggagagcgaaggcaucuucuccccuagcgagcucgagacccccaaccuagccgagagggcguuagacuggcuugagaaguacgggguggagaggcugaaacgcauggccaucuccggcgacgacugcgugguaaagcccaucgaugaccgauucgccacugcccugaccgcccuaaaugacauggggaaggugcgcaaggacaucccccagugggagcccagcaaaggcuggaacgacuggcagcagguccccuucugcucucaccacuuccaccagcuuaucaugaaggacggccgggagaucgucgugcccugccgcaaccaagacgagcugguggggcgggcgcgcgucucgcagggggcgggguggucccuccgggagaccgccugccuggguaagagcuaugcccagauguggcagcugauguauuuccaccgcagggaccuccgcuuggcggccaacgccauuugcagcgccgugccgguggauuggguccccaccagccggacgaccuggagcauccacgcccaccaccaguggaugacaaccgaggacaugcuguccgucuggaaccgcguguggauugaggagaaccccuggauggaggacaagacgcacaucagcuccugggaggacgucccguaccucgguaagcgcgaggaccaguggugcggcagccugaucggccugaccgcgcgggccaccugggccaccaacauccaaguggcaauaaaccaggugcgccgacucaucggcaacgagaauuaccuggacuacaugaccuccaugaagcgauucaagaacgagagcgaccccgagggcgcccuuugguga

SEQ ID NO: 24173 - RNA, 9879 nt, Artificial Sequence
  derived and/or modified CDS sequence (opt11) from DENV-1__FJ410204__SS-prME
agcguuaccaugcuguugaugcugaugccgaccgcccuggcguuccaucuuacgacccgcggcggggagccccacaugaucgugagcaagcaggagcguggcaagagccuccucuucaagaccucagcuggggugaauaugugcacccucauugccauggaccuuggggagcugugcgaggacaccaugaccuauaagugcccacgcaucaccgaggccgagcccgacgauguggacuguuggugcaacgccaccgacacaugggucaccuacgggacauguagccagaccggcgagcaccggcgcgacaaacggaguguggcccucgcgccccacgugggccuggggcuggaaacccgcaccgagaccuggaugagcuccgagggcgccuggaaacagauccaacgggucgaaaccugggcgcucaggcacccaggauucacgguuaucgcccuguucuuagcacacgccaucggaacgagcaucacacagaaggggaucaucuuuauacuccucaugcuggugacccccuccauggccaugagaugcgucggcaucgggagcagagacuucguggaaggacucuccggcgccacguggguggacgugguacuggagcacgggagcugcgugaccaccauggccaaggacaagccgacccuggauaucgagcuccugaagacugagguuaccaaucccgcugugcugaggaagcuuugcaucgaggccaagaucuccaacaccaccacagacagccgcugcccgacccagggcgaggccacacugguugaggagcaggacgccaacuucgucugccggagaacguuuguggaccggggcuggggaaacggcugcgggcucuuuggcaagggaucccucaucacgugcgcaaaguucaagugcgugaccaagcuggagggcaagaucguccaguacgagaaccuuaaguacucugucauugugacaguccacaccggggaccagcaccagguggguaacgagucaacggagcacggcaccaccgccaccauuacgccccaggcccccacgaccgagauucagcucaccgacuauggagcccugaccuuagacugcagcccucguacgggccucgacuucaacgagauggucuuacugaccaugaaggagaagucauggcucgugcacaagcagugguucuuggaccugccccucccauggaccagcggagccuccacgucacaggagacguggaaccgucaggaccugcuugugacuuucaagaccgcccacgccaagaaacaggaggucguggugcuuggcagccaagagggcgcaaugcacacggcccugacgggggccaccgaaauucagaccucgggcaccacgaccauauucgccgggcacuuaaagugcagacugaaaauggacaaacugacguuaaagggaaugagcuacguaaugugcaccgggucuuucaaacucgagaaagagguggcggagacgcagcacggaaccgugcugguccagaucaaauacgagggcaccgaugcccccugcaagauccccuuuucuacccaggaugagaagggggugacgcaaaauggacggcugaucaccgcgaacccgaucgugaccgacaaggagaagccuguuaacauugaggccgagccaccguucggugaguccuacaucguaauaggcgcgggcgaaaaggcacugaagcuaagcugguucaagaagggguccucaaucggcaagauguucgaggcaaccgcccgcggcgcacggcgcauggcgaucuuaggcgacacggccugggacuucgguucuaucggcgguguguucaccagcgucgggaaacugauccaccagaucuucgguacagccuacggggugcuguucagcggcgucagcuggacgaugaagaucgggaucggaguccugcugacguggcucggccugaacucccgcagcaccucccuaagcaugacaugcaucgccgugggguuaguaacccuguaucugggcgucauggugcaagccgacuccggcugcgugauuaacuggaagggccgugagcucaagugcggcagcggcaucuuugucacaaacgaaguuuacaccuggaccgagcaguauaaguuccaggcugacuccccgaagcgacuguccgcugccauuggcaaggccugggaggaagggguaugcggcauccggagcgccacccgccuggagaacaucauguggaagcagaucuccaacgaauuaaaccacauccugcuggaaaacgacaugaagcucacggucguagugggggacgucgcgggcauccuggggcaaggcaagaagaugaucagaccccagcccauggaauauaaguacagcuggaagagcuggggcaaagccaagaucauaggagcagaugcucagaacacgacguucaucaucgacggcccuaauaccccggaaugccccgacgaucagcgcgcauggaacaucugggaaguggaagacuacggguucggcauuuuuaccaccaauaucuggcugaagcucagggacagcuacacccagguuugcgaccaccgacugauguccgccgccaucaaagacagcaaggcuguccacgcggacaugggcuacuggaucgagucggagaagaacgagaccuggaaacucgcgcgggccaguuucaucgaggugaagacuugcauuuggccaaagucccacacgcucuggaguaauggggugcuggaguccgagaugauaauccccaagauauacggcgggccgaucagccaacacaacuaccgccccggguauuucacccaaaccgcuggaccuuggcaccuaggcaagcucgagcuggacuucgaccuuugcgagggcaccacggucgugguugacgagcacugcggaaaucgggggccgagucuccgcaccaccaccgucacggguaagauuauacacgaguggugcugccggucuugcacccugcccccccugcgcuuccggggcgaggauggguguugguacggcauggagauacgccccgucaaggagaaagaggagaaucucguaaaguccauggucagugccgggucaggggagguugacucauucagccuggggcuguugugcaucucuaucaugauugaggaggugaugcggagccgauggucccggaaaaugcucaugacugggacucuggccgucuucuuccuccugauaaugggccagcugacguggaacgaucucauaaggcucugcauuauggugggugcaaaugccuucgaccgcauggguauggggaccaccuaccucgcccucauggccaccuucaagaugcggccgauguucgcgguggggcuccuguuccgaaggcucacuucacgcgagguccuccugcucaccaucggccuaucccuuguggcgucugucgaguuaccgaacucucuggaggagcucggggacggucucgccaugggcaucaugauccucaaacugcucaccgacuuccagagccaccagcuaugggccacccugcucucccugacguucaucaagacuaccuucagccuccacuaugccuggaagaccauggcgauggucuuauccaucgugucgcuuuucccccugugccuuuccacuacuagucagaagaccacauggcugcccguccugcucgggucccugggcugcaagccucugacgauguucuugaucgccgagaauaagaucuggggcaggaaguccuggccccugaacgagggaauaauggccgucggcaucguauccauucugcucagcagccucuuaaagaaugauguaccccucgccggcccccugaucgccggcgggauguuaaucgcaugcuacgucaucucuggaagcuccgccgacuugagccuggagaaggccgcagagguguccugggaggaagaggcagagcacuccggggcaucccacaacauccugguagaggugcaggacgacgguacuaugaaaaucaaggacgaggagcgcgacgauacacucaccauucugcucaaggccacccucuuggcugugucaggagucuacccccugaguauccccgccacacucuuugugugguacuucuggcagaagaagaagcagaggagcggcguucucugggacaccccaagcccgccagaggucgagcgagccgugcuggacgacggcaucuacaggaucaugcagcgcgggcugcucggccggagccaggugggggucggcguguuccaggagaacguguuccauacaauguggcaugucacacgcggggccguucugauguaucagggcaagcggcuggagcccuccugggccagcgugaagaaggaccugaucuccuauggcggaggcuggcguuugcggggaucauggaauacgggugaggagguccaagugaucgccguagaaccugggaagaaucccaagaacguccagaccgccccgggaacguucaagacccccgagggagaggucggggccaucgcucuggacuucaagcccgguacgagcggcagucccaucgucaaccgggaggguaagauagucggacuauaugggaacggcgugguuaccacguccggcaccuacguauccgccauagcccaggccaaggcgagccaggagggcccgcugcccgagauugaggacgagguuuuccggaagagaaaccugacgaucauggaucuucacccggggucagguaagacccggcguuacuuaccugccaucgugcgggaagccaucaagagaaaauuacgcacgcucauccuggcgcccacccgggucguugcgagcgagauggcggaggcccucaagggcaugccgauuagguaccagacgaccgcggugaaguccgagcacaccgggaaggagaucguagaccuuaugugccacgcuacuuucacgaugcggcugcugagcccagugagagugcccaacuacaauaugaucaucauggaugaggcucacuucaccgaucccuccucaaucgcggcacguggcuauaucucaacgagaguagguaugggcgaggccgccgcaaucuucaugaccgcaaccccgcccggcucaguggaggccuuuccucagagcaaugccguuauccaggacgaggagcgggacaucccggagcgcagcuggaauuccggccacgaguggaucacagacuuccccggcaagaccgucugguucgugccuagcaucaaauccgggaacgacauugcgaacugccuccggaagaacggcaaacgcguaauccagcugucacgcaagacuuuugacacagaguaccagaagaccaagaauaacgacugggauuacgucgugaccaccgacaucuccgaaaugggcgcgaacuuccgggccgaccgggugauagacccucgccgcugcuugaaaccugucauccucaaggauggccccgaacgcguaauccuggccggccccaugccggugacggucgccuccgcggcgcagcgccgcggccggaucggccgcaaccacaacaaggaaggggaccaauacaucuacauggggcagccccugaacaacgacgaggaucacgcgcacuggaccgaggccaagaugcuucuggacaacaucaacaccccggagggaaucauccccgcccuguucgagcccgagcgcgagaaguccgccgcuguggauggugaauaccggcugcgcggggaggcccggaaaacguuugucgagcugaugcgucggggcgaccugcccguguggcucagcuacaaaguagcaucggagggcuuccaguauagcgaccgccguuggugcuucgauggggagcggaacaaccagguccucgaggagaacauggacguggagauuuggacgaaggaaggggagaccaagaaguuacggcaccgcuggcccgaugcccggcaguauagcgacccacucggccugcgagaguucaaggaauucgccgcgggccggcgcuccgugagcggcgaccugauccuugagauugggaagcugccgcaacaucugacacagcgggcccagaacgcccucgacaaccugguuaugcugcacaacuccgagcaaggcggccgcgccuaccggcacgcuauggaggagcugccugacacuaucgaaacgcugaugcugcucgccuuaaucgccgugcuuaccggcggggugacccucuucuuccugagcgggcgcggccuggggaagacguccaucggccucuuaugcguaauggccucguccguacuguuguggauggccucaguggagccccacuggaucgcugccuccauaauccuggaauucuuccugaugguccucuugauccccgagccggaccggcagcgcacgccccaggacaaccaacucgccuacguagugaucggacuccucuucaugauccugacugucgccgcgaacgagaugggccuucuggagaccaccaagaaggaccuaggcaucggccauguggccguggagaaccaucaccacgccgccaugcucgauguggaccugcaccccgccucggccuggacccuguacgcgguggccacaaccaucaucaccccgaugaugcggcacacuaucgagaacacgaccgccaacaucagccucaccgcgaucgccaaccaggcggccauccuaaugggcuuggauaagggcuggcccaucaguaagauggacaucggcgugccucuccuggcccugggaugcuacucccaagucaacccccucaccuugacggccgcggucuugaugcuuguagcccacuacgccaucaucggcccgggguuacaagccaaggccacacgcgaggcgcagaagcggaccgccgccggcaucaugaagaaccccaccgucgacgggauaguggccaucgaccuugaccccguggucuacgaugccaaauucgagaagcagcucggucaaaucaugcugcuuauccucugcacgucccagauccuacugaugagaaccaccugggcgcugugcgaguccauaacccuggccacgggccccuuaaccacccucugggaggggucuccgggcaaguucuggaacaccacuaucgccguguccauggccaacauuuuccgcggcaguuacuuggcaggggcugguuuagccuucuccuugaugaaaucccucggcggcgggagacgagggaccggcgcccagggggagacgcuaggcgaaaaguggaaacggcagcucaaccaacugagcaaauccgaguucaacaccuacaagcgaagcgggauaauggagguggaucgguccgaggccaaggagggccugaagcguggagagacgaccaagcacgcgguaagcagaggcaccgccaagcuccguugguuuguggagagaaaccucgugaagcccgagggcaaggucauugaccugggaugcggccgggggggaugguccuacuauugcgccgggcugaaaaaagugaccgaggugaagggcuacacgaaaggcgggcccggccacgaggagccgaucccuauggccaccuacgguuggaaccuugucaaacuucacagcgguaaggauguguuuuuuauuccgccggagaagugcgacacacugcucugcgacaucggcgaaagcagcccaaacccgaccauugaggagggccgcacgcugcgcgugcuuaagaugguagagcccuggcuccgggggaaccaguucugcaucaagauccugaacccuuauaugccgagcgugguggaaacccuugagcagaugcaacguaagcacgggggcaugcucguccggaacccguugucacgaaacucaacgcacgagauguauuggguaagcugugggaccggcaacaucguguccgccgucaacaugacgagccggauguugcucaaucgcuucacgauggcacaccggaaaccuaccuacgagcgggacguggaucugggcaccgggaccaggcacguggccguagagcccgagguggccaaccuggacaucaucggccagcggauagagaacaucaagcacgagcacaaguccaccuggcacuacgacgaggacaaccccuacaagaccugggccuaccacgggagcuacgaggugaagccaucgggcuccgccuccagcauggucaauggcguggucaagcuccugaccaagcccugggacgugauacccauggugacacagauugcgaugacggacaccaccccguucggccagcagcgcguauucaaagagaagguggacacccggacgccgaaggccaagcgcggcaccgcucagaucauggaggugacugcccgguggcuguggggguuccucagccgcaacaagaagcccagaaucugcacucgcgaggaguucacgcgcaagguccgcuccaacgccgcgaucggcgccguguucgucgacgagaaccaauggaacuccgccaaggaggcugucgaggacgagcgguucugggaccuugugcaucgggagcgggagcugcacaagcaggggaagugcgcgacuugcguguauaacaugaugggcaagcgcgagaagaagcucggagaguuuggcaaggccaaaggcucccgggccaucugguauauguggcucggggcccgcuuccuggaguucgaggccuugggauucaugaacgaggaccacugguuuagccgugagaacucccugagcggggucgaaggcgagggucugcacaagcucggcuacauccugcgcgacauaucgaagauccccggugggaacauguacgcggacgacaccgcuggcugggacacgcgcaucacggaggacgaccugcagaacgaggccaaaaucaccgacaucauggaaccggaacaugcccuccucgccaaagcaaucuucaagcuaacguaccagaacaagguggugcggguccagcgccccgccaagaacgggacugugauggacgugaucucacggcgagaccagcgaggcucaggccaggucgggacauacggcuugaacacuuuuaccaauauggaggcacaguugauccgccaaauggagagcgaagggaucuucuccccuagcgagcuggagaccccgaaucucgcagaacgggcccuggacuggcuggagaaguacggcguggaacgccucaaacggauggccaucuccggggacgacugcguugucaagccgaucgacgacagauucgccacggcccugaccgcucugaacgauaugggcaaggugagaaaggauaucccccagugggagcccuccaaggguuggaacgauuggcagcagguccccuucugcucccaccacuuccaccagcucauuaugaaggacgguagagaaaucguagugccgugccggaaccaggacgagcuggugggccgcgcccgggucagccaaggagcgggcuggagccugcgcgagacagccugucucgggaaaagcuaugcacagauguggcaacugauguauuuucaccggcgcgacuuacgccucgccgcgaacgccaucugcucugccguucccguugacuggguucccaccagccgcacgaccuggagcauccacgcccaccaccaguggaugacuaccgaggacauguuauccguuuggaaccguguuuggaucgaggagaaccccuggauggaggacaagacgcacauuucguccugggaggacguaccguacuuaggcaagcgcgaagaccaguggugcggcucucugaucggacugaccgcccgcgcaacaugggccaccaauauccagguggccaucaaccaggugcggaggcugauaggcaacgagaacuaccucgacuacaugaccuccaugaagcgguucaaaaacgagagcgaccccgagggggcccugugguga

SEQ ID NO: 24174 - RNA, 9879 nt, Artificial Sequence
  derived and/or modified CDS sequence (opt11) from DENV-1__FJ432742__SS-prME
agcgugaccaugcugcuuaugcugaugcccacggcccuggcguuucaccucaccacccgggguggggaaccucacaugaucgugaccaagcaagaacgaggcaaaagccugcuguucaaaaccagcgccggagugaacaugugcacccugaucgccauggaccucggagaguuaugcgaggacaccaugaccuacaagugccccaggaucaccgaggccgagcccgaugacguggacugcuggugcaacgcaacagacacgugggugaccuacgggacaugcagccagacgggcgagcaccggcgcgauaagagaucaguggcccuagcaccccacgugggccuagggcuggagacccgcaccgagaccuggauguccagcgagggcgcauggaagcagauccagcggguugagacgugggcccuccgccacccaggguucaccguuaucgcccuguuccuggcgcacgccaucggcaccuccauaacccagaaagggauuaucuuuauccuccuaauguuaguuacgcccagcauggccaugcgaugcgucggcaucggcucccgcgacuucguggaggggcucucuggugccacauggguggacgucgugcuggaacauggguccugcgugaccacuauggccaaggacaagcccacguuggacaucgagcuccugaagaccgagguaaccaaccccgcugugcugcguaaauuaugcaucgaggccaagauauccaacaccaccacggacuccagaugcccaacccagggagaagccacccugauggaggagcaggacgcgaacuuugugugccggcgcacguucgucgaccggggcugggguaacggcugugggcuguucggcaaaggcucacucaucacgugugccaaguucaaaugcguaaccaagcuggaggggaagaucgugcaguacgagaaccugaaguacuccgucaucgugaccgugcauacgggugaccagcaucaggucgggaacgagagcaccgagcacggcaccacggcgacgauuacaccccaggcccccaccuccgagauccagcucaccgacuauggggcccugacacuggacugcagcccccgcacgggauuagacuucaacgaaauggugcugcugaccaugaaggagaaguccuggcucguccacaagcagugguucuuagaccugccacuccccuggaccagcggugccagcaccucccaggaaacguggaaccggcaagaccugcuggugacuuucaaaaccgcccacgcgaaaaaacaggagguggucguguuagggagccaggagggcgcaaugcacaccgcccugacgggggccaccgagauccaaaccuccggcaccacgacgauuuucgccgggcauuugaagugccgccucaagauggauaagcugacauuaaagggcauguccuacgucaugugcacgggcuccuucaagcuugagaaggaggucgcggagacgcagcacggcaccguguuagugcaaauuaaauaugaaggcacagacgcccccugcaagauccccuucucuacacaggacgaaaagggggucacgcagaacggccgccugauaacagccaaucccaucgucaccgacaaggagaagcccgugaacauugaagccgaaccgccuuuuggugaguccuacaucgucaucggcgcgggcgagaaggcccugaagcucucgugguucaaaaagggaucaagcaucggcaagauguucgaggccacugcccgcggggcccggcgcauggcuaucuugggagacacggccugggacuucgggucggugggcggcguguucaccagcgucgggaaacugguacaccagauauucggcaccgccuacgggguccuguucuccggcgucagcuggacgaugaagaucgggaucggcgugcuguuaacguggcucggcuuaaacucacgcagcaccucguuaagcaugacuuguaucgcaguggggcucguuacccuguaccugggagugauggugcaggccgacuccgggugcgucauuaauuggaagggccgggaguuaaaaugcggcucugguaucuucgugacuaacgaggugcacaccuggaccgagcaguacaaauuccaggcugacagcccgaagagguugucggccgcgaucggcaaggccugggaggagggggucugcggcauccguucugccacccgccuugagaauaucauguggaagcaaaucuccaacgagcucaaccacauccuccucgagaacgauaugaaguucaccguuguggucggggacguggugggcauccuggcgcaggguaagaagaugauucggccccagcccauggagcacaaauacagcuggaaguccuggggaaaggcaaagaucaucggcgcagacguucagaacacgaccuucaucaucgacgggcccaacaccccggagugucccgaugaccagcgcgccuggaacaucugggagguggaggacuacggcuucgguauauuuaccacgaacaucuggcugaaacuucgggauucuuacacccaggugugcgaccaccgccucauguccgcggccauaaaagacuccaaggccguccacgccgacaugggcuauuggauugaguccgagaagaacgagaccuggaagcuggcccgggcgagcuucauugaggugaaaacuugcaucuggcccaagagucacacgcuguggagcaacggcgugcucgaguccgaaaugaucaucccuaagaucuacgguggcccgauaagccagcacaauuaucgccccggguacuucacccagaccgcuggccccuggcaccuggggaagcuggagcucgacuucgaucugugcgaaggcaccacggucgugguggaugagcacuguggcaaccgagggccgucccuacgcaccaccacgguaacgggcaagauuauccacgaguggugcugucggucgugcacguugccaccccuccgcuuuaaaggggaggacggcugcugguacgggauggagauccggcccgugaaggagaaggaagagaaccuggugaaguccauggucucggccggcucaggcgaaguugacuccuucagccucgggcugcugugcaucuccauuaugaucgaggaggugaugcgcagcagauggucucgcaagaugcucaugaccggcacccuggccgucuuccugcuccugauaauggggcagcugacauggaacgaccucauccggcugugcaucaugguuggcgccaaugcuagcgaccgcauggggaugggcaccaccuaccuggcacucauggccaccuucaagaugcgcccaauguucgccguggggcugcuguuccggcgccucacgucccgggagguacugcugcucacgauaggccugucacugguggccuccgucgaacuccccaacagccuggaggagcugggcgacgggcucgcgauggggaucaugauccugaaguugcucacggacuuccagucccaccaacugugggccacucugcugagccugacguucaucaagaccacccucucccuccacuaugccuggaagacuauggcuauggugcugucgaucgugaguuuguucccacucugccugagcacgaccucccagaagaccaccuggcugccggugcuccuaggcagccuggggugcaaaccguuaacgauguuccuaaucacugagaacaagauauggggccgcaaauccuggccccuuaacgaggggaucauggcggugggcgucgucagcaucuuauuauccucccugcucaagaaugacguccccuuggccgguccccugaucgccggcgggaugcucaucgccugcuacgugaucagcgguucaagcgccgacuuaucccuggagaaggccgccgaggucagcugggaggaagaagccgagcacuccggcgccucacacaacauccucguggagguacaggacgacgggaccaugaagaucaaggacgaggagcgggacgacacuuuaacgauccugcucaaggccacgcuucuggcggugucgggcguguacccgcucuccauacccgccacccuguucgugugguauuucuggcagaaaaagaagcagcgcucggggguccugugggacacccccagcccgcccgagguggagcgggccgugcucgacgacggcaucuaccgcaucaugcagcggggccuccuggggcgcucccagguagggguggggguguuccaggagaacgucuuccauaccauguggcacgugacgcggggcgccgugcugauguaucaggggaagaggcucgagcccagcugggccuccgucaagaaggaccugaucagcuauggcggcggguggcgguugcaggguucguggaacaccggggaggagguccaggugauugcggucgagccgggcaagaacccuaaaaacguacagaccgcccccggcaccuucaaaacgcccgagggcgaggugggcgccaucgcccuagauuucaagcccggaaccagcggcucccccaucgucaaccgcgagggcaagaucguagggcuguacggcaacggcguagucaccaccagcggcacauacgugagcgccauagcgcaggccaaggcaucucaggaggguccgcugcccgagaucgaggacgagguguucaggaagagaaaccucacgaucauggaccuccaccccggaagcgggaagacccggagauacuuaccggcaaucguccgggaggcgaucaagcgcaagcuccggacccugauacuggccccuacgcgcguuguggcuuccgagauggccgaggcccucaaaggcaugcccauccgcuaucaaaccaccgcggucaagagcgaacacaccggcaaggagaucguggaccugaugugccacgccacguuuaccaugagacugcucucccccgugagggucccgaacuauaacaugaucaucauggacgaggcccacuuuaccgacccaucuuccaucgccgcgaggggguacaucagcacccgggugggcaugggggaagcggccgccaucuucaugacggccacgccgcccgguuccgucgaagccuucccgcagagcaaugcggucauccaggacgaggagcgggacauccccgagcgcuccuggaacucuggguacgaguggaucaccgacuuccccggaaagaccgugugguuugugcccuccaucaagagugggaacgacaucgcuaacugucugcggaagaacggaaagcgugucauccagcugucccgaaagacguucgacaccgaguaccaaaaaaccaagaacaacgauugggacuacguggugaccacggacaucagcgagaugggcgccaacuuccgcgcagaccgggucaucgacccgcgccgaugccuaaagcccgugauacugaaggacgggcccgagcguguaauacuggcgggccccaugccagugaccguggccucggcggcccagcggcgcggaagaaucgggcgcaaucacaacaaggagggugaccaauacaucuauauggggcaaccucucaauaacgacgaggaccacgcccacuggacggaagccaagaugcuguuggacaacaucaacacgccugagggcauaauucccgcccuuuucgaaccggaacgggagaaaucagcagccaucgacggggaguaccgcuuacgcggcgaggcucgcaagacguucgucgagcugaugcgcaggggggaccuccccguuuggcuaucuuacaaggucgcuagcgaggguuuccaguauagcgaccgccgguggugcuucgauggcgagcgcaacaaccagguccuggaggagaacauggacguugagauauggaccaaggagggggagcggaaaaagcucagaccccgguggcuggacgcccguacuuacuccgacccacuggcacuacgggaguuuaaagaguucgccgcuggcaggcgguccguguccggggaccucaucuuagagaucggcaaacucccccagcaccucacccagcgcgcgcagaacgcccucgacaaccucgucaugcugcacaacuccgagcagggcgggagagccuaccgccacgccauggaggagcugccagacacgaucgagacccuaaugcuguuggcguuaauagcagugcugaccggcggggugacccuguuuuuccuuuccggccgggggcugggcaagaccaguaucggccugcuguguguaauggccucuagcgugcugcuuuggauggccuccguggaaccccacuggaucgccgcgagcaucauucuagaguucuuccugaugguccugcugauccccgagccagaccggcagcggacgccccaggacaaccagcuggccuacgugguaaucgggcucuuguucaugauccugaccgucgcggcuaacgagaugggcuugcuggagaccaccaagaaggaccuagggaucggccacguggccguggagaaucaccaccacgcgacgaugcuggacgucgaccuccaccccgcauccgccuggacccuguaugccguggccaccacaauuaucacgccgaugaugcgccauaccaucgagaacaccaccgcaaauaucagccugacggcgaucgccaaccaggccgccauucucauggggcuggacaagggcuggcccaucucgaagauggacaucggcgugccccugcucgcgcuggguugcuacagccagguaaacccccugacccucacggccgccguacugaugcugguggcccacuacgcgaucaucgguccggggcuccaggcuaaagccacucgggaggcccagaaacgcacggcggcgggcaucaugaagaaccccacugucgaugggauuguggccaucgaccuggaccccgugguguaugacgcuaaguucgagaagcaacugggccagauaaugcuccugauccugugcacgucgcagauccuccugaugcggaccacuugggcccugugcgagagcaucacgcucgccacuggcccgcucaccacguuaugggagggguccccgggcaaauucuggaauacuacgaucgcagugagcauggccaauaucuuccggggguccuaccuugcgggcgccggucucgccuucagucucaugaaaucacucgggggcgggcgccggggcacgggagcucagggagagacgcugggcgagaaguggaagcgccagcugaaccaguuguccaagagcgaauucaauaucuacaagcgguccgggaucauggagguggaccgcagcgaggccaaagagggcuugaaacgcggggaaacuaccaggcaugcaguuucgcgaggcacagcuaagcugcgcugguucguggagcggaaucuggugaagccagagggcaaagucaucgaccucggcugcggccgggggggcuggagcuauuacugcgcuggucugaagaaagugaccgaggucaagggcuacaccaaggggggccccggccacgaagagccuaucccgauggcuacuuacggguggaaucuggucaagcuccacuccggcaaagacguguucuuuacgccacccgagaagugcgacacgcugcugugcgacaucggcgaaaguucccccaacccgaccauagaggaggggcguacccuccgcgugcugaagauggucgagccguggcugcgggggaaucaguucugcauaaagauccucaauccauauaugcccagcgugguggaaacccuggagcagaugcagcgcaagcacggugggaugcucguccgcaacccgcuaucccgcaacagcacccaugagauguacuggguguccugugggacgggcaauaucgucagcgccgugaacaugaccucccggaugcugcugaaucgauucaccauggcccaccgcaagccaaccuacgaacgggauguggaccucggggccgggacgcgccacguggcagucgagcccgaaguggccaaccuggauauaaucggccagaggaucgagaacaucaagcacgaacacaagaguaccuggcacuacgacgaggacaacccauauaaaaccugggccuaucacggauccuacgaggucaaaccgagcgguuccgccagcagcauggugaacgggguggucaagcugcucaccaagccgugggacgugauacccauggugacgcagaucgccaugaccgacaccacccccuuuggccagcagagagucuucaaggagaaagucgacacccggaccccgaaggcgaaaagagggaccgcucagaucauggaggugacugcacgguggcuauggggcuuccucucacgcaacaagaagccgcggaucuguacgcgggaggaguuuaccagaaaaguccgcagcaacgccgccaucggcgccguguucguggacgagaaccaauggaacuccgcaaaagaggccgucgaggacgagcguuuuugggaccucgugcagaaggagagagagcugcacaaacaggggaagugcgcgacaugcguguacaacaugaugggcaagcgggaaaagaaguugggggaauucggaaaggcgaaggggucgcgcgccauaugguacauguggcuuggggccagguuccuggaguucgaggcccugggcuucaugaacgaggaucacugguucucccgcgagaacagccucuccggggucgagggcgaaggccuccacaagcugggcuauauccuccgcgacaucagcaagauccccggggguaacauguacgcggaugacaccgcgggcugggacacccgcaucaccgaggaugaccugcagaacgaggccaaaaucaccgacaucauggagccggagcacgcccuucucgccacaagcauuuucaagcugacguaccagaauaagguggugcgcguccagcgcccggccaagaacgggaccgugauggaugucaucagccgaagagaccaacgcggcuccggccaggucggcaccuacggucugaacaccuucaccaacauggaggcgcagcucauacggcaaauggagagcgaggggaucuuuuuacccuccgagcuggagacaccaaaucucgcggagagggugcuggacuggcuggagaaguacggcguggagcggcucaagcgcauggcaaucagcggggaugacugcguugugaagccgaucgacgaccgguucgccaccgcucugaccgcgcuuaacgacaugggcaaggugaggaaagacauuccccagugggagcccuccaagggguggaacgacuggcagcagguccccuucugcagucaccacuuccaucagcucauuaugaaagacggccgggagaucguggugccgugccgcaaccaggaugagcuggucggccgagccagagugucccagggggccggauggucgcugcgggagacggccugcuuaggaaagagcuaugcccagauguggcaacugauguauuuccaccgccgggaucugcgccucgcggccaacgccauuugcucugccgucccggucgauugggugcccaccagucggaccaccuggagcauacacgcgcaccaccaguggaugacaaccgaggacaugcugagcguguggaaccgcgucuggaucgaggagaaccccuggauggaggacaagacccacgugaguagcuggggcgacgugccguaccuggggaagcgggaggaccagugguguggcucccucaucgggcugaccgcccgcgcuacgugggccagcaauauccaggucgcgaucaaccaggugcgccgguuaauagggaacgagaauuaucucgacuacaugacguccaugaagcgcuuuaagaacgagggcgacccggaaggggcgcugugguaa

SEQ ID NO: 24175 - RNA, 9879 nt, Artificial Sequence
  derived and/or modified CDS sequence (opt11) from DENV-1__FJ410205__SS-prME
ucggugacaaugcugcugaugcugaugcccaccgcuuuagcguuccaccucacaacccgugguggggagccucauaugaucgugagcaagcaagagcgugguaagagccugcuguucaagaccucugcuggggugaauaugugcacccucauugccauggaccugggcgagcugugcgaggacaccaugacauacaagugcccccggaucaccgaaaccgagccggacgacguggacuguuggugcaacgccacggauaccugggucaccuacgggaccugcagccagacgggggagcaccggcgggacaagcgguccguggcccucgcgccccacgugggccuggggcuggagacccgcaccgagacguggaugagcuccgagggcgccuggaagcaaauacagcgggucgagacgugggcccuccggcauccgggguucaccgugaucgcccuguuccuggcccacgcgaucgggacaagcaucacacagaaggggaucaucuucauccuccugauguuggugacgcccucaauggccaugcggugcgucggcaucggcagccgggacuucguggaggguuuguccggcgccaccuggguggacgucguacuggagcaugggagcugcgucacgacaauggccaaggauaagcccacgcuggacaucgagcuccugaagaccgaggucaccaaccccgccgugcugcgaaaacucugcaucgaggcgaaaaucuccaacaccacgacagacagccgcugcccgacccagggcgaggccacccugguugaggagcaggacgcgaacuucgucugccggcguacguucguggaccggggcugggggaacggcugcgggcuguucggcaaggggucccucaucacgugcgccaaguucaagugugugaccaagcuggagggcaaaauuguccaguacgagaaccugaaguacagugugauuguaacaguccacacgggcgaccagcaccaggucgggaacgagucgaccgagcacggcaccaccgccaccauuacgccucaggcgccgaccaccgagauccaguugaccgacuacggggcccugacccuggacuguagccccaggacaggccucgacuucaacgagauggucuuacugaccaugaaagagaagucguggcucgugcacaagcagugguuccuggaccugccguuacccuggacaagcggggccucuacaucccaggagacuuggaaccgccaagaccugcuagucaccuucaagaccgcccacgccaagaaacaagaggucgucgugcucggcagucaggagggugcgaugcacacggcccugaccggcgccaccgaaauucagaccucgggcacaaccacgaucuucgcggggcaccugaagugccgccucaagauggauaaacugacccugaagggcaugagcuaugucaugugcacgggcagcuucaaacuugagaaggaacuggccgagacacagcauggcaccgugcuggugcagaucaaguacgagggcaccgaugcgcccuguaagauccccuucagcacgcaggacgagaagggggucacccaaaacggccggcuaaucaccgccaacccgaucgugaccgacaaggaaaagcccgugaacaucgaggccgagccgccguucggagaguccuauauagucaucggcgcaggggaaaaagcgcucaagcugagcugguucaaaaagggcaguagcaucggcaagauguucgaagccacggcacgcggggcccggcgcauggcuauccugggggauaccgcgugggauuuuggguccaucggcggaguguuuacgagcgccgggaagcucgugcaccaaaucuucggcaccgccuacggaguccuguucuccggcgugagcuggacgaugaagaucgggaucggcguccugcuuacauggcugggccugaacucccgcagcaccaguuuaagcaugaccugcaucgccgucgggcucgugacucuguaccugggcgugaugguccaagccgacucagguugcgucaucaauuggaagggccgggagcuuaagugcgggagcggcaucuucgugacuaacgagguucauacguggaccgagcaguacaaguuccaagcggacagcccgaagcgccugucggcugccaucggcaaggccugggaggagggggugugcgggauccggagcgcgacccgacucgagaacauuauguggaagcagaucuccaacgaacugaaccauauccugcucgaaaacgacaugaaguucacaguggucgugggggacguggcgggcauccucgcgcaagggaagaagaugauccgcccccagccaauggaguacaaguacucuuggaaguccugggggaaggcaaagaucauuggggcggacguccagaacacaaccuucaucauugaugggcccaauaccccggaaugcccggaugaccagagggccuggaacauuugggagguugaggacuauggcuucgggaucuucacuaccaacauauggcugaagcuccgugacuccuacacccaagugugcgaccaucgccugauguccgccgccaucaaagacucaaaggccguccacgccgacaugggcuacuggaucgaguccgagaagaacgagacuuggaagcuggcacgggccagcuuuauagaggugaagacgugcaucuggcccaagucccacacccucuggagcaacggcgugcuggaauccgaaaugaucauccccaagaucuacggagggccgaucagccaacauaacuaccgccccggguacuucacccaaaccgccggccccuggcaccuggggaaauuagagcuggacuucgaccugugcgagggcacuaccgucgugguggacgagcacugcggcaaccgggggccgucccuccgcacaaccaccgucaccggcaagauuauccacgaauggugcugccggagcugcacccugccgccccugagauuuagaggggaggacggcugcugguacgggauggagauucgcccugugaaggagaaggaggagaaucuagugaaguccauggucagugccggaucgggagagguggacuccuucagccuggggcugcuguguaucuccaucaugaucgaggaggugaugcggagccgcuggagccggaagauguuaaugacgggcacgcuggccgucuucuuccuccugaucaugggucagcugaccuggaaugaccucauccgccugugcauuauggugggcgcgaacgccuccgaucgcaugggaaugggcaccaccuaccuggcgcucauggcuacuuucaagaugcggccgauguucgcggugggccugcuguuucgccggcucaccucccgcgagguccugcuccucaccaucgggcugagccugguggcauccguggaguuaccuaacagccuggaggaacugggcgacggguuggccaugggcaucaugauccuuaaacuguuaacugacuuccagucacaucagcugugggccacgcugcucagccuaaccuucaucaagacgaccuucucccugcacuacgcguggaagacgauggcgaugguucuuagcaucgugagccuguucccccugugccucagcaccaccucccagaagacgacguggcugcccguccugcugggcagccuggggugcaagccgcuuaccauguuccuuaucgccgagaauaaaauauggggccggagguccuggcccuuaaacgaggggaucauggccgugggcaucgugucaauccugcucagcucgcugcugaagaacgacguuccccuggccgggccccugaucgccggcggcaugcugaucgcgugcuaugucaucagcgguuccagcgccgaucucucccuggagaaggccgcggaggugagcugggaggaggaggcggagcacuccggcgcuagccacaacauccuggucgaggugcaggacgauggaacaaugaagaucaaagacgaggagcgggacgacacccugaccauucugcugaaggccacccuccuagccgugucuggcgucuacccgcugagcaucccggccacacucuucgucugguacuucuggcagaagaagaagcagaggagcgggguucugugggacacccccagcccgcccgagguagagcgggcugugcuggacgacggcaucuaccgcaucaugcagagaggcuugcucgggcggagccaggugggcgucgggguguuccaagagaacguguuccacaccauguggcacguuacgcggggcgcugugcugauguaucaggggaagcgccuagagcccaguugggccagugugaagaaggaccucaucagcuauggcggagguuggcggcugcaaggcuccuggaacaccggggaagaaguccaggugaucgccguggagccuggcaagaaccccaaaaacguacagaccgcgcccgggaccuucaagacgcccgagggcgaagugggcgccaucgcgcuggacuucaagcccggaaccagcggcucccccaucgugaaccgcgaggggaagaucguuggccucuacggcaaugggguggugaccacaagcggaacguacgucagcgcaaucgcccaggccaaggccucccaagaggggccgcuaccggagaucgaagacgagguguuccggaagcgcaaucugacgaucauggaucuccaucccggcagcgguaagacccgacgcuaucugccggccauaguccgggaggcaaucaaacguaagcugcgcacccucauccuugcccccacgcggguaguggccuccgagauggcggaggcccugaaggggaugcccauccgcuaccagaccaccgccguuaagagcgagcacaccggcaaggaaaucgucgacuugaugugccacgccacguucaccaugcggcugcuguccccugugcgcguuccgaacuacaacaugaucaucauggaugaagcacacuucaccgaccccagcuccaucgcggcgcggggguacauuagcacccgcgucggcaugggugaggccgccgccaucuucaugacggcgacgccacccggcuccguggaggccuucccgcagucuaacgccgugauccaagacgaggaaagggacauccccgagagaucauggaacagcggguacgaauggaucaccgacuuccccggcaagaccgucugguucgugccguccaucaagagcggcaacgacaucgcgaacugccuccggaagaaugguaagcgcgucauucagcugucgcgaaaaacguucgacaccgaguaccagaagaccaagaacaacgacugggacuacguugugaccacggauaucagcgaaaugggcgcuaacuuucgcgccgaccgcgugaucgacccgcgccgaugccugaaaccagucauccucaaggacgggccggagcgcgugauccuggccggucccaugccggugacggucgcauccgccgcccagcgccgcgggcggaucggccguaaccacaacaaagagggagaccaauauaucuacauggggcagccccuaaauaacgacgaggaucacgcccacuggaccgaggccaaaauguuauuagacaauaucaacacccccgagggcaucaucccagcccuguucgagccugagcgcgagaaguccgccgcuaucgacggggaguaccgguugcgcggcgaggcccggaagacguucguggaacugaugcgccgcggggaccugcccguauggcucaguuauaagguggcaagcgaaggcuuccaguacagcgaccgucgguggugcuucgacggcgagcgaaauaaccaggugcuggaagagaacauggacgucgaaaucuggacgaaggagggggagcggaagaaacuccgcccccggugguuagacgcccgcaccuacuccgacccacuggccuuacgggaguucaaggaguucgcggccggccgccggagcguguccggggaccucauucuagagauaggcaagcugccucagcaucucacccagcgcgcccagaacgcccuggacaaccuggugaugcuccacaauagcgagcagggcgggcgggcuuaccgacacgccauggaggagcugcccgacacgaucgagacgcugaugcucuuagcucugaucgcaguccuuaccgguggaguaacccuguuuuucuuauccggccggggccucgggaagaccucaaucgggcuccugugcgugauggcguccagcgucuuacuguggauggcuucaguggagccccacuggaucgccgccucuaucauccuggaauuuuuccucauggugcuacugauccccgagccggaccgccagcggacaccccaggacaaccagcucgccuaugucgugaucgggcugcuguucaugaucuuaaccguggccgcgaacgaaaugggucugcuugagaccaccaaaaaggaucucgggaucggccacgucgccguggagaaccaccaccacgccgccaugcuggacgucgaccuccaccccgcauccgcguggacgcucuacgccguggcaaccaccaucauaacgccgaugaugaggcacacgaucgaaaacaccaccgccaacaucagccugacggccauagccaaccaagccgcuauccugaugggacuggacaagggcuggcccaucuccaagauggacaucggugugccccugcuggcccucgggugcuacagccaggugaacccccugacccuuacagcggccguacucaugcugguagcccacuacgccauaaucggcccggggcugcaggccaaggcgacacgcgaggcccagaagaggaccgccgccggcaucaugaagaaccccacgguggacgggaucgucgccaucgaucucgacccugucguauacgacgcgaaguucgagaaacaacugggccagaucaugcugcucauccuaugcaccucccagauccuucucaugcgcaccaccugggccuugugcgaaagcaucacucuggccaccggcccccugacgacauuaugggaagggucuccaggcaaguucuggaacacgaccaucgccgucagcauggcuaacaucuuccgggggucuuacuuggcgggcgccggacucgccuuuagccugaugaagucccucggaggagggcgccgggggaccggcgcccagggcgagaccuugggcgagaaguggaagcgucaguugaaccagcuauccaagagcgaguuuaacacguacaaacggucggggaucauggagguugaccgcucggaggcgaaagagggccucaagcgcggggagaccacaaagcacgccgugucccgcgggacugccaagcugcggugguucgucgagcgcaaccuggugaagcccgaggggaaaguuaucgaccugggcuguggucgcgggggcuggucauacuacugcgccgggcucaagaaggucacggagguaaagggcuauaccaaaggcggccccggccacgaggagcccauccccauggccaccuauggguggaaccuuguuaagcugcacuccggcaaggacgucuucuucaucccgcccgagaagugcgacacccuccugugcgacauaggggagagcucccccaacccaacgaucgaggaggggcggacccugcgggugcucaaaaugguggagcccuggcugcguggaaaucaguucugcaucaagauccugaaccccuacaugcccagcgucguggagacccuagagcagaugcagcggaagcacggaggcaugcuggugcgcaacccgcugucccggaauagcacacacgagauguauugggucuccugcgggaccggcaacaucgugagcgccgugaacaugacgucccgaaugcuccugaaccgcuucacuauggcccaucggaagcccacauacgagagggaugucgaccugggggccgguacccggcacguggccguggagccugaggucgccaaccucgacaucaucggccagcgcaucgagaacaucaagcacgagcacaagagcacguggcacuacgacgaggacaaccccuacaagaccugggcguaccacggguccuacgaggugaagccgagcggcucagccagcagcauggugaacggggucgugaaacugcugaccaagccgugggaugucaucccaauggugacccagaucgccaugacggauacuaccccguucggccagcagcgaguguucaaggagaaagucgauacgcgcacuccgaaggccaagcgggggaccgcccaaaucauggaagugacagcaaaguggcucugggguuuccugucccgcaacaagaaaccccggaucugcacgcgcgaggaguucacgcggaagguacgcagcaacgccgccaucggcgccgucuucguggacgaaaaccaauggaacuccgcgaaggaggcaguagaggacgagagguucugggaccugguccaccgcgagagagagcuccacaagcaggggaagugcgcgacguguguuuacaacaugauggggaagcgcgagaagaaacugggggaguucggcaaggccaaggggagccgggccauaugguacauguggcugggcgcgagauuucucgaguucgaggcucugggcuucaugaacgaggaccacugguucuccagggagaacagccuuucagggguggagggcgaaggguugcacaagcugggcuacauccugcgcgacaucagcaagaucccagggggcaacauguacgccgaugacaccgcaggcugggauacccggaucacggaggaugaccuccagaacgaggcccgcaucacggacaucauggagcccgaacaugcgcuacuggccaagagcaucuucaaacuaaccuaccagaacaaggucgugcgcgugcaacggcccgccaagaacgggaccguaauggacgugaucucgcgccgcgaccagcgcggauccggucaggucgggacguacggccugaacacauucaccaauauggaggcgcagcugauccggcagauggagagcgaggggauuuucuccccgagcgagcucgagaccccgaaccuggccgagcgcguccuggacuggcuugagaaguacggcguggagcggcugaaacgcauggcgauuucgggggacgauugcguugucaagccgaucgacgaccgguucgccacugcccugaccgcccucaacgacaugggcaaggugcgcaaggacauaccccaaugggagccaucuaagggguggaaugacuggcagcagguccccuucugcucccaccauuuccaccagcugauuaugaaggauggccgggaaauugucgugcccugucgcaaccaggaugagcuggugggccgcgcccgcgucagccagggcgcaggcuggagccuccgggagacagccugccuggguaagucguaugcccagauguggcagcugauguacuuccaucgccgggaccuccgccuggcagcgaacgccaucugcagcgccgugcccguggacuggauccccacaucccguacuaccuggagcauccacgcccaccaccaauggaugacgacggaggacaugcugagcguuuggaaccgcguguggauugaggagaaucccuggauggaggacaagacucacaucuccuccuggggcgacgugccguaccucgggaaacgcgaggaccaauggugcggcucccugauuggcuuaaccgcccgggcgaccugggcaaccaacauccaggucgcgaucaaccaggugcgccggcucaucgggaacgagaacuaccuggacuacaugaccuccaugaaacgauucaaaaaugagucagacccugagggcgcccugugguga

SEQ ID NO: 24176 - RNA, 9879 nt, Artificial Sequence
  derived and/or modified CDS sequence (opt11) from DENV-1__FJ410207__SS-prME
ucugugaccaugcuacucaugcugaugccaaccgcccuggccuuccaccugaccacccgcggcggggagccgcacaugaucgugagcaagcaggagcguggcaagucccugcuguucaagaccagcgcgggggugaacauguguacccucaucgccauggaccuuggugaguucugugaggauaccaugacuuauaagugcccucgcaucacugaggcagaacccgacgacguagacugcuggugcaacgccaccgacaccugggugaccuacgguaccugcagccagaccggcgagcaccggcgggauaagagaucgguggcgcuggcgccccacgugggccuagggcuggagacacgaaccgagaccuggaugagcuccgagggcgcauggaagcagauccagcgggucgagaccugggcccugcgccacccgggguucauggugaucgcccucuuccuggcgcacgcuauaggcacgagcauaacccaaaagggaaucaucuucauacugcuuaugcuggugacccccucaauggccaugcguugcgucggcaucgggagccgcgauuucgucgagggccuguccggcgccaccuggguggacgucgugcucgagcaugggagcugcgugacgaccauggcgaaggacaagcccacccuggauauugagcugcugaagacagaggucacgaaccccgcggugcugcggaaauuauguaucgaggccaagaucuccaacaccaccaccgacagccgcugcccgacgcagggcgaggccaccuuaguggaggagcaggacgccaacuucgugugccggcgcaccuucguggaccgcggcugggggaacgggugcgggcuguucggcaaggggucccugauaacgugcgccaaguucaagugcgugacgaaacuggagggcaagaccguccaguaugagaaccugaaguacagcgugaucguaaccgugcacacaggcgaccagcaccagguggggaaugaguccacggagcacggcacuacugcgaccaucacaccccaggcgcccagcacggagauccagcugacugacuacggagcucucacccuggacuguagcccacggaccggccuggacuucaacgagaugguccugcucacgaugaaggagaagucuuggcuggugcacaaacagugguucuuggaccugccccugccauggaccagcggggccaguacaagccaggagaccuggaaucgaaaggaccuccuggugacguucaaaaccgcccaugcgaaaaagcaggaggucgucguacugggcucccaggagggcgccaugcacaccgcccucaccggagccacugagauucagaccagcggcacgaccacgaucuucgcuggucaccugaagugccgccugaagauggacaagcucaccuuaaagggcauguccuacgucaugugcacggggagcuucaagcuggagaaggaaguggcggagacccagcacggcacggugcuuguacagaucaaguacgagggcaccgacgcccccugcaagaucccuuucuccacccaggacgagaagggggugacccaaaacgggcggcugaucacggccaacccaaucgugacugacaaggagaaacuggucaauaucgaggccgagccccccuuuggggagagcuacaucgugaucggcgcaggcgagaaggcccugaagcucucaugguucaaaaaggggaguagcaucggcaaaauguucgaggccacagcccgcggagcccggcggauggcgauacugggcgacacggccugggacuuugggaguaucggcggcguauucacgucggucgggaagcuagugcaccagaucuucgguacagccuacggggugcuguucaguggagucuccuggaccaugaagauagggaucggagugcugcugacauggcucggccugaacagccgcucuacgucccuauccaugacuugcaucgccguggggcucgucacccucuaucuggguguaauggugcaggcugacagcgggugugucaucaacuggaagggccgcgaguugaagugcgguuccggcaucuucgugaccaacgagguucacacguggaccgagcaguauaaguuccaggcugacucccccaagcgccuuagcgccgccaucgggaaggcaugggaggagggggucugcggcauccgguccgccacccgccuggagaacaucauguggaaacaaaucagcaacgagcucaaucacauccugcuagagaacgacaugaaguucaccguggucguaggggacgucgcgggcauccucgcccaggggaagaagaugauccggccgcagccgauggaguacaaguacuccuggaaguccuggggcaaggccaaaaucauuggcgccgacgugcaaaacacgacguucauuaucgacgggcccaacacccccgaguguccggacgaccagcgcgcguggaauaucugggaaguggaggacuacggauucgggaucuucacgaccaacaucugguugaagcugagagacagcuacacccaggugugcgaccaucgccucaugagcgccgccaucaaagacuccaaggcaguacacgccgauaugggcuacuggaucgagagcgagaagaacgagaccuggaaacuggcacgggccuccuucaucgaggucaagaccugcauuuggcccaagucucacacacugugguccaacggagugcucgagagugagaugauuaucccgaagaucuacgggggccccaucucccaacacaacuaccgcccggguuacuucacccagaccgccggccccuggcaccucgggaagcuggagcucgacuucgaccuaugcgagggcaccacgguggucguagacgagcacugcgggaaucgggggcccagcuugcgcacuaccaccgugacuggcaagaucauucacgaguggugcugucgguccuguacguuaccgccccugcgcuucaaaggggaggacggaugcugguacgggauggaaauccggcccgucaaggagaaggaggagaaucuggugaaguccauggugagcgccggcuccggcgaggucgacagcuuuucucucggucuguuaugcaucuccaucaugaucgaggaggugaugcgcucccgguggagccgcaagaugcucaugacaggcacccuggccguauucuuccugcucaucauggggcaacugaccuggaacgaccuaauacggcucugcaucauggucggcgccaacgccuccgaccgcauggggaugggcaccaccuacuuagcccuuauggccaccuucaagaugcgccccauguuugccgugggccuccuguuccggcgccugacaagccgggaggugcuucugcugacgauagggcucucccuggucgcgagcguggagcugccgaauuccuuagaggagcugggggacgggcuggccaugggcaucaugauccuaaagcugcugaccgacuuccaaagccaccagcuuugggccacccugcugucgcucaccuuuaucaaaacgacuuucagccugcacuacgccuggaagacuauggcaaugguacugucgaucgucagccucuuccccuugugccugucaaccacgagccagaagaccaccugguugcccgugcugcugggaucccucgggugcaagccccugaccauguuccugaucgccgagaaccguauuuggggucgaaagagcuggccgcucaacgaggggaucauggccgucggcauugugagcauccuacuguccagccuccugaagaacgacgugccccucgccgggccccucaucgccgguggcauguuaaucgcguguuacgucaucagcggaagcucugccgaccugucucucgagaaagccgccgagguguccugggaagaggaagcagagcacucuggcgccucccauaacaucuugguggagguccaagacgacggaacgaugaagauaaaggacgaggagcgcgacgacacccugaccauacuccugaaagcaaccuuguuagccgugagcggcguguacccccuguccaucccggccaccuuauucgucugguacuucuggcagaagaagaagcagcggagcggugugcucugggacacgcccucaccgccagagguggaacgagccguacuggacgacggaaucuaccggaucaugcagcguggcuuacuggggcgcagccaggucggcgugggagucuuccaggagaacguguuccacaccauguggcacgugacccguggcgcgguccucauguaccaggggaagcggcuggagccguccugggccagcguuaagaaggaucuuauuuccuacggcggcggguggcgccuccaggguuccuggaacaccggggaggaggugcaggucaucgccguggaaccuggcaagaaccccaagaacgugcagaccgcccccggaaccuuuaagaccuccgagggcgagguuggcgccaucgcgcuggacuucaaacccgggaccucugggagcccaaucguuaaccgggagggaaagaucgugggccuguacgguaacggcgucgugacuaccuccggcacuuacgugagcgccauugcccaggcgaaggcgucccaggagggcccccuacccgagauagaagacgaggucuuccgcaagcggaaucugaccaucauggaccugcauccgggcagcgggaagacgcgccgguaccuccccgccaucgugcgcgaggcaaucaagcgcaagcugcgcacacugauccuagccccgacccgcguggucgccagugagauggcagaggcccugaagggcaugccaauccgguaccagacgacggccgucaagagcgagcacaccggcaaggaaauuguagacuugaugugucaugccaccuucacuaugcgccuccugucccccguccgggugccuaacuacaauaugaucaucauggacgaggcccacuucacggaccccagcuccaucgcugcacgcggguacaucagcacucgggugggcaugggggaggccgccgcaaucuucaugacggcgaccccaccaggcucggucgaggcguucccccagagcaacgccgugauccaggacgaggagcgcgacaucccugaacgaaguuggaauagcggguaugaguggaucacggauuucccgggcaagaccgugugguucgugcccuccaucaagagcggcaacgauaucgccaauugucugcgcaagaacgguaagcggguaauccagcucucccgcaagaccuucgacaccgaguaccagaagacgaaaaauaacgauugggacuacguggucacaaccgacauaagcgagaugggagcuaacuuucgggcugaccggguuaucgaucccagacgcugucugaagcccgugauccuuaaggaugggccggagcgggucauucucgccgggccaaugccggugaccgucgccucggccgcgcaacgcagagggcguaucggccggaaccacaacaaggagggcgaucaguacauuuacauggggcagccccugaacaacgacgaggaccacgcgcacuggacggaggccaaaaugcugcucgacaacaucaacacgcccgagggcaucauccccgcccuguucgaacccgagagagaaaagucagccgcgaucgacggagaguacagacugcgcggcgaggcccgcaagaccuucgucgagcucaugagacgcggggaccugccaguguggcugagcuacaaggucgccuccgaggguuuccaguacagcgaucggcgcugguguuucgacggcgagagaaacaaccagguauuagaagagaauauggacguggagaucuggaccaaggagggggagcgcaaaaagcugcggccgcgcuggcuggacgcgaggacguacuccgacccccucgccuuaagggaguuuaaggaguucgcggccggccggcgcagcgucuccggggaccuuaucuuggaaaucggcaagcugccacagcaccugacccagcgggcccagaaugcacucgacaaccuggugaugcugcacaacagcgagcagggcgggcgcgcguaucggcacgccauggaggagcucccagacaccaucgagacccuaaugcugcucgcgcuuauugcaguguugacgggcggggucacccuuuucuuccuauccggccgcgggcugggcaagaccagcaucggccuccucugcguaauggccuccucgguccugcucuggauggcguccgucgagccgcacuggaucgccgccagcaucauccuugaguuuuuccugauggugcuacugauccccgagcccgaccggcagcgcacgccccaagacaaucagcuggccuacguggucaucgggcucuuguucaugauccugacaguggccgcgaacgaaaugggccuccuagagacgaccaagaaggaccugggaauuggccacguggccgucgagaaccaccaccacgccgccaugcucgacguggaccugcacccggccucagcguggacccuguacgccguggccaccacgauuaucacacccaugaugcggcacacgaucgagaacaccacggccaacaucagccucaccgccaucgcgaaccaggcagcgauccugaugggacuggacaagggguggcccauuuccaagauggacaucggcgucccgcuccuggcccuggggugcuacagccaggugaacccacucaccuugacggcggcaguccugaugcucgucgcucacuaugccaucaucggcccgggacugcaggcaaaggcgacccgcgaggcccagaagaggaccgccgccggcaucaugaagaaucccaccguggacgggaucguggccaucgaccuggauccggucguuuacgacgcgaaguucgagaaacaguuaggccagauaaugcuccugauccucugcaccucccagauccugcuaaugcggacgaccugggcucucugcgagagcaucacucuggccaccggcccccugacgacgcucugggaaggaucccccggcaaauucuggaacaccaccauagcggugagcauggcgaacauauuccgcgggagcuaccuggcgggcgcuggcuuggccuucucccucaugaagucccucgggggugggaggcgcgggacaggggcccagggcgagacccuuggggagaaguggaagcgccagcucaaccaacuguccaagucagaauucaacaccuacaagcgcaguggaaucauggaggucgaccggucggaggcuaaggagggccuaaagcgcggggagacuacaaagcacgcagugagccggggcaccgccaagcuccgcugguucgucgagcggaaccuggucaagcccgaggggaaagugauugaccugggcugcggccgcgggggcuggagcuauuauugcgccgggcuaaagaaggugaccgaggucaagggcuacaccaagggugggccgggccacgaggagcccaucccuauggccacguacggguggaaccucgugaagcugcacuccggcaaggacguguucuucacaccgccagagaagugcgacacccuguugugcgacaucggggagucaucccccaauccaaccauugaggaaggcaggacgcugcgcguccugaagaugguugagcccuggcuccgcggcaaccaguucugcaucaaaauacugaaccccuacaugccaagcguggucgaaacucuggagcaaaugcagcguaagcacggcggcaugcucgugcguaacccccuuucccgcaacagcacccacgagauguacuggguguccugcgggacuggcaacaucguaagcgcugugaacaugaccucccggaugcugcucaacagguuuaccauggcccaccgcaagcccacguacgagcgggacguggaccugggggccggcacccgccacguggccguggagcccgagguggccaaucuggacaucaucggccagcggauagagaacaucaagcacgaacauaaaagcaccuggcacuacgacgaggacaaccccuacaagacgugggccuaccacggguccuacgaggucaagcccagcggcagcgccuccagcaugguaaacgggguagugaagcuacugaccaagcccugggacgugaucccgauggucacccaaaucgccaugaccgauacgacuccguucggccagcagcgcguguuuaaggaaaaggucgacacacggacgcccaaggcuaagcgcgggacggcacagaucauggaggucaccgcgaaguggcuguggggauuucucagccggaacaagaagccacgcaucugcacaagggaggaguucacccgcaagguucggagcaacgccgcgaucggcgccguuuucgucgacgaaaaccaguggaacuccgcuaaggaggccguggaggacgagcgcuucugggaucuggugcaucgggagcgggaacugcacaagcaggggaagugcgcaacgugugucuacaacaugaugggcaagcgggagaagaagcucggggaauucggcaaggcuaaggggagccgagccauaugguacauguggcugggcgcgcgauuccuggaguucgaggcgcucggcuucaugaaugaggaccacugguucucccgcgagaacagccuguccgggguggagggcgaggggcugcauaagcucggcuacaucuugcgggacaucagcaagauccccggcgggaacauguacgcggacgacaccgccgggugggacaccaggaucacggaggacgaccugcagaacgaggcgaaaauaacggacaucauggagccggagcacgcgcuccuggccaaauccaucuucaaacugaccuaucaaaacaagguuguuagggugcagcgccccgcuaaaaacgggaccgugauggacgucauuagccgccgcgaucaacgcggcucaggacaagugggcaccuacgggcuuaauacguucaccaacauggaggcccagcugauccggcagauggagagcgaggggauuuuuuccccgucugagcuggagacuccaaaccucgccgggcgagugcuggacuggcuggagaagcacggggucgagcggcucaaacggauggcgaucaguggggacgacugcguggugaagccuaucgacgaccguuucgccaccgcccugacggcccugaaugacauggggaagguccgcaaggacaucccccagugggaaccgagcaagggcuggaacgauuggcagcagguccccuucugcagccaccauuuccaucagcucaucaugaaggacggccgggagaucgugguccccugucgcaaucaagacgagcuggugggacgggcgcgcgugucccagggcgcgggguggagccugagggagaccgccugucucggcaaguccuacgcccaaauguggcaguugauguauuuccaccgccgggaccugcgccucgccgcgaacgccaucuguagcgccguaccgguggacugggugccgaccucuagaaccacguggagcauccaugcccaccaccaguggaugaccacagaggacaugcuguccgucuggaaccggguguggaucgaggagaacccuuggauggaggauaaaacgcacaucucuuccuggggugaugugcccuaccuggggaagagagaggaccagugguguggcagccuuaucgggcugacugcgcgcgcgacaugggcaaccaacauccaagucgcgaucaaccaggugagacggcugaucgggaacgagaauuaccucgacuacaugaccuccaugaagcgcuuuaagaacgagagcgaccccgaaggggcccugugguga

SEQ ID NO: 24177 - RNA, 9879 nt, Artificial Sequence
  derived and/or modified CDS sequence (opt11) from DENV-1__FJ432744__SS-prME
agcguaacgaugcugcucaugcugaugcccaccgcccuggcguuccaccucaccacccgcggcggggagccacacaugauuguuuccaagcaggagcggggcaagucucucuuguucaagaccuccgcgggggugaacaugugcacucucaucgccauggaccugggggaguucugcgaggacacgaugacguacaaguguccccggaucaccgaggccgagccagacgacguggauugcuggugcaacgccacagauacgugggucaccuacgggaccugcagccaaacgggagagcaucggcgcgacaagcgcaguguggcucuggcgccccacgugggccucgggcuggaaacucgcaccgaaaccuggaugagcagcgagggcgccuggaagcagauccagcgggucgaaaccugggccuuacgucacccuggguuuacggugaucgcccuguucuuagcgcaugccaucggcaccagcaucacccagaaggggaucaucuucauccugcucaugcuggugacgcccuccauggccaugcguugcgugggcaucgguucacgcgacuucguggaaggacuguccggcgcgacguggguggacgucgugcucgagcacgggagcugugugaccaccauggccaaagacaagccuacccuggauaucgagcugcucaagacggaggucaccaaccccgcggucuugcggaagcuuugcaucgaggcaaagaucucaaacaccaccacggacagccgcugcccgacccagggcgaggccacccuuguggaggagcaggacgccaacuucgucugucggagaaccuucguggaccggggcugggggaacggcugcggucuguuuggcaaagguucccucaucacgugcgcaaaguucaaaugcgugacuaaacuggagggcaaaacaguccaguacgagaaucugaaguacagcgugaucgugaccguccacacgggcgaccagcaccagguggggaacgaguccaccgagcacggcaccacagcgacuaucaccccccaggcccccagcaccgagauacaacugaccgacuacggggcccucaccuuagacugcagcccccgcacgggccuggacuuuaacgaaaugguccuccugaccaugaaagagaaggcuuggcuggugcacaagcagugguuccucgaccugccgcugcccuggacgagcggggccagcaccucucaggagacguggaaccggaaggauuuacuggugaccuucaaaaccgcgcacgccaagaagcaggagguaguggugcugggcucucaggagggcgcuaugcacaccgcccucacuggggccaccgagauccagacguccgggaccacgaccaucuucgccgggcaucugaaaugucgccugaagauggacaagcuaaccuugaagggcaugagcuacguaaugugcaccgggucguucaaguuagagaaggagguggccgagacgcagcauggcaccgugcucguccagaucaaauacgaggggaccgaugcccccugcaaaaucccguucucuacccaggacgagaaggggguuacgcagaacggccggcugaucaccgccaauccgauagugaccgacaaggagaagccugucaauaucgaagcggagccgcccuucggggaauccuacauugugauuggcgccggcgagaaggcucuuaagcugagcugguucaagaaaggguccagcauaggcaagauguuugaagcuacugccagaggggcgcgucgcauggccauccucggugacacugccugggacuuuggguccaucggcggcguguucacgagcgucgggaagcuggugcaccagaucuucggcacagccuacggagugcuguucucaggcgucuccuggaccaugaagaucggaaucggcgugcuccugaccuggcugggcuuaaauucccgcagcaccucucugagcaugaccugcaucgcgguugggcuggucacccucuaccuggguguaaugguucaggcagacuccgggugcgucaucaacuggaagggccgggagcugaagugcgggagcggcauauucgugacaaacgaggugcacaccuggacugagcaguacaaguuccaggcugacagcccgaaacgccucagugccgccaucggcaaggccugggaggagggggucugcggcauccgaagcgcgaccaggcuagagaacaucauguggaaacagaucuccaacgagcuuaaccacauccucuuggagaacgacaugaaguuuacuguggugguaggggacguggccggcauccuggcgcagggaaaaaagaugauacgaccccagcccauggaguacaaguacagcuggaaguccuggggcaaggccaaaaucaucggcgcagacguacaaaacgccacguucaucauagacgggcccaacaccccggaaugucccgaugaccagcgcgcauggaacaucugggagguugaggacuacggcuucgggauauucaccaccaauaucuggcugaagcugcgggacucuuauacccaggugugcgaucaccgccugaugagugccgccaucaaggacagcaaggcggugcacgccgacaugggcuacuggaucgagagcgaaaagaacgagacguggaagcucgcacgggccagcuuuauugaggucaagaccuguaucuggcccaagucccacacccuguggucuaacggugugcuggaguccgagaugaucauccccaagauauacgggggcccgaucagccaacacaauuaccgcccuggguauuucacucagacggccggacccuggcaucucgggaagcuugagcuggauuucgaccucugugagggcaccacaguggucguggacgagcauugcggcaaccgggggcccagucugcgcacgacgaccguuaccggcaagauuauccacgaguggugcugccggucaugcacgcugccgccccugagguucaagggagaggacggcugcugguacgggauggagauucgacccguaaaggagaaggaagagaaccuaguuaagaguaugguaagcgcgggcagcggcgaagucgacuccuucagccuggggcuccugugcaucuccaucaugauugaggaggugaugcguagccgguggucgcgcaagaugcuaaugaccggcauccucgccguguucuuccugcugaucauggggcaacucaccuggaacgauuugauucggcugugcaucaugguuggcgcuaacgccagcgaccgcauggguaugggcaccacuuaccucgcacugauggcuacauuuaagaugcgcccgauguucgccgugggccuccuauuccggcgacucaccucccgagaggugcugcuucucaccaucggauugagccucgucgccuccguggagcucccaaacagccuggaggaacucggcgacggucuggccaugggcaucaugauacugaagcuacugacagacuuucagucccaccaacugugggcgacccuccugagccugaccuucauuaagaccacguuuagucuccacuacgccuggaagaccauggccauggugcugagcauagugucccuguucccccucugccugagcaccacuucccagaaaaccaccuggcugcccgugcuccuggggagccucgggugcaagccguuaaccauguuucugaucgccgagaacaagaucuggggccgcaaauccuggccgcugaacgaggggauuauggccgucggcaucgugagcauccuacugagcagucuacucaagaacgacgugccucuggcggggccccugaucgccggcggcaugcuuauugccuguuacgucaucuccgguuccagcgccgaccucucccuggagaaggccgcggagguuagcugggaagaggaagccgagcacuccggcgcgagucacaauauccucguggagguacaggacgacgggaccaugaagaucaaggacgaggagagggaugacacgcuuaccauccugcucaaggcgacgcuguuagccguguccgguguauacccgcucagcauccccgcgacccucuuugucugguacuucuggcagaagaaaaagcgccgguccggggugcugugggacacgccauccccccccgaaguggagcgcgccguguuggacgacggcaucuauagaaucaugcagcgcggccuguuagggcggucccaggugggcgucgggguauuccaggaaaacguuuuccacacaauguggcacguuacccgaggcgccgugcugauguaccaggggaagcggcucgagcccagcugggcauccgugaagaaggaccugauauccuacggcggcggguggcgacuucagggcuccuggaacaccggggaggaggugcaagucaucgcaguggagcccggcaagaaucccaagaacguacagaccgcgcccgggacauucaaaaccagcgagggugaggucggcgccaucgcccucgacuucaagccagggaccucgggcucccccaucgugaaccgagaggggaagaucguaggccuguacggcaacggggucguaaccacgucuggcaccuacgucuccgcuaucgcgcaggccaaggccucacaggaggggccccugccugagauugaggaugagguuuuccgcaagcggaaccugaccauaauggaccugcacccaggcagugggaagacccgccgguaccugccggccaucguacgcgaggccaucaagcggaagcuccggacgcugauccuggcgccgaccagggugguugccagcgagauggcggaagccuuaaagggcaugccgauccgcuaccagaccaccgcagugaaguccgagcacacgggcaaggagaucguggaccugaugugccacgcuaccuucaccaugcgacuccucagccccguccgggugcccaacuauaacaugaucaucauggacgaggcccacuuuaccgacccguccagcaucgccgcccggggguacauaucgacgcgagugggcaugggagaggccgcagccaucuucaugaccgccacgccuccgggcucggucgaggccuucccccaguccaacgcggugauccaggaugaggagcgcgacaucccggagcggagcuggaacuccggguaugaauggaucaccgacuuucccggaaaaacggucugguucguccccucuaucaaguccgguaacgacaucgccaacugccugcgcaagaacgggaagagggugauccaacugagccgcaagaccuucgacacugaauaccagaagaccaagaauaacgacugggauuauguggucacgacagacaucuccgagaugggagccaacuuccgugcugaucgcguaaucgacccccggcgcugccucaagccggugauccugaaggacgggcccgagcgugucauccuugccggccccaugcccgugacaguugcgagcgcggcccagcgccgggggcgcaucgggcggaaccacaacaaagagggcgaucaguacaucuacaugggucagccgcugaacaacgacgaggaccacgcccacuggaccgaagccaaaaugcugcuagacaacaucaacacgcccgaaggcaucauccccgcccucuucgagccugaacgcgagaaguccgccgccauugauggggaauaccgccugcggggcgaggcccggaagaccuucguggagcugaugcggcgcggggaccucccgguuuggcugagcuacaaggucgccagcgagggcuuccaguauuccgaucggcguuggugcuucgauggcgagagaaacaaccaaguucuggaggagaacauggacguggagaucuggaccaaagagggggaacgcaagaagcucagaccccgcugguuagacgcgaggacuuauagcgacccccuggcccuccgggaguucaaggaguucgccgccggccggcgcucggucagcggggaccugauacucgaaauuggcaaacugccgcaacaccuuacgcaacgggcacagaacgccuuagacaaccucgugaugcugcacaacuccgagcaaggagggcgcgccuaccggcacgcgauggaggagcugccggacacaaucgagacccucaugcuccuggcccucaucgcgguucugaccggcggggucacccuguucuuccucagcggucgcggguugggcaagaccuccaucggccugcucugcgugauggccagcuccguccugcuguggauggcaagcgucgagccucacuggaucgccgcuucuaucauucuugaguucuuccugaugguguuacuuauccccgagcccgaccggcagcgcaccccgcaggacaaccagcuggcguacguagucaucgggcuccucuucaugauccuaaccguggccgccaacgagaugggacuacucgagaccacgaagaaagaucuggggaucggccacgucgccguggagaaccaccaccacgccgcgaugcuggacguggaccuccacccggccagcgccuggacccuguacgccguggcaacaaccaucaucacacccaugaugcggcacaccaucgagaacaccaccgcuaacauaucacucacggcaauugcuaaucaagcugcgauccucauggguuuagacaaggguuggccgauaagcaaaauggauaucggagucccacugcucgccuuagggugcuacucccaggugaacccccugacacucacagccgcugugcugauguuggucgcccacuaugcgaucaucggccccgggcugcaggcgaaggccacccgcgaggcccaaaaacgcaccgcggcgggcauuaugaagaacccgacgguggacgguaucgucgccauagacuuggaccccguggucuacgacacaaaguuugagaagcagcuggggcagaucauguuguuaauccugugcaccucacagauacuccugaugcggacgaccugggcgcugugcgagagcaucacccucgcaaccggcccccugacuacccugugggaagggagccccggaaaauucuggaacaccacgaucgccguguccauggcgaacauauuccgagguagcuaccucgccggcgccggcuuagcuuucucucugaugaagucccuggggggggggcgacgcggcacaggugcgcagggcgagacccucggcgagaaguggaagcggcagcugaaccagcucuccaaguccgaauuuaacaccuauaagcgcagcgggaucauggaagucgaccgguccgaggcuaaggagggccugaagcguggagagaccacgaagcacgccgugucacggggcaccgccaagcugcgaugguucguggaacggaaccuugugaagccugagggaaagguuaucgaucugggaugcggacgcgggggcuggucguauuacugcgcagggcugaagaaagugaccgaggucaagggcuacaccaagggcgggccgggccacgaagagcccaucccuauggcgacguacggguggaaccuggugaagcuccacagcggcaaggacguguucuucaucccacccgagaagugcgacacgcugcugugcgacaucggggagucaucacccaaccccaccaucgaggagggcaggacccuacgagugcugaagaugguagaaccguggcugcgcgggaaucaguuuugcaucaaaauauugaaccccuauaugcccucuguggucgagacgcuggaacaaaugcagcgcaagcacggcggcaugcugguacgcaacccacucagccgaaacuccacgcacgaaauguacugggugagcugcgggaccggcaacauugucuccgcagugaacaugacaagccggaugcugcugaaccgcuucacgauggcccacaggaagccgacguacgaacgggauguggaccuuggugccggcacgcgacacgucgccguggagccagagguggcgaaucuggacaucauugggcagcgaauugagaacauaaagcacgagcacaaguccacauggcacuacgacgaggacaacccguacaaaacuugggccuaccacgggagcuacgagguuaagccguccgguagcgcaagcagcaugguuaacggggucgugaagcugcucacgaagccgugggacgugauaccaauggucacccagaucgcgaugaccgacaccacgcccuuuggccaacagcggguguucaaggagaagguugacacccggacccccaaggcuaaacgcgggacggcgcagaucauggaggucacugccaaguggcuguggggcuuccugucacggaacaagaagccgcgcaucugcacccgcgaggaguucacccgcaaaguacgguccaaugccgccauaggcgcgguguucgucgacgagaaucaguggaacagcgccaaggaggccguggaggacgagcgcuucugggaccucgugcaccgggagagggagcugcacaagcaggggaaaugcgcgacaugcgucuacaacaugaugggcaagcgggagaagaagcucggggaguucggcaaggccaaggggucccgcgccaucugguacauguggcuuggcgcccgguuccuugaguucgaggcccugggauucaugaacgaggaccacugguucagucgcgagaacucucucagcggcguugaaggcgaagggcugcauaagcuuggguacauccuccgagacaucuccaagauccccggaggcaacauguacgccgaugacacggcgggaugggacacccgcaucaccgaagacgaccuccagaacgaagcgaagaucaccgauaucauggagccagagcacgcccugcuugccaagagcaucuucaaacugacguaccagaacaaggugguccgggugcaacgcccugccaagaacgggacugugauggacgucaucuccagacgggaccagcgcggcagcggccaggugggcaccuacggccuaaacaccuuuacgaacauggaagcacagcucauccggcagauggaaucggaggggauauucagccccuccgaacuggagacacccaacuuggcgggccgcgugcuugauuggcuggagaagcacgggguagagcggcugaagcgcauggccaucagcggcgacgacugcguggugaagcccaucgacgaccgguuugccacugcccucaccgcacucaacgacauggggaaaguucguaaggacauuccacagugggagcccuccaagggcuggaaugauuggcagcagguccccuucugcagccaucauuuccaccaguuaaucaugaaagacgggcgggagauugucguccccugccgcaaucaggacgagcucgugggccgugcgcgcgugagccagggagccggguggucccugcgggagacggccugccugggcaaguccuaugcgcagauguggcagcucauguacuuccaucgccgcgaccugcgccuggcggccaacgccaucugcuccgcagucccgguugauugggugcccacuagccggaccaccugguccauccacgcucaccaccaguggaugacgacagaggacaugcuuagcguguggaaccgcguguggaucgaggagaaccccuggauggaagacaagacccacauuuccagcuggggcgacgugcccuaucugggcaagcgggaggaccaguggugcggcucccugaucgggcuaaccgcgcgcgcgacgugggccaccaacauacaggucgccaucaaccaggugcgccggcuuaucggcaacgagaacuaccuggacuacaugaccucgaugaaacgcuucaagaacgagauagauccggagggggccuuaugguga

SEQ ID NO: 24178 - RNA, 9879 nt, Artificial Sequence
  derived and/or modified CDS sequence (opt11) from DENV-1__FJ547060__SS-prME
agcgugaccaugcugcuaaugcugaugcccaccgcccuggccuuccaucucaccacccggggcggggaaccccacaugauugugaccaagcaggaacggggcaagagccugcuguucaagaccagcgccggggugaacauguguacccucaucgccauggaccucggggagcugugcgaggacacuaugaccuauaagugcccacggaucaccgaagccgagcccgacgacguggacugcuggugcaacgccaccgacaccugggugaccuaugggaccugcucccagacgggggagcacaggcgcgacaagcggaguguggcccucgcgccccacgugggucuggggcuggaaacccgcaccgagaccuggaugucaagcgagggugccuggaagcagauccagcggguggagacgugggcacuccgccaccccggguucaccgugaucgcccuguuccuggcgcacgccaucggcacguccaucacccagaaggguauuaucuucauccuccugaugcuggucacucccagcauggccaugcgcugcgucggcaucggcucccgagacuucguggaagggcuuagcggcgccaccuggguggacguuguguuagagcacggguccugcgugaccaccauggcuaaagacaagccaacgcuggacaucgagcucuugaagaccgaggucaccaacccagcgguccugagaaaacucugcaucgaagccaagaucagcaacacgacgacggacucacgcugccccacccagggcgaggccacccuuauggaggagcaggacgccaacuucgugugccggcgcacuuucgucgaccgggggugggggaacggaugcgggcuguucggcaaggguagccuaaucacgugcgccaaguucaagugcgugaccaagcuggagggcaagauaguucaguacgagaaccugaaguauuccgucaucguaaccgugcacacgggcgaccagcaccaggucgggaacgagagcacggagcauggcaccaccgcgaccaucacgccgcaggcccccaccuccgaaauccagcucaccgacuacggagcccugacccuggacugcagcccacguacaggccucgauuucaacgagauggugcuccugaccaugaaggagaaaagcuggcucguacacaagcagugguuccuggaccuaccgcuccccuggaccagcggggccagcaccucgcaggagaccuggaaccgccaggaccugcuggugaccuucaaaaccgcccacgcgaagaagcaggagguggucgugcucgggucccaggagggcgccaugcacaccgcccugacgggggcuaccgagauccagaccuccggaaccacuaccaucuucgccgggcaccugaagugccgccucaagauggacaagcugacccucaaggguaugagcuacguuaugugcaccggguccuucaagcucgagaaggaggucgccgagacacagcauggcaccgugcuggugcagaucaaguaugagggcaccgacgcccccuguaagauccccuucagcacccaggaugagaagggggucacgcagaacggccggcugaucacggccaauccgauagugaccgacaaggagaaaccagucaacaucgaggccgagccgcccuucggggagagcuacaucguuauaggggcgggugagaaggcccucaagcucagcugguucaagaagggguccagcaucggcaagauguucgaagccaccgcccgcggggcccggcgcauggcgauccugggcgauacggccugggacuucggguccaucggcggaguguucaccaguguggggaagcuaguccaccagaucuucggcaccgcuuacggcgucuuauucuccggggugucuuggaccaugaagaucggcaucggcguccuccugacguggcucggacugaauagucgcagcacaucccugagcaugaccugcauugccguggggcucgugacccuguaccugggcgucaugguacaagcugacuccgguugcgugaucaacuggaagggccgggagcucaagugcgggagcggcaucuucgucacgaacgaggugcacaccuggaccgagcaguacaaauuccaggcggacagcccaaaacgacugagugcagccauaggcaaggccugggaggagggggugugcggcauccggagcgccacccgccuggaaaacauuauguggaagcaaaucuccaacgaguuaaaccacauacugcuggagaacgacaugaaguucaccgucgugguaggggacgucgugggcauccucgcccaggggaagaaaaugauccggccccagcccauggagcacaaguacagcuggaaguccuggggcaaggccaagauaaucggcgccgacguccagaacacgaccuucaucaucgacggacccaacacuccugagugccccgaugaucagagggccuggaacaucugggaagucgaggacuacgguuucgggaucuuuacgacgaauaucuggcugaagcugcgggacagcuacacccagguaugcgaccaccgccucauguccgcggccauaaaagacagcaaagccgugcacgccgacaugggguacuggauagaguccgagaagaacgagaccuggaagcuggcccgggcgagcuucaucgaggucaaaaccugcaucuggccgaagucccacacauuguggagcaacggagugcucgaguccgagaugaucauccccaagaucuacgggggcccgaucagucagcacaacuaccgccccggguacuucacccagaccgccggcccuuggcaucuggggaagcuggagcucgacuucgaucugugcgagggcacaacgguggucguggacgagcacugcggcaaccgggggccgucccugcgcaccacgaccgugacgggcaagaucauccacgaguggugcugccggucaugcacccugccgcccuugcgcuucaaaggggaggacggcugcugguacgggauggagauacggcccgucaaggagaaagaggaaaaccuggugaaguccauggugagcgccggcagcggcgaggucgacuccuucagccucggccugcugugcaucuccaucaugaucgaggaggugaugcgcucccguuggucccgcaagauguugaugaccggcacccuggccguguuccugcuccugaucauggggcagcuuacguggaacgaucucauccgucugugcaucauggucggcgcaaacgcgagcgaccgcauggggaugggcaccaccuaccuggcgcucauggccaccuuuaagaugcgcccgauguucgccgugggccugcuguuccggcgacucacgucccgggaggugcugcugcucaccaucggguugagccuggucgccuccguagagcuccccaacagucuggaggagcucggcgacggacucgcgaugggcauaaugauccugaagcuacucaccgacuuucagucccaccaguugugggccacucuccucucacugacguucaucaagaccacccugucccuccauuaugccuggaagaccauggccaugguucugagcaucguuucccuguucccucucugcuuaucgacgaccucccagaagaccacuuggcugcccgugcuccuggguagucuggggugcaagccacucacgauguuccugaucgcugagaacaaaaucuggggccgcaaguccuggccccuaaacgaggggauaauggcggucggcgugguaagcauccuccugucaucccuucucaagaacgacgucccccuggccgggccucugaucgccggcggcaugcucaucgcuugcuacgugaucagcgggagcagcgcggaccuaucccuggagaaggccgcggaggugagcugggaggaggaggccgagcacucaggcgccagccacaacauccuggucgaggugcaggacgacgggaccaugaagaucaaggacgaggagagggacgacacgcuuaccauccugcugaaggcgacccugcuggccgugucuggcgucuacccgcucagcauccccgccacacucuucgugugguacuucuggcagaagaagaaacagagguccggggugcuaugggacacccccagcccgccagagguggagcgugccgugcucgacgauggcauuuaccgcaucaugcagcgggggcuccuggggcgcucccaggugggcgucgggguguuccaggagaacguauuccacaccauguggcacguaacccggggcgccguguugauguaccaagggaagcgccuggagcccagcugggcguccgugaagaaggaucuuauaagcuacggcggcggguggcggcugcagggcuccuggaacacuggggaggagguccaggugaucgccguggagcccggcaaaaaucccaagaacguccagaccgcccccgggaccuucaagacccccgagggcgaaguuggagccaucgcccucgacuucaagcccggcacgagcggaucgccuaucgugaacagggaggggaagaucgucggccucuacggcaacgggguagucaccaccagcggcaccuacgucagcgcgaucgcccagacaaaggccucccaggaggggccgcugcccgagaucgaggacgagguguuccggaagcgcaaccugacgaucauggaccugcaccccggcagcgggaagacgcggcgauaccugcccgccaucgugcgggaggcgaucaagcgcaagcuccggacccugaucuuagccccgacgcgcguaguggccuccgagauggccgaagcccucaaaggcaugcccauccgcuaucagaccaccgcggucaagagcgaacacaccgggaaggagaucgucgaccugaugugccacgccacguucaccaugcggcugcucucccccgucaggguuccaaacuacaacaugaucauuauggacgaggcccacuucaccgaccccagcuccaucgccgcccggggguacaucagcacccgcgucggcaugggggaagccgccgccaucuucaugacggccacgccgccaggcucgguggaagccuucccacagagcaacgcggugauccaggacgaggagcgggacauccccgagcgcagcuggaacagcggguacgaguggaucaccgacuucccuggcaagaccgucugguucgugcccucaaucaaaagcgggaacgauauagcgaacugccugcggaagaacgggaagcgagucauccagcugucccggaagacguucgauaccgaguaccagaagaccaagaacaacgacugggacuacgucgugaccacggacaucagugagaugggugccaacuuucgagccgaccgcgugaucgacccgcgccggugccucaagccagucauccugaaagaugggcccgagcgcgugauccuggcgggccccaugccgguuaccguggccuccgccgcucagcggcgcgggcggauaggacgcaaucauaacaaggagggcgaccaguacaucuacaugggccagccucuuaacaaugacgaggaccaugcccacuggaccgaagcgaagaugcugcuggacaacaucaacacaccagagggcaucauccccgcccucuuugagccggaacgggagaaguccgccgccauugacggggaguaucgccugcggggcgaagcccggaagaccuucguggagcugaugcgccgcggggaccuccccguauggcuguccuacaagguggcgagcgagggcuuccaguauagcgaccgccgguggugcuucgacggcgaacgcaacaaccaggugcucgaggagaacauggacgucgaaaucuggaccaaggagggggaaaggaagaagcugcgcccccgguggcuggaugcucguaccuacuccgaccccuuagcccuccgggaguucaaggaguucgccgccggccgccgaagcguauccggcgaccugauccuggagaucggaaagcucccgcagcaccugacccaacgcgcacagaacgcccuagacaaccucgugaugcugcacaacagcgagcaaggcgggcgggcuuaucgccacgccauggaggagcuacccgauacaaucgagacccuuaugcugcuggcgcucaucgccguucugacgggcggggugacccuguucuuccucuccggccggggucugggcaagacgagcaucggccugcugugcgugauggccuccagcguccuauuguggauggccucaguggagccgcauuggaucgccgcuagcauuauccucgaguucuuucugauggugcuucucauucccgagccggaccgucagcggacgccccaggacaaccagcuggccuacgucgugauugggcuccucuucaugauccugaccguggcugccaacgagaugggccugcucgagaccaccaagaaggaccuggggaucggccacgucgccguggagaaccaccaccacgcgacgaugcuggacguggaccuccacccugccuccgccuggacccuguacgccgucgccacaaccaucauuacgccgaugaugcgccacaccaucgagaacaccaccgcgaacaucagcuuaacggccaucgccaaccaggccgcaauccugauggggcuggacaagggcuggccgaucuccaagauggauauuggcgugccccugcucgccuuggggugcuacucacaggugaacccgcugacccucacagccgccguccugaugcugguugcccauuacgcgaucaucggccccgggcuccaagcgaaagccacacgggaagcccagaagcgcacagccgcggguauuaugaagaaccccaccguggacggcaucgucgccaucgaccuggaccccgugguguacgacgccaaguucgagaagcaacugggccagauaaugcuccugauccugugcaccucccagauacucuuaaugcgcaccacaugggcacugugcgagagcaucacccuagccaccggcccccugaccacgcugugggagggguccccgggcaaguucuggaacaccacaaucgcggucagcauggccaacaucuuccgggggucguaccucgccggugcuggccuggcuuucagccugaugaaaucuuuaggagggggacgccgggggaccggggcgcagggcgagacgcugggcgagaaguggaagcgccaacugaaccaacucagcaagagcgaguucaacaucuacaagcggucugggaucauggaaguugaccgcucugaggcaaaagagggccugaagcgcggggagaccacccgccaugcgguuucccgcggaaccgccaagcugcguugguucguggagcgcaaccuggugaagcccgaggggaaggugaucgaucuuggcugcgggagagggggcuggagcuacuacugcgccggguuaaagaaagucacggaagugaagggauauaccaagggcgggcccggccaugaggagcccaucccgauggccaccuacggguggaaucuggugaagcuccacucgggcaaggacgucuucuucacgccgcccgagaagugcgacacccugcugugcgacaucggggagagcucccccaacccgaccauugaggagggucggacccuccgcgugcugaaaaugguugagcccuggcugcgggggaaccaguucugcaucaagauccuaaaccccuacaugcccucggugguggaaacccuugagcagaugcagcgcaagcacggcggcaugcugguacggaacccgcucucucgcaacagcacccacgaaauguacugggucuccugcgggacgggcaacaucgugagcgccgugaauaugaccagccggauguuacugaaccgcuucaccauggcccaccgcaagcccaccuacgagcgugaugucgaccucggggccggaacgcggcacguggcgguggagcccgaggucgccaaccuggacaucaucggccaacgcaucgagaauaucaagcacgagcacaagucuaccuggcacuaugacgaggacaaucccuacaagaccugggccuaccacgggagcuacgaggugaagccgagcggguccgccagcagcauggucaacgggguggugaagcuguuaaccaagccuugggacgugauccccauggugacgcaaaucgccaugaccgacaccacccccuucggccagcagcgcguguucaaggagaaagucgacacgcggaccccgaaggcgaagcgcgggaccgcccagaucauggaggugaccgcacgguggcuauggggcuuccugucccgcaacaagaagcccaggauaugcacgcgcgaggaguucacccgcaaagugcgcagcaaugccgccaucggggcgguauucguggacgaaaaccaguggaacuccgccaaggaggccguggaggacgagcgauucugggaccucguccagaaggaacgugagcugcacaagcagggcaagugugcgaccugcguguacaacaugaugggcaaacgugagaaaaagcugggagaguucgguaaggcgaaggggagccgcgccaucugguacauguggcuuggcgcacgauuccuggaguucgaggccuugggcuucaugaacgaagaccauugguuuucccgcgagaacagccucuccgggguggagggcgaagggcugcacaaauugggcuauauccuccgggacaucagcaaaauccccggcggcaauauguacgccgacgacaccgcgggaugggauacgcgcauaacugaagacgaccugcagaaugaggccaagaucaccgacaucauggagccggaacacgcccugcucgccacguccaucuucaagcugacguaccagaacaaggucgugcgggugcagcgccccgccaagaacgggaccgucauggacgugaucagccgcagagaccagcgcggcuccggccaggugggcaccuacggccugaacaccuuuacuaacauggaggcccagcucguccgacagauggagagcgaggggaucuucucccccugcgagcucgagauccccaaccuggccgaacgggugcucgacuggcuggagaaguacggcguggagcggcugaaacgcauggcgaucagcggggaugacugcguugugaaaccgaucgacgaucgguucgccaccgcccucaccgcgcugaacgacaugggaaaggugcgcaaggacgucccccagugggagcccuccaagggguggaacgacuggcagcagguccccuucugcagccaccacuuccaccaacugaucaugaaggacggccgggagaucguggucccgugccggaaccaggaugagcucgugggccgggcccgggugucccagggggccgguuggagccugcgggagaccgccugccugggcaagucauacgcucagauguggcagcucauguacuuccaccgacgggaccuccgccuggcggccaacgcuaucugcuccgccguccccguggacugggugcccacgagccggaccaccugguccauccacgcgcaccaccaguggaugacgacggaggacaugcucagcgucuggaaccgcguguggaucgaggagaaccccuggauggaggacaagacccaugugucaucuuggggcgacgucccguaccuggggaaacgcgaagaccaguggugcggcucacugaucggccucaccgccagggccaccugggccuccaacauacagguggccaucaaccaggugcgccggcugauaggcaacgagaacuaucuggacuacaugaccuccaugaagcgcuucaagaacgaaggcgaccccgagggggcgcucugguga

SEQ ID NO: 24179 - RNA, 9879 nt, Artificial Sequence
  derived and/or modified CDS sequence (opt11) from DENV-1__FJ432745__SS-prME
ucugucacuaugcugcucaugcugaugccgaccgcacuggccuuccaccucaccaccagaggaggggaaccccacaugguggugagcaagcaggaacggggcaagagccuguuauucaagaccucagcgggggugaacaugugcacccucaucgcgauggaccugggcgagcugugcgaggacacuaugaccuacaagugcccccgaauaaccgaggccgagccagacgacguggacugcuggugcaacgcaacggacaccugggugacuuacgggaccugcagccagaccggggaacaccgccgcgacaagcgaucuguggcccucgcgccucaugucggccugggucuugagacgcggaccgagaccuggaugagcuccgagggcgcguggaaacagauccagcguguggagaccugggcccuucgccacccgggcuucacggugauagcccuguuccuggcgcaugcuaucgggacuagcaucacccaaaaggguaucauauucauucuccugaugcuggucacacccagcauggccaugcggugcgugggcaucgguagccgcgauuuuguugaagggcucucaggugccacgugggucgacguggugcuggagcacgggucgugcgucacgacuauggccaaggacaagccaacccuggacaucgagcuccucaagacugagguaaccaacccugccauuuugcggaagcucugcaucgaggccaagaucuccaauaccaccacggacagccgcugcccaacccagggcgaggcuaccuugguggaggagcaggacgccaacuuugugugccggcgcacguucgucgacagggggugggggaacggcugcgggcuguucggcaagggguccuuaaucacgugcgccaaguucaagugcgucaccaagcuggagggcaagaucguccaguacgagaaccucaaguacagcgugaucgugaccgugcacaccggugaucagcaccaaguggggaacgaguccacggagcacggcacaaccgcgaccauuacgccccaggccccaacgaccgagauccagcucaccgacuacggggcgcugaccuuggacugcagcccgagaacgggcuuagauuucaacgagaugguccugcugaccaugaaagagaaauccuggcucgugcauaagcagugguuccuugacuuaccucuccccuggacgagcggggccagcaccucacaggaaacguggaaucgccaggaccugcuggugaccuucaagaccgcccacgcgaagaagcaggaggucgucguucugggcucccaggagggggccaugcacaccgcgcugacgggggccacugaaauccaaaccuccggcaccacuaccauuuucgcggggcaccugaaaugucgucucaagauggacaaacuuacccuaaagggcaugucauacgucauguguaccggguccuucaagcucgagaaggagguugcggaaacgcagcacggcacgguccucguacagauuaaguaugagggcaccgacgcgcccugcaagauacccuucucaacacaggacgagaaggggguaacccaaaacggccgacugaucaccgccaacccgaucgugaccgacaaggaaaagccgguaaacaucgaagcggagccgccguucggggagucauacaucgugauuggcgcaggcgagaaggcgcugaaacucagcugguucaagaaggggucaucgaucgggaagauguucgaggccaccgcacgcggggcccggcguauggccauauugggcgacacggccugggacuucgggucaaucggcggcguguucacuagcgucgggaagcuaguucaccagaucuucggaaccgccuacgggguccuguucucgggcgucagcuggaccaugaagaucggccugggcgugcugcucacguggcuaggccugaacagucguuccaccucacucucaaugaccugcauugccgugggacuggucacccuguaucucggcgucauggugcaagcagacuccgggugcgucaucaauuggaaggggcgggaguuaaagugcggcagcggcauuuucgugacgaacgaggugcauacguggaccgagcaguauaaauuucaggcggauagcccgaagcgccuguccgccgccauaggcaaggccugggaagagggagucugcggcauacgcucugccacccggcuagagaacgugauguggaagcagaucaguaaugaauugaaccacauccugcuagagaacgauaugaaguucaccguuguggugggggacguggcgggaauauuggcccaggggaaaaagaugauccggccccagcccauggaauacaaguacagcuggaaguccuggggaaaggcaaagaucaucggcgccgacguacagaacacgaccuucauuaucgacggccccaacaccccggagugucccgaugaccagagggcguggaacaucugggagguugaggacuacggauucgggauuuucaccacgaacaucuggcucaaacuucgagacagcuacacccaagugugugaucaccgccugauguccgccgcaaucaaggacaguaaggccguccacgccgauaugggcuauuggaucgaguccgagaagaacgagaccuggaagcuggcgcgggcuuccuucaucgaggugaagaccuguauuuggcccaagucccacacacucuggagcaacggcguucuggaauccgagaugaucauccccaagauuuacggaggcccaaucagccagcacaauuaccggcccggauauuucacccagaccgccggccccuggcaccuugggaaacuggagcuugacuucgaccugugcgagggcaccacugucgugguggacgagcacugcggcaaccggggaccgucccuccgcaccaccacagucacggguaagauuauacacgagugguguugccgcagcugcacauuaccgccccuucgcuuccggggcgaggacggcugcugguaugggauggaaaucaggccggugaaggagaaggaggagaaccuuguaaagagcauggucagcgccggcagcggugagguggacuccuucagccuggggcugcucuguauauccaucaugauagaagaaguaaugcggucccgcuggucgcggaagauguuaaugaccggaacgcuggcggucuuccugcugcugaucauggggcagcucacguggaacgaccugauccgccuguguaucauggucggcgcgaacgccagcgaucgaauggggaugggcacgaccuaccucgcccugauggccaccuucaagaugcggccgauguucgccguugggcuccuguuucgucggcuuacgucaagggaaguacuguugcuaaccaucggguugagccucguggcgagcgucgagcugccaaacagcuuagaagaacucggcgauggguuggccaugggcaucaugauccugaagcuccugacagacuuucaaucgcaccaacugugggccacccuccugucucugacauucaucaagaccaccuuuucgcuccacuacgccuggaagacgauggcgaugguucugagcaucgugucccuauucccgcucugccuuagcacgacaucccagaagaccacauggcugcccguccuccugggcagcuuagggugcaagccgcucacgauguuuuuaaucgcagagaacaaaauauggggcagacgcuccuggccccugaacgaggguaucauggcgguggguauagugagcauccuccucagcucccugcucaagaacgacgucccccuggccgggccccugaucgccggcggcauguuaauagcgugcuacgugaucagcggguccagugcggacuuaucucuggagaaagccgcagaggugucgugggaagaagaggccgaacauuccggcgcgagucacaacauccucgucgaggugcaggacgacgggacuaugaagaucaaggacgaggagcgugacgacacccugaccauccugcucaaggccacgcugcuggccgugucaggcguuuacccgcucucgaucccagccacgcuguucgugugguacuucuggcagaaaaagaagcagcguuccgggguacuaugggacacccccagcccgccugaggucgaacgggccguguuagaugacggcauuuaccgcauuaugcagcggggccuccucggaaggucccaggugggcguugggguuuuccaggagaauguguuucacacuauguggcacgucacacggggcgcggugcugauguaccaggggaagaggcucgagcccagcugggcaucugugaagaaggaccugauaagcuauggaggcggauggcggcugcagggcuccuggaacacgggggaagagguccagguuaucgccguggagcccggcaagaaccccaagaacguucagacggcuccggggaccuucaagacgccggagggcgaggugggcgccauagcgcucgacuucaagcccgggacgagcggcucucccaucgugaaccgagaggggaagauagugggccuguacggcaacgggguggugaccaccagcggcaccuacgucagcgccaucgcccaggccaaagcgucccaggaggggccgcugcccgaaauugaggacgaaguguuccggaagcgcaaucucacgauuauggaccugcaucccggcuccgggaagacccggcgcuaucugccugccaucgugcgggaggccauuaagcgcaagcugagaacacugauacucgccccgacccgagucguggccagugaaauggcggaggcccucaaggguaugccaauccgcuaucagacgacggccgucaagucugagcacaccggcaaggagaucgucgaccugaugugccacgccacguuuacaaugcgauuacuguccccugugcgcgugccgaacuauaacaugaucaucauggaugaggcucacuucaccgaccccucguccaucgcggcccggggguacaucagcacaaggguaggcaugggggaagccgccgccaucuucaugaccgcaacgccgcccggcucaguagaggccuuuccgcagucaaacgccgugauccaggacgaggagagggacauucccgaacgguccuggaacagcggguaugaguggaucacggauuuccccggcaagaccgucugguucgugcccucuaucaagucuggcaacgacauagccaauugucugcggaagaacgggaagcgcgugauacagcucucgcggaagaccuucgacacggaguaucagaagaccaagaacaacgacugggacuaugucguaaccacagacauuagugagaugggggcgaacuuccgagccgaccgaguuaucgauccgaggcggugcuuaaagcccgucauacugaaggacgggcccgagcgcgugauccuggccggccccaugccggucacuguugccuccgccgcgcagcggcgcgggagaaucggccgcaaccacaacaaagagggcgaccaguacauuuacauggggcagcccuugaauaacgaugaggaucacgcccacuggacagaggccaagaugcuucuggacaacaucaauaccccggaagggauaauccccgccuuauucgagccagagcgcgagaaauccgccgcgauugacggggaguaccggcugcgcggcgaggcccggaagaccuucguugagcugaugcgccgcggggacuuacccgucuggcugagcuacaaagucgccagcgagggcuuccaguacagcgacagaagauggugcuucgacggagagcgcaacaaccagguccuggaggagaacauggacgucgagaucuggacgaaggagggggagagaaagaagcuccgcccccguuggcuggacgcaagaacguauucugacccgcucgcccuucgggaguucaaggaguucgcggcuggccgccggagcgucuccggagaucugauucuggagaucggcaaauuaccccagcauuugacccagcgcgcgcagaaugcccucgauaaucuagucaugcugcauaacagcgaacaaggcgggcgggcguacaggcacgccauggaggaguugccagacaccaucgagacccugaugcuacuggcucucaucgccguccugacaggagggguuacucuauuuuuccucuccggccggggacuaggcaagacaagcauaggcuuacucugugugauggcuuccucaguucugcuauggauggcgucgguggaaccccacuggauagccgccagcaucauccucgaguucuuccugauggugcugcuaauucccgagccggaccggcagcggacuccccaggacaaccagcuggcuuaugucgugaucggccugcuguucaugauccugaccguagcagcaaacgaaaugggccuccucgaaaccaccaagaaggaccuuggcaucggccacgccgcggugggaaaccaccaccacgcagccaugcuggacguggaccuccaccccgcguccgcuuggacguuguacgccguggcaacaaccaucaucaccccgaugaugcgccacaccauagagaacacgacggcaaacaucagccugaccgcgaucgccaaccaggccgccauccucaugggccuggacaaaggcuggcccauuuccaaaauggacaucggagucccccuacucgcgcuaggguguuacagccagguaaauccacugacgcucacggcggcgguacugaugcuggucgcccacuacgccaucauugggccgggccuacaggcgaaggccaccagagaggcccagaaacggaccgccgccggcaucaugaagaaccccaccguggacggcaucguggcgaucgaucuggaccccgucgucuacgacgccaaguucgagaaacagcugggccagauaaugcuccugauccuuugcacgagucaaauccuccugaugcgcaccaccugggcccugugcgagagcaucacccuagccacggggccccuuaccacacugugggagggcuccccggggaaguucuggaacaccacaauagccguaucaauggccaacaucuuccggggauccuaccuagcgggcgccgggcuggcauucagccugaugaaauccuugggcggcggccgucgggggaccggcgcccagggcgagacccugggggagaaguggaagcgccagcugaaccagcuguccaagucagaguucaacaccuacaagcggaguggcaucauggagguugaucgcagcgaagccaaggaggggcugaagcggggcgaaacgaccaagcacgccgucucccgcgggaccgccaagcugcggugguucguggagcgcaauuuagucaagcccgagggcaaggucauagaccucgguugcggucggggcggcuggaguuacuacugcgccggccugaagaaggugaccgagguaaagggguacacgaagggcggccccggccacgaggagcccauaccgauggcuacuuacggguggaaccuggugaagcuccacuccgggaaggacguguucuucaucccucccgaaaagugcgacacccuccugugcgacaucggcgaguccagccccaauccgaccaucgaggaggggcgcacccuccggguccucaagauggucgagcccuggcugcggggcaaccaauuuuguaucaaaauucucaacccauacaugcccagcgugguugagacccuggagcagaugcagcggaaacacggagggaugcugguccgcaacccgcuuucccggaacucaacccacgagauguacuggguguccugcggcaccgggaauaucgugagcgcagugaacaugacgucacgcaugcugcucaaucgcuucacgauggcccacaggaagcccacauaugagcgcgaugucgaucucggugccggcaccagacacgucgccguggagccggagguggccaaccuggacaucaucgggcagcgcaucgaaaacaucaagcacgagcauaagagcacuuggcacuacgacgaagacaaucccuacaagacgugggccuaccacggcuccuacgaaguaaagccgagcggguccgcuaguagcaugguuaauggcgucguuaagcugcucaccaaaccaugggacgucauucccaugguaacccagaucgccaugaccgauacgacccccuucgggcagcagcggguuuucaaggagaagguggacacccgcacgccuaaggccaagcggggcacggcacagauuauggagguuaccgccaaguggcuauggggcuuccucucccgcaauaagaagccccggaucugcacccgcgaggaguucacccgcaagguacgcagcaacgccgccaucggggcgguguuugucgacgagaaccaguggaacuccgcuaaggaggccguggaggacgagagauucugggaccuugugcaccgcgagcgggaguuacacaagcaaggcaagugcgcgacgugcgucuacaacaugauggggaagcgcgagaagaaacuuggcgaguuugggaaggccaagggcucucgggcgaucugguacauguggcuaggugccagguuucucgaguuugaggcccugggguucaugaacgaagaucacugguucucccgggagaacagcuugucaggaguggagggggaagggcugcacaaacuuggcuacauccuccgcgacaucagcaaaaucccagggggcaacauguaugccgacgacacagccgggugggacacccgcauuaccgaggaugaucugcagaaugaagcgcgcauuacggacaucauggaaccggagcaugcccuuuuggccaaguccaucuucaagcugacuuaccaaaacaaggugguucgcgugcagcggcccgccaagaauggcaccgugauggacgucaucagccgccgggaucaacgcggguccggucaggugggcacguacggacugaacacguucacuaacauggaagcccaacucauccggcagauggagagcgagggaauauucucccccagcgaauuggagacccccaaccuggcggagcgcguccucgacuggcucgaaaaauacggggucgagcgacugaagcgcauggccaucuccggcgaugacugcguggugaagccgauugacgaccgguucgccaccgcucucacggcucugaacgauauggggaaaguccgcaaggacauaccccagugggagcccucgaagggcuggaacgacuggcagcaggucccuuucugcucacaccacuuccaccagcugaucaugaaggacggucgggagaucguggucccuugccguaaccaggacgaacucguggggcgggcgcgcgugagucagggcgcaggguggucacugcgggagaccgccugccugggaaagagcuaugcccagauguggcaacucauguauuuccaccgccgggaccugcgccuggcggccaacgccaucugcuccgccguucccguagacuggaucccgaccagccgcaccacauggagcauccacgcucaucaccaguggaugaccaccgaagauaugcucuccguguggaaccgcguuuggaucgaagagaaucccuggauggaggacaagacccacaucucauccuggggcgacgugcccuaccuggggaagcgagaggaccaguggugcggcagccugauuggucuaacggcgcgggccacaugggccaccaacauccagguggcaaucaaccagguccgccggcugauaggcaaugagaacuaccuggacuacaugacauccaugaaaagguucaagaaugagagcgauccggagggugcccucugguaa

SEQ ID NO: 24180 - RNA, 9879 nt, Artificial Sequence
  derived and/or modified CDS sequence (opt11) from DENV-1__FJ432746__SS-prME
agcguuaccaugcugcugaugcucaugcccaccgcgcuagcauuccaucucacgacccgcggcggggaaccccacaugauagugagcaaacaggagcggggcaaauccuuacuguucaagaccucagcgggggugaacaugugcacccuuaucgccauggaccugggcgaguucugcgaggacacgaugacguacaagugcccgcgcaucacugaagcugagccggacgacguggacugcuggugcaaugcaaccgacaccugggugaccuaugguaccuguagccagaccggggagcaccggcgcgacaaacgcuccguggccuuggcaccccacgugggccucgggcuggagacgcguacagagacuuggaugagcuccgagggggccuggaagcagauccagcgcguugagaccugggcccuccgccaccccgguuucacggugauagcacucuuccuggcgcacgccauuggcaccagcaucacucaaaaggggauuauauucauucuucucaugcuagugacccccuccauggccaugcggugcgucgguaucgggucacgagacuucguggagggucuguccggcgccaccugggucgaugucguccucgagcacgguagcugcgugacuaccauggccaaggacaagcccacgcuggacauugaacugcugaagaccgaggucaccaaccccgcggugcugagaaagcugugcauugaggcaaagaucuccaacacuaccaccgacagccgcugcccgacccagggggaggccacccucguagaggagcaggacgccaacuucgucugccggcgcaccuucguggaccggggcugggguaacggcugcgggcuguucggcaaggggucauugaucacgugcgccaaguucaaaugugugaccaaguuggagggcaagaucguucaguaugagaaccugaaguacagcgugaucguuaccguccacacgggcgaucagcaccaggugggaaacgaguccacggagcacggcacuaccgcgacaauuacgccccaagcccccuccaccgagauucaacugacggacuacggggcuuuaacccuggacugcucuccccgcaccggccuagacuucaacgagauggugcuccugacgaugaaggaaaaguccuggcuggugcacaagcagugguucuuggaccugccgcugccguggaccucaggggccuccaccagccaggagaccuggaacagacaggaccuccuugugacguucaagacugcccacgcgaagaaacaggagguggugguccuaggcucccaggagggggccaugcacacggccuugaccggggccacggagauccagacaagcgggacuaccacgaucuucgcugggcaccugaagugccgcuuaaaaauggauaaacugaccuuaaagggaauguccuacgucaugugcaccgggagcuucaaacuggagaaggagguggccgagacacagcacggaaccguucucguccagaucaaguacgagggcaccgacgcacccuguaagauccccuucuccacccaggacgaaaagggggugacccagaaugggcgguugaucacggccaacccgauuguuacggauaaagaaaagccggucaacaucgaggccgagccgcccuuuggggagagcuacaucgugauaggcgccggcgaaaaggcacugaagcuguccugguucaagaagggaucuuccauaggaaaaauguucgaggcaacugccaggggcgcccggcgcauggcgauccucggggacacggccugggacuucgggagcaucggcggcguauucacuuccgucgguaagcuggugcaccagauauucggcaccgcuuacgggguacuguucagcggcgugucguggaccaugaagaucggaauuggcguacuccucaccuggcugggccucaacagccgcuccaccucacuauccaugacgugcaucgccguggggcuagucacccucuaucugggcgugauggugcaggcagauagcggaugcgucaucaacuggaagggucgggagcugaagugcgggagcggcaucuucgugaccaacgagguccacacguggaccgagcaguacaaauuucaggcggacucuccgaagcgccucagugccgccauaggcaaggccugggaggagggggucugcgggauccgguccgccacccgccuagaaaacaucauguggaaacagaucagcaacgagcuuaauuacauccugcuggagaacgacaugaagcugaccguugucgugggggacguggcgggcauccucgcacaggggaagaaaaugauccggccccaacccauggaguacaaguacaguuggaagucauggggcaaggccaagaucaucggagccgacguucagaacacgacguucauaaucgacgggccuaauacaccggaguguccagacgaccagcgcgcguggaacauuugggaaguggaggacuacggcuucggaaucuucaccacgaacauauggcugaaacugcgggacuccuauacccaggugugcgaccaucgccuuaugagcgccgccaucaaagacaccaaggccgugcaugcagacaugggcuacuggaucgaaagcgaaaagaaugagacuuggaagcuggcacgggccagcuuuaucgaggucaagaccugcaucuggcccaagucacacacgcuguggucuaacggggugcucgagucagaaaugaucauccccaagaucuacgggggaccuauuagccagcacaacuauagaccaggguacuucacccaaacugccggcccuuggcauuuagggaagcucgaacucgauuucgaccugugcgagggcaccacggugguaguagacgagcacugcggcaaccgggggcccagccugcgcaccaccaccgugacgggcaaaaucauccaugagugguguugccggagcuguaccuugccgccucuccguuucaagggggaggacggcuguugguacgggauggagauucggcccgugaaggagaaggaggaaaauuuagugaaguccauggucucagccggcagcggcgaggucgacuccuucagccucggccugcugugcaucuccaucaugauagaggagguuaugcgcucccguugguccagaaagaugcucaugaccgguacucuggccguguucuuccugcucauaaugggucaacucacguggaacgaccugauccggcucugcauaauggucggcgcgaacgcgagcgaucgcauggggauggguaccaccuaccuggcucugauggccaccuucaagaugcgaccaauguucgccgugggccuucuguuccgccgcuuaacgucccgggagguauugcuacugaccaucggguugagcuuggucgcaagcgucgagcugcccaacucucuggaagaacugggcgacgggcuggccaugggcaucaugauacuaaagcugcugaccgacuuccagucccaccagcucugggccacgcugcucucacucaccuucguccgcaccaccuucagucugcauuacgccuggaagaccauggccaugguguugagcauugugucauuauucccccugugccucuccacuaccucucagaagacaaccugguuacccgucuuacugggcagccucgggugcaaaccgcugacgauguuccugaucgccgaaaacaagauuuggggcagaaaguccuggccccuaaacgaggggaucauggccguggggaucgugagcauccugcugagcucgcuccugaaaaacgacguucccuuggcggguccccucauugcuggcgguaugcucaucgcgugcuacgugauuagcggguccagcgcggaccugucacucgagaaagccgccguugucagcugggaggaagaagccgaacacagcggcgcgagccacaacauccugguugaagugcaggacgacgggacuaugaagaucaaggacgaggagcgcgaugacacacugaccauccuccuuaaggccacccugcucgccguauccggcguguacccgcugucuaucccugcgacccuguuuguuugguacuucuggcagaagaagaagcagcggucaggcguccucugggacacccccucaccgccggagguagagcgcgccguguuagacgacggcauauaccggaucaugcaacgcggacugcuggggaggucccaggucggcguggggguguuccaggaaaaugucuuccacaccauguggcaugugacccgcggcgcgguucucauguaccaggggaagaggcuggagcccagcugggccuccgugaaaaaggaccugaucagcuauggcggcggguggcgccuccagggcucauggaacacaggcgaggagguccaggucauugcgguggagccgggcaaaaaccccaagaacguucagaccgcccccgggaccuucaagaccagcgaaggcgaggugggcgcaaucgcacuugacuucaagccugggacguccggcagccccaucgucaaccgggaaggaaagaucgugggccucuacggcaacgggguggucacuaccucgggcaccuacgucuccgccauagcacaggcgaaggcgucgcaggagggaccccucccugaaauagaggacgagguguuccgcaagcggaaccugacgaucauggaucuacaucccggcucagggaaaacgagacgcuaccucccagccauuguccgugaggcaaucaagcgcaaacuucgcacacugauccuugcccccaccagggugguggccagcgaaauggcggaggcguugaagggcaugccuauccgauaccagacuaccgcggucaaguccgagcacaccggcaaagagaucguggaccugaugugccaugccaccuuuacgaugcgcuuacucagcccagugcgggugcccaacuacaauaugaucauaauggacgaggcccacuuuaccgaccccuccagcauagcggcccgcggguacauaagcacccgggugggcaugggggaggcugccgccauauuuaugacagcuacgccgccaggcucuguggaggccuucccccaauccaacgccgucauccaggaugaggaacgcgacauaccggagcguagcuggaacuccgguuacgaguggauuacugauuuccccggcaaaaccguaugguucgugcccaguaucaaguccggcaacgacaucgccaauugccugaggaagaacgggaagcgugucauucaacucagcagaaagaccuucgacacggaguaccagaaaaccaagaauaaugauugggacuacguuguaacuacugacaucuccgaaaugggagcgaacuuccgggccgaccgcguaaucgacccccggcgcugccugaagccggugauccugaaggacgggcccgagcgggucauccucgcaggccccaugcccgugaccguggcgagcgccgcgcagcgcagggggaggaucggucggaaccacaauaaggagggcgaccaguauaucuacauggggcagccgcugaauaacgacgaagaucacgcccacuggaccgaggccaaaaugcugcucgauaacaucaauacccccgaaggcaucauccccgcccuguucgagcccgagcgcgagaaguccgccgcgaucgacggggaguaucgccugcggggcgaggcccgcaagaccuucgucgagcucaugcggcgcggagaccugccgguguggcugagcuacaagguggccagcgagggcuuccaguacuccgaccggcgcuggugcuucgacggugagcggaacaaucagguacucgaggaaaacauggacguggagaucuggacgaaggaaggggagcgcaagaaacuacggccccgcuggcucgacgcccggaccuacagcgauccccuagcgcuucgcgaguucaaggaguucgcggccggccggcgguccguaagcggagaccugauccucgaaaucggcaagcucccccagcaccuaacccagcgcgcccagaaugcccucgacaaccucgugaugcugcacaacuccgaacaaggcgggagggcguaccggcaugccauggaagaacucccggacaccaucgaaacccugaugcuguuagcccuaaucgccguucugaccggcggggugacccucuucuucuugagcggccgcggccuggggaagacaucuaucggcuuauugugcguaauggccagcucagugcugcuauggauggcaagcguggagccccauuggaucgccgccuccaucauccuagaguuuuuccugaugguccuccugauccccgagccugaccgccagagaaccccgcaggacaaccagcuugccuauguggucaucgggcuccuguucaugauccugacgguggccgcgaacgagaugggccucuuagagaccacuaaaaaggaccuggggaucgggcauguggccguggagaaucaucaucacgccgccaugcuagacgucgaccugcaccccgccagcgcauggacccuguacgccguggccacgaccaucauuacccccaugaugcggcacaccauagagaauacgaccgcuaauaucucccucaccgcaauagcgaaccaagccgccauccugaugggguuggacaaaggauggccgaucagcaagauggacauaggcgugccccuccuggcccuggggugcuacucccaggucaauccgcuaacccuuacggcggcagugcugaugcucguggcccacuacgcuauuaucggacccgggcugcaggccaaggcgacucgugaggcgcaaaaacgcaccgccgccggcaucaugaaaaauccgacgguagacgggauaguggcgaucgaccuggaucccguggucuacgacgcgaaguuugagaagcaacucggccagaucaugcugcugauccucuguaccagccaaauccuauuaaugcggacgaccugggcauugugcgaguccauaacccuggccacgggccccuugaccacccuaugggaggggagcccgggcaaguucuggaacacaacgaucgccguguccauggccaacaucuuucgcggguccuaccuggcgggcgcgggccuggccuucagccucaugaagucacucgggggcgggcggcgcgggaccggggcgcaaggcgagacucugggcgagaaguggaaacggcagcucaaccagcuuagcaaguccgaguuuaacaccuauaagcgcagcgggaucauggaggucgaccgguccgaggcgaaggagggccugaaacgcggggagacaaccaagcacgccgucagccgaggcaccgccaagcuccguugguucguggagagaaaccuggugaagccggaggggaagguaaucgaccugggcugcgggcgcggcggcuggucuuacuacugugccgggcugaagaaggugaccgaggugaagggguauacgaaaggagggcccggucacgaggagcccauccccauggccacauacggguggaaucucguaaagcugcacucgggcaaggacguguucuucaucccgcccgagaagugcgacacucugcucugcgacaucggugaguccagcccaaaccccaccaucgaggagggccgcacgcugcgcguccucaagaugguugaaccguggcuccggggcaaucaguucugcauaaagauccugaaucccuacaugcccuccgugguggagacccuggaacagaugcagcguaagcacggaggcaugcucguacguaacccccugucucgcaauuccacccacgagauguacugggugagcugcgggaccggcaauaucguauccgcgguuaacaugaccagccggaugcuguugaaccgcuucacgauggcccaccggaagccgacguacgaacgugauguggaccugggggccgggacacgccacguggccgucgagccagagguagcuaacuuggacaucauuggccaacggaucgagaacaucaaacacgagcacaaguccaccuggcacuaugaugaggacaacccuuacaagacaugggcguaccacggcagcuacgaggucaagcccuccgguagugccucuuccauggugaacggcguugucaagcuccugacgaaaccaugggacgugauccccauggugacucaaaucgccaugacggauaccacccccuucggccaacagcgcgucuucaaggagaagguugauacacggacccccaaagccaagaggggaacggcccagaucauggaggugacggccaaguggcuguggggcuuccucucccggaacaaaaagccacgcaucugcacuagggaggaguucacccgcaagguccguuccaaugcugccaucggcgccgucuucguggaugaaaaccaguggaacagcgcgaaagaggccguugaggacgagcgcuucugggaccuagugcaccgggagagagagcuacacaagcagggaaagugcgccacgugcguguauaacaugauggguaaacgggagaaaaagcucggcgaguucggcaaagccaaggggucccgcgccaucugguacauguggcugggcgcgcgguuuuuagaguuugaggcccucggcuucaugaacgaggaccacugguucagccgggaaaacucccugagcggcgucgaaggagaggggcuucacaaguugggcuacauccugcgggacaucucaaaaauccccgggggcaacauguacgccgacgauaccgccggaugggacacccgcaucaccgaggacgacuuacagaacgaggccaaaaucacagauaucauggagcccgaacacgcguuacuagcaaagagcaucuucaagcugaccuaccagaacaagguaguccggguccagcgcccagcgaagaacggcaccgugauggacgugaucucccgcagagaccaaaggggaagcggacaggucgguaccuacggcuugaacacguucacaaauauggaggcacagcugauacgucaaauggaguccgaagggauauucagcccguccgaguuagagacccccaaccucgccggccgcguucuggacuggcuggagaagcacggggucgagcggcucaagcgcauggcgaucucaggcgacgacugugucguaaagccgaucgacgaccgguucgccaccgcccugacggcgcugaaugacaugggaaaggugaggaaggacaucccgcaaugggagccuuccaagggcuggaacgacuggcaacaagucccguucuguucacaccacuuccaccagcucaucaugaaggacggucgggaaaucgucgugcccugccggaaucaggacgagcuggucgggcgggcccgcgugagccaaggcgcgggcuggucccugcgggagaccgccugccuggguaagagcuaugcccagauguggcagcugauguacuuccaccgccgggacuuacgccucgccgcgaacgccaucuguuccgccgugccggucgacugggugcccaccagccggaccacgugguccauacacgcccaccaccaguggaugaccaccgaggacaugcugagcguguggaauagggucuggaucgaggagaaccccuggauggaagacaagacccacaucuccagcuggggcgacgugcccuaccugggcaagcgggaggaccagugguguggcagccucaucgggcugacggcucgcgccacgugggccaccaacauccaagucgccaucaaccagguccggcgacuccucggcaacgagaacuaccuggacuacaugaccagcaugaagcgcuucaagaacgaaagugacccggagggggcccugugguaa

SEQ ID NO: 24181 - RNA, 9879 nt, Artificial Sequence
  derived and/or modified CDS sequence (opt11) from DENV-1__FJ432748__SS-prME
agugugaccaugcuccuuaugcuuaugcccacggcccucgcauuccaccucaccacucggggcggagaaccccacaugauugugagcaagcaagaacgaggcaagagccuguuauucaagacaagugccggggugaauaugugcacucugauagccauggaccucggggagcugugcgaagacacuaugaccuauaagugccccaggaucaccgaaaccgagcccgacgacguagacugcuggugcaacgccacggacacaugggugaccuacggaaccugcagccagacgggagagcaccggcgcgacaagcggucuguggcacucgcaccccaugugggccugggucuggagacccggaccgagacauggaugucguccgagggcgcguggaaacaaauccagcgggucgagacgugggcccuccgccaccccggguucaccgugaucgcccuguuucuugcccacgcaauaggaacaucgaucacccaaaaggggaucauuuucauucuccugauguugguuacucccuccauggccaugcggugcgucggcaucggcucucgugacuuuguggaagggcucuccggcgccacuugggucgaugucguacuggagcacggaagcugugugacuaccauggccaaggauaagccgacguuggacauugaauugcugaagaccgaggucaccaaccccgcagugcuacguaagcuauguaucgaggcgaagauauccaacaccacgacugacagccgcuguccgacucagggcgaggcgacgcugguggaggagcaggaugcgaauuuugucugccggcgcacguuuguggaccggggcugggggaacggaugcggucuguucggcaaagggucccuaaucacgugcgccaaguucaagugugugaccaaacuggagggcaagaucgugcaguaugaaaaccugaaauacagcgucaucgucaccgugcacacgggcgaccaacaccagguggggaaugaauccaccgagcacgguacgacagccaccaucacgccccaggcgcccaccaccgaaauacagcuuaccgacuacggugcucugacgcuugacugcucgccccgcaccgggcucgacuucaacgagaugguccuacuuacgaugaaggaaaagucguggcucguccacaagcaaugguuccuggaccugccgcuccccuggaccagcggcgccuccaccagccaagaaacguggaaccgccaggaccugcuggugacguucaagaccgcucacgccaagaagcaggaggucguaguguugggcagccaagagggggcgaugcauacggcccugaccggggcuacagagauacagacguccggaacgaccacaaucuucgcugggcaccugaagugccgcuuaaagauggacaagcugacccugaagggcauguccuacgucaugugcacgggcuccuucaagcucgaaaaggagguugcugagacccagcacgguacagugcugguacagaucaaguacgaaggcaccgacgcgcccugcaaggugccauucagcacgcaggacgagaagggggugacgcagaacggccgccuaauuacugccaaccccauugucacggacaaggaaaagcccguuaacaucgaagcggagccgcccuucggggaguccuacaucgugaucggugccggugagaaggcgcugaaacucagcugguuuaagaaggggucaagcauuggcaagauguucgaggccacggcccgcggggcucgacgcauggccauccugggcgacaccgccugggacuuuggguccaucggcggcgucuucacgagcguggggaaguuggugcaucagaucuucggcacagccuacgggguccucuuuuccggagucagcuggacgaugaagaucgggaucggcguacugcucaccuggcucggccugaacucucgaagcaccuccuuaagcaugaccugcaucgccgucggguuagucacgcuguaccucggcgugaugguucaagccgacuccgggugcgugaucaauuggaaagggcgugagcucaagugcgggagcggcaucuucgugaccaacgagguccacaccuggacugagcaguauaaguuccaagccgacagcccgaagcgccuguccgcggccaucggaaaggcgugggaggagggggugugcgggauccggagcgccacccgacuggagaauaucauguggaagcagauauccaacgaacucaaucauaucuuacuggagaacgacaugaaguuuacaguagucguuggcgacguggccggcauccucgcgcaggggaagaaaaugaucaggccacagcccauggaguacaaguacagcuggaaguccugggggaaagccaaaauaaucggcgcggacguccagaauaccaccuucaucaucgacgggcccaacacgccggagugccccgacgaccagcgcgccuggaacaucugggaaguggaggauuauggcuucgggauuuucaccaccaacaucuggcugaagcugcgcgauucuuacacccaagucugcgaccacaggcucauguccgcggccaucaaagacagcaaagccguccaugccgacaugggguacuggaucgaguccgagaagaaugaaaccuggaagcuggcgagagccagcuucaucgaagugaagacgugcaucuggcccaagucccacaccuuguggagcaacggcgugcuggagagugagaugaucauucccaagaucuacgggggcccgauuagucaacacaacuacagacccggguacuuuacccaggcagccggcccguggcaccuggggaagcuggagcucgacuucgacuuaugugaggguaccaccgucgugguagaugagcacugcggcaaccgggggccgucacugaggaccaccacagucacgggcaagauaauccacgaguggugcugccgcagcugcacccugcccccucuccgauucaagggcgaggauggaugcugguacggaauggaaauucggccuguaaaggagaaggaagagaaucuugugaaguccauggucagcgcuggcagcggugagguggauuccuucucacucgggcuccugugcaucuccaucaugaucgaagaggugaugcgcucaaggugguccaggcgcaugcucaugaccggcacccucgccguauucuuucuguuaaucaugggccagcuaacuuggaaugaccugauucgacucugcaucauggugggcgcaaaugccagcgaccgcauggggaugggcacgaccuaccuggcccugauggcaaccuucaagaugcggccaauguucgcgguaggacugcuguuccgccgacugacgucccgcgagguacuccugcugaccaucgggcucagccugguggcguccgucgagcugccaaacagucucgaagaacugggcgacggccuggccauggguaucaugaucuuaaagcugcugaccgacuuccagucccaccagcuaugggccacccugcugagccucaccuuuauaaagacgaccuucucgcugcacuaugcuuggaaaaccauggcgauggugcuaucuaucgugagucuguuuccgcugugccugagcacgaccucucagaagacgacuuggcuucccguccugcugggaagccucggauguaaaccccugacaauguuucucauagccgaaaacaagauuuggggccggcgcuccuggccccucaacgaggggauuauggcggugggcaucgugagcauccugcugagcucccuccugaagaacgacgucccccuggcugguccccucauagcugguggcaugcuaaucgcgugcuacgugaucagcggguccuccgccgaccugucccucgagaaagccgccgaggugucuugggaggaagaggcagagcacaguggggcaucgcauaacauacugguggaagugcaggacgacgggaccaugaagauaaaagacgaagaacgagacgacacccugaccauccuauugaaggccacccuucucgccguauccggcgucuacccgcugagcauucccgccacgcuguucgugugguacuucuggcagaaaaagaagcagcgcucagggguccucugggacacccccagcccgcccgagguggagcgugcagugcuggacgacgguaucuaccgcaucaugcagcggggccuacuggggcgcucgcaagugggcgucgggguguuccaggagaacguuuuccacaccauguggcaugucacccgcggggcaguucucauguaccaggggaagcgccuggagcccagcugggccagcgugaagaaagaccuuaucagcuacggcggcgguuggcgguugcagggcucguggaacacgggggaggagguccaggucaucgcuguggaaccuggcaagaacccuaagaacguccagaccgccccggggaccuucaagaccccagaaggagaggugggugccauugcccucgauuucaagccgggaacgucgggcucccccaucgugaaucgggaaggcaagaucgucggccuguacggcaacgggguugugacuaccagcggcacauacgucagcgccauugcccaggcuaaggcgucccaagagggaccgcuccccgagaucgaggacgaggucuuccgcaaacgcaaccugacgaucauggaucugcaccccgguuccgggaagacccggcgcuaccucccggcgauugugcgggaggcgaucaagcgcaagcugcgaacccuaauacuggccccuacacgggucgucgccuccgagauggcggaggcccugaagggcaugcccaucagauaucaaacaaccgccgucaagagugagcauacgggcaaggagauugucgaccugaugugccaugcgaccuuuacgaugcggcuccuguccccugugcgcgugccgaacuacaacaugaucaucauggacgaggcccauuucaccgacccuagcuccaucgcggcaaggggguacaucucaacccgcgucggcaugggggaagccgcugcaaucuucaugaccgcuaccccgcccggcucaguggaggccuuuccgcagucgaacgccgugauccaggacgaggaacgggacauucccgaaagguccuggaacucuggguaugaguggaucaccgacuuccccggcaaaaccgucugguucgugcccuccaucaagagcggcaacgacaucgccaacugccuucgaaagaaugggaagcgcgucauccagcucucccggaagaccuucgauacggaguaccagaagaccaagaacaacgacugggacuacguggugaccaccgacaucucugaaaugggcgccaacuuccgcgccgaccgggugaucgacccacggcgcugccuaaagcccgucauccuaaaggauggaccugagcgcguaauccuggcgggcccgaugcccgucacgguggccucagccgcgcaacggcgcgggcggaucggccggaaucacaauaaagagggcgaucaguacaucuauaugggacagccucucaauaacgacgaggaucaugcccauuggacugaggcuaagauguuacucgacaacaucaacacccccgaaggcaucauccccgccuuauucgaaccggagcgcgaaaaaucugcggcgaucgacggagaguaccgguugcgcggcgaggccaggaagaccuucguugaacucaugaggagaggggauuuacccgucuggcuauccuacaaaguugccucagaaggcuuccaauacagcgacaggcggugguguuucgacggcgagcggaacaaccagguacucgaggaaaauauggacgucgaaauuuggacgaaggagggcgagcggaagaagcuccgcccccgguggcuagacgccaggacauacagugacccccucgcccugcgugaguucaaggaguucgcggccggccgccggagcguguccggggaccugauccucgagaucggcaaacuaccgcagcaccuaacccagcgggcccagaacgcccucgacaaccuggugaugcugcacaacagcgagcaaggcggacgggcguaccgccaugccauggaggaacuccccgacaccauugagacgcuaaugcuccucgcacugaucgcggugcugacgggcggcgugacguuauucuuucuguccggcagagggcuggguaagaccuccauaggccuccuuugcgugauggcguccagcguguuacucuggauggcguccguggagccccacuggauugcugcgagcaucauuuuggaguucuuccugauggugcuccugauccccgagcccgaccgccaaaggacgccccaggacaaccagcuggccuacgucguaauaggccuacucuucaugaucuugacgguggcagcgaacgagauggggcuccuggagaccaccaagaaggauuuagggaucggccauguagcaguagagaaccaccaccacgccgcuaugcucgacguagauuuacauccugccuccgcguggacccuguacgcagucgcgacgaccaucaucacccccaugaugagacacaccauagagaauacgaccgccaacaucucacuaaccgcgauagcgaaccaggccgccaucuugauggggcuugacaaggguuggcccauuucaaagauggacaucggcgugccccucuuggcccugggcugcuacagccaagucaacccucuaaccuuaacggcggcggugcuuaugcuaguggcccauuaugcgauuaucggcccgggucugcaagcaaaggccacccgcgaggcucagaagcggaccgccgcuggcauuaugaagaaccccaccguugacgggaucguggcaaucgaccuggaucccgugguguacgacgcgaaguucgagaagcagcucggacagaucauguuacugauacucugcacgagucagauccuucugaugcgcaccacuugggccuugugcgaaagcauaaccuuggcuacgggcccccugacaacccucugggaaggguccccaggcaaauucuggaacaccacuaucgccgucagcauggcgaacaucuuucggggauccuaucucgcgggcgccggccuggcauuuagccucaugaagucccucgggggcgggagacgggggacgggggcccaaggcgagacucugggcgagaaguggaagcgccagcucaaccagcuuaguaagagcgaguuuaacaccuacaagcgguccgggauuauggagguggaucgcagugaggcgaaggagggacugaagcgcggggagacgaccaaacaugccgugucgcgcggaaccgcgaagcucaggugguucguugagcguaaccuggugaagcccgaggggaaggugauugaucugggcugcggcaggggcggguggagcuacuacugugcuggacugaagaagguaacggagguuaaaggguauacgaagggcggccccggccaugaggagccaaucccgauggccaccuacggguggaaccuugugaaguuacacuccggcaaagaugucuucuucauaccgcccgagaagugcgauacacugcucugcgacaucggugagaguuccccgaaucccacuaucgaagagggccgcacgcugcgugugcugaagaugguggagccauggcuccgagggaaccaauucugcaucaagauccuaaaccccuacaugcccagcgucguggaaacccuggagcagaugcaacggaagcacggaggcaugcucgugcgcaacccgcugucaagaaauucgacccacgagauguauugggucuccuguggaacgggcaacauugugagcgcggugaauaugacgagucgcaugcuacucaaucgcuucaccauggcccaucggaagccgacauacgagcgcgacguugacuugggagccggcacccgacauguggccguggagcccgaggucgcgaaccuggacauuaucggccaacgaauagagaacauuaaacaugagcacaagagcacuuggcacuacgaugaggacaaccccuacaagacgugggcguaucacgggucuuacgaggugaaacccucuggcuccgccagcucuauggugaacgggguggugaagcuacugacuaagcccugggacgugauccccauggugacccagauugcaaugacggacacgacccccuucggccaacagcggguguucaaggagaaggucgauaccagaaccccaaaggccaagagggggacggcccagaucauggaaguaacagcaaaguggcuguggggcuuccucucacggaacaagaagccccggaucugcaccagagaggaguucacccggaaggugcgcucaaacgccgcaauuggagccgucuucguggacgagaaccaguggaacuccgcuaaagaggccguagaggacgagcgguucugggaccucguccacagggagcgggagcugcacaaacaggggaagugcgccacgugcguguacaauaugauggguaagcgcgagaaaaagcucggggaguucggcaaggcgaaggggagccgggcaaucugguauauguggcugggggcgcgcuuccuggaguucgaggcccuaggcuuuaugaacgaggaucacugguucucucgggagaauagccuguccgggguggaaggcgaggggcugcauaagcucggcuauauccuacgcgacaucagcaagauccccgggggaaacauguaugccgacgacaccgcgggcugggacaccagaauuacagaggaugaccuccagaacgaagcgcgcauuacggauauaauggagccggagcaugcgcuccucgccaagaguauuuucaagcugaccuaccagaauaaggugguucgcgugcagcggcccgccaagaaugggaccgucauggacgugaucagccgcagggaccagagaggcuccggccaggugggcaccuacggccucaacacauucaccaacauggaggcucagcugauucggcagauggagagcgaggggaucuucucacccagcgagcuagaaacccccaaccuggcggagcgggucuuagacugguuagagaaauacggcguggagagacucaagcggauggccaucuccggggacgacugcguggugaagccgauugacgaccgguuugccacggccuuaacagcacugaacgacauggguaaggugcgcaaagacaucccccagugggagccgagcaagggauggaacgacuggcagcagguacccuucuguucccaucauuuccaucagcucaucaugaaggauggccgggagaucgucguaccuugucgcaaccaagaugaguuagugggccgggcccgcguaagccagggggcgggcuggagccugcgugagacagcgugccucggcaaguccuaugcccagauguggcaguuaauguacuuccaccggcgcgacuuaaggcucgcagcgaacgccaucugcagcgcugugccuguggacuggauccccacuucccggaccacguggagcauccacgcccaucaccaguggaugacuaccgaggacaugcugucgguguggaaccgcguauggaucgaggagaaccccuggauggaggacaagacacauauaucuuccuggggcgacgugccauaucugggaaagcgcgaggaucaguggugcgggucacucauuggucugacggcccgagccacuugggcuacgaacauccaagucgccauaaaccaagugcgccggcugaucgggaacgaaaacuaccucgacuacaugacauccaugaagcgcuucaagaacgagagcgacccagagggggcccucugguga

SEQ ID NO: 24182 - RNA, 9879 nt, Artificial Sequence
  derived and/or modified CDS sequence (opt11) from DENV-1__FJ432749__SS-prME
agcgugaccaugcugcugaugcugaugccgaccgcccuggccuuccacuugaccacacgcgguggggagccccacaugaucguaaccaaacaagaacgggggaagagccuucuguucaaaaccagugcgggggugaacaugugcacccuaaucgcgauggaccuuggcgagcugugcgaggacaccaugacuuacaaaugcccccgaaucaccgaggcagaacccgacgauguggauugcuggugcaacgccaccgauaccugggucaccuacgggacauguucccagaccggcgagcaccggagggacaagcggagcgucgcccucgcgccccacgugggccuugggcuggagacgcgcaccgaaaccuggaugucgagcgagggcgcuuggaagcaaauccagcgagucgagacgugggcacucaggcaccccggcuucaccgucaucgcccuauuccuggcucacgccaucggcacuuccaucacccaaaaaggcaucaucuucauacugcugaugcugguaacgcccucaauggccaugcggugugucggcaucggcucccgcgauuucguggaggggcucucuggcgccaccuggguggacgucgugcuggagcauggcuccuguguuaccaccauggccaaggacaagcccacgcuggacaucgaacuacugaagacugaggucaccaaccccgcggugcugaggaaguugugcaucgaggcaaagaucaguaacaccaccaccgacucccgcugccccacacagggagaagccacccuuauggaggagcaggacgccaauuucgugugccggcgcacauucgucgacaggggcugggguaacggcugcgggcuguucgguaaggggucgcucaucacgugcgccaaguucaagugugugaccaagcuggaagggaaaaucgugcaguacgagaaccuuaaguacuccgucaucgugacggugcacacgggggaccagcaccaggucgggaaugagagcaccgagcacggcaccaccgcgaccaucacuccgcaagcucccaccuccgagauccagcucacagacuacggggccuugacccuugacugcagcccucgcaccggccucgauuucaacgagauggugcugcugacgaugaaggagaaguccuggcucgugcacaaacagugguuccuggaccugccauugcccuggacaagcggggcuagcaccucccaggagacguggaaucggcaggaccugcuggucacauucaaaaccgcccacgcgaagaagcaggagguugucgugcugggcagccaggagggcgccaugcauacugccuuaacgggggcaacugagauacagaccucugguacaacgacgaucuucgccggccaucugaagugccgcuuaaagauggacaagcugacccugaagggcaugagcuacgugaugugcaccgggaguuucaagcucgagaaggaggucgccgagacgcaacacggaaccguccuggugcagauuaaguacgagggcaccgacgcccccugcaagauccccuuccugacccaggacgagaagggggucacgcagaacgguagacugauaacugcaaauccgauugugacggacaaggaaaagcccgugaacaucgaagccgagccacccuucggggaaagcuauaucgucaucggcgcaggcgagaaggcacucaaguuauccugguucaaaaaaggcagcucaauaggcaagauguucgaagccaccgccagaggggcucggcgcauggcgaucuugggcgacacggccugggacuucgggagcaucgggggcguuuucaccaguguggggaagcuuguccaccagaucuucggcaccgccuacgggguccuguucagcgggguuuccuggacaaugaagauaggaaucggcguccugcucacguggcugggccuaaacagccgcuccacgagccucucgaugaccugcaucgccguagggcuggugacacucuaucucggcgucauggugcaggccgauagcggguguguuaucaacuggaagggucgggaacuaaaguguggguccggcauauucguuacgaacgagguacauacauggaccgaacaguacaaauuccaagcggacucuccgaagcgccugucagcggccaucgguaaggccugggaggagggggugugcggcauccgguccgccacccgcuuagagaauaucauguggaagcagauaagcaaugagcucaaucacauucuacucgagaacgacaugaaauucaccgucguggugggagaugucgugggcauacuggcgcaagggaagaagaugauccggccucagccgauggagcauaaguacuccuggaaguccuggggcaaggcaaaaauuauaggcgccgacgugcagaacacgaccuucaucaucgacgggcccaacaccccggaguguccugaugaccagcgcgccuggaacaucugggagguggaggacuacggcuuugguauuuucacuacgaacauauggcugaagcuccgggacuccuacacccaggugugcgaccaccgccugaugagcgcggccaucaaagacuccaaggccguccacgccgacaugggcuauuggauugaaagcgagaagaacgagaccuggaagcuggcccgggcguccuucauagaagucaagacaugcaucuggccgaaaagccauacgcucuggucaaacggagugcuugaaagcgagaugaucaucccuaaaaucuacggaggccccauuagucagcacaacuaucgccccggguacuucacccagaccgccggccccuggcaccuggggaagcuagagcucgacuucgaccugugcgaggggacgacgguggucguugacgagcacugcggcaacagggguccgagccuucgcaccacuaccguuacggguaagaucauccaugaauggugcugccgauccugcacccugccgccacugagguucaagggggaggacggcugcugguacgggauggagauccggccugucaaagagaaggaggagaaccuggucaagucgaugguguccgcaggcuccggcgaaguagauagcuucucccuggggcugcucugcauaagcauaaugaucgaagagguuaugcgcagccguuggucccgcaagaugcuaaugacuggcacacuugccguguuccuacugcuaaucauggggcagcucacguggaaugaccugauacggcuuugcaucauggugggcgccaacgcgucugaccgcauggggaugggcaccaccuaucuugcccucauggccacauuuaagaugcguccgauguucgccgugggccuccuuuuccgaagauuaacgagccgagagguccugcugcucaccauugggcuauccuuggucgcuagcguugaacugcccaacucccuggaggagcucggcgacggacuggcgauggggaucaugauccugaagcugcugaccgauuuccagucccaucagcuaugggccacccugcuuucgcugaccuucaucaagacgacccucucauugcacuacgccuggaagaccauggccaugguccugaguaucgugagccucuuccccuugugucuguccacaacuagccaaaagaccaccuggcuucccgugcugcugggaucucuugggugcaagccguuaacgauguuucugaucgccgagaacaagaucuggggccgcaaguccuggccacucaacgaggggaucauggccgucggcgugguguccauuuuacuaagcagccuccugaagaacgacguaccucuggcagggccucucaucgccgguggcaugcugaucgcaugcuacgugaucuccgggagcuccgcagaccugagccucgaaaaggccgccgaggugucgugggaggaggaggccgagcacuccggggccucccacaacauacuggucgaggugcaggacgacgggaccaugaagaucaaggacgaggagcgggacgacacccugaccauccuccugaaggcgacccugcucgccguuagcggggucuacccgcuguccauccccgcuacgcuguucguaugguauuucuggcagaagaaaaagcagcgcagcggcgugcugugggacacccccagcccgcccgaaguugaaaaggccguucucgaugacggaauuuaccggaucaugcagcgcggcuuacucggacggagccaggugggcgucgggguguuucaggaaaacguauuccacacgauguggcacgucacccgcggcgccguauugauguaccaggggaagcgucucgagccuuccugggcgagcgugaagaaagacuugaucuccuacggcggcgguuggcgccuucaaggcucauggaacacuggggaggagguccaagugaucgccguggaaccugggaagaaccccaaaaacgugcaaaccgcaccuggaacuuucaaaacccccgagggugaggugggcgcgaucgcacuggauuucaagcccgguacguccggcagcccgauugucaaccgcgaggggaagaucgucggccuguaugggaacgggguggugaccaccagugggaccuacgucagcgcgaucgcccaggccaaggccagccaggaggggccgcugccugagaucgaagaugaaguguucagaaaacggaaccucacgauaauggacuuacaccccggcuccgggaagacccgccgauaccuccccgcgaucgugcgagaggccaucaagcggaagcugcgcacccugauccucgcccccacacgggucguggccagcgagauggccgaggcgcugaaggguaugcccauccgcuaccagacgaccgccguaaagucugagcacaccggaaaggagaucgucgaccugaugugucacgccaccuucacgaugcgcuugcugagccccgugcgggucccgaacuacaauaugaucaucauggacgaagcccacuuuaccgaccccuccagcaucgcagcgcgcggguacaucaguacacgggucggaaugggagaggccgccgcgauuuuuaugaccgccacgccucccggcagcgucgaggcguucccucaguccaacgccgugauccaggacgaggagcgcgacaucccugagcgcagcuggaacuccggguacgaguggaucacggauuuccccggcaagaccgucugguucguucccaguauaaaguccggcaaugacaucgccaacugccugcgcaaaaacgggaagcgugugauccagcucucccgcaagacguucgacacagaauaucagaagaccaagaacaacgacugggacuacgucguaaccaccgacauauccgagaugggcgccaauuuucgggcagaucgcgugaucgacccacggcgcugccugaagcccgucauccugaaggaugggccagagcgggugaucuuggccggcccaaugccagucacgguggccagcgccgcccaacgcagggggcgaaucggccggaaccacaacaaggagggcgaccaauacaucuacauggggcagccccugaacaacgacgaggaccaugcgcacuggaccgaggcgaagaugcugcuggacaacaucaacacgcccgaggguauuauacccgcccuguucgagccggagcgcgaaaaguccgccgccaucgacggugaguaucgauugcgcggugaggcgcgcaagaccuucguggaguugaugcggcgcggagacuugcccguauggcugagcuacaagguugcaucugagggguuccaguacagcgaccggcgcugguguuucgacggcgagcguaauaaucaggugcuugaggagaacauggacgucgagaucuggacaaaggagggagagcgcaaaaagcugaggccccgcugguuggaugcccgaacauacagcgacccccucgcucugcgcgaguuuaaggaguucgccgcgggccgccgcucagugagcggggaccuaauccucgagauagggaaguuaccgcagcaccugacacagcgggcccagaacgcccucgacaacuuagucaugcugcacaacagugagcaaggcgggcgugccuaccgccaugccauggaagaacuucccgacaccaucgagacguugaugcugcucgcccuaauugccguccugacaggcgggguaacgcucuucuuccucagcggccgcgggcugggcaagaccuccauaggcgugcucugugucauggccucaagugugcuccuguggauggccucaguggaaccacacuggauagcggccucgaucauacucgaguucuucuugaugguccugcuuaucccagaaccggaucggcaacgaacgccccaggacaaccagcucgccuacgucgugaucgggcuccuguucaugauacugacgguagccgccaacgagaugggccugcucgaaaccacaaagaaggaccuggggaucggccacguggcaguggaaaaucaccaccacgcgaccauguuagacgucgaucuccaccccgccucagccuggacgcuuuaugccguggccaccaccaucaucaccccgaugaugcggcacacgaucgagaacaccaccgccaacauuucccugaccgccaucgccaaucaagcugcgaucuugaugggacuggauaagggcuggcccaucagcaaaauggacauaggcgugccccugcucgcccugggaugcuacucccaggucaacccucuaacgcuaaccgccgccgugcucaugcugguugcgcacuacgccauuaucggaccgggccuccaggccaaagcaacgcgcgaggcgcagaagcggaccgcugcaggcaucaugaagaaccccaccgucgacgguaucguugcuauugaccuggaccccguggucuacgacgcuaaauucgagaagcagcugggccagauaaugcugcugaucuugugcaccagccagauucuccuuaugcgcacuaccugggcucugugcgagucaaucacgcucgcgacgggaccuuuaaccacccugugggaagggagcccgggcaaguucuggaacacgacuaucgccgugagcauggcuaacaucuuccgcgggagcuaccucgccggcgccggccuagcuuucucccugaugaagucccuaggaggcgggcggcgcggcaccggggcccagggcgagacccugggcgagaaguggaaacggcagcugaaccaacucagcaagucugaguucaacaucuacaagcgaagugggauuauggagguggaccgcuccgaggcaaaggagggccuaaagcgaggggagaccacccgucaugccgucagccgcgggacggcgaagcugcgcugguuuguggagcgcaaccuggugaagcccgaagggaaaguaaucgaccucgguugcggccgcgggggguggucguacuacugcgcagggcuaaagaaggugaccgaggucaagggguacacgaagggcgggccgggacacgaagagcccaucccgauggccaccuacggguggaaccuggucaagcuccacucgggcaaggacguauucuucacgccgcccgagaagugcgacaccuuacugugugacaucggggaguccagcccaaacccgacgaucgaagaaggucgaacccuccgaguucuuaagauggucgagcccuggcugcgcggcaaucaguucuguaucaagauacucaaccccuauaugcccuccgugguagagacccuagagcagaugcaacgaaagcacggcggcaugcugguccgcaacccguuaagccggaacuccacccacgagauguacugggugaguugcgggaccgguaacaucguguccgcugucaacaugacgagccgcaugcugcugaaccgauuuacaauggcccaccgcaagcccacguacgagcgagacguggaccucggggcggguacgcgacauguagccgucgaacccgagguagccaaccuggauaucaucgggcaaaggauugagaacauaaagcaugagcacaaaagcacguggcacuacgacgaggacaaccccuacaagaccugggccuaccaugggagcuacgaggucaagcccuccggcagcgccagcagcauggugaacgggguggugaaacugcuuaccaagcccugggaugucauccccauggucacgcaaauagcaaugacagacaccacccccuucggucaacagcgggucuuuaaggaaaaggucgacacccgcacgccgaaggccaagcgggggacagcgcaaaucauggaggugaccgcacgguggcuguggggcuucuugagucguaauaagaagccacggaucugcacccgggaggaguucacgcgcaagguucggucgaacgcggcgauuggcgccguguucguggaugagaaucaauggaacagcgccaaggaggcugucgaggacgagagauucugggaccucgugcaaaaagaacgugagcugcacaagcaggggaaaugcgccaccugcguguauaacaugaugggaaagcgcgagaaaaaacugggggaguucggaaaggccaaagggucgcgggcgaucugguauauguggcucggcgcccgcuuccuugaguucgaagcgcugggcuuuaugaacgaggaccacugguucagccgagaaaacucccucucuggagucgagggugaagggcugcacaagcugggcuacaucuuacgcgauaucuccaagauaccgggcggcaacauguacgcggacgacaccgccggcugggacacccgcaucacggaggacgaucugcagaacgaggcuaagaucaccgacauaauggagccggagcacgcccuccucgccacgucaaucuucaagcugaccuaccagaacaaggugguucgcguccagcggccagccaagaacgggacagugauggacgugauaucccgucgcgaccagcggggcagcgggcaggucggcaccuacggccugaacacauucacuaacauggaggcacaguugauacgccagauggagucugaaggaaucuuccugcccagcgagcucgagacgccaaaccuggcggagcgcgugcuagacuggcucgagaaguauggcguggaaaggcuuaagcgcauggccauauccggggacgacugcguggugaagccgaucgacgauagguucgccaccgcgcugacggcccugaaugauaugggcaaggugcggaaggacauaccacagugggagcccagcaagggguggaacgacuggcagcaaguccccuucugcucccaccacuuccaucagcucauuaugaaagacggccgggagaucgugguuccgugccggaaccaggacgagcugguugggcgcgcgcggguaagccagggggccggcuggagccuccgcgagaccgccugccuuggcaagagcuacgcgcagauguggcagcugauguacuuucaccggcgcgacuugcggcuggccgccaacgcgaucugcagcgcgguucccgucgacuggguccccacgucccgcaccaccugguccauacaugcccaccaccaauggaugaccacugaggacaugcucuccguguggaaccggguauggaucgaggagaaccccuggauggaggacaagacccauguaagcaguuggggcgacgucccauaccugggaaagcgcgaggaccagugguguggcagccucauuggccugaccgcgcgggccaccugggcauccaacauccaggucgcgaucaaucaggugcgccgccugauugguaacgagaacuaucucgacuacaugacaagcaugaagagauucaagaacgaaggcgaccccgagggggccuucugguga

SEQ ID NO: 24183 - RNA, 9879 nt, Artificial Sequence
  derived and/or modified CDS sequence (opt11) from DENV-1__FJ410212__SS-prME
agcgugaccauguuacugaugcugaugccaacugcccuggccuuccaccucacaacucguggcggggagccccacaugauuguuucaaagcaagagcggggcaagagccuccuguuuaagacuagcgccgguguuaacaugugcacgcucaucgcaauggaccugggcgagcugugcgaggauacgaugacuuacaaguguccccggaucacggaggccgagcccgacgacguagacugcuggugcaacgcgacggacacgugggucacuuacgggaccugcagccagaccggcgagcaucggcgggagaagcgguccguggcccucgcuccccacgugggccugggacuugagacacggaccgaaaccuggauguccuccgagggggccuggaagcagauccaacgggucgagaccugggcccuacgccaucccggguucacggugaucgcacuguuccuggcgcacgccaucgggacauccaucacucaaaagggaaucaucuucauuuuacuuaugcuggugacccccuccauggccaugcgaugcguaggcaucggcucgcgcgacuucguggagggccucucgggcgcgacguggguggacguugugcuggaacacgggucgugcgugaccaccauggccaaggacaaacccacccuggauaucgagcuccugaagacggaggucaccaaccccgcggugcugcggaaacucuguaucgaggccaagaucucgaacaccacgacggacagccgcugcccgacccagggcgaagcaacucugguugaagaacaggacgccaacuucgucugucggcgcaccuuuguggaccggggcugggggaacggcugcggucuguuuggcaaggggucccugcugacuugcgccaaauucaagugcguaaccaagcucgagggcaaaaucguacaguacgagaaccucaaguacucggugaucguuaccguccacacgggcgaccagcaccagguugggaacgaguccacagagcauggcaccaccgcuacaauuacgccucaggcucccacgaccgagauccagcugacggacuauggggcccugacccucgacuguagcccccgcacggggcuggacuucaacgagaugguucuccucaccaugaaagagaaguccuggcuggugcacaagcaaugguuccuggaccucccccugcccuggaccagcggggccagcaccucccaggagacguggaaccggcaagaccugcucgugaccuuuaagaccgcccacgcgaaaaagcaggaggucguggugcugggcagccaggaaggcgccaugcacacggcccugacuggggccacggagauccagacguccgggacaacgaccaucuucgccggacaccugaagugccgacuaaaaauggacaagcugacccucaaggguaugucauacgucauguguaccgggucuuucaagcucgagaaggaggucgcggagacacagcacggcaccgugcugguccagaucaaguaugagggcacugacgccccaugcaagaucccguucagcacucaagacgagaagggggugacgcagaacggccggcugaucaccgccaacccgauagugaccgacaaagaaaagcccgugaacaucgaggccgagccgcccuucggggaauccuauaucgugaucggcgcuggcgaaaaggccuugaaacuuagcugguucaagaaaggauccagcaucggcaagauguuugaggccacugccagaggggcacgucgcauggcgauccugggagauacggccugggacuucggauccaucggcggcguuuucacaagcguugggaaacucgugcaucaaauuuucggcaccgccuacggggugcuauuuuccggggucuccuggaccaugaagauagggaucggcgcgcugcuuacuuggcugggacugaacucucgcucuacuagccuaagcaugaccugcaucgcaguggggcuggugacccucuaccucggcgucaugguacaggcggacuccggaugcgugaucaacuggaagggcagagaacugaagugcgggucaggcauauucgucacuaaugaggugcacaccuggaccgagcaguacaaguuccaagcggacagcccgaagcgccugagcgcggccaucggcaaggccugggaggaaggggugugcgggauccgguccgcgacccgacucgagaacaucauguggaaacagaucuccaacgaacugaaccacauccuucucgagaaugacaugaaguucaccgucguggugggggacguggccggcauccuggugcaggggaagaagaugauccggccucagccgauggaguacaaguacagcuggaaguccuggggcaaggcuaagaucaucggcgcagacgugcagaacagcacguucauaauugacggacccaacaccccggagugccccgacgaccagcgcgcguggaauauaugggaggucgaggacuacggguucgguauuuucaccaccaacaucuggcugaaacucagagauuccuacacccaggugugcgaccauaggcugaugagcgcugccauaaaagacuccaaagccguccacgccgacaugggcuacuggauagaaagcgagaagaaugagaccuggaagcuggcgcgcgccuccuucaucgaggucaagaccugcaucuggcccaagucucacacccucugguccaacggcgugcuggagagcgaaaugauaauccccaagauccaugggggcccgaucucccagcacaacuaccgccccggguacuuuacgcagaccgcggggccauggcaccuggggaaacuggagcuggauuucgacuugugcgagggcacgacagugguuguagacgagcacuguggcaaucgggggccuagccuccgcacaaccaccgugaccggcaagauaauccacgaaugguguugucgguccuguacgcuuccgccccugcgguuccguggggaagaugguugcugguacgggauggagauacgccccgucaaggaaaaggaggaaaaccuggugaaaaguaugguuuccgccggcaguggcgagguagauagcuucagucuggggcugcucugcauaucgaucaugauagaggaggugaugcggucccgcuggagccggaaaaugcugaugaccggcacccuggccguguucuuccucuuaaucauggggcagcugaccuggaaugaccucauucgccugugcaucauggucggcgcgaacgccuccgaucgcauggggaugggcacgacuuaccuggcccucauggccaccuucaaaaugcggccgauguucgccgugggccuccuguucagacggcucaccagccgcgagguucugcugcugacaauaggguugucccuggucgcguccguggagcuccccaacagccuggaggagcucggcgacgggcucgcgaugggcaucaugauccugaaacuacucaccgacuuccagagcuaccaacugugggccacccugcucagccugaccuucaucaagacgacuuucagucugcacuacgcguggaagaccauggcgaugguccucagcaucgugucucuguucccccugugcuuauccaccacgagccagaagaccacauggcugcccgugcuguugggaucccuggggugcaagccgcuuaccauguuccuaaucgcggagaacaagaucuggggccgcaaaagcuggccccugaacgaggggaucauggccgucggcaucgugagcauacugcuauccagccugcuuaagaaugacguccccuuagcggggccccucaucgccggaggcaugcuaauugcgugcuacgugaucuccggguccuccgccgaccucagcuuagagaaagccgcagaggucuccugggaggaggaggccgagcauaguggcgcgucccauaacauuuugguggagguccaggacgacgggacgaugaagauuaaggacgaggaacgcgacgacacucugacaauucuccugaaagccacccuacuggccgugucgggcguguauccgcugucgauccccgccacacuguuugucuggcacuucuggcagaaaaagaagcaacggagcggggugcuaugggacacgcccagcccgcccgaaguugagcgcgcgguacuggaugacggcaucuaucggauuaugcagcgcgggcugcucgggcggucucaggugggugugggcguguuccaggagaacguguuccacaccauguggcaugugacgcgcggcgcgguccugauguaccaggggaagaggcuggagcccuccugggcuagcgugaagaaggaccucauaucauauggcggcggguggcgauuccaagggagcuggaacacaggggaggaggugcagguuaucgccguggagcccggcaagaaccccaagaauguucagacggccccagggacuuucaagacccccgagggcgaggucggagcaaucgcgcuggacuucaagcccgggacguccggcucgccgaucgugaaucgggaaggaaagaucgugggguuguauggcaacggggucgugaccaccagcggcacguacgucuccgccaucgcccaggcaaaggcgagccaggaggggccgcucccugagaucgaggacgaagucuuccgcaagcggaaccugacaaucauggacuugcaucccggcuccgguaaaaccagacgauaccucccggcgaucguucgcgaggccauaaagcggaaacuuagaacccugauccuagcccccacgcgaguggucgccagcgagauggcagaggcccugaagggcaugccuauccgguaccaaaccacggccgugaaguccgagcauaccgggaaggagaucguggaccuaaugugccacgccaccuucaccaugcgccuccugagcccugugcggguaccgaacuacaacaugaucaucauggacgaagcccacuucacggaccccuccagcaucgcggcccgcggguacauauccacccgggugggcaugggggaggcugcagccaucuucaugaccgcgacgccgccggggucaauggaagcauucccgcagucuaacgcggucauccaggacgaagaacgcgacauucccgaacgcagcuggaacuccggguaugaguggaucacggacuuccccggcaagaccgugugguucgugcccagcaucaaggcugggaacgacauagcgaacugccugcgcaaaaacggcaagcgggucauccaguuaucccggaagacuuucgauaccgaguaucagaaaacgaagaacaacgacugggacuacguggugaccaccgacaucagcgagaugggagccaacuuccgggcagaccgcgucauugacccacgccgcugccugaagcccguuaucuugaaggacggucccgaacgcgucaucuuagcaggacccaugccgguuaccgucgccuccgcggcccagaggagggggcgcaucggccgaaaccacaacaaggaaggcgaccaguacaucuacauggggcagccccugaacaacgaugaggaccacgcccacuggacggaggccaagaugcuacucgacaacaucaacacccccgagggcaucauccccgccuuauuugagccugaaagagagaaguccgcggccaucgacggggaguacagacugcgcggggaggcccggaagaccuuugucgaguuaaugcggagaggggaccugccuguguggcucuccuacaaaguggccagugagggcuuccaauacagugaccggcguuggugcuucgacggcgagcggaacaaccagguccucgaggagaacauggacguggagauauggaccaaagagggggagcgcaagaaacuucggccccgcuggcucgaugcccggacguacucagacccucucgcgcuacgcgaguuuaaagaguuugcugccggccggcgcagcguguccggggaccugauccucgagaucgggaaacugccgcaacaccugacccagcgggcccagaacgcgcucgauaaccuagucaugcugcauaacucagagcagggugggagagccuaucgacaugcgauggaggagcuccccgacacuaucgaaaccuugaugcuguuggcccugaucgcugucuugacgggcgggguuacccuguucuuucuguccggcaagggguugggcaagaccagcaucggacuccugugcgucauggcauccagcgugcugcucuggauggcuuccguggaaccccacuggaucgccgcaagcaucauacuggaguucuuccugaugguccuccuuauucccgagccggacaggcaaaggacgccccaggacaaccagcuggccuacguggucauaggucuccuguucaugauccugaccguggccgcaaacgaaaugggucuauuagagacgaccaagaaggaccuggggaucggccacguggcgguggagaaccaccaccacgcggccaugcucgaugucgaccuucaccccgcguccgcuuggacccuguacgccgucgcaaccacgaucgucaccccaaugaugcggcauaccauugagaauaccacugcgaauaucucucucacagcgaucgcaaaucaggcugccauccugauggggcuggacaagggcuggcccaucuccaagauggacaucggagucccccuccuagcgcugggguguuauagccaggugaacccccucacccugaccgccgccgugcugaugcucguugcccacuacgccaucauaggcccggggcugcaggccaaggccacgcgggaggcccagaagcgcaccgcagccggcauuaugaagaaucccaccauagaugggauuguggcgaucgaccuggaccccguggucuacgacgcuaaguucgagaagcaacucggccagaucaugcuacuuauccucuguacgucccagauccugcugaugcgcaccaccugggcccucugcgagagcaucacccuggccaccggaccccugacuacccucugggaggggagucccggcaaauucuggaauaccaccaucgcugugagcauggcgaacaucuuccggggguccuaccuggcaggcgccggacuggccuuuagccucaugaaaagccucgggggcgggcgccgggggaccggggcacagggcgaaacacugggagagaaguggaagcgccaguuaaaccaacuguccaagagcgaguucaauaccuacaagcgguccgggaucauggagguggaccggagcgaagccaaggaggggcugaaacgcggggagacuacgaagcacgcugucucccgcgguacugccaagcuccggugguucguggagcgcaauuuagucaagccugaggggaagguuaucgaucuagguugcggccgagggggcuggagcuacuacugcgccgguuugaagaaggugacagagguaaaggguuacaccaaaggcggaccgggucaugaggaaccgauccccauggccacuuacggauggaacuuagugaagcuccauuccggcaaggacguguuuuucauaccgcccgagaagugcgacacccuccucugcgacauaggggagucaucccccaauccgaccaucgaagaaggcagaacccugcggguguuaaaaauggucgagcccuggcuccgagggaaccaguucuguauuaagauccucaacccuuacaugccaucugugguggagacgcuggagcagaugcagcggaagcacggcggcaugcucguccguaacccgcugagucggaacagcacccacgagauguacugggugaguugcgggaccgggaacauagugagcgcagucaacaugaccucccgaaugcugcuaaacagauucaccauggcccauagaaagcccacguacgagcgcgacguggaucuuggggccggcacccggcaugucgccguggagccggagguggcgaaccuggacauaaucggccagcgcauugagaauaucaaacacgagcacaagucgaccuggcacuaugaugaggacaacccuuacaagaccugggcauaccauggcucguacgaagugaagccgagcggcuccgccucuagcauggucaaugggguggucaagcuguugacgaaacccugggacgucauccccauggugacccagaucgccaugaccgacacaacacccuucggccagcaacggguauucaaggagaagguggacacacgcaccccgaaggccaagcgggguaccgcccagaucauggaaguaacggcucgcuggcuguggggguuccucuccaggaacaagaagccccgcaucugcacccgggaggaguucacucgaaagguccggagcaaugccgccaucggcgcgguguuugucgaugaaaaccaguggaacuccgccaaagaggccgucgaggacgaccgcuuuugggaccuggugcaccgggaacgcgagcuacacaaacaggggaagugcgcgaccugcguauacaacaugaugggcaagagagagaagaagcucggggaguucggcaaggccaaggggagccgugcgaucugguauauguggcugggcgcccgcuuccuggaguucgaggcacuuggcuucaugaacgaggaccacugguucucccgagagaacagccuguccggggucgaaggcgaggggcugcacaaacugggguacauccugcgggauaucagcaagauccccgggggaaacauguacgccgacgacacggccggcugggauacacgcaucaccgaggacgaccugcagaacgaggcgaagaucaccgacaucauggagccugaacacgcccuucuggcaaagucuaucuuuaagcugacguaccagaacaagguggugcgagugcagcgcccugcuaagaacgguaccguuauggacgugaucagucgccgggaccagcgcggcuccggccaggucggcaccuacggccuaaacaccuucacgaacauggaggcucaacugauccggcaaauggagucagaggggauauuccugcccaacgaacucgagacgcccaaccuggcgggucgcgugcuggacuggcucgaaaaauacgggguggagcggcugaaacgcauggccaucucgggcgacgacugcgucgugaaaccgaucgacgaccgguucgccaccgccuugacagcccucaacgacauggggaaagugcgcaaagauaucccccagugggagcccuccaagggcuggaacgacuggcagcagguccccuucugcucccaucacuuucaccaacugaucaugaaggacggccgggagauuguggugcccugccgcaaccaggacgagcugguggggcgugcgaggguuagccagggcgccggguggucccuccgcgagaccgccugccuugguaagagcuacgcccaaauguggcagcugauguacuuccacaggcgggacuugcgacuggcggccaacgccauaugcagcgccgucccugucgacugggugcccacuucccggaccaccuggagcauccacgcccaucaccaguggaugacgacugaagacaugcuauccguguggaacagggucuggaucgaggagaaccccuggauggaggacaagacccgcaucagcuccugggaggacgugccguaccucgggaagcgcgaggaccaguggugcggcagccuaauaggccugacggcgcgcgccacgugggcuaccaacauccagguagccauuaaccagguccgucgccucaucggcaacgagaacuacucggauuacaugacgucaaugaagcgguucaagaacgaauccgagcccgagggugcguugugguga

SEQ ID NO: 24184 - RNA, 9879 nt, Artificial Sequence
  derived and/or modified CDS sequence (opt11) from DENV-1__FJ461307__SS-prME
agcgugacaaugcugcugaugcuuaugcccaccgcccuggccuuccaccucaccacccgggguggggaaccccacaugauagugagcaagcaagagcguggcaagagccugcuuuucaagaccucggccggcgugaacaugugcacgcuuauagcgauggaccugggagagcugugcgaggacaccaugaccuacaagugcccccggaucaccgaggcugagcccgacgacguggacugcuggugcaacgcuaccgacacaugggucaccuacgggaccugcagccaaaccggcgaacacaggcgggagaagcgguccguggcccuggcuccccacgugggucugggucuggagacgcggaccgagacguggaugagcuccgagggcgccuggaagcagauccagcggguugagaccugggcgcuacgccaccccggcuuuacggucaucgccuuguuucuggcgcacgcaaucggcacgagcaucacccaaaaggggaucaucuucauccucuugaugcuugugacccccuccauggccaugcgcugcgucggcauaggcagucgcgauuucguugagggucucuccggcgccaccuggguugauguaguguuagagcacgguagcugcgugaccaccauggccaaggacaagccaacccuggacaucgagcuccuaaaaacggaaguuacgaaccccgcuguguuacgaaagcucugcaucgaggcuaagaucucaaacaccacgacggacucucgcugcccaacacagggcgaggccacccuggucgaagaacaggacgccaauuucgucugucggcguaccuucguggaucgggggugggggaacgguugcggucucuuuggcaaggguucccuccucacgugcgccaaguucaaaugcgugaccaaguuagagggcaaaaucguccaauacgagaaccucaaguacagugugaucguaaccguucauacuggagaccaacaccagguggggaaugaauccacagagcacggcaccacagcgaccaucacgccccaggcccccacgacagagauccagcuaaccgacuacggggcacuuacccucgacuguagcccgcgcacgggccuagacuuuaacgagaugguucugcucaccaugaaggagaagucguggcuugugcacaaacagugguuccuggaccuaccgcugcccuggacgucuggagccagcaccucgcaggagacguggaaccggcaggaucugcucgugaccuucaagacggcccacgcgaagaaacaggaagucguugugcugggcagccaggagggggccaugcacacagcccuuaccggggcaacggagauccagaccuccggcacaacgaccaucuucgccggccaccucaaguguaggcugaagauggacaagcugacccuaaagggaaugagcuacguaaugugcaccggguccuuuaagcuggagaaagaaguggcggaaacucaacacggcaccgugcugguucagaucaaguacgagggcaccgacgcccccugcaagaucccauucagcacccaagaugagaaaggagugacgcaaaaugggcgucuuaucacagcgaacccgaucgugaccgauaaagagaaaccaguaaauaucgaggcagagccccccuucggcgaguccuauauugugauuggcgcgggcgagaaggcccucaagcugagcugguucaagaagggguccaguaucggaaagauguucgaggcuaccgcccgaggugcacgucgcauggcgauccugggugacaccgccugggauuucgguuccauaggggggguauucaccucgguugggaagcucguacaccagaucuucggcaccgcuuacggggugcuguucagugggguaagcuggaccaugaaaaucgggauugguguacugcucacguggcugggcuuaaacuccaggagcaccucccucagcaugaccugcaucgccguugggcuggucacccuguacuuggggguuauggugcaggccgauagugggugcguaauuaacuggaagggcagagagcugaagugcggaagcggcaucuucgucacgaacgaagugcauaccuggaccgaacaguacaaguuucaggcggacagcccgaagcgacugagugccgcgaucggcaaggccugggaggagggggucugcggcauccguagugccacccgccucgagaacaucauguggaagcagauuuccaaugagcucaaccacauacugcucgagaacgacaugaaguucaccguggugguuggcgacguggccggcauccugguacaggggaagaagaugauacggccacaacccauggaauacaaguacagcuggaagaguuggggcaaggcaaaaaucaucggggccgacguccagaacagcacauucaucaucgacgggccaaacacaccggaaugccccgacgaccagcgcgccuggaacauuugggagguggaggacuacggauucgguaucuucacgaccaacauauggcucaagcucagagacuccuacacacaggugugcgaccaucgccugaugagcgcugccaucaaggacuccaaggccguccacgccgacaugggauacuggaucgagucggagaaaaacgaaaccuggaaauuggcccgggcgucguucauugaaguuaaaaccugcaucuggcccaaaagccacacccucugguccaacggggugcuugagagugaaaugaucaucccaaagauccacggaggcccuauaucccaacauaacuaccgccccggguacuucacgcagacggccggccccuggcaccuagggaagcucgagcuggauuucgaccuuugugagggcaccaccgucgugguggacgagcacugcggcaaccgagggccgucguuacgcacgaccaccgucacaggcaagauuauacacgagugguguugccgguccuguacgcugccgccccugcgcuuucgcggggaggacgggugcugguauggaauggagauucgacccgugaaggagaaggaagagaaccuugugaaaucgauggucagugcgggcagcggcgagguggacagcuucucacugggacugcucugcaucagcaucaugaucgaggaggugaugcggucucgcuggagccgaaaaauguugaugaccggcacccuggcgguuuucuuccuacuuaucauggggcaacugaccuggaacgaccucauucgucugugcauaauggucggcgcuaaugcgagugaucgcauggguaugggcacgaccuaucuggcacucauggccaccuuuaagaugaggccgauguuugccgugggccuccucuuccgccggcucacgucucgcgagguccugcugcuaaccaucgggcugucgcugguggccagcgucgagcuccccaauucccuagaggaacuaggcgaugggcucgcaaugggaaucaugauucugaaacuauugacugacuuccagagcuaucagcugugggcuacccuguuaucccucacauucaucaagacgaccuucagccugcacuacgccuggaagaccauggccauggugcuauccauagugagccuuuucccacuaugccucuccaccacaagccagaagaccaccuggcuccccguccugcucggcucucuggggugcaagccgcugacgauguuucucaucgcggagaauaagaucuggggucgcaaauccuggccuuugaaugaggggaucauggccguggguaucguaucuauacugcuuucuagccugcugaagaacgaugucccccucgcggggccccugauugcgggcgguaugcugauugccugcuacgugaucuccgggagcagugcugaucugagccuggagaaggccgccgagguauccugggaggaagaagccgagcacagcggcgccucccacaacauccuggucgagguucaggaugacgggacaaugaaaauuaaggacgaagaacgcgacgauacccucaccauccugcugaaggcgacccugcuggccgugagcgggguguacccgcuuucgauucccgccacccucuucguguggcacuuuuggcagaagaaaaaacagcgguccgggguccuaugggauaccccgucaccgccugaagucgagcgugccguccuggacgauggcaucuaucggaucaugcagcgcggccugcucgggcggagccagguuggcgucgggguuuuccaggagaacguguuccacaccauguggcacgucacaaggggcgccgugcucauguaccagggcaaacgccuggagcccuccugggcgagugugaagaaggaccuaauuuccuacggcggcggauggcgcuuucaggguaguuggaacacaggggaagagguccagguaaucgccguggaaccuggcaagaauccuaagaacguccagacggcccccggcaccuucaagacgccagagggcgaggugggcgcaauugcccuggacuucaagccagggacgucaggcagcccaaucgugaaucgggagggaaagauagucggccuuuacggaaacgggguugugacuaccagcggcacuuacgucucagcuauugcccaggcgaaggccagccaagaggggccgcuuccagagauagaggacgaaguguuccguaagcggaaccugacuaucauggaccuacaccccggaagugggaagacgcgccgguaucucccugcaauaguucgcgaggccauuaagcggaagcugcgcacccugaucuuggccccgacccgggugguggcuucagagauggcugaggcgcugaagggaaugcccaucagauaccaaaccacagccgugaaauccgagcauacuggcaaagaaaucguggauuugaugugucacgcaaccuucaccaugcgucuccugagccccgugcgggugccgaauuacaauaugaucaucauggacgaagcucacuucaccgacccaucgagcaucgccgcgcgcggguacauuuccacccgggucgggaugggggaggccgccgcgauauucaugaccgccacgccgccgggcagcauggaagcguucccucaguccaacgccgugauccaagacgaggagcgggacauucccgagcggagcuggaauuccggguacgaguggaucacggacuuccccgguaagacugucugguucguccccucuaucaaggccggcaacgacauugccaacugucuacgcaagaacgggaaacgcgugauccagcugucucggaaaaccuucgacaccgaguaccagaagacgaagaauaaugacugggacuacguggugaccacagacaucagcgagaugggcgccaacuuccgagcugaccgcgugauagacccgcgucgcugcuuaaagcccguaauauugaaggacgggcccgagagagugauccuagccggccccaugcccgugacugucgccuccgcagcgcaacgccgugggcggaucgguaggaaccacaacaaggagggcgaccaguauaucuacauggggcaaccucuuaacaaugacgaggaucacgcccauuggacggaagccaaaaugcuucuagacaacaucaacaccccagagggaaucauccccgcccuguucgagccggagcgcgagaaguccgccgcgauugacggggaguaccgcuuacggggcgaagcccgcaagaccuucguggagcucaugcggcgcggggaccucccaguguggcugaguuacaaggucgccagcgagggcuuccaauacagcgacaggcgguggugcuucgacggagagcguaacaaucaagugcucgaggaaaacauggacguggagauuuggaccaaggaaggggagcgcaagaaauuacggccccgguggcucgacgcgcggacguauuccgaccccuuagcccugcgcgaauucaaggaguucgcggccggccggagaucagucucgggcgaccugauauuagagaucggcaagcugccacaacaccugacccagagggcccagaaugcucucgacaacuugguuaugcugcacaauagcgagcaaggcgguagggccuaucgccaugccauggaagaacucccagauaccauugagacccugaugcuacucgcccugauugccguucuaacgggcggggucacacucuucuuucugucgggcaaagggcugggcaagaccagcaucggccuccugugcgugauggccuccagcgucuugcuauggauggcgagugucgagccacacuggauagccgcuagcaucauccuggaguucuuccugauggugcuccugaucccagagccggaccgccagcggacgccccaggacaaccagcuggccuacguggugaucgggcugcuguucaugauccugaccguggcugcuaacgagaugggccuccuagagacuaccaagaaggaucuggggaucggccacguggccguggagaaccaccaccacgccgcgaugcucgacgucgauuugcaccccgccuccgcguggacacuguaugccguggccaccacgauaauaaccccgaugaugcgccacaccaucgagaauacuacggcuaacaucucgcucaccgccaucgcgaaucaggccgccauccugauggggcuggacaaggguuggccaaucuccaaaauggacaucggaguccccuugcuggcccuggggugcuacagccaggugaauccgcuaaccuugacagccgcagugcucaugcucgucgcccacuacgcgaucaucgguccgggguuacaagcaaaagcgacacgggaggcccagaaacgaaccgcggcuggcaucaugaagaacccgaccaucgaugggaucguggccauugacuuggaccccgucgucuacgacgcgaaguucgagaagcagcuaggccagaucaugcugcugauacucugcaccucacagauccuucugaugcgcacgaccugggcccuuugcgagagcaucacccuggccaccgguccacugacaacacuuugggaaggcuccccgggcaaguucuggaacaccacgauugccgugaguauggccaacaucuuccggggguccuaccuggcgggagccggccuggcauuuucccucaugaagucccucgggggcgggcgcagagggacgggggcucagggugaaacucucggcgagaaguggaagcgccaacucaaucaguuauccaagagcgaguuuaacaccuacaagcgguccggaaucauggagguagacagaucagaggcaaaggagggccugaagcgcggcgagacaacgaagcacgcagucagucgcgggaccgccaagcuucggugguucguggagcggaaccuggugaaacccgaggggaaggucauagaccugggcugcgggcgggggggcuggagcuauuacugcgccggguuaaagaaggugaccgaggucaagggcuacaccaaggggggcccaggccaugaggagcccauaccgauggccacguacggguggaaccucgucaaacuccacucaggcaaggacguguucuucaucccgcccgagaaaugcgacacuuuacucugugacaucggggagagcuccccgaacccgaccauagaagagggacgcacacugcguguuuuaaagauggucgagcccugguugcgcgggaaccaauucugcaucaagauucugaaucccuacaugccuagcgugguggaaacgcuggagcaaaugcagagaaagcacggcgguaugcuugugcgcaacccgcugucccgcaacuccacccacgagauguauuggguauccugugggaccggcaacaucgugagcgccgucaacaugaccucccgcaugcuacucaaccguuucacaauggcgcaccgcaagcccacguacgagcgcgauguagaccugggugccggcacccggcacguggccgucgagcccgagguggccaaccuggacauuaucggccagcgcaucgaaaacauuaagcacgagcacaagagcaccuggcacuacgacgaggacaacccuuacaagaccugggcuuaucacggaaguuacgaggugaagccgagcggguccgccagcaguauggucaacggaguggucaaguugcuuacgaagccgugggacgugauccccauggugacccagaucgccaugaccgacaccacgcccuucggccagcaacgggucuucaaggaaaaaguggauacccgcaccccuaaagccaagcgcgggaccgcgcagauaauggaggugacggcacgcuggcuuuggggcuuccuuuccaggaacaaaaagccccgcaucugcacccgggaggaguucacccgcaagguucggagcaacgcagccaucggcgccguuuucguggacgaaaaucaguggaacuccgcgaaggaagcuguggaggacgaucgcuucugggaucuagugcaccgagagcgcgaacugcacaagcagggcaaaugugcuaccuguguuuacaacaugaugggcaagcgugagaagaagcucggcgaguuuggcaaagcgaaggggucccgcgcuaucugguacaugugguuaggcgcgcgguucuuggaguucgaagcccucggcuucaugaacgaggaucacugguuuucccgcgagaauucacugucuggagucgagggugagggguugcacaaacucggcuacauccugcgggacaucucgaaaauccccgggggcaauauguacgccgacgauacggcaggcugggacaccagaaucaccgaggacgaucugcagaacgaggccaagaucaccgacauuauggagccagaacaugcguuacuggccaaguccauuuucaaguuaacguaccagaauaagguggugcggguacagcgccccgcgaagaacgguaccguaauggacgugauuucccgcagagaccaaagagguucggggcaagucgggaccuacggauuaaacaccuucacgaauauggaggcccagcugauccggcagauggagucugaggggaucuuucugccaaacgaguuagagacacccaaucuagccggccgcguucuggacuggcucgagaaguacgggguagagcgacugaagcgcauggcuaucuccggcgaugacugcguggugaagccgaucgacgaccgguucgccaccgcacugaccgcccuuaacgacauggggaaggugcgcaaggacaucccgcaaugggagccgagcaagggcuggaacgauuggcaacaggucccuuucugcagccaccacuuucaccagcugauaaugaaggauggccgggagaucguggugccuugccguaaccaggaugaacucgucgggcgagcucgggucucucagggagcgggguggucccuccgcgagacggccugccugggcaagucguacgcacagauguggcaacuaauguacuuccaccgccgugaccuccgccuggccgcgaacgcaauaugcagcgccgugcccgucgauugggugcccacuucccggaccaccuggagcauccacgcccaucaucaguggaugacgaccgaggauaugcuguccguguggaaccgcgucuggauagaggagaaccccuggauggaggacaagaccagaauaagcuccugggaggacgugccguaccuggggaaacgcgaggaccaguggugcggcagccugaucggcuugacugcccgcgccacgugggccacaaauauccagguggcaaucaaccagguccggcgccugaucgggaacgagaacuacuccgauuacaugauaagcaugaagagauucaaaaacgaauccgagcccgagggcgcccugugguga

SEQ ID NO: 24185 - RNA, 9879 nt, Artificial Sequence
  derived and/or modified CDS sequence (opt11) from DENV-1__FJ410213__SS-prME
agcgucaccauguugcuaaugcugaugccaaccgcccucgccuuucacuugacaacuagaggcggggagccccacaugauugugaccaagcaggaacgggguaagagucugcuguucaagaccagcgccggggugaauaugugcacccucauagccauggauuuaggcgaacugugcgaggacacgaugacguacaagugcccccguauuaccgaagcggagccggacgauguggauugcuggugcaacgccacggacacuugggucacauacgggaccugcagccaaacgggcgagcaccggcgcgacaagcggagcguggcucucgcgccucacgugggccugggguuggagacccgcaccgagaccuggaugucuuccgaaggagccuggaagcagauacagcggguugagacgugggcccucaggcacccuggcuucaccgugaucgcacuguuccuggcccaugccaucggaaccuccaucacgcagaaggggauaauauucauccuccuaaugcuggugacgccaaguauggccaugcggugcgucggcaucgguucccgcgauuucgucgagggguuaagcggagccaccuggguggauguggugcuggaacauggaaguugcgugaccaccauggccaaggacaaacccacgcuggauaucgaacuguugaagaccgaagugaccaaucccgcugugcugcggaaguugugcaucgaagccaagauaucuaacacaacgaccgauucccgcuguccuacccaaggcgaagccacucugauggaggagcaggaugccaacuucgugugccggcgaacguuugucgaccgcggcugggggaacggcugcgggcucuuuggcaagggcagccucaucacgugcgccaaauuuaagugcguuaccaaauuggagggcaagaucgugcaguacgagaaucugaaguacuccgucaucgugaccgugcauacgggcgaccagcaccaagucgggaacgagagcacggagcacggcacaacugcgacuaucacuccccaggccccaacauccgagauacagcucaccgacuacggcgcccugacgcuggacuguagcccccgcacgggcuuggauuucaacgagauggugcuuuuaacaaugaaagaaaagagcuggcucgugcacaagcagugguuccuggaucuaccgcuccccuggaccagcggggccuccacuucccaggaaacguggaaucggcaggaucugcuggugacguuuaagacagcccacgcgaagaagcaagaaguggucgugcuaggaucacaggagggcgccaugcacacggcgcugacgggggcuacugagauccaaacauccggcacgacgacaaucuuugcuggucaccugaaguguaggcuaaagauggauaaacuuacguugaagggcaugucuuaugugaugugcaccgggucuuucaagcucgagaaggagguggcggaaacccagcauggcaccgugcuaguucaaauuaaguacgaggguacagacgcucccuguaaaaucccuuucagcacucaggacgaaaaggggguuacccagaacggcagacugaucaccgccaacccgaucgugacggauaaggagaaaccggucaauauugaggcggaaccacccuucggugaauccuacaucgucaucggcgcgggcgagaaggcccugaagcucucuugguucaagaaggggucuuccaucgguaagauguucgaggcgacugcacguggggcccggcgcauggcgauccucggggacacggccugggacuucgggagugugggcgguguguucaccucgguagggaaacuugugcaucaaauauucgguacugcguacggaguccuguuuucgggcgucuccuggaccaugaagaucgggaucggcgugcugcucacguggcucggccugaacucgcgcagcaccucccugagcaugacauguauugccguugggcucgugacccuguaccugggcguaauggugcaggccgacuccgggugcgucaucaacuggaagggcagggagcugaagugcgggagcggaaucuucguaacgaaugaggugcauaccuggaccgagcaguacaaguuucaggcggacagcccuaaacgccuguccgcggcaauaggcaaggcgugggaggaggggguuugcggcauccggagugccacucgccuggagaacaucauguggaagcagaucuccaacgagcucaaccauauccuacuugagaaugacaugaaauucacaguaguggucggggacguggugggaauccucgcgcaggggaagaagaugauccggccccagccgauggagcacaaguauagcuggaaguccuggggaaaggccaaaaucaucggcgccgauguacaaaauacaaccuucaucauagauggccccaacacaccagagugccccgacgaccaacgggccuggaacauuugggaagucgaagacuacggguucgggauauuuacaacgaacaucugguuaaaguuacgagacagcuauacccaggugugugaccauagacucauguccgcggccaucaaggauagcaaagccguccacgcggacaugggguacuggaucgaguccgagaaaaacgagacuuggaagcuggcucgggccuccuucauugaagugaagaccugcauuuggccaaagucccauacgcuguggagcaacgggguuuuagagucagaaaugaucauuccuaagaucuacgggggaccgauaagccagcacaauuaccgcccgggguauuuuacccaaaccgccggcccguggcaccucgggaagcuggagcucgacuucgaccuaugcgagggaaccacggucgugguugacgaacauugcggcaaccgggggccgucccugcgcacgaccacugugacgggcaagaucauccacgaguggugcugccggagcugcacucugccgccccuccgcuucaaaggggaggaugggugcugguacgggauggagauccgucccgugaaggagaaggaagagaaccuagucaaguccaugguaucugccggcagcggugagguagacuccuucuccuuaggucugcugugcaucuccaucaugaucgaggagguuaugcgcucacgguggucccgcaagaugcucaugaccgguacgcuggccguuuucuuguuacugauaaugggccagcuuacguggaacgaccucauccggcugugcaucauggugggcgccaacgccagcgaucgcauggggauggguacuaccuaucuggcccugauggccacguuuaagaugcggccuauguucgcugugggccuucuguuucggcgccucacgucccgggagguccugcugcucaccaucggccugagccugguggccuccgucgaguuaccgaacagccuggaggagcugggcgaugggcucgcgaugggcaucaugauccugaagcugcugacggacuuccagagucaucaguuaugggccacccuucucagccugaccuucaucaagacgacccugaguuuacauuacgccuggaagacgauggcgaugguccugagcaucguuucccuguuuccccucugccuaucaacgaccucgcagaaaacgacuuggcugcccgucuugcugggcucucuggggugcaagccacuuacgauguuucugaucaccgagaacaagaucuggggacgcaaguccuggccccugaaugaagggaucauggcggugggaguggucagcauacuccugagcucccuucucaaagacgacgugccccuggcagggccucuuauagccggcggcaugcucauagcaugcuacgucauuagcggguccagcgccgaccuaagucuagaaaaggccgcggaagucagcugggaagaggaggccgagcacuccggcgccagccauaacauccucguggaggugcaggacgacgggacuaugaagaucaaggacgaggaaagagacgacacauuaaccauccugcucaaggcuacccugcuggcgguguccggcguguacccgcucagcauccccgccacccuguuuguuugguacuucuggcaaaagaagaagcagcgaagcgguguccugugggacacccccagcccacccgagguagaacgggccguucuggaugacggcauuuaccgcaucaugcagcgaggccuccugggccguucccaggucggcguggguguguuccaagagaacgucuuccacaccauguggcaugugacacguggugccgugcugauguaccaagggaagcgcuuggaaccaucuugggccuccgucaagaaagaccugaucagcuaugggggcggguggcgauugcagggguccuggaacacuggcgaggaaguacaggugauagcggucgagccgggcaagaacccgaagaauguacagaccgccccuggaaccuucaaaacgcccgaaggcgaagugggcgccaucgcccucgauuuuaaaccagggaccaguggcucccccauugucaaccgcgaggggaagaucguuggauuauacgggaaugggguggugaccaccagcggaacguacgugagcgccaucgcgcaggccaaggccucccaggaggggccccuccccgaaaucgaggacgagguguucaggaagcgcaaccucaccaucauggaucugcauccaggcucggggaaaacgcggcgcuaccugccggccaucguucgggaagcaaucaagcgcaagcuccggacccugaucuuagcgccgacgcgcguaguagcauccgagauggcugaggcucucaagggcaugcccaucagguaucagaccacagcaguaaagagcgagcacaccggcaaagagauaguggaccugaugugccaugccacguuuaccaugaggcugcucaguccuguucguguuccgaacuacaauaugauaaucauggacgaggcccacuucaccgaccccagcaguaucgccgcccggggguacaucagcacccgcguugguaugggagaggcugccgccaucuucaugacagcgacuccgcccggcucgguggaggccuucccgcagagcaacgcugucauccaggacgaagagagggacaucccggagcgauccuggaacagcggguacgaauggauaaccgacuucccugguaagaccgugugguucgugcccuccaucaagucuggcaaugauauagccaacugccugcggaaaaaugggaagcgcguuauccaacugucccggaaaacguuugacacugaauaccaaaagaccaaaaacaacgacugggacuacguggugaccacggacauuagcgagaugggcgcgaacuuccgagccgaccgagucauugacccgcgccguugccuaaagcccgugauccucaaggacgggcccgaacggguaauccuggcggggccuaugccggugaccgucgccuccgccgcucaacggcgcgggcggauuggccgcaaccacaacaaagagggugaccaguauaucuacauggggcagccccuaaauaacgacgaggaccaugcccauuggacagaagcgaagaugcuguuggauaacaucaauaccccugaaggaaucauccccgcccucuucgagccggagcgggagaaguccgcagccaucgauggggaguauagacuacgcggcgaggccaggaaaacauuuguagaguugaugcgcagaggggaccucccuguguggcugagcuacaagguggccagugagggcuuccaauauagcgaccguagaugguguuucgacggcgaacguaacaaucagguacuggaagagaauauggacguggaaaucuggaccaaggagggugagcggaagaaauugcgcccacguuggcuggaugccaggaccuacagcgacccccuggccuuacgggaauuuaaggaguucgccgccggccgccggagcguuagcggggaccucauccuggagauaggaaagcugccgcagcaccugacccaacgcgcgcaaaaugcccuggauaaccuugucauguugcacaacagcgagcagggcggccgggcguaccgccacgccauggaggaacugcccgacaccaucgagacacugaugcugcuggcgcucaucgccgugcugacugggggaguaacguuguuuuuccucuccggccggggguuaggaaagaccagcauaggccucuuaugugucauggccuccagcguucuguuguggauggccuccguggagccucauuggauagcagcaagcaucauccucgaguucuuucugaugguccuacucaucccagaaccggaucgccagagaacaccccaagauaaccaauuagcauacguggucaucggguuguuauucaugauauuaaccgucgcugccaacgagaugggccugcucgaaacgaccaagaaggaccugggcaucggccacgucgccgucgagaaccaccaucacgcgacuaugcuggacgucgaucuccaccccgccuccgcauggacccuguacgccguggcgacuaccauaauaacaccgaugaugcgacacacaaucgagaacaccacggcgaacaucagcuuaaccgccaucgccaaccaggccgcgauccucauggggcuggacaagggcuggcccaucuccaaaauggauaucggcgugccgcugcucgcgcugggguguuacucacaggugaauccccugacccucaccgccgccguguugauguuaguggcccacuacgcgauuaucggcccggggcuccaggcuaaggccacccgagaagcucaaaagcgcacggccgcagggaucaugaaaaaccccaccguagacgggauuguggcuaucgaccucgaccccguuguguacgacgccaaguucgagaagcagcugggccagauuaugcuccugauccuguguaccucccagauccuccugaugcguacuacaugggcuuugugugaaagcaucacccuugcgaccggcccccugaccacgcugugggagggguccccgggcaaguucuggaacaccaccaucgcggucagcauggcuaauaucuuccgugggucauaccuugccggcgcaggccuggcuuucagccugaugaaaucacuagggggcggccgcagaggcaccggcgcucagggcgagacgcuuggcgagaaguggaagcgucaguuaaaccagcucucuaaguccgaguuuaacaucuacaagcggucugggaucauggagguggaccguagcgaagcaaaggaggggcugaagcgcggggagaccacuaggcacgccguuucccggggaaccgcaaaacugagaugguucguggagcggaaccugguuaaaccagaggguaaggucaucgaucucggcugcggccgcggggguuggucauacuacugcgcggggcugaagaagguuacugaggugaagggcuauaccaagggaggacccggccacgaggagccgaucccgauggccacguacggguggaacuuggucaagcugcacuccggcaaggacguauucuucacaccacccgagaaaugcgacacgcuacugugcgacauuggggagagcucgccaaauccgaccaucgaggaaggccgcacccuccggguucuaaagauggucgagccguggcugcggggaaaucaguucuguaucaagauccucaaccccuacaugccgucuguuguggagacccuggagcagaugcaacgcaagcacggcggcauguuggugagaaacccgcugagucgcaacagcacccaugaaauguacugggugagcugcgggacuggcaacaucgugagcgccguaaacaugaccucacggaugcuguuaaaucgcuucaccauggcccaccgcaagcccaccuaugagcgggacguggaucucggugccggcacgcgucacguggcaguugagcccgagguggccaaccuggacauaaucggacagagaaucgaaaacauaaagcacgaacacaagagcacguggcauuacgaugaggauaaccccuacaaaaccugggcauaccauggguccuacgaagugaagcccagcgggagcgccagcucuauggugaacgggguggucaaacugcucaccaaaccgugggacguuauccccauggugacgcagaucgccaugacggacaccacuccguucggacagcaacgcgucuucaaggagaagguugacacgcggacccccaaagcgaagcgcggaaccgcccagaucauggaggugacagcccgcuggcucuggggauuuuugucccgcaacaagaagccccgaaucugcacgagagaggaauuuacucggaaaguucgcagcaacgccgcuaucggcgcuguguuuguugacgaaaaccaguggaacuccgccaaggaggccguugaggacgagcguuucugggaccucgugcagaaggagcgggagcugcacaaacaggggaagugcgcgaccugcguguacaacaugaugggcaagagagagaaaaagcugggggaguucgguaaggcgaagggaucgcgggcaauuugguacaugugguuaggcgcccgguuccuggaguucgaagccuuaggcuuuaugaacgaggaccacugguucucccgcgagaacagccucuccggggucgaaggagaaggccugcacaagcugggguauaucuugcgggacaucagcaagaucccagguggcaacauguacgccgacgacacagcgggaugggacacgcguaucaccgaggaugacuuacaaaacgaggcaaagaucaccgauaucauggagccggagcacgcccugcuugccaccuccaucuucaagcuaacguaccagaacaagguggugcggguccagcggcccgcaaagaauggaacugugauggacgugaucucccggcgggaccaaaggggcuccgggcagguuggaaccuacggccugaacaccuuuacgaacauggaggcgcaacucauccggcagauggaaucggaggggaucuucuugcccuccgagcucgagacucccaacuuggcugagcgcguucuggacuggcuugagaaguacggcguggagcgguuaaagcgcauggcgauuagcggggaugacugcguugugaaacccauagacgaccguuuugccaccgcccugacugcauugaacgacaugggcaaggugaggaaggacaucccccagugggagcccuccaagggcuggaaugacuggcagcaggucccuuuuugcucccaccacuuccaccaauuaaucaugaaagacggccgggagaucgucgugccgugccguaaccaggacgagcuggucgggagggcacgagugucccagggugccggcuggagccugcgggaaacggccugccucggcaagaguuacgcccaaauguggcagcugauguauuuccacaggcgggaccugagacucgcagccaacgcgaucugcuccgccgugcccgucgacuggguaccgaccagcagaaccaccugguccauacacgcgcaccaccaguggaugacgacggaggacaugcugagcguguggaaccgugucuggaucgaggaaaaccccuggauggaggauaagacccacguguccucauggggcgacgugccguaccucgggaaacgggaggaccagugguguggcucgcucaucgggcugaccgcccgcgccaccugggccagcaacauucaagucgccaucaaccaggugaggcggcugaucgggaacgaaaacuaccucgacuacaugaccagcaugaagcgcuucaagaacgagggagaccccgagggugcgcugugguga

SEQ ID NO: 24186 - RNA, 9879 nt, Artificial Sequence
  derived and/or modified CDS sequence (opt11) from DENV-1__FJ461308__SS-prME
agcgugaccaugcugcucaugcugaugcccaccgccuuggcauuccaccuaaccaccaggggcggggagccccacaugaucguuagcaagcaggaacgggggaagucucuguuguuuaaaacuagcgcggggguuaacaugugcacccucaucgccauggaccugggcgaguucugugaggacaccaugaccuacaagugcccgcgcauaaccgaggccgaacccgacgacgucgacugcuggugcaacgcgaccgacacaugggugaccuacgggaccugcucucagacgggcgaacaucggcgggacaagcgaagcguagcccuggcuccucacgugggccucgggcuggagacucgcgccgagacguggaugucuuccgagggcgccuggaagcagauccagcggguggagaccugggcguugcgccacccggguuuuaccgugauugcccuguuccuggcucacgcgaucgguacgagcauaacacagaagggcaucaucuucauccuacucaugcuggugacccccuccauggccaugcgcugugucgggaucggcagcagggacuucguugagggguuauccggugccaccuggguggacgucguccucgaacacgggagcugcguaacgaccauggcgaaagacaagcccaccuuagauaucgagcugcucaagaccgagguaacuaacccagccgugcuccggaagcugugcauugaggccaagauauccaacacgaccaccgacagccgaugcccaacgcagggcgaggcaaccuuggucgaggaacaagacgccaacuucgugugccggaggacuuucgucgaccggggguggggcaacggaugcgguuuguucggcaaggggucucucauaacuugcgcgaaguucaagugcgugacgaaauuagaaggcaagacuguccaguacgagaaccugaaguacagugugaucgugacaguccacaccggcgaccagcaccagguugggaacgaaucuacggaacacggcaccaccgccacuauaacgccccaggcccccagcaccgagauucagcugaccgauuacggcgcccucacccuggacugcagcccccgcaccggucuagauuucaacgagaugguccuccuaacgaugaaggaaaagucauggcuggugcacaagcagugguuccucgaccucccgcugcccuggacaagcggagccucgaccucucaggagaccuggaaucggaaggaccucuuggugacguuuaaaaccgcgcacgcuaagaagcaagaggucgugguccucggcucccaggagggugccaugcacaccgccuuaacaggggccacggagauucagacuagcggcacgaccacgaucuuugcggggcaccugaaaugccgccugaagauggacaaacucacccugaagggaaugaguuacgucaugugcaccggguccuucaaacuggagaaggagguggccgagacccagcacggcacggugcucguccagaucaaguacgagggcaccgacgcccccugcaagauucccuucuccacccaagacgagaagggcgugacccagaacggacgacugaucacggccaacccuaucgugaccgauaaggagaagccagucaauauugaggcagagccgccguucggggaaagcugcaucgugaucggcgccggcgagaaagcgcugaagcuguccugguuuaagaagggaucuuccaucggcaagauguucgaggcgaccgcccgcggggcgcggcgcauggcgauccucggcgacaccgcaugggacuucgggagcaucggcgguguguucacguccgucggcaagcugguucaccagaucuuuggcaccgccuacggaguacuguucucgggggucuccuggaccaugaagaucgggaucggcgugcuccugaccugguuaggccucaacagucgcuccacgagccuguccaugaccuguaucgccguggggcucguuacccuuuaccuaggcguuauggugcaggcugacagugggugcgucauuaacuggaaaggccgggagcugaagugcgggucaggcaucuucguuaccaaugaagugcauacguggacggagcaauacaaguuccaggccgacuccccuaagagacucuccgccgcaaucggcaaggcgugggaggaaggugugugcggcauccguagcgcgacaagacuggagaauaucauguggaagcagauuagcaaugagcuaaaccacauccucuuggagaacgacaugaaguucacugugguggucggggacguggccggcauuuuggcccaagggaagaagaugauccggccccagcccauggagcauaaguacuccuggaaauccugggguaaggcgaagaucaucggcgccgacgugcagaacacgacguuuaucauagacggccccaacaccccggagugcccagacgaccagcgcgcuuggaauaucugggagguggaggacuacggcuucgggaucuucacaacgaacaucuggcucaagcugcgcgacuccuacacacaggugugugaccaccgacucaugagcgccgccaucaaggacuccaaggccgugcacgcggacaugggcuacuggaucgagucugagaaaaacgagacuuggaagcucgcccgggccuccuuuaucgaggucaagaccugcaucuggcccaagagccacaccuuguggagcaacggcgugcuagagagcgagaugaucaucccaaagaucuacgggggcccaaucucgcaacauaacuaccgucccgguuacuuuacgcagacugccggacccuggcaccucgggaagcuggagcuggauuucgaccucugcgagggcaccaccguggucguggacgagcacugcggcaaccgggggccgagccuacgaacaaccaccgugaccggcaagaucauccacgaguggugcugcagauccugcacgcugccgccauuacgcuucaagggagaggacggcugcugguauggaauggagauccggcccguaaaggagaaggaggagaaccugguuaagagcauggugagcgccgguaguggggagguggacuccuucucccugggucuccugugcauuagcaucaugauagaggaggugaugcgcagucgguggagccgcaaaaugcugaugaccggcacacucgcgguguucuuucuauugaucauggggcagcucaccuggaacgauuuaauccggcugugcaucauggucggcgccaacgccuccgacagaauggggaugggcacuacuuaccucgcgcugauggccaccuuuaaaaugcgccccauguucgcaguggguuuacuauuccggcgccugacgagccgggaaguacugcuccugacgaucgggcucucccucgucgcaucaguggagcuccccaauagccuggaggagcucggagacggguuagccauggguaucaugauccuaaagcuccucacagauuuccagucccaucagcuaugggccaccuuacugucccuuacuuucaucaagacgaccuucagccuccauuacgcguggaagacgauggccaugguccuuuccauugugagcuuguuuccgcucugccugagcaccacgagccagaaaacaaccuggcugcccguccuccuggggucccuggggugcaagccgcucaccauguuccugaucgccgagaauaagaucuggggccgcaagagcuggccccugaaugaggggauuauggccgucggaaucgugucuauccuccuguccagccugcucaagaaugacguacccuuggccgggccccuuauugccgggggcaugcucaucgccugcuacgucaucucuggguccuccgccgaucugagccuggagaaagcggccgagguguccugggaggaggaggcggagcacagcggcgccagucacaacauccuuguggagguccaggacgacgguacgaugaagaucaaggacgaggagcgugacgauacgcugaccauccuauugaaagccacccugcuugcaguaagcggaguguacccgcucaguaucccugcaacucuguucgucugguauuucuggcaaaagaagaaacagcgcagcgggguucuuugggauacgccaagcccgcccgagguugagcgugcggucuuagacgacgguauuuaccgcaucaugcagcguggcuuguuagggcgcagccaggucgguguagggguauuccaggagaacguauuccauaccauguggcacgugacucggggcgccguccugauguaccaaggaaagcgcuuagagcccuccugggccuccgugaagaaggaucugauaucauacggcggcggcuggcgucugcaggggucauggaacaccggugaagagguacaggugaucgccguggagccugguaagaaccccaagaacgugcagacggccccggguaccuuuaagaccuccgagggggaggucggcgcaaucgcccucgacuuuaagcccgggacgagcggcagucccaucgugaaccgcgaggggaagauuguuggccuguacggcaacgggguggugaccacgucugggaccuacgugagcgcgaucgcucaggcgaaggccucccaagaagggccccucccagagaucgaggaugaggucuuccggaagcgcaaucuaaccaucauggaucugcaccccggcuccgggaagacucggcgcuaccugccagccaucgugcgggaggccaucaagcgcaaauuacggacccucauccuggccccgacccgcguggucgccuccgagauggccgaggcccucaagggcaugccuauccgcuaccagaccacagccgucaagagcgagcacaccgguaaagagaucguggaccugaugugucacgccaccuucaccaugcggcugcucucgcccguccgcgugcccaacuacaacaugaucaucauggacgaggcucacuuuacggacccgagcagcaucgcagcccggggauacaucagcaccagagugggcaugggggaagcagccgcgaucuucaugacggccacgccgcccggcuccgucgaggcguucccgcaaagcaacgccgucauccaggacgaggagcgagacaucccggagagauccuggaacagcggguacgaguggaucacagacuuccccggcaagaccgugugguucguccccucaaucaaaagcggaaacgacaucgcgaacugccugcgcaaaaacgggaagagaguuauccagcugucccggaagacguucgacaccgaguaccaaaagacgaagaauaacgauugggacuacgugguuacaaccgacaucucggagaugggagccaacuuccgcgccgaccgggucauugacccgagacggugccucaaaccggucauccugaaggacgggcccgagcgcgucauccuggccggcccaaugcccgugacaguggccagugccgcccaacggcgcggacggaucggacgcaaucacaacaaggagggcgaucaguauaucuacaugggccaaccgcuuaacaacgacgaagaccacgcccacuggacggaagcuaagaugcugcuggacaacaucaacacccccgagggaaucauccccgcccucuucgagcccgaacgggagaaguccgcugccaucgacggugaguaccgccuuagaggcgaggcccggaagacguucguggaauuaaugcggcgcggggaccucccgguguggcucucguacaaggucgccuccgagggcuuccaguacagcgaccgccgguggugcuucgacggggagcgcaauaaccaaguguuggaggagaacauggauguggaaauauggaccaaagagggggagcggaaaaagcugcgcccccggugguuagacgcccgcacguacuccgacccucuggcacuccgcgaguucaaggaguuugccgcaggccgccgaagugucuccggagaucugauccuggagauuggcaaacucccccaacaucugacccagcgcgcucagaacgcgcuggacaaucuagugauguugcacaacagugaacaaggcgggcgggcuuaccgccacgccauggaggaacugccggacaccaucgagacccucaugcugcuagcccucauugcuguccugacaggcggggucacucuguucuuccuauccggccgagggcugggcaaaaccuccauaggccuuuuaugcgugauggccucuagcguccugcuguggauggcaucugucgagccgcacuggauagccgccagcauaauccucgaguucuuccugauggugcuguugauccccgagcccgaucgucaacggaccccacaggacaaccagcuggccuauguugucaucgggcuacucuucaugaucuugaccguagccgcaaacgaaaugggucugcucgagacgaccaagaaggaccuggggaucggccacguggccguggagaaccaucaccacgccgcaaugcuggacguggaccuccaccccgcguccgcguggacucuguaugccguugcaaccacuaucaucacccccaugaugcgccacaccaucgagaauacgacggccaacaucagccugaccgcaaucgcuaaccaggcagcaauccucauggggcuggacaagggguggccgaucaguaagauggacaucggggucccccuccucgcgcuugggugcuacagccaagugaacccacugacccucaccgccgccguccucaugcugguugcccacuacgccaucauuggccccgggcuccaggcgaaggcgacccgagaggcccagaagcgcaccgccgccggcauuaugaagaaccccaccguggacgggaucguggcgaucgacuuagauccaguaguauaugaugccaaguucgagaagcagcugggccagaucaugcugcugauccugugcacgucccagauccuucugaugcgcacgacgugggcccugugugagagcaucacccuggccacagggccccuuacgacccugugggaagggucacccggcaaauucuggaacaccacaauagcagucucgauggcgaacaucuuccgggggagcuaccuggcgggugccggacuggccuucucacugaugaagucccucggggguggucgccguggcacgggggcgcaaggcgagacccugggcgagaaguggaagcgccaacugaaccaauuauccaaguccgaguucaacacauacaagcgguccgggaucauggagguggaucggagcgaagccaaggagggucugaaacgaggggagacuacuaagcacgccgugagccgcggcaccgccaaauugcggugguuuguggagagaaaccucgucaagccugaggggaaggucaucgaccugggcugcggaaggggcggguggagcuacuacugcgccggacugaagaaggugaccgaggucaagggguacaccaagggcgggcccggccacgaggagcccauccccauggcgaccuauggauggaaucuggugaagcugcacaguggcaaggacguuuucuuuaucccacccgagaagugcgauacccugcugugcgacaucggggagagcucccccaaucccaccaucgaggaggggcggacccugcggguccugaagaugguggagccguggcuccgcggaaaccaguucugcaucaagauccucaaccccuacaugccaagcguggucgagacgcuggagcagaugcaacggaaacacggaggaaugcuggucaggaauccacucuccagaaacucgacccacgaaauguacuggguguccugcgggaccggcaacauugucagcgccgucaauaugaccucccgcaugcuccugaaccgguucacgauggcccacagaaagccgacguacgagagggauguagaccucggggccggcacccggcacgucgccgucgaacccgagguggcuaaccuggauaucaucggccaaagaaucgagaacauaaagcacgagcacaagagcaccuggcacuaugacgaagauaaccccuacaagaccugggcguaccacggguccuacgaagugaagcccagcggcagcgccuccucaauggugaacggcguggugaagcugcucacgaagccgugggacguuauccccauggucacccagaucgcuaugacagacacaacgcccuucgggcaacaacguguguucaaggagaagguggauacacgcacccccaaggccaagcgggggaccgcgcagaucauggaggucaccgccaaguggcuaugggguuuccuaucuaggaacaagaagccgcgaaucugcacccgcgaggaauuuacccgaaaaguacgcagcaaugcggcuaucggugcgguguuugucgacgaaaaccaguggaacucggccaaggaggcaguggaggacgagcgguuuugggaucuuguucaccgcgaacgggagcuucauaaacaggggaagugcgcgaccugcgucuacaacaugaugggcaagcgcgagaagaaguuaggagaguucggcaaggccaagggcagccgggcgauaugguacauguggcugggcgcccgcuuucuggaguucgaggcucugggcuuuaugaacgaagaccacugguuuucccgggagaacagccucuccgggguggagggcgaggggcugcacaaacugggcuauauccuccgggacaucagcaagauccccggggguaacauguacgccgacgacacagccggaugggacacccggaucaccgaggacgaccugcagaacgaggcgaagauaacggacauuauggagcccgaacacgcucugcucgcaaagagcauuuucaaguugacguaccagaacaaggugguccgcgugcagcggccggccaagaacggaaccguuauggacgucaucagccgccgcgaccagcggggcuccggacaggugggcacauacggucucaacacguucacgaacauggaggcccagcucauccgucagauggagagcgaggguaucuucucucccagcgaguuggagacccccaaccuugcgggccgaguguuggacugguuagagaaacaugggguugagcgccugaagaggauggccaucuccggcgacgacuguguggugaagcccauagacgaccgcuucgccaccgcacucaccgccuuaaaugauauggggaaggugcggaaggacauaccgcagugggagcccagcaaggguuggaacgauuggcagcaaguccccuucugcagccaccacuuccaccagcugaucaugaaggauggccgcgaaaucgugguccccugccggaaccaggacgagcucguugggcgcgcgcgggucucucaaggcgccggguggagccugcgcgagacggccugccugggcaagucuuaugcccagauguggcaacuuauguacuuucaccgcagagaucugaggcuggcggccaacgccaucugcagcgcuguccccguggacugggugcccaccucccgcaccacguggagcauucacgcccaccaucaauggaugacgaccgaggacaugcucuccgucuggaaccguguguggauagaagaaaaccccuggauggaggacaagacccacaucagcuccuggggcgacguucccuaccugggcaagcgcgaggaccaauggugcggcucgcugaucgggcucaccgcgcgggcgacaugggccacuaacauccaggucgccaucaaccaggugcgcagacucaucggcaaugagaacuacuuggacuacaugaccuccaugaaacgguucaagaacgagagcgauccggagggagcgcucugguga

SEQ ID NO: 24187 - RNA, 9879 nt, Artificial Sequence
  derived and/or modified CDS sequence (opt11) from DENV-1__FJ461310__SS-prME
agcgugaccaugcugcucaugcugaugcccacggcacuggccuuccaccucacuaccagaggaggggaaccucauaugauugugucgaagcaggaacggggcaagagccugcuguuuaagaccagcgccggggugaacaugugcacccugaucgccauggaccugggcgagcugugugaggacacaaugaccuacaagugcccccggaucacggaggccgagcccgacgacgucgacugcuggugcaacgccacagauaccuggguaaccuacgggaccuguagccagaccggggagcaccggcgggacaagagaucaguugcccucgcgccccacgugggucugggucuggagacgcgcacagagaccuggaugagcucagagggggccuggaagcagauccagcgggucgagacgugggcccuacgucaccccggguuuacugugaucgcccuuuuucuggcacaugccaucggcaccucuauuacccaaaaggggaucaucuucauccuccugaugcugguuacccccucgauggccaugcggugugucggcauugguagccgcgacuucguggaggggcucuccggugccacgugggucgaugucgugcuggagcacgggagcugcgugacaacgauggccaaggauaagcccacuuuggacaucgagcuccugaagacggaggucaccaacccugcgguguugcggaaacugugcauugaggccaagaucuccaauaccacgacggacagccggugcccgacgcagggagaggcgaccuugguugaggaacaggacgcgaacuucgucugccgucgcaccuucguggaccggggcugggggaauggcuguggacuguucgguaagggaucccuaauaaccugcgccaaguucaagugcgugaccaagcuggaaggcaagauuguccaauacgagaaucuuaaguacagcgugaucgugaccguccacaccggcgaccagcaccagguggggaaugaguccacugaacacggaaccaccgccaccaucacgccccaggcccccacgaccgagauccagcucacggacuacggggcccuaaccuuggacugcagcccgcgcacuggccucgacuucaacgagaugguccugcugacaaugaaggagaaguccuggcucgugcacaaacaaugguuccuggaccugccccucccuuggacaucaggugcaucaaccagccaggagacguggaaccggcaggaccugcuggucaccuucaagaccgcccacgcgaagaagcaggagguugucguguuaggcagccaagagggcgccaugcacaccgcauugacgggggcaacggagauccagaccuccggcaccacgaccaucuucgccgggcaccugaagugucgacucaagauggacaaauuaacccugaagggaaugagcuacgucauguguaccggcuccuucaagcucgagaaagaaguggccgagacgcagcacggcaccguucucguccagaucaaauaugagggcaccgaugccccuugcaagauccccuucucgacgcaggacgagaagggagugacgcagaacggccggcuaaucacugcuaacccuaucgucaccgacaaggagaagcccgucaauaucgaggcagaaccuccguucggugaguccuacaucgugauuggugcgggcgagaaggcacugaagcugagcugguuuaagaaggggucgagcaucggcaagauguucgaggcaacugcccgaggagcccgaagaauggcgauucugggugacacggccugggacuuuggguccaucggcggagucuucaccagcgucggcaagcuggugcaccagaucuucgggaccgcuuacggggugcuuuucuccgguguaagcuggacgaugaaaaucggcaucggagugcugcugacguggcucggccugaacuccagauccaccucccugagcaugaccugcaucgcaguggggcucaucaccuuauaccuaggcgucauggugcaggcagacuccgggugcgugaucaacuggaagggccgggagcucaagugcgggagcgggaucuucguaacgaacgagguccacacauggacagagcaauauaaguuccaggcugacagccccaagcgccugagcgccgccaucggcaaagccugggaggagggggugugcggcauacggagcgccacccgccuugagaacauaauguggaagcaaaucuccaacgagcucaaccauauccuguuagagaaugacaugaaguuuaccguaguugucggggaugucgccggcauccucgcccaggggaagaaaaugauacggccccaacccauggaauacaaguacucguggaaguccugggguaaagcaaaaaucauuggggcagacguucagaacacuaccuucaucaucgacggaccgaacaccccggagugccccgacgaccagcgggcauggaacauaugggaaguggaggacuacggauucgggaucuucaccacgaacaucugguuaaagcugcgggacagcuauacccaggucugcgaucaccgacucauguccgcugcaaucaaagacagcaaggccgugcacgccgacaugggcuacuggaucgaauccgagaaaaacgaaaccuggaaguuggcgcgggccagcuucaucgaagugaagaccugcaucuggcccaaaucccacacacucuggaguaauggcguccucgaguccgaaaugaucauacccaagaucuacgguggcccuaucagccagcacaacuaccgccccggguauuucacucaggcggcggggccguggcaccuugguaaacuggaguuagauuuugaccugugcgagggaacgaccgugguggucgaugagcacugcggcaaccgggggccguccuugcggacgaccaccgugaccggcaagaucauccacgaguggugcugccgcagcugcacgcugccacccuuacgguuccgcggggaggacggaugcugguacggaauggagauccgccccgugaaggagaaggaggagaaccuugucaaguccauggugucggccggcagcggagagguggacucguuuucucuuggccugcuuuguauuuccaucaugaucgaggaggucaugcgaucgcguuggucccggcgcauguuaaugaccggcacucuggcgguauuuuuccuucucauaauggggcagcugaccuggaaugacuuaauccgccucuguaucauggugggcgccaaugccuccgaccggaugggaauggggacuaccuaccuggcgcugauggcgaccuucaagaugcggccgauguuugcgguuggacuccuguuccgccgccugaccagucgggagguccuguuacugacgauagggcucagucugguagccuccgucgagcugcccaacagccucgaagaacugggcgacgggcuggccaugggaaucaugauccugaaguugcugacugauuuccaaucccaucagcucugggccacgcuccucagcuuaaccuucaucaagacgaccuuuagccugcacuaugcguggaagacaauggcgaugguccugucgauugucucccucuuuccccugugccugucaacaacgucacagaaaacuaccugguugccugugcugcugggcagccuagguuguaagccgcuuaccauguuucugaucgcagagaauaagaucuggggccgccggaguuggccccuaaacgaggggaucauggcggucgguauagucagcauccugcuaucaucguuacugaagaacgacguuccccuggccgggccccugauagcgggcggcaugcuaaucgccugcuaugugaucucaggguccagcgcagaucuaucccucgaaaaagcggccgagguaagcugggaagaagaggcggagcacuccggagccucccauaacauacugguggaggugcaagacgacgguaccaugaaaaucaaggacgaggagagggaugacacccugaccauccucuuaaaggccacccugcuggccgucucggggguguacccgcugucaauacccgccacccuguucgugugguauuuuuggcagcguaagaagcagcgcuccgggguacuaugggacacgccgagcccuccggagguggagcgagcgguucucgacgacgguaucuaccgcaucaugcagagaggccucuuagggcguucccaggucggcguggggguguuucaggagaacguuuuucauaccauguggcaugugacccggggugcugugcucauguaucaggggaaacggcuggagcccagcugggccagcguaaagaaggaccugaucucauacgggggcggguggagauugcagggcucguggaacaccggggaagaaguccaagugaucgccgucgaacccgggaagaaccccaaaaaugugcagacugcucccgggacauuuaaaacacccgagggagaaguaggcgcgaucgccuuagauuucaagcccggaaccucgggcucccccaucgucaaccgcgagggaaagaucguggggcuguacgggaaugguguggucaccaccaguggcacauacguuagcgccaucgcccaggcgaaggcuucccaagagggaccacuacccgagaucgaggacgaggucuucaggaagcgcaaucugaccaucauggacuugcacccuggcagcgggaaaacgcggcgcuaucucccggcuaucguccgcgaggccaucaaacggaagcuacggacauuaaucuuagcccccacgcgggugguagcguccgagauggccgaggcccugaagggcaugcccauuagauaucagaccacggccgugaagucagagcacaccgguaaggagaucguggaccugaugugucacgccaccuucaccaugcggcugcugucgcccgugcgcgucccuaacuacaacaugauaaucauggacgaggcgcacuuuacggaucccagcucuauugccgcacgcggguacaucagcacccgcguggguaugggcgaagcagccgcgaucuucaugacagccacgccacccgggucuguggaggccuucccgcaaagcaacgccgucauccaagacgaggagcgcgacaucccagagcgcuccuggaacagcggguacgaguggauuaccgacuuccccggcaagacggucugguucgugcccaguaucaaaaguggcaacgauaucgccaacugucugcggaaaaacggaaagcgcgucauccaacucucccguaagaccuuugacacggaguaccagaagacgaagaacaaugacugggacuacgucgugaccacugacauuagcgaaaugggcgccaauuuuagggcugaccgagucauagacccccgccggugcuugaagcccguuauccugaaggacggacccgagagggugauccucgccggaccuaugcccguaacaguggccuccgcggcccagcggcgcgggaggauaggccggaaucacaacaaggaaggagaccaguacauauauauggggcagccccugaacaacgaugaggaccacgcccacuggacggaggcuaagaugcugcuugacaauauuaauacccccgaagggaucaucccugcccucuucgagccagaacgcgagaagucagcggccaucgacggugaguaccgguuacgcggcgaggcccggaagaccuuuguugagcugaugcgccgcggggaccugcccgucuggcuguccuacaaggucgcuagcgagggauuccaauacagcgaucgccgguggugcuuugacggcgaacgcaacaaccaaguccucgaagagaacauggacguggaaaucuggaccaaggagggggagcgcaagaaguuacggccccgguggcucgacgccaggacauacagcgacccucucgcgcugagggaguuuaaagaguucgccgcuggccgccggucaguauccggugaccuuauccucgagaucggcaagcugccucaacaccugacccagcgcgcgcaaaacgcgcucgauaaucuggugaugcugcacaauuccgagcaagggggcagagccuauaggcacgccauagaggagcugcccgacaccaucgagacccuaauguugcucgcauuaaucgccgucuugacgggcgggguaacccucuucuuccuguccgggcgggggcugggcaagacgagcauuggcuuacucugugucauggcguccucugugcuucuauggauggccucaguagagccccacuggaucgcggccagcaucauccuggaguucuuucuaaugguucugcugauuccugagccggaccgacagagaacgccccaagacaaucagcuggcuuacgucguuaucggccuccuguucaugauccugaccguggccgccaacgagaugggacucuuagagacuaccaagaaggacuuggggaucggucacguagcgguagagaaccaucaucacgcagccaugcucgaugucgaccugcacccggcuuccgcauggacccucuacgccguggccacaacgauaauuacccccaugaugcggcacaccaucgagaacaccacggccaacaucucccucaccgcaauagcuaaccaggccgccauauuaaugggacuggauaaaggcuggcccaucucgaagauggacaucggggucccccucuuggcgcuugggugcuauagccaggucaaccccuuaaccuuaaccgcagccguacugaugcuaguugcacacuacgcgaucaucgggccgggacugcaggcgaaggccacgcgcgaggcccaaaagcgaacugccgcgggcaucaugaaaaaccccacagucgaugggauuguggcgaucgaucuggaccccgucgucuacgacgccaaauucgaaaagcaguuaggccaaaucaugcugcugauccuaugcacuagccagauccugcugaugcgcacgacaugggcauuaugugagucuaucacccuggcgacggggccccugacaacccucugggagggguccccaggcaaguucuggaauaccaccauagcaguaucaauggcgaauauauuccggggguccuaucuggccggggccggacuggccuucucgcucaugaaaucccucggcggugggaggcgagggacgggggcgcaaggggagacccugggcgagaaguggaagcgccagcucaaccagcuuaguaagagcgaguuuaacacguacaaacggucugguaucauggaaguggacaggagcgaggcaaaggaaggccugaagcgcggagagaccacuaaacacgccgugucccgcgguaccgccaagcuccggugguucguagagcgcaacuuagugaagccugaagggaaggucaucgaccugggcugcggcagagggggcuggagcuacuacugcgccgggcuaaagaaagugacugaagugaaaggcuacacuaagggcggccccggucacgaggagcccauuccuauggcuacguacggcuggaaccuugucaaauugcacuccggcaaggacguguucuuuauaccacccgaaaagugcgacacccugcugugcgauauaggagagagcuccccgaacccgaccaucgaggagggaagaacucuccgugugcugaagauggucgagccguggcuccggggcaaccaguucugcaucaagauccugaaccccuacaugcccaguguagucgagacguuagagcaaaugcagcggaagcacggagggaugcuuguccggaacccucugucccgcaacagcacacacgagauguacuggguguccugcgggaccggcaacaucgugagcgccgucaacaugaccucccggaugcugcucaaccgcuucaccauggcacaccgcaagcccacguaugagcgcgauguugaccugggcgccggcacucgacauguggccgucgagcccgagguggcgaaucucgacaucaucgggcagcgcaucgagaacaucaaacacgagcacaagucuacauggcacuacgacgaggacaaccccuacaagaccugggccuaccacggguccuacgaggugaagccgagcggcuccgccagcagcauggugaacggcguggucaaguugcuuaccaaacccugggacgugauacccauggugacucagaucgccaugaccgauacuacgcccuucggacagcagagagucuucaaggagaagguggacacccgcacuccaaaggccaaacggggaaccgcgcagaucauggaagugacggcaaaguggcucuggggcuuccucucccgcaacaaaaagcccagaaucugcacccgcgaggaguuuacacguaagguccgcuccaaugccgccaucggggcggucuucguggacgagaaucaguggaacuccgccaaggaggccguggaggacgagcgguucugggaccugguacaccgcgaacgggaacugcauaagcaggggaagugcgcgacaugcgucuauaauaugaugggcaagcgagagaagaagcuaggugaguucggcaaggcuaagggcagccgggcgauaugguauaugugguugggcgcccgcuucuuggaguucgaggcccuaggcuucaugaacgaggaccauugguucucccgagagaacagccuguccggcgucgaaggcgaaggacuccacaagcucggcuacauccugcgcgacaucagcaaaauccccggcggaaauauguaugcagacgacacggcuggcugggacacccgcaucaccgaggacgaccugcagaacgaggcuaggauaaccgacaucauggagcccgagcacgcccuccucgccaagagcaucuucaaacucacuuaucagaacaagguggugcgcguccagcggcccgccaagaacggcaccgugauggacgugauuagucgccgggaccaaagaggcucggggcaagucggcacauacggucucaacacauucacgaacauggaagcgcaauugauccggcagauggagagcgaggggaucuucucccccucggagcuggagaccccgaaccucgcggaacgcguuuuggacugguuagagaaguacggcgucgaacggcucaagcggauggccauaucuggggacgacugcguagugaagccaaucgaugacagauucgcaacagcccugaccgcccugaacgacauggguaaggugcgcaaggacaucccucagugggaaccgagcaagggguggaacgacuggcagcagguccccuucuguucccaccacuuccaccagcucauaaugaaggauggccgggagaucguggugccgugucgcaaccaggacgagcuagugggccgagcgcgcgugagccaaggggccgguuggagccugcgggagacggccugccuugggaaguccuaugcccagauguggcagcugauguacuuccaccgcagagaccuucgccucgccgcuaaugccaucugcuccgccguucccgucgacuggauccccacaucucguaccacguggagcauccacgcccaucaccaguggaugacgaccgaggacaugcugucaguguggaaucggguguggauugaagagaaccccuggauggaggacaagacccauaucagcuccuggggagacgucccauaucuggggaagcgcgaagaccaaugguguggcagccucaucggacugacugcgcgugccacgugggccaccaacauucagguggcaaucaaccaggugcgccggcugauagggaacgagaacuaccucgacuacaugacaaguaugaagcgguucaaaaaugagagcgaccccgagggugcccugugguga

SEQ ID NO: 24188 - RNA, 9879 nt, Artificial Sequence
  derived and/or modified CDS sequence (opt11) from DENV-1__FJ906728__SS-prME
ucagugaccauguuacucaugcuuaugcccaccgcuuuagcauuccaccucacaacccgaggcggugagccgcauaugauaguuuccaaacaggagcgggggaaaagccuguuguucaagaccagugcgggggugaacauguguacucucauugccauggacuuaggugaauuaugcgaggacaccaugaccuacaaaugcccccgaaucaccgaggcagaaccugacgacgucgauugcuggugcaaugcaacggacacgugggugacuuacgggacuugcucccaaaccggugagcaccggcgagacaagcgcucuguggcacucgcgccccacgugggccugggucuggagacgcgaaccgagaccuggaugagcagugagggggccuggaagcagauucagcgggucgagaccugggcacuccgccauccuggcuucacggugaucgcacuguuccuggcgcacgccaucggcaccucgauuacccagaaagggaucaucuucauacuccuuaugcucguuacccccagcauggccaugaggugcgucggcaucggcagccgcgacuucguagaggggcuguccggggccaccuggguggacgucgugcuggagcauggaagcugugugaccaccauggccaaggacaaaccgacacuagauaucgagcugcugaaaacggaagucacuaacccggcuguguuacggaaacucuguaucgaggcaaagaucaguaacacgaccacggacagcagaugccccacucaaggcgaggcuacccugguugaggaacaggacgccaauuucguaugccggcgaaccuucguggaccgcggcuggggaaacggcugcggacucuucggcaaggggucccucaucacuugugccaaguucaagugcgucacaaaauuggaaggcaagaucguccaguacgaaaaccugaaguauagcgugaucgugaccguacacaccggcgaccagcaccagguagggaacgaguccacggagcacggaacaaccgcgacgaucacaccccaggcccccacgacggagauccagcucaccgacuacggggccuuaauccuggauuguuccccgcgcaccggucucgacuucaacgagaugguccuauugacgaugaaggagaaguccuggcucguccauaagcaaugguuccucgaccugccucucccauggaccagcggggccagcacaagucaggagaccuggaaccggcaggaccugcuggugacguucaagaccgcccaugcgaagaagcaggaggugguaguccuuggcagccaggaaggcgccaugcacacagcccuaaccggcgccacagagauacagacauccggcaccaccaccaucuucgcggggcaccugaagugccgcuuaaaaauggacaaacuuaccuugaagggcauguccuacgugaugugcaccggacccuucaagcucgagaaggagguggccgagacccaacacggcacgguacucguucaaauuaaguacgagggaaccgacgcccccugcaagaucccguucaguacucaggacgagaaaggagugacgcagaauggccggcugauaacggccaacccgaucgucaccgacaaggaaaaacccgucaacauagaagcugagccuccauucggggagucguacaucgugaucggcgcgggggagaaggcucuuaaacucuccugguucaagaaggggagcucuaucggaaagauguucgaggccaccgcccgcggcgcccgccgcauggccauccuuggggacaccgcaugggauuuugggagcaucggaggaguuuucacguccguagggaagcuggugcaccagauauucggcaccgcguacggggugcucuuuuccggaguaagcuggacaaugaaaaucgggauuggcguacuguuaaccuggcucggacuaaacagccgcuccacgagcuugucgaugacgugcaucgccgugggacuugugacccuguauuugggagugauggugcaggccgauucgggaugugucaucaacuggaagggucgagaguuaaagugcggguccggcaucuucgugacuaacgaggugcacacguggaccgaacaguauaaguuucaggcugacagcccgaagcggcugagcgccgccauagggaaggcuugggaggagggggugugcggaauacgauccgcgacucgccuugagaauaucauguggaaacagaucucuaacgaacucaaccacauccuuuuagaaaacgacaugaagcuaaccgugguugugggggacguggcgggcauccuggggcaggggaagaagaugauaaggccccagcccauggaguacaaguacuccuggaaaagcuggggaaaggcuaagauuauuggggcggacgcccagaacaccacuuuuaucaucgacggaccuaacacuccggagugucccgacgaccagcgcgcguggaauauuugggagguggaggacuacggauucgguaucuucaccacaaacauuuggcugaaacuucgggacucuuacacacaggucugcgaccaccgccugaugagcgccgcgaucaaggacuccaaggcugugcacgcagacaugggcuacuggaucgagagcgagaagaacgagaccuggaagcuagcgcgagccucuuucaucgaagugaagaccugcaucuggccaaaaucgcacaccuuauggucuaacgggguacuagaaagcgagaugauaaucccgaaaauauacggcgggcccauuucccagcauaacuaucggcccggguacuuuacgcagaccgccggcccguggcaccuggggaagcucgagcuggacuucgacuuaugcgaggguaccacgguuguggucgacgaacacuguggaaaccgcgguccgagcuuaaggacgaccaccgugaccgggaaaauuauacaugaguggugcugcagguccuguacccugccuccccuacgcuuccggggcgaagacggguguugguacggcauggagauccgaccgguuaaggagaaggaggagaacuugguaaagucaaugguauccgccggcagcggggagguagacucuuucucccugggccugcucugcaucagcaucaugaucgaggaagucaugcggucucgcuggucacggaaaaugcugaugaccgggacucuggccguauucuuccuccugaucaugggccagcugaccuggaacgaccucauccgccugugcaucauggugggggcgaacgcuuccgaccgcaugggcaugggaacuaccuaccuagcgcugauggccaccuucaagaugcggccuauguucgccguagggcugcugcuacgcagguugacuucgcgagagguguuacuccugacgaucggccugucccucguagcgaguguugagcuuccaaacuccuuggaggaacucggggacggucuggccaugggcauaaugauccucaagcuccugaccgauuuucagucacaccagcuaugggccacccuccugucucugacauucauuaagacgaccuucagccuacacuacgccuggaagacaauggcaaugguccuguccaucguuagccuguucccgcucugccuguccacgacgucgcagaaaaccaccuggcucccugugcucuuggggucccugggcugcaagccucucaccauguuccugauugcggaaaacaagaucugggggcgaaagagcuggccccugaacgagggcauaauggccguggggaucguuuccauccuccuuagcagccuccuuaagaacgacgucccucuggccggcccgcugaucgccggcgggaugcucaucgcgugcuacgugaucuccggcuccuccgcggaccugucucuggagaaggccgcugagguuuccugggaagaggaggcggaacauagcggcgcaagccauaauauccucguggaggugcaggacgacggcacgaugaagauuaaggacgaggagcgcgaugauacucugaccauacuucuuaaggcuacucuacuggcggucagcgggguguaccccuugaguauucccgcaacccuguucgugugguacuucuggcagaagaaaaagcagcggagcgggguccucugggacacacccuccccgcccgagguggaacgcgccgugcuggacgacggcaucuaccggaucaugcagagagggcucuuaggccggagccaggucggagugggaguuuuccaggagaacgucuuucacaccauguggcauguuaccagaggagcgguccuuauguaccaaggcaagcgguuagagccgaguugggccagcguaaagaaggaccugauauccuacggcggaggguggaggcuccggggcucuuggaacaccggcgaggaggugcagguaaucgccguggaacccgguaagaacccgaagaacgugcagacggccccggguaccuucaaaacccccgagggggaggugggugcaaucgccuuggacuucaagcccggcaccuccgggagcccgaucgucaaccgcgagggcaagaucguuggucuguaugggaauggcguggucacuacuuccgggaccuacguaagcgccauugcccaggccaaggcaagccaggaagggccccugcccgagauugaggaugagguguucaggaaacgaaaucucacuaucauggaccugcauccgggguccggcaagacgcggagauacuugcccgccaucguccgggaggcgauaaaacggaagcuccgcacccuuauccuggccccuacccgggugguggccagcgagauggcggaggcgcuaaaggguaugccaauacgcuaucagacuacggccguuaaguccgaacacaccgguaaagagaucguggacuugaugugucacgccacuuucaccaugcggcucuugagccccguacgcgugcccaacuacaacaugaucauaauggacgaggcucacuucacugaccccucguccaucgcggcucggggcuacaucucuacacgcguggguaugggcgaggccgcagcuauuuuuaugacggcaacacccccggggaguguugaagccuucccucaguccaacgccgugauccaggacgaggaacgggacauccccgagcgcagcuggaauacagguuacgaauggauuaccgacuuuccagggaagaccgucugguucgugcccucaaucaagagcgggaacgauaucgccaacugccuacgaaagaacggcaagcgcgucauucagcugucccggaaaaccuucgacacggaguaccagaagaccaagaacaaugacugggacuacguggugacuaccgacaucagcgaaaugggggcgaacuuccgcgccgauagagugaucgaccccagacggugccuaaaaccagucaucuuaaaagacggacccgagcgcgugauccuggccgggccgaugccagucacuguggcgucugccgcucagcggagaggccggaucggccgcaaccauaacaaagagggggaccaguacaucuauaugggccaaccgcucaauaaugacgaggaccacgcucacuggaccgaggcuaaaaugcugcuggacaacaucaacacacccgaagguauuauaccagcccuuuucgaaccagaacgggaaaagagcgcagcgguagacggcgaguaccguuugcgcggggaggcccggaagaccuuuguagagcuuaugcgacgcggcgaccuccccguguggcuuagcuacaaagucgccagcgagggauuucaguauucggaccgccgauggugcuucgauggggaacgaaacaaccaggugcuggaggagaacauggacgucgaaaucuggacuaaggagggcgagcgcaagaagcuccgcccccgguggcuggacgcccgcacuuauuccgacccauuggcccuccgggaguucaaggaguucgcugccggacgacgguccgucuccggcgaccugauccuggagaucggcaagcugccccagcaccugacccagcgagcccagaacgcccuggacaaccuagucauguuacauaacuccgaacaaggagggcgggcuuaucgccacgcaauggaggagcuccccgauaccaucgagacguuaaugcugcuagcccuaaucgccgugcugaccggaggugucacacuguucuuucucuccggucgcggccuaggcaagaccagcauugggcugcucugugugauggcuagcucuguuuuacuuuggauggcgucggucgaaccacacuggauugccgccaguaucauucucgaguuuuuccuaaugguucuccuaauaccagagcccgaucggcagcgcaccccacaggacaaucaauuagccuacguaguuaucggacuacucuucaugauccuggccguggcggccaacgaaaugggccugcucgaaacgaccaagaaggaccuggguaucgggcacgucgccgucgaaaaccaccaccacgccgcuaugcuagacgucgaccuccaccccgcguccgccuggacguuguaugcgguggccaccacuaucaucaccccuaugaugagacauacgaucgagaacaccacggcuaacaucagccugaccgcgauugccaaccaggccgccauuuuaaugggccuggauaaggguuggcccauauccaagauggauauuggugucccucugcucgcucugggcugcuacucacaggugaauccucuaacacucaccgccgccguguuaaugcuggucgcccacuacgcaaucaucgggccaggccuccaggcaaaggccacacgggaggcccagaagagaacagccgcagggaucaugaagaaucccacaguggacggcauuguagcuauugaccuagaccccgucguguacgacgccaaguucgaaaagcagcuuggccagauuaugcuccugauccugugcaccucccagauccuccugaugcgcaccaccugggcccugugcgaaucaaucacccucgcaacugggccguugacaacccugugggagggaaguccugggaaguucuggaacaccaccauugccgugagcauggcgaacaucuuccggggaucguaccucgccggcgcggggcuagccuucagccugaugaagucccuuggcgggggccgccgggggacaggcgcucagggcgagacauuaggggaaaaauggaagcgccagcugaaccaguugagcaagagcgaguucaacaccuacaaacgcagcggcaucauggaggucgaucgaagcgaagccaaggagggcuugaagcguggcgagaccacuaaacacgccgucucccgggggaccgccaaauugcguugguucgucgagcgcaaccuggugaagcccgagggcaaggucauagauuuggguugcgggaggggcggguggagcuacuacugcgccggccuaaagaaaguaaccgaggucaaaggguauaccaagggcggccccgggcacgaggaaccgauccccauggcgacuuacggauggaaucuaguaaaauuacacucuggaaaggacguguucuucauaccgcccgagaagugcgacaccuuacugugugauauaggugaguccucccccaaccccacuaucgaggagggacguacccuucggguacugaagaugguggagcccuggcuucggggcaaccaguucugcauaaagauccucaaucccuacaugccgagcgugguggagacguuagaacagaugcaacgcaagcacggcgggaugcuggugcgcaacccucuaagccgaaacuccacgcaugagauguauuggguauccugugguacagggaauaucguuagcgcugugaacaugacaucccgcaugcugcugaaccgcuucaccauggcccaucgcaagcccacguaugaacgcgacguggacuugggcaccggcacccggcacgucgccguggagccagagguggccaaucuggauauaauuggacagcggaucgagaacaucaagcaugagcacaagagcaccuggcacuaugaugaggacaacccuuacaaaacuugggccuaccauggcucguacgaaguaaagcccagcgggucagcgagcuccauggugaacggagugguaaagcuccucacuaagcccugggaugugauccccauggucacgcagauugcuaugacagacacgaccccuuucgggcagcagcgggucuucaaggaaaaagucgacacucggacccccaaggccaagcggggcaccgcccaaaucauggaagucacagcgcguuggcuguggggcuuccugagccggaacaagaaaccccgcaucugcacccgggaggaguucacgcgcaaggugcgcagcaacgccgccaucggggccguguucgucgacgagaaccaguggaacuccgcgaaggaagccguggaagacgagcgcuucugggaucucguucauagagagcgcgagcugcacaaacagggaaagugcgccacgugcguguacaacaugauggguaaacgggagaagaaauugggcgaguucgggaaggcuaagggcucgcgcgccauaugguauauguggcucggugcaagguuccuggaguucgaggcacuuggguucaugaacgaagaccauugguucagccgcgaaaacucacucagcggcguggagggggagggccuucacaagcugggguauauuuuacgggauauaaguaagaucccgggaggcaacauguacgcagacgacacugccgggugggacacccgcauuacugaggaugaccugcagaacgaggccaagaucacggauauaauggagcccgagcaugcgcugcuugcuaaggcgaucuuuaagcugacguaucagaacaagguggucagggugcagcgacccgccaagaacggcaccgucauggacgucauuucccgcagggaccagcgcggcaguggccagguggguaccuacggacugaacacguucacgaauauggaagcgcagcucauacggcaaauggaguccgaggguauuuucagccccuccgagcuugagaccccgaacuuggcggagcgcgcucucgauuggcuggagaaauacgggguagaaaggcugaagcgcauggccauaaguggcgacgacugcguuguaaagcccaucgaugaccgguucgccacggccuugacggcccugaacgauauggggaaaguuagaaaggacauuccccagugggagcccuccaagggcuggaacgauuggcagcagguaccguuuugcucgcaucacuuccaucaauugauaaugaaggacgggcgggagaucguugugcccugccgcaaccaggacgagcucgucgggcgagcccgagugucucagggcgcgggguggagccugcgagaaaccgcuugccugggcaaguccuacgcgcagauguggcagcucauguacuuccaccgccgggaccugaggcuagccgcgaaugccaucuguagcgccguacccgucgacugggugcccacuagccggacaacguggucuauccaugcgcaccaccaguggaugaccacagaggacaugcucucgguguggaaccgcgucuggauagaggaaaacccguggauggaggauaaaacccacaucuccuccugggaggaugugcccuaccuugggaagcgcgaggaccagugguguggcucccugaucggccucacggcccgggccaccugggccaccaacauccagguagccauaaaccaaguucgccggcucaucgggaacgaaaacuaccuugacuauaugaccagcaugaagcgcuucaagaacgaguccgacccagagggcgcauuaugguag

SEQ ID NO: 24189 - RNA, 9879 nt, Artificial Sequence
  derived and/or modified CDS sequence (opt11) from DENV-1__FJ461313__SS-prME
agcgucacaaugcugcuuauguuaaugccuaccgcccuggcuuuccaucucaccacgcguggcggagagccgcacaugaucgucagcaagcaggagcggggcaaaagcuuacuuuucaagaccucagccggggugaauaugugcacucucaucgccauggaccugggagagcugugcgaggauacgaugacguauaagugccccaggaucacagaggcggagcccgaugauguggacuguuggugcaacgccacggauaccugggugaccuacgggaccugcucacagaccggagagcaccggcgggacaagcguuccguggcccucgcgccccaugugggccuggggcuggagacacgcacugagaccuggaugagcuccgagggcgcguggaagcagauccagcggguugagacgugggcccuccgccaccccggguucacagugaucgcccuguucuuagcucacgccaucgggaccagcauuacccagaaagggauaaucuuuauccuucugaugcuggucacccccuccauggcaaugaggugugucggaauagguucccgcgacuucguggagggccuauccggggcaacguggguugaugucgugcuggagcacgggagcugugugaccacgauggccaaggacaagcccacccuagacaucgaacucuugaagacagaggugacaaaccccgcuguucugcggaaguuguguaucgaggccaaaauuuccaacaccaccacugacagccgcugcccuacucagggcgaggccacccuaguugaggagcaggacgccaacuucgucugccggcgcaccuucgucgauagaggcugggggaacgguugcgggcuauucggcaagggguccuuaauaacgugugcuaaguuuaagugugugacgaagcuggaaggaaagaucguucaguaugaaaaccugaaauauagcgucaucgugaccguccacaccggagaccaacaucaggucgggaacgaguccacggaacacggcacgaccgcgaccaucaccccucaggcacccacgaccgagauccagcucaccgauuauggcgcguugacccuggacuguagcccccgcacgggccuggacuucaaugagaugguccugcugaccaugaaggagaaguccuggcucguacacaagcagugguuucucgaccuuccccuccccuggaccagcggugcaagcaccucccaggagacuuggaaccggcaggaccugcuggugacauucaagaccgcgcaugccaagaagcaggaggucgugguccucggaucacaggagggcgccaugcacacagcccugacgggggccacugagauccagaccuccggcacgacaaccaucuucgccggccacuuaaagugccgccucaagauggacaagcuaacccugaagggcaugagcuacgucaugugcacugggucguuuaagcucgaaaaggagguggcggagacgcaacacggcacgguguugguccagaucaaguaugaaggcaccgacgcccccuguaagauccccuucucaacccaagacgagaagggagugacgcagaauggccggcugauaaccgccaaucccaucgugacagacaaggagaagcccgucaacauugaagccgagccccccuucggcgaguccuacaucgugaucggcgcgggggagaaggcccugaagcuguccugguucaaaaagggcucuagcaucgguaagauguucgaggcaaccgcucgcggggcccggcggauggcaauccuuggcgacacggccugggacuuugggucaaucggcggcguguucaccagcgucgggaaacucguccaccagaucuucggcaccgccuacgggguuuuguuuuccggagucagcuggaccaugaagaucggaaucgguguguuacugaccuggcucggucugaacucccgcucaaccucgcugagcaugacguguaucgcaguggggcuagucacuuuguaccugggggccaugguucaagcggacuccgggugcgugaucaauuggaagggccgggagcucaagugcggguccggcauuuucgucaccaacgaggugcacaccuggacugagcaguauaaguuucaggccgauagcccgaagcgccuguccgccgccaucggcaaggccugggaggaaggggugugcgguauccggagugcgacccgacucgagaacauuauguggaagcagaucuccaacgagcugaaccacauccugcuggaaaacgacaugaagcucacagucguggugggcgacgucgccgguaucuugggucagggaaaaaaaaugauccggccccaacccauggaguauaaauauucuuggaaauccuggggcaaggcaaagauaaucggggccgacgcgcagaacacuaccuucaucauugacggacccaacaccccugagugcccugacgaccagcgcgccuggaauaucugggagguggaagacuauggguucggcaucuucaccacuaacauuugguugaagcugcgggacagcuauacccaggugugcgaccacaggcugaugucagcagccaucaaggacuccaaggccgugcacgcggacauggguuacuggaucgaguccgagaagaacgagaccuggaaacucgccagggccucguucaucgagguaaagaccugcaucuggcccaagucccauacgcucuggagcaacggggugcuggagucagagaugaucauaccgaagaucuacggggggccaaucucucaacauaacuaccgacccggauacuucacccagaccgccgggccauggcacuugggcaagcuagaacuugauuucgaccuaugcgaaggcaccacgguagugguugaugagcacugcgggaaccggggcccgagucuccgcaccacuaccgucacggggaagauuauccacgaguggugcugcaggagcugcaccuugccgccccugcgcuuccggggcgaagacggcugcugguacggcauggagauucgcccugugaaggagaaggaagagaaccucgugaagucuauggucagcgcgggcagcggggaagucgacuccuucucgcugggcuuacucugcaucuccaucaugauugaggaggugaugcggagccgguggagccggaagaugcuaaugaccggcacccuugcgguguucuucuuacugauaaugggucagcugacguggaacgaccucauccgccugugcauuauggugggggcuaacgcgagcgaccgcaugggcaugggcacuaccuaccucgccuuaauggccaccuucaagaugcggccgauguucgcggucggucugcuguuccguagguuaaccucccgcgaggucuuacugcucaccaucggucuuucuuugguagccuccguugagcugccaaacagccuagaggagcucggggacggccucgcaaugggcaucaugauccugaaacugcucaccgacuuccagucccaccaacuaugggccacccugcucagccugacuuucaucaagaccaccuucucccugcacuacgcguggaaaaccauggcaaugguacucucgaucguguccuuauuuccacugugucucucaacuacgucccaaaagacuaccugguugcccguccugcucgggucccugggaugcaagccgcugacaauguuccucaucgccgagaacaagaucugggggagaaagaguuggccauuaaacgaaggcaucauggcgguugggaucgugagcauacugcucucuucgcugcugaagaacgacgucccccuggccggcccccugaucgcaggugggaugcugauugcguguuacguaaucagcggcuccucagcagaucucucgcuggaaaaagcggccgaggugagcugggaggaagaagccgagcacuccggggccagccacaauauccuggucgaggugcaggacgacggcaccaugaagaucaaagacgaggagcgggacgacacucucaccauucugcugaaggccacccuccuggccgucuccggaguguacccccuaucgauacccgccacccucuucgugugguacuucuggcagaagaaaaagcagcggagcggggugcugugggacacccccagcccgcccgagguagagcgcgcggugcuggacgacggcaucuaccggauaaugcagcgggggcuccucggccggagucaagugggggucgguguuuuucaggagaacguguuccacacaauguggcaugucacucggggcgcgguccugauguaccagggaaagcgguuagaacccaguugggccuccgugaagaaggaccucauuagcuauggcgggggcuggagacuucggggguccuggaauacgggggaggaaguccagguuaucgcaguugagcccggaaagaaccccaaaaacguucagaccgccccgggcaccuucaagacacccgagggcgagguuggggcgaucgcucuagacuuuaagcccggcacgagcggauccccaauuguuaaccgcgagggcaagaucguuggucucuacgggaacggcgucgugaccaccagugggaccuaugucagcgccaucgcucaggcaaaggccucccaggagggcccccugcccgagaucgaggaugagguauuccggaagaggaaucugacgaucauggaccuccacccugggagcgggaagacccggcgauauuugccagccaucgugcgggaggccaucaagcgcaagcugcgcacccucauccuggcccccacacgggugguggcgagugagauggccgaggcccugaaagguaugccaauucgcuaccaaacgaccgccgucaagucggagcacaccgggaaggagaucguagaucucaugugucacgccaccuuuaccaugcggcuguugagucccgugcgcguuccgaauuacaacaugaucauuauggacgaggcgcauuucacggaccccucgucuaucgcggccaggggcuauaucagcacgcgugucgggaugggugaggccgcagcgaucuucaugaccgccacgccgcccgguucuguggaggcauucccgcagagcaacgccguaauccaggaugaggaacgggacaucccggagcgcuccuggaacagcggcuacgaguggaucaccgacuuccccggaaagacggucugguucgugcccuccauuaagagcggcaacgacaucgcgaauugccuccggaagaacggaaagcgggucauccaguugagccggaaaaccuucgacacggaguaccagaagacgaagaacaacgacugggacuacgucguuaccaccgauaucagugagaugggggcuaauuuccgugcugaccgggucaucgacccgcgccggugucugaagcccgucaucuuaaaggauggacccgagcgcgugauccuggccgggcccaugcccgugacggucgcuuccgccgcccagcggagggggcggauuggccgcaaucacaacaaggaaggggaccaauacaucuauaugggccagccucugaacaacgaugaggaccacgcccauuggaccgaggccaaaaugcuacuggacaacaucaacacacccgaagguaucauccccgcccuguucgagccugagcgcgaaaagagugcggccguggacggcgaguaccggcugcgcggagaggcccgcaagaccuucguggaacugaugcgccguggugaccuccccguguggcucagcuacaagguggcguccgagggcuuccaguacucggaccgccgguggugcuuugauggggagcgcaauaaccagguuuuagaggagaacauggacguggagaucuggacuaaagagggcgagcggaagaagcuccgcccacgguggcucgacgcccgcacauacuccgacccccuggcgcugagagaauuuaaagaguucgccgccggucgucggucagugaguggcgaccucaucuuagagaucggcaaguugccgcagcauuuaacccagcgagcccagaacgcacuugacaaccuggucaugcuccacaacagcgagcagggcgggagagcuuaccggcacgccauggaggaguuacccgacaccaucgagacccugauguugcuggcccucaucgcaguguugaccgggggggugacccuguucuuccuguccgggcggggcuuggguaagaccaguaucgggcugcuuugcgucauggcgucgagcguguugcuguggauggccucuguugagccccacuggaucgccgccagcaucauucucgaauucuuccucaugguccugcugauccccgaacccgaccgccagcggacgccccaagacaaccaacucgcauacguggugaucggccugcucuucaugauucucacggucgcggccaacgagauggggcugcuggagaccaccaagaaggaccucggcaucgggcacguggcaguggagaaccaucaccacgccgccauguuggacguagaccugcaccccgccucagccuggacucucuacgcgguggccacgaccauaaucaccccgaugaugcgccacaccaucgagaacacgaccgccaacaucagcuuaaccgcgaucgccaaccaggccgcaauccuaaugggccuggacaaaggguggcccaucuccaagauggacauugggguaccacugcuugcgcuuggcugcuacucacagguuaauccccugacccugacggccgcagucuugaugcugguggcgcacuacgccauuaucggcccgggccuucaggcgaaggcgacacgcgaggcccagaaacggacugccgccggaaucaugaagaaccccacugucgauggcauuguggcgaucgaccuugaccccguggucuaugacgcgaaguuugagaaacagcuagggcaaauaaugcuucuuauccugugcacgucccagauccugcugaugcgcaccaccugggcacugugcgagagcaucacccuggccacggggccucucacaacccugugggaaggcuccccggggaaguucuggaacaccaccaucgcaguaaguauggcgaacauauuccggggguccuaccuggccggggccggacucgccuucucgcugaugaagagccuaggcgggggccgacggucgaccggggcgcaaggggagacucucggcgaaaaguggaagcgccagcuaaaccaacuaucaaaguccgaauuuaacacguacaagcggagcggcaucauggaaguggacagauccgaggcuaaggaaggccucaaaaggggcgaaaccaccaaacacgccgucagcaggggcaccgccaaauuacggugguucguggaacguaaccuagucaaacccgagggcaaggucaucgaccugggcugcggaagggguggaugguccuacuacugcgccgggcuuaagaaggugacagagguuaagggguauacgaaaggcggcccaggccacgaggagcccaucccgauggcuaccuacggguggaaccuuguaaaauuacacagcggcaaggauguguuuuuuaucccgcccgagaagugugacaccuugcucugcgacauuggggaauccagccccaauccgaccaucgaggagggacggacacugagagugcuaaaaauggucgagccuuggcuucgcgggaaccaauucugcaucaagauucugaaccccuacaugcccuccgugguggagacucucgagcagaugcaacgaaaacacggcggcaugcugguccgcaacccgcugagcagaaacuccacccacgaaauguacuggguuagcugcgguaccggcaacaucgucuccgcuguuaauaugaccagucgcauguugcugaacagauucaccauggcccaccggaagcccaccuaugagcgcgauguggacuuagggaccgggacccggcacguggccguugagcccgagguggcaaaccucgauauaaucggucagcguaucgagaacauaaagcacgagcacaaguccaccuggcacuacgacgaggauaaccccuacaaaaccugggcguaccacgggagcuacgaggugaagccuuccgguagcgccagcuccauggucaacggugugguuaaguuacugacuaagcccugggaugugauccccaugguuacacagaucgcgaugacggacacaacccccuucggccagcagagagucuucaaggagaagguugauacucgcacucccaaggccaagcggggaacugcucagauaauggaggugacugcgcgauggcucuggggcuuccugagcagaaacaagaagccccggauaugcacccgggaggaguuuacacgcaagguccgguccaacgcugcuaucggggcuguguucguggacgagaaccaguggaacucggccaaggaagccguagaagacgagcgcuucugggaccucgugcacagagagagagagcuucacaagcagggcaagugcgcgacauguguguacaauaugaugggcaagagagaaaagaaacugggagaguucggcaaggccaaaggguccagagccauuugguauauguggcugggcgcgcgguuccucgaguuugaggcccugggcuuuaugaacgaagaccacugguucagccgcgaaaacucucuaagcggggucgagggcgaggggcuacacaaguuggguuacauccuacgggacaucucgaagauccccgggggaaacauguacgccgacgacaccgccggcugggacaccagaaucaccgaggacgaucuccagaaugaggccaagauuaccgacaucauggagccggagcaugcgcugcuggccaaggcaaucuucaagcuuaccuaucagaacaagguggugcgaguacagcggcccgccaagaacggcacagugauggaugugaucagccgccgggaccagcggggauccgggcaagucggaacguauggccugaauacauucaccaacauggaggcccaguuaauccggcagauggaaagcgagggcaucuucucccccuccgagcucgagacccccaaccuggcggagcgcgcccugaacuggcucgagaaguacggcguggaaagguuaaagcguauggccaucagcggggaugacugcguggugaagccgauagacgaccgguucgccacggcccugaccgcgcucaacgacaugggcaaggugcgcaaggauaucccccagugggagcccagcaaaggguggaacgauuggcagcagguccccuucuguucccaccauuuucaccagcugaucaugaaggacggccgagagaucgucguaccguguaggaaccaggacgagcuggugggccgggcccgggucagccaaggagcuggcuggagcuuaagagagaccgccugucuggggaaauccuaugcgcagauguggcaguuaauguacuuccacaggcgcgaccuccgccuagcugccaacgccauauguagugccgugcccguagauuggguucccaccagucggacgacguggagcauccacgcccaccaucaguggaugacaaccgaggauaugcugucuguuuggaaccgcguguggaucgaggaaaacccguggauggaggacaagacgcauaucucaucuugggaagacguuccguaccucggcaagcgcgaggaccaguggugcgggagccugauugguuuaacagcgcgggccaccugggcuaccaacauacagguugcaauaaaccaaguucgccggcucaucggcaacgagaacuaccuggacuacaugaccuccaugaagagauucaagaaugagagcgaccccgaaggggcgcucugguag

SEQ ID NO: 24190 - RNA, 9879 nt, Artificial Sequence
  derived and/or modified CDS sequence (opt11) from DENV-1__FJ547063__SS-prME
agcguaaccauguugcucaugcugaugccuaccgcccuggccuuccaccucacuacccggggcggggagccacacaugaucgugucgaagcaagagcgggguaagucacugcuauucaagaccagcgccggugucaacauguguaccuugaucgcuauggacuugggcgaacugugcgaggacaccaugaccuacaaguguccccggaucaccgagaccgaacccgacgacguggacugcugguguaacgcgacggacaccugggugacuuacgguaccuguagccagacgggugagcaucggcgggacaagcggucaguagcccuugcgccccacgugggccucgggcucgagacccgcaccgaaacuuggaugagcuccgagggcgcguggaaacaaauccagcggguagagacgugggcucuccggcacccuggguucacagugaucgcccuguucuuggcccacgcuaucggcacaagcaucacccagaaggggauaaucuucauccuccugauguuagugacucccuccauggccaugcgaugcguaggaaucggaucgcgggacuucgucgagggcuuauccggcgccaccuggguggacgucgugcuggaacacgggucaugugugaccaccauggccaaggacaagccuacgcuggauauagagcucuuaaagacagaagucaccaaccccgcggugcugaggaaacucugcauagaggcaaagauuaguaauaccacgaccgacagccgcugccccacacagggcgaagccacauugguggaggagcaggacgcuaacuucgucugccggcgcacguucguagaccgagggugggguaacgggugcgggcuguucggcaaggggagccuaauaacgugcgccaaguucaagugcguaaccaagcuagaggggaaaaucgugcaauaugagaacuugaaguacucagugaucguuaccguccacaccggcgaccaacaccagguggggaaugagucaacggagcacggcaccacagccacaaucaccccccaggcgcccacgaccgagauccaguuaacugacuacggugcucugacgcuggauuguaguccccgcaccgguuuggacuucaacgagaugguccuuuugaccaugaaggagaaguccugguuggugcauaagcaaugguuccuggaccugccauugccuuggacaagcggugccagcacaucccaggagaccuggaaccggcaggaucugcuggugaccuucaagaccgcccaugccaagaaacaggaggucguuguguugggcucgcaggagggcgcgaugcacacagcacugaccggggccaccgaaauucaaaccuccggcacgaccaccauuuucgccgggcaccuaaagugcagacuuaagauggacaagcugacucugaagggaaugagcuacguaauguguacaggauccuucaaguuggaaaaggagcuagcugagacccagcacggcacggugcuagugcagauuaaguacgagggcacagaugcgcccugcaagaucccguucagcacgcaagacgagaaggggguuacucagaacggccggcugauuaccgcuaacccgaucgugacggauaaggaaaagcccgugaacaucgaggcugagccccccuucggggagagcuacaucguuauaggggccggcgagaaggcgcugaagcugucgugguucaagaaagggucaagcaucggcaagauguucgaggcuacggcccgcggagcccggcgcauggccauccugggcgauacagcuugggacuucggauccauagggggcguguuuaccaguguggggaaacucguccaccagaucuuuggcaccgccuauggugugcuguucucgggcgugagcuggacgaugaaaaucgggaucggaguccuguuaaccuggcugggcuuaaacucccggagcacgucuuuaaguaugacguguaucgccgucgggcugguaacgcuguaccucggcgucauggugcaggccgacagcggcugugugaucaacuggaaaggcagagaguuaaagugcgggagcggcaucuuuguuaccaacgagguucacacauggaccgaacaguacaaauuccaggccgauagcccgaagcgccucuccgccgcuaucggcaaggcuugggaggaggggguaugcggcauccgauccgcaacgcgccucgaaaacauaauguggaaacaaaucuccaacgagcugaaccacauccugcuugagaacgacaugaaguucacggucguggugggggacgucgcaggcauccuggcgcaggggaaaaagaugauucggccccagcccauggaauacaaguacagcuggaagagcugggguaaggccaagaucaucggcgccgacgugcaaaacaccacauucauaaucgacgggcccaacaccccggagugccccgacgaccagcgugcuuggaacaucugggagguagaggauuaugguuucgggaucuucacgaccaacaucugguuaaagcuccgggacagcuacacccagguuugcgaccaccgccugauguccgcggccaucaaagacucgaaggccgugcacgccgauaugggcuacuggauagaguccgagaagaacgagacauggaagcuggcccgcgcgagcuucaucgaggucaagacgugcauuuggccgaagucgcacacccucuggucuaacggcguccuggagucagagaugauaauccccaaaaucuaugggggcccuaucagccagcauaacuaccgcccgggguacuucacccagaccgccggccccuggcaccuggggaagcucgaguuggacuuugaucugugcgaagggacgaccgucguggucgacgagcauuguggcaaccgggggccgucccucaggaccaccacggugacuggcaaaaucauacacgagugguguugccggagcugcacgcugccgccgcugcgcuuccgcggggaggacgguugcugguacgggauggagauacgccccgugaaggagaaagaggagaaccucgucaaguccaugguuagcgccggcuccggugagguugacuccuucagcuuagggcuacucugcaucuccaucaugauugaagaagucaugcggagucgcuggucccggaagaugcugaugacgggcacccuggccgucuuuuuccucuugauaauggggcagcugaccuggaaugaccucauccggcugugcauuauggugggcgccaacgcuagcgaccgcauggguaugggcaccaccuaucuggcacucauggccacguucaagaugcggccgauguucgccguugggcuucuguuccgacgucucacuagccgagaaguccugcuucucaccaucggacugagccugguggccucaguggaacucccuaacucgcuggaggagcugggggacggacucgccauggggaucaugauccugaagcugcucacggacuuccaaucacaccaauugugggccacgcuucugagccugaccuucauuaagaccaccuucucacuacacuaugccuggaaaacgauggcaaugauuuuaagcaucgugucccuguucccccugugccucuccaccaccucccagaagacuacguggcugccaguccugcucggcagccuggguuguaagccauugaccauguuccucaucgcggagaacaagaucuggggccggcgcuccuggccccugaacgaggggaucauggcagugggcaucgucagcauucugcugagcucccuguuaaagaacgauguccccuuggccgggcccuuaaucgccggcgguaugcugaucgccuguuacgugaucagcgggucguccgcggacuuaucccuggagaaggccgccgaggugaguugggaggaggaggccgagcacaguggagcgagccauaacauccuugucgaagugcaggacgacggaaccaugaaaauaaaggacgaggagcgggacgacaccuugaccauauuacugaaagcgacacuccuggccguguccggcgucuacccucuaagcaucccggccacgcucuucgucugguauuuuuggcagaagaagaagcaacgaucgggugugcuaugggacacgcccuccccgccggaaguggagcgugcagugcuagacgacgggaucuaccgcaucaugcagcggggccugcuagggcgcucucaggugggcgucggaguguuccaggagaacgucuuucacaccauguggcaugucacgcggggcgccguccugauguaucaggggaagcgccuggagccuagcugggcgucagugaagaaggaccucaucagcuauggcgggggguggcggcuccaggggucauggaacacuggugaagagguccagguaaucgcuguggagcccggcaaaaaccccaagaauguccaaacggcccccggaaccuuuaagacgcccgagggcgaggugggggcaaucgcccuugauuuuaagcccgguaccagcggcagccccaucgugaaccgcgaggggaagaucgucggccuauacggcaacgggguggugaccaccucuggcacuuacgucuccgcaaucgcucaggccaaggcaucccaggaggggccgcuacccgagaucgaggacgagguguuccggaaacgcaaccugaccauaauggaccuccacccggggagcgggaaaacucggcguuaccucccggcgaucguacgggaagccauaaagcgcaagcugcgcacccucauccuggcgccgacgcgggugguagccagcgagauggccgaggcguuaaaaggcaugcccauccgcuaccaaaccacggcgguaaagagcgagcacaccgggaaggagauuguugaccucaugugucacgccacguucaccaugcgccugcugucccccgugcggguaccgaacuacaacaugaucauuauggacgaagcccacuucaccgacccaucuuccaucgcugcacgcggguacauaaguaccagagucggcaugggugaggccgccgccaucuucaugacagccacgccgcccgguuccguggaggcguucccgcaaucgaacgcugugauccaggacgaggagcgggacauucccgaaaggagcuggaacagcggguacgaauggaucaccgauuucccagggaaaacgguuugguucgugcccuccauuaagagcggaaaugacauagccaacugccuucggaagaacgggaagcgcgugauccagcugucacggaagacguucgacacggaguaccaaaagaccaaaaacaaugauugggacuacguugugacgacggacaucuccgaaaugggagccaauuuccgcgcggaccgggugauugacccgagacggugucugaagcccgucauccucaaggacgggccagaacgcguuauccuugccggacccaugccggugaccgucgccucggcugcacagcggagagggaggauaggcaggaaccacaauaaggagggcgaccaguacauuuacauggggcagccccugaacaacgacgaggaccacgcgcacuggaccgaggccaagaugcuauuggacaauaucaauacuccggagggcaucauccccgcgcuguuugaaccugagagagagaaguccgcagcuaucgacggggaauaucggcuccgcggcgaggcgcggaagacguucguggagcuuaugcgccgcggcgaccugcccgucugguuaagcuacaaaguggccucggaaggauuccaauauagcgaccgccggugguguuucgacggagagcgcaacaaucaagugcuggaggagaacauggacgucgagaucuggaccaaagaaggcgagcggaagaagcugcgcccucggugguuagaugcgcgcaccuacuccgacccccuggccuugcgagaguucaaggaguucgccgcaggccgacggucgguaaguggggaccucauccuggagaucggcaagcuuccgcaacauuuaacccagcgcgcccagaacgcccuggacaaccucgugauguugcacaacagcgagcagggcggacgugcauaccgccacgcgauggaggagcugcccgacacgaucgagacccugaugcugcuggcccugaucgccguccuuaccgggggugucacccuguucuuccugucgggccgagggcucggcaagaccagcaucggccugcugugcgugauggccuccagcguccuccuguggauggccucgguagagccccacuggaucgcggccagcauaauccuggaguucuuccucaugguguugcugauccccgagccggaucgccaaaggacuccccaggauaaccagcucgcguaugucguaaucggacugcuguucaugauccucaccguggccgccaacgagaugggccugcuggaaaccaccaagaaggaucucgggaucggccaugucgcgguugagaaccaucaccacgccgcaaugcucgacgucgaccugcaccccgccagcgccuggacucuauaugcggucgccaccaccaucauuacaccgaugaugcggcacacgaucgaaaacacaaccgccaauaucagucucacagcgaucgccaaccaggcggccauucugauggggcucgacaagggcuggccaaucuccaagauggacaucggugugccccuguuggcucucgggugcuauagccaggugaauccgcuaacgcugaccgcugcugucuugaugcugguggcucacuacgccauuaucgggccagggcugcaggccaaggccacacgcgaggcgcagaagcggacagcagccgggauaaugaagaacccuacgguugacgggaucgucgcgaucgaccucgaccccgugguguaugacgcgaaguuugagaagcagcugggccagaucaugcugcuaauacugugcacaucccagauccugcucaugaggaccacaugggcguugugugagagcauuacgcuggccaccgggccccugaccacccuuugggagggguccccggggaaguucuggaacaccacaauugccguuuccauggccaacaucuuccggggguccuaccuggccggcgcgggccuugccuuuagccugaugaaguccuuggggggcggccgccgggggacuggugcccaaggcgagaccuuaggggagaaguggaagagacagcugaaccaguuauccaagagcgaguucaacacguauaagcgguccgguauaauggagguggaccgguccgaggccaaggagggcuugaagcgaggugagaccaccaagcacgccguaucgcgcggcacugccaagcugcguugguucgucgagagaaaccuggugaagccagaagguaaagugauagaccugggcugcggccgugggggguggucguacuauugcgccggccucaagaaggucacggaggugaagggguacacaaagggcggucccggccacgaggagcccauaccgauggccaccuauggguggaaccuaguaaagcugcacagcggaaaggacgucuucuuuaucccgccugaaaagugcgacacccuccucugcgacaucggugaaaguucccccaacccgacaaucgaggaggggcgcaccuuaagaguacucaagauggucgagcccuggcuccgcgggaaccaguucugcauuaagauccuuaaccccuacaugccgagcguuguggaaacccucgaacagaugcagagaaaacauggcgggauguuagugcgcaauccgcugcagagaaacucuacccacgaaauguacugggucuccugcgggaccgguaacaucgugagcgcggugaacaugacgagccgaaugcuccugaaccgauucaccauggcgcaccggaagcccaccuacgagcgcgacgucgaucucggggccgggacacggcauguggccguggagcccgaagucgccaaccuagauaucaucggucagaggaucgagaauaucaagcacgagcauaaauccacauggcauuacgaugaggacaaccccuauaagaccugggccuaccacgggucauacgaggucaagcccucuggcagcgccuccuccauggugaauggagucgugaagcugcugacaaaacccugggacguuauccccaugguaacccagaucgccaugacggauacgaccccuuucggccagcaacggguguucaaagagaagguugacacccgcacgccgaaggcaaagcgcgggacugcccagaucauggaggugaccgccaaauggcucuggggcuuccugagccgcaacaaaaagcccaggaucuguaccagagaggaguucacgcggaaagugcgcuccaacgcggcaaucggcgccgucuucguggaugagaaccaguggaacagcgccaaggaggccguugaggacgagcguuuuugggaccugguccaucgggagcgggagcuccacaagcaggggaagugugcgaccugcguuuacaauaugaugggcaagcgcgagaaaaagcugggagaauucggcaaggccaaggggucccgggccauuugguauaugugguuaggcgcucgcuuccucgaguucgaagcacugggguucaugaacgaggaccacugguucagcagagagaacucccugagcgggguugaaggugaaggguugcacaagcucggcuauauccuacgugauaucucaaagauccccggggguaacauguacgcggacgauaccgcaggcugggacacucggauuacggaggaugaucuccagaacgaagcccguaucaccgacaucauggagccggaacacgccuuacuggccaagaguaucuucaagcuaacuuaccagaauaagguggugcgcgugcaacgacccgccaagaacggcaccgucauggaugugaucucccggcgagaccagcgaggcaguggccagguggggacguauggccuuaacaccuucacuaacauggaagcccagcugauaaggcagauggaguccgaggggaucuuuagccccuccgagcuagagacgccgaaccucgcagagcgcguccuugauuggcucgagaaguauggaguggagcgacugaagcgcauggccaucucaggggacgacugcguggucaagccgaucgacgacagguuugcuaccgcccugaccgcccucaaugauaugggcaaggugcgcaaggacaucccccagugggagcccaguaagggguggaacgacuggcagcagguacccuucugcagccaccauuuccaccagcuaaucaugaaggacggccgggagaucgucgucccgugccguaaccaggacgaacuggucgggcgggcccgugucucccagggggccgguuggucguuacgggaaaccgcgugccugggcaagaguuacgcccagauguggcagcugauguacuuccauaggcgcgaccuccgccuggccgccaacgcgaucugcuccgccguaccaguggacuggauccccaccagccggacgaccuggaguauccaugcccaccaccaguggaugacaaccgaagacaugcuaagcguuuggaaccgcguguggaucgaggaaaaccccuggauggaggauaagacgcacaucucgucguggggugacgugccguaccuagggaaacgcgaggaccaaugguguggcucccugaucggguugacggcgcgggccaccugggcgaccaacauucaggucgccauuaaccaggucaggcggcucaucgguaacgagaacuacuuagacuacaugacaagcaugaagcgcuuuaagaaugaauccgaccccgagggcgcucuuugguga

SEQ ID NO: 24191 - RNA, 9879 nt, Artificial Sequence
  derived and/or modified CDS sequence (opt11) from DENV-1__FJ410218__SS-prME
agcguaaccaugcugcucaugcugaugcccaccgcccuagccuuucaccugacuaccaggggcggggaaccacacaugaucgugacaaagcaggagcggggcaagagcuugcuguucaagaccagcgccggggugaacauguguacccucaucgcaauggaccuuggggagcugugcgaagacacuaugaccuauaaaugcccucggaucaccgaggcggagccggacgauguagacugcugguguaacgccaccgacaccugggugacuuacgggaccugcucucagacuggggagcaucggcgcgacaagcggucugucgccuuggcgccccacguggggcugggucucgagacgcgcacggagaccuggauguccagcgaaggagcguggaagcagauccaacggguggagaccugggcccuaagacaccccggguuuaccgugaucgcccuguuccuggcacacgccaucggcaccuccaucacccagaaagggaucaucuuuauccuccucauguuagucacgccgagcauggccaugcggugcgucggcauuggcucgcgugacuucguagaggggcucagcggggccaccuggguggacgucgugcuggaacauggguccugugugacgaccauggccaaggacaaacccacuuuggauauugagcucuugaaaaccgaggucaccaaccccgcggugcuacggaagcucugcaucgaggcaaagauaaguaauacaacuaccgacucgcgcugccccacccagggcgaggccacccucauggaggagcaggacgcuaacuucgugugucggcgcacguucgucgacaggggaugggguaacggcugcggcuuauucggcaaggggagccucaucacgugcgcgaaguucaaaugcgugaccaagcuagaaggaaagaucguccaauacgagaaccucaaauauucugucaucgugaccgugcacacaggcgaccaacaccagguagggaacgaaucaaccgaacacggcaccaccgcgaccaucacgccccaagcgcccaccagugaaauccaacucaccgacuauggggcccugacucucgacugcucuccccguacggguuuggacuucaacgaaaugguucugcugaccaugaaggagaaaucguggcucguucacaagcagugguucuuagaucugcccuuaccuuggacaagcggggccuccacaucccaagagaccuggaaucggcaggaccugcucgugaccuucaagaccgcgcacgcgaaaaaacaagaaguggucgugcucggaagccaggagggcgcaaugcauaccgcccugacgggggcuaccgagauccaaaccagcgguaccaccaccaucuucgccgggcacuugaaaugccgccucaagauggacaaacuuacucuaaaaggcaugagcuaugugaugugcaccggcucauuuaaacuugagaaagagguggcggagacacagcauggcaccgugcuagugcagaucaaguacgagggcaccgacgcgccaugcaagauccccuuuucaacccaggaugaaaaaggggucacucagaacggccggcucauuaccgccaacccgaucgugacugauaaggagaagcccgugaacauugaggccgagccccccuucggggaguccuacauuguuaucggcgcgggcgagaaggcccugaagcucagcugguucaaaaaggggaguagcaucgguaagauguucgaggcaaccgcccggggugcgcgacgcauggcgaucuuaggagacacugccugggauuucggaucgaucgguggcguguucacgagcguagggaagcuuguacaucaaauuuucggcacagcguacgggguccuguucucaggcgugucuuggaccaugaagaucgggauuggcguccuguuaacgugguugggacuuaacucccguucgaccagcuuaucaaugaccugcauugccguagggcuagugacccuguaucuggguguaauggugcaggccgauucaggcugcgugaucaauuggaaaggacgggaacucaaaugcggaagcggcaucuucgucacgaacgaggugcacaccuggacggagcaguacaaguuucaggcggacuccccgaagcgccugagcgccgccaucggaaaagccugggaagagggggucuguggcauccgguccgcgacccgcuuggagaauauaauguggaagcagauauccaaugaauugaaccauauccuacuggagaacgacaugaaguucaccgucguggucggggacgucguggguauccucgcgcaggggaagaagaugaucaggccacagccuauggagcauaaguacucguggaagagcugggguaaggccaaaauaaucggggccgauguacagaacacaaccuucaucaucgaugggcccaacacaccggagugcccagaugaccagcgcgccuggaacauaugggaggucgaggacuacggcuucggcaucuucacgacgaauaucuggcugaaacugagggacaguuacacccaagugugugaucaccgccucauguccgcggcuaucaaggacagcaaggccgugcacgcggacaugggcuacuggauugagucugagaaaaaugagaccuggaagcucgcacgggcgucguucaucgaagucaaaacaugcauauggcccaagucccacacguuauggagcaauggcguacucgaguccgaaaugaucauccccaaaaucuacggaggaccuaucucccaacacaacuauagaccaggguacuuuacgcagaccgccggccccuggcaucuggggaagcuggagcucgacuucgaccugugcgagggcacaacggugguuguggacgagcacugcggaaaucgaggcccgucccugcgcacgaccaccguuaccggaaagauaauccacgaguggugcugccggagcugcacacugcccccacuccgcuucaagggagaggacggcugcugguacgguauggagauuagaccuguaaaagagaaggaggagaaccuggugaaguccauggugagcgccggcagcggcgagguagacucguucagccucggccugcuuugcaucucaauuaugaucgaggagguaaugcguagccgguggucccguaagaugcucaugaccgguaccuuagccguauuccugcucuuaaucaugggccaacugacguggaacgaccucauucggcugugcauaauggucggcgcuaacgcgagcgaccgcauggggaugggcacaacguaccuggcccugauggccaccuucaagaugcgcccgauguucgccguuggcuugcuguuccggcgccucacgucccgggaaguacugcugcucaccaucgggcugagccuggucgccuccgucgaguuaccuaacagccuggaagagcugggagacggguuggcgaugggcauuaugauccuuaaguuguugaccgacuuucagucccaccaguugugggccacccugcucagccuuacguucaucaagaccacccugucguugcacuaugccuggaagaccauggccaugguccugagcauugugucccuauucccccucugccugucuacgacaucccagaaaacuacgugguuaccagugcuacuuggcucucuggggugcaagccguugacgauguuucugaucguggagaauaagaucuggggucgcaaguccuggccccugaacgagggaaucauggccguaggcguuguauccauucuccugagcucccuccucaagaacgacgugccccuggccgggccacugaucgcaggcggcaugcucaucgcuugcuacgugaucuccgggucaucagccgaucugucccuggagaaggcggccgaggucagcugggaggaagaggccgagcacucuggagcuagccacaacauccuaguggagguucaggacgacgguaccaugaagaucaaggaugaggagcgggacgacacacugaccauuuuauuaaaggccacccugcuggcggugagcgggguguacccuuuaaguauccccgccacguuauucgucugguacuucuggcaaaagaagaaacagagaaguggggugcuaugggauacacccucgccgccggagguggaacgggccguccucgacgauggaauauaccgcaucaugcagcgugggcuccuggggcgcucacaaguaggcguggggguguuucaagagaacgucuuccacaccauguggcacgugacccguggcgccguucuuauguaccagggcaagcggcuggagccgucgugggccagugucaagaaggaccugaucagcuauggcggaggguggaggcugcagggcuccuggaauacgggggaggaaguccaggugaucgcugucgaaccagggaagaacccuaaaaacgugcaaaccgcgccuggaaccuucaagacccccgagggcgagguaggcgcuaucgccuuagacuuuaaaccggggaccagcggcucccccauagucaaccgcgaggggaagauugugggacuauacggcaacgguguggucacaaccagcggcaccuacgugagugcgauagcgcaggccaaggcgucgcaagaggggccacugcccgaaaucgaggacgagguguuccgcaagcgcaaccucacgaucauggaccugcauccaggcucagggaagacccggcgcuaccugccggccauaguucgggaggcgauuaagcgcaaacuccgcacccucauucuggcccccacccgcguaguagccucggaaauggcggaggcccucaagggcaugcccauucgcuaccagacgaccgcggucaagagcgagcacaccggcaaggaaaucguggaccuaaugugccacgcuaccuuuacgaugcgucuccuaucccccgugcgcgucccuaacuauaauaugaucauaauggacgaagcacacuuuaccgauccuagcucgaucgccgcccggggauacaucagcacccgcgucggcaugggagaagcagccgcaaucuucaugaccgccacuccgcccgguaguguggaggccuucccucagagcaacgcgguuauccaggacgaggagcgugacaucccugagcgcucguggaacucgggguaugaauggaucaccgauuucccagguaagacugucugguucguacccuccaucaagagugggaacgacaucgccaacugcuuacggaaaaacggcaaacgcgucauacagcugucacggaagacguucgauacggaguaccaaaagacgaagaauaacgauugggacuauguagugacgaccgacaucuccgaaaugggcgccaacuuccgggccgaccggguaauagacccuagaagaugccuuaagcccguaauucugaaggacgggcccgagcgcguuauucuggcaggccccaugccgguaacgguagcaucagcagcacagcggcgcggucggauagggcggaaucacaauaaggagggcgaccaguacaucuauauggggcagccccucaauaacgacgaggaucaugcgcacuggacggaggcgaagaugcugcuggacaauaucaacacccccgagggcaucauccccgcccucuuugagccggagcgggaaaaauccgccgccaucgacggggaguaccgccugcgcggcgaggcccggaagaccuucguggagcugaugcgccgcggggaccucccgguguggcugaguuacaaaguugcguccgagggauuccaauacucggaccgucgguggugcuucgacggugagcggaacaaccagguacuggaagagaacauggacguggaaauuuggaccaaggaaggcgagcggaagaaauugcgccccagauggcuagacgcccgcaccuacucagacccacuggcgcuccgagaguuuaaggaguucgccgccggccgccggagcguguccggggaccugauccucgagaucggcaaguugccucagcaccugacccagcgcgcgcagaacgcucuggauaaccuuguuaugcugcauaauagcgaacagggggggcgggcguaccgucaugcaauggaagaauugcccgacacaaucgagacguuaaugcugcuggcgcuaaucgcaguguuaaccggcggggugacccuguucuuccucuccgggcgggggcugggcaaaaccuccaucggucuguugugugucauggccucgaguguacuguuauggauggcuuccguggagccgcacuggaucgccgcgucuauuauccucgaguuuuuucugaugguccugcugauucccgaaccugaccgccaacggacaccgcaggacaaccagcuggccuacguggugauaggccuccucuucaugauccuaacggucgccgccaacgagaugggccugcucgagacaacuaagaaagaccugggcaucgggcaugucgcgguggagaaccaccaccacgccaccauguuggaugucgaccuccaucccgccucugcguggacgcuguaugccgucgcgacgacaauaauuacgccgaugaugcgccacacgauagagaacaccacggccaauauaagccugacggcuauagcaaaccaagcagccaucuugauggggcuugacaagggcuggcccauuagcaaaauggacauaggcguuccccugcucgcgcuggggugcuacagccaaguaaauccccugacgcucacagcugcuguucuaaugcugguggcacauuaugcgaucaucggcccaggucuccaagcuaaggccacacgggaggcccaaaaaagaaccgccgcagggaucaugaagaauccaacggucgaugggauagucgccauugaccuggacccgguggucuacgacgccaaguuugagaagcaguuagggcagaucaugcuccuuauccuaugcaccagccagauccuccucaugcgcaccaccugggccuuaugcgagagcauaacgcucgcuaccggcccccugaccaccuuaugggagggaucaccgggcaaguuuuggaauacgaccauagcggugagcauggccaacaucuucagggggaguuaccucgcaggggccggcuuagcguucucacugaugaaaucacucgguggcggacggcggggaaccggugcacaaggcgaaacccugggcgagaaguggaagcgacagcugaaccagcuguccaaaucggaguuuaacaucuacaagcggucggggaucauggaaguggauagaagcgaggccaaagagggccugaagcgcggggagaccacccgccaugccgucucuagaggaaccgcgaaacugcgcugguucguugaacgcaaccucgugaagcccgaggggaaggucaucgaccuggguugcggccgcgggggcuggagcuauuauugcgcugggcucaagaaagugaccgaggucaagggcuauacuaaaggcggccccggucacgaggagcccauccccauggcaaccuacggauggaaccuggucaagcuccacucaggcaaggauguguuuuucacgccgcccgagaagugcgacaccuugcugugcgacaucggugagucaucccccaacccgacgaucgaagagggucgaaccuugcgcgugcuaaagauggucgagccguggcugcgggggaaccaguuuugcauaaagaucuugaaucccuacaugccgucugugguggaaacacuggagcagaugcagcgaaagcacggcgggaugcugguccggaauccgcucucccggaacaguacccaugagauguacuggguguccugcgggacgggcaacaucgugucugccgucaauaugacaucccgaaugcuucugaacagauucaccauggcccaccgcaagcccaccuacgagagggacguugaccucggggccggcacccgccacguagcaguugaaccggaaguggccaaccuggauaucaucggccagcgaauagagaacauaaagcacgaacacaaaagcacauggcacuacgaugaggacaacccguacaagaccugggccuaccacgguuccuacgagguaaagccaucaggcuccgccagcagcauggugaaugggguuguaaaacugcucacuaagcccugggacgugauaccuauggugacccagaucgccaugaccgauacaacuccguuuggccagcagcgugucuucaaggaaaagguugacaccaggacgcccaaggcuaagcgcgggacagcccagaucauggaggugaccgcccgauggcuguggggcuuccugucccguaacaagaagccucguauuuguacuagagaggaauucacgaggaaggugcgcagcaacgccgcaauuggcgcgguguucguagaugaaaaccaguggaacagcgccaaggaagccguggaagacgagcgcuucugggacuuaguacaaaaggagcgcgaacuacacaagcaagggaagugcgcgacauguguguacaacaugaugggcaagagagagaaaaaacugggcgaguucggcaaggccaagggaagucgcgcuaucugguacauguggcucggagcccgcuuucuggaguuugaagcccucggcuucaugaaugaggaccauugguuuucccgcgagaacucuuuguccggggucgagggugagggucugcacaaguuggguuacauccuccgugacaucagcaaaauacccgggggcaacauguacgcggacgacaccgcuggaugggacaccagaauaacggaggaugaccuacagaacgaagcaaaaaucaccgacaucauggagccagagcaugccuuacucgccacuaguaucuucaaacugaccuaccagaacaagguggugaggguccagcggccggccaagaacgggacugugauggacgugauaagccgccgugaucaacgcggcuccgggcaagucggcaccuauggucugaacaccuucacuaauauggaggcgcaauugauccggcagauggaaagugaggggaucuucucccccagcgaacuggagauaccgaaccuggcggagcgcguauuagacuggcuggagaaguacgggguggagcggcugaagcggauggcgaucuccggggacgacugugucgugaagccgauugacgacagauucgccacggcccucaccgcgcugaaugauauggguaagguccgcaaggaugucccucagugggagcccucaaaaggguggaacgacuggcaacaggucccauuuugcucccaccacuuucaccagcuuaucaugaaggacggccgggaaaucgugguccccugccgcaaccaggacgagcuggugggccgggccagggugucgcaaggugccggcuggagccugcgggagacggccugucuggggaaguccuacgcccagauguggcagcucauguacuuccaccgccgggaccuacgccuggccgcuaaugcgaucugcagcgcugugcccguggacugggugcccaccucccggacgacauggagcauccacgcucaccaccaguggaugacgacggaggacaugcuauccgucuggaaccguguguggaucgaggagaaccccuggauggaggacaagacacacgugucuagcuggggcgaugucccguaccuggguaagcgggaggaccaaugguguggcagucugauagggcucacagcacgcgcgacuugggcuuccaauauccaaguggccaucaaccaaguacgccgacugaucgggaaugaaaacuaucuagacuacaugaccucaaugaagcgcuucaaaaacgaaggugaccccgaaggagcgcucugguga

SEQ ID NO: 24192 - RNA, 9879 nt, Artificial Sequence
  derived and/or modified CDS sequence (opt11) from DENV-1__FJ461316__SS-prME
agcgugaccaugcuguugauguuaaugcccaccgcgcuggccuuccaccucaccacccgaggaggcgaaccacacaugguggugagcaaacaggaacgggggaaaucuuuacucuucaaaaccagcgcgggggugaauauguguacccucaucgcuauggaccugggcgagcugugcgaggacaccaugaccuauaaguguccgaggaucaccgaggccgaacccgacgacguggacugcugguguaaugccaccgacacgugggugaccuacgggaccuguagccagacuggcgagcaccggcgcgacaagcggucaguggcccucgcgccccacgugggccugggccuagaaacgcgcaccgagaccuggaugagcagcgagggcgccuggaagcagauccagcgggucgaaaccugggcccuccgacacccgggguucacggugauagcccuauucuuagcccacgccaucgguaccagcauuacgcagaaagggauuauuuucauccuccugaugcugguaacccccucgauggccaugcggugcguagggaucggcagccgcgacuucguugaaggccucuccggcgcuacgugggucgaugugguccuggaacacggaagcugugucaccaccauggccaaggauaaaccuacucuggacaucgagcucuuaaaaacggaggucaccaaccccgccauucugcggaaacucuguaucgaggccaagaucuccaacaccaccaccgacagccgcugccccacccagggcgaggccacccugguggaggaacaggacgccaacuuugucugccggcgcaccuuuguggaucggggcuggggaaacggcugugggcuguucggcaaagggucccucaucacgugugccaaguucaagugcgugaccaagcuugagggcaagaucguacaguaugagaaccugaaguacagcgugaucgugaccguccacacuggcgaccagcaccaagucgggaacgaguccacggaacacggcaccaccgcgaccaucacgccucaggcccccacuaccgagauccagcucacugacuacggggcacugacucuggacugcagcccccgaacgggccucgacuucaacgagaugguccugcugaccaugaaggaaaaauccuggcuagugcacaagcaaugguuccuggaccugccccuucccuggaccagcggggccuccacuucccaagagacguggaaccggcaggaccugcuggugacauucaagaccgcccacgcgaagaagcaggagguggucgugcucgggucacaggagggcgccaugcauaccgcucucacgggggccacugagauccaaacuuccggcacaaccaccaucuucgcggggcacuuaaaaugccgccucaagauggacaaguugacccugaaggggaugucauacgucaugugcacagguuccuucaaacuggagaaggagguggcggagacgcaacacggaaccgugcugguccagaucaaguacgagggcacugacgcccccugcaagaucccguuuagcacccaagacgagaagggggugacgcaaaacggccgguuaauaacugccaacccgauagugacugacaaggaaaaaccugucaacaucgaggccgaaccgcccuuuggggaguccuacaucguaaucggugcgggcgaaaaggcccugaagcucucaugguucaagaaaggguccagcaucggcaaaauguucgaagcaacagcacgcggggcccggcguauggcaauccugggcgacacggccugggacuucgggaguauaggcgguguguucaccagcguggggaaacugguucaccagaucuucggcacggccuacgggguccuuuucagcggcgucuccuggaccaugaaaaucgggcucggcguuuuacucacaugguugggccugaacucccgcucgaccucccucucgaugaccuguaucgccgugggguuggucacccuauaccucggcgugaugguacaggcugacagcgggugcguuaucaacuggaagggucgggagcucaagugcggaagcgggaucuucgugacaaacgaggugcacacauggaccgagcaauacaaguuccaggcagacuccccgaagcgccuguccgcggccauaggcaaggcuugggaggagggggucugcggcauaagguccgccacccgccucgagaacguuauguggaagcagaucuccaacgagcugaaccacauccugcucgaaaacgacaugaaguucaccguagucguuggggacguggccggcauccuggcacaagggaagaagaugauccggccucaaccgauggaguacaaguacagcuggaagucauggggcaaggccaagaucaugggcgccgacguacagaacacgaccuucaucaucgacgggcccaacacccccgagugcccagacgaucagagagcguggaacaucugggaggucgaggauuacggcuucgggauuuucaccacgaacaucuggcuuaagcuccgggacagcuauacccaggugugcgaccaccgacucaugucagccgccaucaaggacagcaaagccguccacgcugacaugggcuauuggaucgagucagagaagaaugagaccuggaagcucgcgagggccagcuucauagaaguuaagacguguaucuggccuaaaucccacacgcucuggagcaacggcguccuggaguccgaaaugaucauccccaaaauuuacgggggcccgaucagccaacacaacuaucgcccgggguauuucacccagacugccggccccuggcaccuggggaagcuggagcuggacuucgaccugugcgagggcacaacggucguaguggacgagcacugcggcaaccgggggccgucccuccgcaccacuaccgucaccggcaagaucauacacgagugguguugccgguccugcacacugccgcccuugcgcuuccgcggggaggacggcuguugguacgggauggagauccgcccggugaaggagaaagaggagaaucucgugaaguccauggucucggccggcagcggcgaaguggacuccuucagccuagggcugcucugcauuuccaucaugaucgaggaggugaugcggagcagauggucccgaaagaugcugaugaccggcacacuggccgucuuccucuuacugaucaugggccagcugacguggaacgaccugauccgccugugcaucauggugggugcgaacgccagcgaccgcauggggaugggcaccaccuaccuagcccugauggccaccuucaaaaugagaccgauguucgccguggggcuucucuuccgccgauuaaccucacgugaggucuuguugcuaaccauagguuugagccucguggcgucgguagaguuacccaauucgcuugaagaacucggagacgggcuggccaugggcaucaugaucuugaagcuccugaccgacuuccaaucccaccagcugugggcgacccuccuaagccugacguuuaucaagacgaccuucucccuccacuacgccuggaagaccauggcgauggugcuuagcaucgucucccuguuccccuuaugcuugagcacuaccucccagaagacuacguggcugcccguccuccugggcucucuggggugcaagccguuaacgauguuccugaucgccgagaacaagauauggggccggagguccuggccccugaacgagggcaucauggccgugggaaucgugagcauccuauugucuucccuucucaagaacgacgucccacuggccgggcccuugaucgccggcggcaugcucaucgcgugcuacgugaucagcggcuccucggccgaccugagucuagagaaagcagccgaagugagcugggaggaggaggccgaacacuccggcgcgagccacaacaucuuagucgaggugcaggacgacgggaccaugaagaucaaggacgaggagagggacgacacccucaccauccuguuaaaggccacccugcuugcuguguccggcgucuauccgcucagcauccccgcuacgcuguucgugugguauuucuggcagaagaaaaagcagcgguccgggguguugugggacacgccuagcccaccggaggucgagcgggccgugcuggacgauggcaucuacagaaucaugcagcgcgggcuccuggggcgcucccagguaggggucgggguguuccaagagaacguguuccacaccauguggcacgucacccggggugcgguauuaauguaccagggaaagcgccuggagcccagcugggccucugugaagaaggacuuaauuucuuacggcggcggcuggcgacugcagggcuccuggaauacgggggaggagguacaagugaucgccguggagccaggcaagaaccccaagaacguacagaccgcccccgggacuuucaagacccccgagggagaggugggggcgaucgcgcucgacuuuaagcccggaacgucaggaucccccaucgugaaccgcgaggggaagauugucggacuguacgguaacggggugguuaccaccagcggcaccuacgucucggccauagcccaggccaaggcuucgcaggaggggccccugcccgagaucgaggacgagguguuccggaagcgcaaccucacgauaauggaccugcaucccggcagcgggaaaacccggcgcuacuugcccgcuaucgugcgggaggccaucaaacgaaagcuccgcacccugauauuggcccccacccgaguuguggccuccgagauggccgaagcccucaagggcaugcccauccgcuaucagacuaccgccgucaaaagugagcacacuggcaaagagaucgucgaccugaugugccacgccacuuucacuaugcgacuucucaguccagugcgugugccuaacuacaacaugaucaucauggacgaggcccauuuuaccgaccccaguuccaucgcggcccggggguacaucucaacacgagucggaaugggggaggccgccgccaucuucaugacagcgacgccccccggcucaguggaggcuuucccgcaaagcaacgccguuauccaagaugaagagcgggacauccccgagcgcuccuggaacagcggguacgaguggauaaccgauuuccccgguaaaaccgucugguucgugccuuccaucaagagcggcaacgacaucgccaacugccugcggaagaacgggaagcgggugauccaacugucccguaagacauucgacacggaguaucaaaagaccaaaaacaacgacugggacuacguagugacgaccgacaucagcgagaugggcgccaacuuccgcgccgacagagugaucgacccgcgccgaugucucaagcccgucauucugaaggacgggcccgagcgcgucauccuggccggacccaugccagucacgguagccuccgcagcgcagagacgugggcggaucggccguaaccauaacaaggaaggcgaccaguacauauacauggggcagccccucaacaaugacgaagaccaugcccacuggaccgaggccaagaugcugcuggacaacauuaacaccccugagggcaucauccccgcccucuuugagccggagcgagagaagagugccgcgauugacggcgaguaucggcugcgcggcgaagcccggaagaccuucguggagcugaugcgcaggggggacuugcccgucuggcuguccuacaagguagccucggagggauuccaauacagcgaucgacgguggugcuucgacggcgagcgcaacaaccaaguguuagaggagaacauggaugucgagaucuggacgaaggagggggagcggaagaagcucagaccccgguggcuggacgcccgcaccuacuccgacccccuggcacuccgggaguucaaggaguucgccgccgggcgccggagcguguccggggaccugauucuggagauuggaaaguugccucaacaccugacccagcgcgcccagaacgcccuggauaacuuagugaugcugcacaacagugagcagggcgggagagcguaucgccacgccauggaggagcugccugacaccauugagacgcucaugcuucucgcacucaucgccgugcuaaccggcggggugacccuguucuuccucuccggccgggggcuuggcaagacgagcaucgggcugcucugcguuauggcuuccagcguccuguuguggauggcguccguggagccccacuggaucgccgccagcaucauccucgaauuuuuccugaugguccugcuuauaccugagccugaccggcagcgcacgccgcaggacaaccagcuggccuacgucgugauagggcuucucuucaugauccugacuguggcggcgaacgaaaugggccugcucgagaccaccaaaaaggaccuggggaucggccacgccgcugucgggaaccaccaccacgccgccaugcuggacguggaccuacauccagcguccgccuggacucuguacgccguggcaaccacuaucauaaccccgaugaugcgccacaccaucgagaauacgaccgccaauaucagccugacugcgaucgccaaucaggccgcgauccugaugggccuggacaaaggcuggcccaucuccaagauggacaucggugucccccuguuggcgcugggcugcuauagccaagugaauccccugacucucacggccgccguccugaugcuggucgcccacuacgccauuaucgggccgggccuccaggcgaaggccacccgugaggcucagaagcgaacugcugccgggaucaugaagaaccccaccguugaugguaucguggccaucgaucucgacccggucguguacgaugccaaguucgagaagcagcugggccagauaauguugcugauccugugcaccucccagauucuccugaugcgcaccacuugggcccuuugcgagagcaucacccuugccacggggccacugacaacguugugggagggcuccccggggaaauucuggaacaccacgauugcaguuagcauggcgaacauauuucggggcuccuaccucgccggcgccgggcuggcguucagccugaugaagucccucggcggcggcagacgggggaccggugcucagggcgagacacugggggagaaauggaagcgacaguugaaccaguuaucgaaguccgaguucaacaccuacaaacgguccggcaucauggaggucgacagaagcgaagcgaaggaggggcugaagcggggcgagacgaccaagcacgccgucuccaggggcaccgcuaaacugcggugguucgucgagcgaaaccuggucaagcccgagggaaagguaaucgaccucgguugugggcggggcgguuggagcuacuauugcgcuggacugaagaaggugaccgaggucaaggguuacacgaaggguggccccgggcaugaagagcccauaccgauggcgacguacggcuggaacuuaguaaagcuccauucugggaaagauguguuuuucauaccgcccgagaagugcgacacccugcucugcgacaucggugaaagcagccccaauccgaccaucgaggaggggcgcacguugcguguauuaaagaugguggagccauggcugcgcggcaaucaguuuugcaucaagaucuuaaacccauacaugcccagcgugguggaaacucuggagcaaaugcagagaaagcacggcggcaugcuggugaggaacccgcuaucacggaacagcacccaugagauguacugggugagcugcgguaccgggaauauugucagcgccgugaacaugaccucccgcaugcuacuuaacagauucaccauggcacacagaaagcccaccuaugagcgcgacguggaccucggcgccggcacccgacauguagccguggaaccagagguggcgaaucuggacaucaucgggcaaaggaucgagaacaucaagcacgaacacaagaguaccuggcacuacgacgaggacaacccuuacaagacgugggccuaucacggcagcuacgaggucaagccgagcgguucggccagcagcauggugaacggcgucguuaagcuccucacuaagcccugggacgucauccccauggucacucaaaucgcgaugaccgacacgacgcccuucggacagcaacgcguguuuaaggagaaaguggauacccgcaccccgaaggcuaagcggggaacugcgcagaucauggaggucaccgcaaaaugguuauggggcuucuuaucccgcaacaagaagccccggaucugcaccagggaggaguucacucggaaggugcgcagcaacgccgccaucggugcuguguucgucgacgaaaaucaauggaacuccgcuaaggaggccguggaggaugagcgguucugggaccucgugcaccgcgagcgagagcugcauaagcaaggcaagugcgcgaccugcgucuacaauaugauggggaaacgggagaagaaacugggcgaguucgggaaggccaagggcagcagggccaucugguacauguggcuaggcgcccgauuccuggaguucgaggcccugggauucaugaacgaggaucacugguucuccagggagaacagccuauccgggguggagggggagggucugcauaagcugggguacauccuacgcgacaucucgaagauacccggaggcaacauguacgccgacgacaccgcgggaugggauacccggauuaccgaggacgacuugcagaaugaagcccgcaucacggauaucauggagccggagcaugcuuuacucgcaaaauccaucuuuaagcucaccuaccagaacaaggugguccgcguucagcggccugccaagaauggcaccgucauggacguaauaucgcggagggaccagcgcggauccgggcaggugggaaccuacggccugaacaccuucaccaauauggaggcccagcuuauccggcaaauggaaagcgagggaaucuucucccccagcgagcuggagacccccaaccuggcggagcgcguucucgacuggcuggagaaguacggggucgaaaggcugaagagaauggcgauauccggagacgauugcgucguaaagccgaucgaugauagguucgccaccgcauugacggcccucaacgacaugggcaagguccgcaaggacaucccccagugggagcccagcaagggcuggaacgacuggcagcagguccccuucugcucccaccacuuccaccagcugaucaugaaggacgggcgggagaucguggugccaugccggaaucaagacgaacucguugggcgggccagggugagccagggcgccggguggucacugcgggagacagccugccugggcaaguccuacgcccagauguggcagcuuauguacuuccaccgacgggaccugagacucgcggccaaugccauaugcagcgcagucccaguggacuggauacccacaucccggaccacguggucaauccaugcccaccaccaguggaugacgaccgaggacauguugucgguguggaaccgcgucuggaucgaagagaaccccuggauggaggacaagacccacaucagcuccuggggcgacguaccguaccugggcaagcgcgaggaccagugguguggcuccuuaaucggccucacggcgcgggccaccugggccaccaacauccagguggccaucaaccaggugcgccggcugaucggcaacgaaaacuaccuggauuacaugacguccaugaagcgcuucaagaacgaaucagaccccgagggagcacucugguga

SEQ ID NO: 24193 - RNA, 9879 nt, Artificial Sequence
  derived and/or modified CDS sequence (opt11) from DENV-1__FJ410220__SS-prME
agcgugacuaugcugcugaugcugaugcccaccgccuuagccuuucacuuaaccacacggggcggggagccccacaugauugugagcaagcaggagcggggaaagagccugcuguucaagaccagcgcaggggugaacaugugcaccuuaaucgccauggaccugggcgagcuuugcgaggauacuaugaccuacaagugcccccggaucacugaggccgagcccgacgacguggacugcuggugcaacgccacggacacaugggugaccuacgggaccugcagccaaaccggugagcaccggcgagagaagcgguccguggcccuggcgccacacgugggacuuggucuggagacgcggaccgagacuuggaugucuuccgagggcgccuggaagcagauucagcgggucgagaccugggcucuccgccacccuggguucaccgugauagcccuguuccuagcgcacgccauaggcaccagcaucacccagaaggggaucguguucauccuccugauguuagucacccccucuauggccaugcggugcgugggcaucgggucccgugacuuuguggagggcuuauccggagccacgugggucgacguggugcuggagcauggaucaugcgucaccaccauggccaaggacaagccuaccuuggacaucgagcuucugaagacagaggugacuaaccccgcggugcugcggaaacucugcaucgaggccaaaaucucuaacaccaccaccgacagccggugcccgacccagggcgaggccacccuggucgaggagcaggacgccaauuucgugugccggcgcaccuucguggaucggggcugggggaacggaugcgggcuguucggaaaggggucccuacucacgugugccaaguucaaaugcguuaccaaguuagaggguaaaaucguucaauacgaaaaccucaaguacagcgugaucguaaccgugcacaccggcgaccagcaucaagucgggaacgagagcacagagcacgguacuaccgcgacaaucacgccccaggcccccacaaccgagauccaguugaccgacuauggggccuuaacccucgacugcaguccccggacgggccuggacuucaacgaaaugguacuccucaccaugaaagagaaguccuggcuagugcacaagcagugguuccuagaccuccccuugccauggaccagcggggccagcaccucccaagagacguggaaccggcaggaucugcucgucaccuucaaaaccgcccacgcaaagaagcaggaagugguggucuuaggcagccaggagggcgccaugcacacggccuugacgggggccaccgagauccagacguccggcacaacgaccaucuucgccgggcaccucaagugccgccuaaagauggacaagcugacgcucaagggaauguccuacgugaugugcaccgggucauucaagcuggagaaggaaguggcagagacgcagcacggcaccguacuggugcagaucaaguacgaaggcaccgacgcccccugcaagauacccuucagcacgcaggacgagaagggagugacgcagaacggccggcugaucaccgccaacccgaucgucacggauaaggagaagccaguaaacaucgaggccgagccgcccuucggcgaauccuacauaguuaucggagcgggugagaaggcccugaagcugagcugguucaagaagggcuccagcaucggcaagauguucgaggccaccgcccgcggggcacggcgcauggcgauccugggugacacggcgugggacuucggguccaucggcggcguguucaccagcguggggaagcucgugcaccagaucuuuggcaccgccuacgggguccuguucuccggcgugagcuggaccaugaagaucgggaucggcgugcugcucacguggcugggcuuaaacucccgcagcaccucccucagcaugaccugcaucgccguugggcuggugacacuguaccuuggugugaugguucaagcggacucagggugcgugaucaacuggaagggucgcgagcugaagugcgggagcggcaucuuugugacaaacgagguacauaccuggaccgaacaguacaaguuccaggcggacagcccgaagcgacugucagcagccaucggaaaggccugggaggagggggucugcggcaucaggagcgccacccgccucgagaacaucauguggaagcagauuuccaaugagcuuaaccacauccuccucgagaaugauaugaaauuuacugugguugugggcgacguggcuggcauccugguccaagggaagaaaaugauccggccccagcccauggaguacaaguacagcuggaagucauggggcaaggccaagauuaucggcgccgacgugcagaacagcacguucauuaucgacggccccaacaccccggagugccccgacgaucagcgcgccuggaacaucugggagguugaggacuacggcuucgggaucuucaccaccaauaucuggcugaagcuccgggacuccuauacgcaggucugcgaccacaggcugaugucugcggccauaaaggauuccaaggccguccacgccgacaugggcuacuggaucgagagugagaagaacgagaccuggaaguuagcccgugcguccuucaucgagguaaaaaccugcaucuggcccaagagccacacccucugguccaacggagucuuggaaagcgagaugaucauacccaagauccacgggggccccauaucccagcacaacuaccgccccggauacuucacucagaccgccgggcccuggcaccuggggaagcucgagcuugacuucgaccugugcgaggguacgacaguuguugucgacgaacacugcggcaaccggggaccgagccugaggacgacgaccgucaccggcaagaucauccaugaauggugcugccggucgugcacgcugccaccccugagguuccgcggggaagacggcugcugguacgggauggagauccgccccgucaaggagaaggaggagaaccucguuaaguccauggugagcgccggcuccggcgagguggacagcuucucccuagggcugcucugcaucagcaucaugaucgaggagguaaugcggucccgcuggagccggaagaugcugaugaccggcacucuggcuguguucuuccugcugaucauggggcaguuaaccuggaacgaccucaucaggcugugcauaauggugggcgccaaugcgucagaccgcauggggaugggcacgaccuaccuggcccucauggccacauucaaaaugcggccaauguucgccgucggccugcuguuccgccggcucaccagccgcgaggugcuacugcucacuaucgggcugagucuggucgccagcguggagcuccccaacucccuggaagagcugggcgacgggcucgcgaugggcaucaugauccugaagcuccucaccgacuuccagagcuaccagcugugggccacccugcucucccuaaccuucaucaaaacgaccuucagccugcacuacgccuggaagaccauggccauggugcucuccaucgucagccuguucccccugugccuuucaacaacgagccagaaaacaaccugguuacccgugcugcucggcucccuggggugcaagccgcugaccauguuucuaaucgcggagaauaagaucuggggccgcaaguccuggccucugaacgaggggaucauggccgugggcaucgucagcauacugcucucuagccugcugaagaacgacgugccccuagccggaccccucaucgccgguggcaugcugaucgccugcuacgugaucuccgggucuuccgccgaccucagccuagagaaggccgccgaggucuccugggaggaggaggccgagcacaguggcgcuucccacaauauccugguggagguccaggacgacgggacuaugaagaucaaagacgaggagcgcgacgacacccuuaccauucugcugaaggcgacgcuccuggcagucuccggcguguacccguuauccaucccagccacucucuucguuuggcauuuuuggcagaagaagaagcagagauccgggguucuaugggacacgcccagcccgcccgagguggagcgcgcagugcuagacgacggcaucuaucgaaucaugcagcgcgggcuguuagggcggucccaggucggcguggggguauuccaggagaacgucuuccacaccauguggcacgugacccguggcgccgugcugauguaccaagguaaacggcuggagccuuccugggcgagcguuaagaaggaccucauuuccuacggcggaggguggcgcuuccagggcagcuggaacaccggugaggaaguccaagugaucgccgucgagcccggcaagaaccccaagaaugugcagacggcgcccgggaccuucaagacccccgagggcgaggugggcgccaucgcccuggacuucaagcccgggaccuccggcagucccaucgucaauagagaggggaaaaucgugggccuguacggcaacgggguggugacgacgagcggcaccuacguuuccgcgaucgcccaggccaaggccagccaggaagggccguugcccgagaucgaagacgagguuuuccgcaagaggaaucugaccaucauggaucugcaccccggcuccgggaagacgcgccgguaucucccggccaucguccgcgaggccaucaagcggaaacugcgcacccuaauccuggcgcccacucguguggucgccagugaaauggcagaggcgcugaagggcaugcccauccgauaccagacaacggccgucaaguccgagcacacuggcaaggagaucguggaccugaugugucaugccaccuucacaaugcgccuccuaagccccguccgggucccgaacuacaacaugaucaucauggacgaggcucacuucacggaucccucaagcauagccgcucgcggauacauaucuacccgagugggcaugggggaggccgccgccaucuuuaugaccgccacgccgccuggcagcauggaagcauuuccgcaauccaacgccgucauccaagacgaagagcgcgacauccccgagcggucuuggaacagcggguaugaguggauuacggacuuccccgggaagaccgucugguucgugcccagcaucaaggccggcaacgacaucgcaaacugucugcgcaagaacgggaagcgggugauccaacucucccgcaagaccuucgacaccgaguaccagaagacgaagaacaacgacugggacuacgucgugaccaccgacaucuccgaaaugggcgcgaacuuuagggccgaccgcgugaucgacccgcggcgcugccugaagccagucauccugaaagacgggcccgagcgggucauccucgcgggcccgaugccggucacgguggccuccgccgcccagaggcgggggcgcauaggccggaaccacaacaaggagggcgaccaauacaucuacaugggacaaccccugaacaacgacgaggaccacgcccacuggaccgaggccaagauguuacucgacaacaucaacacccccgagggcaucauccccgcccuauucgagccggagcgcgagaaguccgccgcgaucgacggggaguaccggcuucggggcgaggcccgcaagaccuucguggagcucaugcggcgcggggaccugcccguguggcuguccuacaagguggccagugagggauuucaauacucggacaggcgcuggugcuucgacggcgagcggaacaaccaagugcucgaggaaaauauggacguggagauuuggacaaaggaaggggagcgcaagaagcugcggccccgcuggcuggacgcacggacguacuccgacccgcuagccuuaagggaguucaaggaguucgcugccggccggcgcagcguguccggcgaccugauccucgaaaucggcaaguugccgcagcaccucacccagcgggcccaaaacgcuuuagacaaccuggugaugcuacacaacagcgagcagggcgggcgggcguaucggcacgcgauggaggagcuccccgacaccaucgagacacugaugcugcucgcucugaucgcgguccugacgggcggaguaacccuguucuuccugaguggcaaggggcugggcaagaccagcauagggcuuuugugugugauggccagcucgguccuccucuggauggcguccguggagccccacuggaucgccgccagcaucauccuggaauucuuccugauggugcugcugauucccgagccggacagacagcggacaccccaggacaaccaauuggcguacguggucaucgggcuccuguucaugaucuugaccguagccgcgaaugagaugggccugcuggagacgaccaagaaggaccuggggaucgggcaugucgccguggaaaaccaucaucacgccgcaaugcucgacguggaucugcaccccgccagcgcguggacccuguacgccguggccaccacgaucauaaccccgaugaugcgccacaccaucgagaacaccacugccaacaucagccucaccgcaaucgcgaaccaggccgcaauccuaauggggcuggacaagggcuggcccaucuccaagauggacaucggcgugcccuugcuggcacugggguguuacagccaggugaacccccucaccuugacugcggccguccuuaugcucguggcccauuaugccaucaucggcccgggguugcaggccaaggcuacgcgggaggcccagaagcgcaccgccgccggcaucaugaaaaaccccaccauugacgguaucgucgcgaucgaucuggacccugucguguaugacgcgaaauucgagaagcagcucggccagaucaugcugcugauucucugcaccucccagauccugcugaugcguaccaccugggcgcuaugcgagaguaucacccuggcgaccggaccccugacuacucucugggaggggaguccgggcaaguucuggaacacaaccaucgcagugagcauggcgaacauauuucgggggagcuaccuggcgggcgcugggcuggccuuuagccucaugaagucccucggaggcgggcggcgggggacgggggcccaaggcgaaacccugggcgagaaguggaagcgccagcucaaccaauuaaguaaguccgaauucaacaccuauaagcgguccgggaucauggaggucgaccgcuccgaggcgaaagagggucugaaacgcggugagaccacaaagcacgccgugagccgcggcacggccaaacuccgaugguuuguggagcgcaaccuggucaaacccgaggggaaggugaucgaccugggcugcggccgagggggcuggagcuauuacugcgcggggcucaagaaagucaccgaggugaagggcuacaccaagggcggccccggccacgaagagcccaucccgauggcuacuuacggcuggaaccucgugaagcugcauuccggcaaggacguguucuucauuccucccgagaagugcgacacccugcucugcgacaucggggagagcucuccgaacccgaccauugaggagggccgcacccugaggguccugaagaugguggagcccuggcucagagggaaccaauucugcaucaaaauccuaaaccccuacaugcccuccgugguugagacgcuggagcagaugcagcggaaacacgguggcaugcucgugcgcaacccccugagccggaacagcacccacgagauguauuggguguccugcgggaccggcaacauagucagcgcggugaacaugaccagccguaugcuccucaaucgguucacgauggcccaucgcaagcccacguacgaacgcgauguggaccugggggccggcacccggcacguagcgguggaacccgaggucgcaaaccuggacauuaucggccagcgcaucgaaaacauaaagcacgagcacaagagcaccuggcacuacgacgaggacaaccccuacaagacuugggcguaccacgggucauacgaggucaagccuagcggcuccgccagcagcauggugaauggggucgugaaacuucuaacaaagcccugggacgugauccccauggucacccaaaucgccaugaccgacaccacgcccuucggccagcagcgaguguuuaaggaaaagguggacacccgcacccccaaggcgaaacgugggacugcacagauaauggaggugacggcgagauggcuguggggcuuccucucccggaacaagaagccccgcauuugcacacgggaggaguucacccgcaaggugcggagcaacgccgccaucggcgccgucuucguugacgagaaccaguggaacuccgcgaaggaggccguggaggacgaccgcuucugggaccuggugcaccgggagcgcgaacuccacaaacaggguaagugcgcgaccugcgucuacaauaugaugggcaagagagagaagaaguugggugaguucgggaaagccaaggggagccgagccaucugguacauguggcuaggcgcgcguuuccuggaguucgaggcccucggcuucaugaaugaagaucauugguucucccgggagaacagccuguccggggucgagggcgagggucugcacaaacuaggcuacauccugcgggacaucagcaagauccccggcggcaacauguacgccgacgacacggcgggcugggacacccgcauuaccgaggacgaucugcagaacgaggccaaaaucaccgacaucauggagccggaacacgcgcucuuggccaaauccaucuuuaaguuaacauaccagaacaaggugguacgggugcagcgaccugccaagaacgggacagugauggacgucaucucaagacgggaucagcgcggcucgggccagguggggaccuauggccucaacaccuucacuaauauggaggcccagcugauccggcagauggagagcgaggggaucuuccugcccaacgaauuggagacccccaaucuggccggccgagugcuggacuggcucgaaaaguacggggucgagcggcuaaagcgcauggcgaucuccggagacgacugcguggugaagccgauugacgaucgguucgccaccgcccugaccgcccucaacgacauggggaagguucgcaaagacaucccgcaaugggagcccagcaaaggcuggaaugauuggcagcaggucccuuucugcucccaucacuuccaccagcuaaucaugaaggauggccgugagaucguggucccgugccgcaaccaggacgagcuggugggacgagcgagagugagccaaggcgcgggguggucacuccgugagacggccugcuugggcaaaagcuacgcccagauguggcagcugauguacuuccaccgccgggaucuccgccuagccgcaaacgccaucugcagcgcgguccccguggacugggugcccacaucccggaccaccuggagcauccacgcccaccaccaguggaugacgaccgaggacaugcuguccguuuggaaccgggucuggaucgaagagaaccccuggauggaggacaagacccggaucagcagcugggaggacgugccguaucuugggaagcgcgaggaccaauggugcggcagccugauuggcuuaaccgcucgcgcgacuugggccaccaauauccagguagccaucaaccaagugagacgccucaucgggaacgagaacuacuccgauuacaugaccagcaugaaacgguucaaaaacgaaucggagcccgaaggggccuugugguag

SEQ ID NO: 24194 - RNA, 9879 nt, Artificial Sequence
  derived and/or modified CDS sequence (opt11) from DENV-1__JF937649__SS-prME
agcgucaccaugcugcugaugcugaugcccaccgcccuggccuuccaucuuaccacccggggcggugagccacauaugaucgugucaaaacaagagcggggcaagagccuucuguucaagaccagcgccggcguaaacaugugcacauuaaucgcuauggaucugggcgagcugugcgaggacaccaugacuuauaagugcccccgaaucaccgagguagagcccgacgacguugacuguugguguaauaccaccgacaccugggugaccuacgggaccugcagccagacgggagagcaccggcgcgacaaacggagcguggccuuagccccccacgucggucugggccuggagacccgcgcggagacguggaugucguccgagggcgcguggaagcaaauccagaagguggagacuugggccuugcgucaccccggguucacggugaucgcccuguuccuggcccacgcuaucggcaccucgaucacccagaaggggaucaucuucauccuccugaugcuagucacccccucgauggccaugcggugcgugggcaucgguucacgggauuucguggaggggcucaguggggccacguggguagacguggugcuggagcacgggagcugcgucacuaccauggcuaaggacaaacccacccuggauaucgagcucuugaagaccgaggugacgaaccccgccgugcugcgcaagcucugcaucgaggcuaaaaucucgaacaccaccacggacagccgguguccgacgcaaggcgaggccacccugguugaggagcaggacgcuaacuucgugugucgccggacauuuguugaccgcggaugggggaacggcugcgggcuguucggcaaggggucacuaaucacgugcgccaaguucaagugugucacuaagcuggagggcaagaucgugcaauacgagaaucugaaguacagcgugaucgucaccgugcacacuggcgaccaacaccaagucgggaaugaguccacggagcacggcaccaccgccaccaucacgccccaggcgccaacgagcgagauccaacuuacggacuauggggcccugacccuggacuguagcccacgcaccggccucgauuuuaacgagaugguacugcugacgaugaaagagaaguccuggcuugugcacaagcagugguuccuggaccugccccugcccuggaccagcggggccagcaccagccaggagacauggaaccggcaggaccuacuggucacguucaagaccgcgcacgcaaaaaagcaggaggugguggugcuaggcagucaggagggcgccaugcacaccgcacugacgggggcuacggagauccagaccagcggcaccacgacgaucuuugccgggcauuuaaagugccggcucaaaauggacaagcugacccugaagggcauguccuacgugaugugcacaggaagcuucaagcucgagaaagaggucgccgaaacccaacacgguacgguccugguucagaucaaguacgagggcaccgacgcgcccugcaagauccccuucaguacccaggacgaaaaggggguuacgcagaauggccgccugaucacggcaaauccgaucgucaccgacaaagagaagcccgugaacaucgaggccgagccgcccuuuggggagagcuauauagugauaggcgccggcgagaaggcgcuuaaacucuccugguucaagaaggggagcuccaucggcaagauguucgaggccaccgcgcgcggggccaggcguauggccauccugggugacacugcgugggacuucgggucaauuggcggggucuucacguccguagggaagcuagugcaccagaucuucgggaccgccuacgggguccucuucagcggcguguccuggacgaugaagauugggaucggcgugcugcuaaccuggcucggccugaauagccgcagcaccagcuuguccaugaccugcaucgccgucggccucgucacccuguaccugggcguaaugguccaggccgacagcgggugcgugaucaauuggaagggccgcgagcucaagugcgggaguggcauuuucgugaccaacgaagugcacaccuggaccgagcaguacaaguuccaagccgacuccccgaaacggcucagcgcggccaucggcaaagccugggaggagggagugugcggaauccgcuccgcuacccggcuggaaaacaucauguggcgccaaauuaguaacgagcuaaaccacauccucuuagagaacgacaugaaguuuaccguggucgugggugacguugucggcauccucgcccagggaaagaagaugauacggccccagcccauggaacauaaguauucguggaaguccuggggcaaggcgaaaaucaucggcgccgacgugcagaacaccacguucaucaucgaugggcccaacaccccggagugccccgacgaccagagagccuggaacaucugggaaguggaggacuacggguucgggaucuucaccacgaacaucuggcuaaagcugcgggacuccuacacgcaggucugugaccaucgccucaugucggccgcgaucaaggacucgaaggccgugcacgccgacaugggguacuggauugagagcgagaagaacgagacguggaaauuagcccgggccuccuucaucgaggugaagaccugcauauggcccaagagccauacccuguggaguaacggcguccucgagagcgaaaugaucauccccaagaucuacgggggcccaaucucccaacacaacuaccgccccggguauuucacacagaccgcgggaccguggcaccuagggaagcuggagcucgacuucgacuugugcgagggcaccaccgucguggucgaugagcacugcggcaaccgggggccgucccugcgcacgaccacagugaccggcaagaucauccaugaguggugcugucgguccugcacacugccgccccuccgcuucaaaggggaggacggcugcugguacgggauggagauccggcccgugaaggagaaggaagaaaaccucguuaagagcauggugucagcaggcaguggggagguggacagcuucucccucgggcugcuguguaucucaaucaugaucgaggagguaaugagaucccgguggagccgcaaaaugcucaugaccggcacccuggcuguguucuuccugcucaucauggggcagcugaccuggaacgaccugaucagguccugcaucaugguuggcgccaacgccagugaccgcauggggauggguacgacauaucucgcgcugauggccaccuucaagaugcgcccgauguucgccgucgggcugcuguuucggcgccugaccucccgggagguccuguugcugacgaucgggcugagccuagucgccuccguggaacugcccaacagccuggaggagcucggugacgggcuagccaugggcaucaugauccuaaagcuccugaccgauuuccaguccuaucagcugugggccaccuuauugucgcugacauucaucaagacgaccuucagucuccacuacgccuggaagaccauggccauggugcugucaaucguuucccugcucccccugugccugaguaccacgucccagaagaccaccuggcuucccguacugcugggcagucucggguguaagccgcugaccauguuccugaucgccgagaauaaaaucuggggccgcaagagcuggccccucaacgagggcaucauggcagugggcaucgucuccauccugcuaagcuccuuacucaagaacgacgugccccuggccgguccacucaucgccggcggcaugcugaucgccugcuaugugaucagcggauccagcgcagaucugucccucgagaaggcggccgaggucagcugggaggaggaggccgagcacuccggugccagccacaauauccugguggaagugcaggacgaugggacgaugaagaucaaagacgaggaacgggacgacacuuuaaccauccuccugaaggccacccugcucgcggucaguggaguguacccucugagcauccccgccacccuguucguuugguacuucuggcagaagaagaaacagcgcuccgggguccucugggauacgcccagcccuccggaaguggagcgggccgugcuggaugacggcauuuaccgcauaaugcagaggggccugcuggggcgcucgcaggucggcguggggguguuccaagagaacguuuuccacaccauguggcacgugacccggggcgcugugcucauguaccaggggaagcgucuggagcccagcugggccuccgugaagaaggaucugauaagcuacggcggcggauggcggcuccagggcuccuggaauacaggggaggaaguccaagugaucgcuguagagccagggaagaaccccaagaacgugcagacugcccccggcacauucaaaacccccgagggagaggugggcgcgauagcccuggacuucaagcccgggacgucgggcagccccauuguaaauagggaggggaagaucgugggucuguacggcaacgggguggucacgaccuccggcaccuacguaagcgccaucgcgcaggccaaggcuucccaggaggggccacuccccgagaucgaggacgagguguuccggaagcgcaaccugaccaucauggaccugcacccaggcagcgggaagacgcggcgcuaccucccggcaaucguucgggaggcuaucaagcgcaagcugcggacccucauccucgcccccacccggguaguggccuccgagauggccgaggcccugaagggcaugcccauuagauaccaaaccacggcggucaagagcgagcacacaggccgggaaaucguggaccuaaugugccacgccacguucacuaugcgccuacuguccccaguaagagugccgaacuacaacaugaucauuauggacgaggcccacuucacggaccccagcagcaucgcugcccgcggguauaucagcacccggguggguaugggggaggcggccgccaucuucaugaccgccacgccgcccggcucaguugaggccuucccgcagagcaaugcggucauccaggacgaggagcgcgacaucccugaacgguccuggaauaguggguacgaguggaucacggacuuccccgggaaaacagucugguucgugccuucuaucaaaagcggcaacgauaucgccaacugccugcgcaagaacggaaaaagggucauacaacucucgcggaaaaccuucgacaccgaauaccagaagacgaagaacaacgacugggacuauguggugaccaccgacaucagcgagaugggcgcuaacuuucgggccgaucgaguaaucgauccgagacgcugccugaagcccgugauccugaaggacgggcccgagagagucauccucgcgggccccaugccggugaccguggccuccgcggcccagcgccgugggcgcaucggccggaaccauaacaaagagggcgaccaguacauauacauggggcagccccuaaacaacgacgaagaccacgcccacuggacggaggcgaagaugcugcucgauaacaucaacacccccgagggcaucauccccgccuuauucgagccggagcgcgaaaaguccgccgccaucgacggggaauaccgccugcggggagaggcucgcaagacguucguggaacucaugcggcgcggggaccugcccguguggcugagcuacaagguggccuccgagggcuuucaguacucugaucggcgcuggugcuucgacggggagcggaacaaccagguccucgaggagaacauggauguugagaucuggaccaaagaaggggagcgcaagaagcugcggccccgguggcuagacgcgcgaacguacuccgacccccuugcccugagagaguucaaggaguucgccgccggucggcgcagcguguccggagaucugauccuggagaucgguaagcugccucagcaccugacccagcgggcgcagaacgccuuggacaaccuggucauguugcacaauagcgagcagggcgggcgcgccuaccggcacgccauggaggagcuccccgacaccaucgagacccugaugcugcucgcgcucaucgccguguugacgggcggggugacccucuucuuccuuuccggcaagggccugggcaagaccagcauugguuugcugugcgucauggccuccucugcacugcucuggauggccuccguugagccccacuggauugcggccucuauuauccuggaguucuuuuuaaugguccuccugaucccggagccggaccgccagcggacgccccaggauaaccaguuagccuacgucgugaucggguuguuauucaugauccucaccgucgccgccaacgagaugggccuccuggaaacgaccaagaaggaccuggggauaggccacgucgcgguggagaaccaccaccacgccacuaugcucgacguggaccugcaccccgcguccgccuggacccucuacgccgucgcgaccaccauaaucacuccgaugaugcgccacaccauagagaacaccaccgcaaacaucagucucaccgccaucgccaaccaggcagcaauccuaauggggcuggacaagggcuggcccaucuccaagauggacauaggcgugccccuccuggcccugggcugcuacucccaagugaauccccucacccugacggccgcaguccugaugcuugucgcgcacuacgccauuauaggcccggggcuacaggccaaggccacccgcgaagcccagaaacgcaccgcggccggcauuaugaaaaaccccaccguggacgggaucgucgccaucgaccuggaucccgugguguacgacgccaaguuugagaaacagcucgggcagaucauguuacugauccucugcacaucccagauucugcugaugaggaccacgugggccuuaugcgagagcaucacgcuugcgacgggcccccugaccacccucugggagggguccccgggcaaguucuggaacaccacaauagcugucucuauggcgaacaucuuccgggggagcuaccuggccggugccggacuggcguucucgcucaugaagucucucggcggugggcgccgggguaccggugcccaaggcgagacucugggcgagaaguggaagcgccaacucaaccaacuguccaaaagcgaguucaacaccuacaagcgguccgguaucauggagguggaccgcagcgaggccaaggagggccugcggcgcggggagaccacgaaacacgccguaucccggggcaccgcgaagcuccgcugguucgucgagcguaaccuggugaagcccgaggggaaagugaucgaccuuggcugcggucgcgggggguggagcuacuauugcgccggguuaaagaaggucacugaggugaagggcuacacaaagggcggaccugggcacgaggagccaauuccgauggcuaccuacgguuggaacuuaguaaagcugcacuccggcaaggacgucuucuuuaucccgcccgagaagugugacacgcugcucugcgacaucggagagucgagccccaacccaacuaucgaggagggccgaacgcuucgcguucuaaagaugguggagcccuggcuccggggcaaucaauucugcaucaagauccugaaccccuacaugccaaguguuguagagacccuggagcagaugcagcgcaagcacggcggcaugcuggugcggaacccgcugucccgcaacagcacccacgaaauguacuggguguccugcgggacuggcaacaucgugagcgccguuaauaugaccagccggaugcugcugaaccgcuucacgauggcccaccgcaagccaacuuacgagagagacgucgaucugggugcgggaacccgccacguagccguggagccagaggucgccaaccuggacaucaucggccagcggaucgaaaacaucaaacacgagcacaagaguaccuggcacuacgacgaggacaaccccuacaagacgugggccuaucacggaucuuaugaggugaagccgagcggcagcgccuccagcauggucaacgggguggugaagcugcugaccaagccaugggacgucauccccauggugacccagaucgcgaugacggacacgacccccuucggccagcagcgcguguucaaggagaaagucgacacccgcaccccgaaggcuaaacgcgggacggcccagauaauggaggucaccgccagguggcuguggggcuuucugucgcgcaacaagaagccccggauaugcacucgcgaggaguuuacccggaaggugcggagcaacgcagcgaucggagcuguguuuguggacgaaaaccaauggaacagugccaaggaggccguggaggacgaacgauucugggacuuaguucaucgcgaacgggagcugcacaaacaggggaagugcgcgaccugcguuuacaacaugaugggcaaaagagagaagaaacucggggaguuugggaaggccaagggaagccgggcaauuugguacaugugguuaggcgcccgcuucuuagaguucgaggcccucggcuucaugaaugaggaccacugguucucccgggaaaacucuuuguccgggguggagggcgaggguuugcacaaguugggcuacauccugcgcgacauuagcaagauccccgggggcaacauguacgcagacgacaccgcaggcugggacacccggaucaccgaagacgaccuacagaacgaggccaagauaacggacaucauggagccggaacacgcccucuuagccaccuccaucuucaagcugaccuaccagaauaaggucgugcgcgugcaacgccccgcgcggaacgggaccgucauggaugugauaucacgccgggaccagcgcggcuccggccaggugggcacguacgggcucaacacuuucacgaauauggaggcccagcugauacggcagauggaguccgaggguaucuucucccccagcgagcuggaaacccccaaucucgccgagcgggucuuagacuggcuggagaagcacggcguugagcggcucaagcgcauggccaucuccggggacgacuguguagucaagccgauugacgaccgguucgcgacggcgcugagcgcgcugaaugacaugggcaagguccgcaaggacaucccccagugggagcccagcaagggauggaacgacuggcagcagguucccuucugcagucaucacuuccaccagcucauaaugaaggacggucgcgagauugucgugccgugucgcaaccaggacgagcuggucggccgggcaagggucagccaaggggccgguuggucccuccgggagaccgccugccucggcaagagcuacgcgcagauguggcagcugauguauuuucaccgccgggacuuacgccucgccgcuaaugccaucugcagcgcggugccgguugacuggguccccaccagccggaccacuugguccauccacgcccaucaccaguggaugacgacggaggacaugcugucaguguggaacaggguguggaucgaggagaaucccuggauggaggacaaaacccauaucuccucuuggggcgaugucccguaccuggggaagcgcgaggaccaguggugcggcucccucaucggccugacggcccgggcuaccugggccaccaacauucaaguggcgauaaaccagguccgcaggcugaucgggaacgagaacuaccucgacuacaugaccagcaugaagcgcuucaagaacgaguccgaccccgaaggagcccugugguaa

SEQ ID NO: 24195 - RNA, 9879 nt, Artificial Sequence
  derived and/or modified CDS sequence (opt11) from DENV-1__FJ410222__SS-prME
ucggugacaaugcugcucaugcugaugccgaccgcuuuggccuuucaccucacuacccggggaggggaaccccacaugaucgucagcaaacaggagcgggggaaaucucugcuguuuaaaacgagugccgggguuaacaugugcacgcuaauugcgauggaccugggcgaacucugcgaggacacaaugaccuacaagugcccccggaucaccgaaacugagcccgacgacguggacugcugguguaacgccacggacaccugggucacuuacggcacauguagccagaccggcgagcaccgucgggauaaacguagcgucgcccuugccccgcacgugggccuggggcucgagacacgaaccgagacauggaugagcuccgagggggccuggaagcagauccaacgagucgaaacgugggcucuaaggcaccccggguucacggugaucgcacuguuucuugcccaugcgauuggcacaagcaucacccagaaagggaucauauucauucuccugauguuggugacgccgucgauggccaugcggugcgucggcaucgggagccgcgauuucguggaaggguuaagcggcgcgaccugggucgacgucgugcuggagcaugggucuugcgugaccaccauggccaaggauaaacccacgcuggacaucgagcucuugaaaaccgaaguuacuaaccccgccgugcugcggaaauuaugcaucgaggcuaaaaucuccaacaccacgaccgauagccggugccccacgcaaggggaggccacucugguugaggaacaggacgcuaacuucgucugccggcgcacauuuguugaccggggcugggggaacggcugcgggcuauuugguaaagggucccucauaacgugcgccaaguuuaagugcgugaccaagcuggagggcaaaauuguucaauacgagaacuuaaaguacagcgugaucguuaccguccauacgggcgaucagcaucaggugggcaacgaaucgacugagcacggcaccacggcuaccaucacgccccaggcccccacaacagaaauccagcucacugauuacggggccuugacgcuggacuguucccccagaaccggccuggacuucaacgagauggugcugcugaccaugaaggagaaaucgugguugguucacaagcaaugguuucuggaccugccgcuccccuggaccuccggggcaagcacgucacaggaaacauggaaccggcaggaccugcuggucacauucaagaccgcacaugccaagaaacaggagguuguaguucuggggucucaagaaggggcgaugcauacugcccugacaggggccacggagauccaaacauccggcacaaccacuaucuucgccgggcacuugaaaugcagguugaagauggauaaguuaacccugaagggcaugagcuacgugaugugcacggggucuuucaagcuagagaaagaacuggcggagacccaacacggcacggugcuaguacagaucaaauacgagggcacugacgcgcccuguaagauucccuucuccacucaagacgagaaggggguaacgcagaauggccggcuaaucacggcaaaccccaucguuacagauaaggagaaacccgugaacauugaagccgagccgcccuucggcgagagcuacaucguuaucggcgccggcgagaaagcccugaagcugagcugguucaagaaaggguccucgaucggaaaaauguuugaggcgacggcccgcggggccaggcgcauggccauucucggggacacggcgugggacuuugguuccaucggaggcguguucaccagcguuggcaagcucguccaccagauuuucggcaccgccuaugggguacuuuucuccggcguuagcuggacgaugaaaauagggauaggcguucugcucaccuggcugggcuugaacuccaggagcaccucccucagcaugaccugcaucgccguugggcugguuacgcuguaccucggcgugaugguacaggcugacagugggugcgucaucaauuggaagggcagggagcugaaaugcgggagcgguaucuucgucaccaacgaggugcacacguggaccgaacaguacaaguuucaagccgauucuccaaagcgccugucagcggccaucggcaaggccugggaggaggggguguguggcauccggucugccacccggcucgagaacaucauguggaagcaaaucagcaaugagcugaaucacauccugcuagagaacgacaugaaauuuacuguggucgucggggaugucgccggcauucuggcgcaagguaagaagaugauccguccacaacccauggaguauaaguacagcuggaaguccugggguaaggccaagaucauaggcgccgacguccagaacaccaccuucauaauagauggaccaaacaccccugagugccccgacgaucaacgcgccuggaacaucugggaaguggaggacuacggguucgguauuuuuacgaccaacaucuggcuaaaauugcgggacagcuauacacaggugugugaccaccgcuugauguccgcggcuaucaaggacucuaaggcagugcacgccgacaugggguacuggaucgagagcgagaaaaaugagacuuggaagcuggcccgggcuuccuucaucgaagugaagacaugcaucuggcccaaaucccauaccuuauggucuaacggcguauuagagucugagaugaucauuccuaaaaucuacgggggcccaauuucucaacacaacuaccgcccuggcuauuuuacccaaacugcgggccccuggcaccuggggaagcucgagcuggacuucgacuugugcgagggcacgacuguggucgucgacgagcacugcgggaaucgggguccgucauugcgcaccaccacggucaccgguaagaucauccacgaguggugcugccgcucuugcacacugccacccuugagauuucgcggggaggauggauguugguacgggauggagauccggcccgugaaggagaaggaggagaaccucgucaagucuaugguaucggcuggcagcggcgaaguggacuccuucagccuggggcuucucugcauuuccaucaugaucgaagaggucaugcguucgcguuggucaagaaagauguugaugacagggacgcuggccguuuucuuccuguuaauaauggggcaacugaccuggaaugaucugauuagguuaugcaucauggugggcgcaaaugcaagcgaccgcaugggcaugggcaccaccuacuuggcacucauggccacguucaagaugcgucccauguucgccgucggccuccuguuccgccggcucaccucccgggagguacuguuacuaacuauaggacugagucugguggccuccguagagcuacccaacucacuggaggagcugggcgacggguuggccaugggcaucaugauccuuaaacugcuuaccgacuuccagagccaccaacugugggcuacucuacucucacucacauucaucaagaccaccuucucccuucauuacgccuggaagacgauggccaugguguugaguaucgugagccugcuccccuugugccugucuaccacaucccagaagacuacguggcugcccgugcuccuggguucauuggggugcaagccgcucaccauguuccugaucgccgagaauaaaaucuggggucggcgcuccuggccccugaacgagggaauuauggccguagggaucguuagcauccuccucagcucccuacucaaaaaugaugugccccuagccgggccccugauagccggggguauguugaucgcaugcuacguaaucucggggucuagcgcggaccuuucgcuggaaaaggccgccgagguaucgugggaggaggaggccgagcacucuggagccagccacaacauucucguggaagugcaggacgacgggacuaugaagaucaaagacgaggaacgggacgacacgcugacuauccucuugaaggcaacucuguuagcggugaguggcgucuauccguugagcauucccgccacccucuucguuugguacuuuuggcagaaaaagaagcagcgaucagggguccugugggacacucccagcccucccgaagucgagcgggccguacuugacgacggcauuuaccguauaaugcagagaggccugcuuggucgcucccaggucggcgugggcguauuccaggagaaugucuuucacaccauguggcacgugacgcguggggccgugcugauguaccaggggaaacgccuagagcccagcugggcuucugucaaaaaggaccuuaucagcuacggaggcggguggcggcugcagggguccuggaacaccggggaagaagugcaagucaucgccgucgagccgggcaaaaaccccaaaaacguacaaaccgcaccugggaccuucaaaacgcccgagggcgaggugggcgccauagcgcucgacuucaaaccaggaaccagcggcucccccaucgucaaucgcgaggggaagaucguaggacucuauggcaacgguguggucaccacaucaggcacguacguguccgcgaucgcgcaggccaaagcaucccaggaagggccgcuaccugaaaucgaggacgagguuuuccgcaaacgcaaucucaccaucauggaccugcauccgggcuccgggaagacucggcguuacuugccggcgaucguacgggaggcaaucaagcgcaagcucagaacacugauacuggccccuacgagagugguggccuccgagauggccgaggcucucaagggcaugcccauccgcuaccaaacuaccgcgguaaaaagcgaacauacaggcaaagagaucguggaucuaaugugccacgcaacauucacaaugcggcuacucuccccugugcgcgucccgaauuacaauaugaucaucauggacgaagcccacuucacagaccccuccaguauagccgcgagaggguacaucagcacacgcguuggcaugggggaggccgcagccauauucaugaccgccacgccgccagguuccgucgaagcguuuccgcagagcaaugccgucauucaggaugaggaacgugauauacccgagcgcuccuggaacucaggguacgaguggaucacugacuuucccggcaagaccgugugguuugugcccucaaucaaaucgggcaaugacauagccaauugccugcggaaaaacgggaagagagucauccagcugucacggaagacauuugacaccgaguaccaaaagaccaagaauaacgacugggacuacgugguaaccacagacaucagcgaaaugggcgccaacuuccgcgcugaucgggucauagaccccaggcgaugccucaagcccgugauccuaaaggaugggcccgaacgcgugauacuugccgggcccaugccuguuacgguagccuccgccgcccagcgucgcggccggaucggccgcaaucacaauaaggaaggcgaccaguacaucuacaugggacaaccccucaacaacgacgaagaccacgcgcacuggacugaggccaagaugcuguuagauaacaucaacacccccgagggaaucauccccgcccucuucgagccagaacgagagaagucggcagccauugacggcgaauaccggcugcgcggggaggcgcgaaagacguucguagagcugaugcgccgaggagaccuacccgucuggcugaguuacaagguggcuuccgagggcuuccaauacucugauaggagauggugcuucgauggcgagagaaacaaccaaguccuggaggaaaauauggacguugagaucuggaccaaggagggggagcggaagaaacuucgcccgcgguggcucgacgcucgaaccuacuccgacccccuugcucugcgggaguucaaggaguuugccgcugguagacguucggucuccggcgacuuaauacuugagaucggcaagcucccgcaacaccugacgcagcgcgcgcaaaacgcacuugacaaccucgucauguuacacaacuccgagcaaggcggucgggccuaccgccacgcaauggaggaguugcccgacacgaucgaaacccucaugcugcucgcccucaucgccgugcucacgggugggguaacccuguucuuccucucgggcagagggcuaggcaagacuucaaucggacugcucugcguaauggcguccucaguauuauuauggauggcguccguggagccccacuggauagcggccuccaucauccucgaguucuuccugaugguuuuauuaauccccgaacccgaccggcagcggacgccccaggacaaccagcuggccuaugugguuaucggacuucucuuuaugauccugacgguggccgccaacgagaugggccuacuggaaaccacuaagaaagaccuggguaucggccacguagcgguggaaaaccaucaccacgcugcaaugcuugacgucgauuugcaccccgccuccgcguggacgcuguacgcgguggccaccaccauaaucacacccaugaugcgacauaccaucgagaacacuaccgccaacauaucccucaccgccaucgccaaccaagcggccauacugauggggcucgacaagggcuggcccauaaguaaaauggacaucggcgugccgcugcucgcgcucggguguuacagccaagucaaccccuugacguuaaccgccgccguguugaugcugguggcccacuacgccauuaucgggccugggcuccaggcuaaagcuacccgcgaggcucagaaacguaccgccgccggcauuaugaagaacccaacuguggacgggaucguggcaauagaccuggaccccgugguauacgacgcgaaauuugagaagcagcuaggccagaucauguugcugauccugugcaccucccagauccuccucaugcgcaccaccugggcccugugcgaaagcaucacguuggccaccgguccacuaaccacacugugggaaggcuccccagggaaguucuggaacacgaccaucgccguguccauggccaacaucuuccgcggguccuaucucgccggcgcuggucuugccuucagccucaugaagucccuagggggagggaggcggggcaccggagcgcaaggcgagacacucggcgaaaaguggaaacgccaacugaaucagcucaguaagucagaguuuaacacguauaagcggucagguaucauggagguugaucgcuccgaggcaaaggagggacuaaagagaggggagaccacaaagcacgcggucucccgcggcaccgcgaaacugaggugguucguggagcgcaaucuggugaagcccgaagguaaagucaucgaccucggaugugguagagguggguggagcuacuacugcgccggguuaaagaaagucaccgaggucaagggguacacgaagggcggaccaggucacgaggaaccgaucccuauggccacauacgguuggaaccuggucaaguugcauuccgggaaagacguguucuucauaccacccgagaagugcgauaccuugcugugcgacauuggggagagcuccccuaauccgaccaucgaggaaggccgcacucuucgagugcucaaaaugguagaacccuggcuccggggaaaucaauuuugcaucaaaauccucaaucccuauaugccuagcgugguggagacucuggaacagaugcagcgcaaacauggcgggauguuaguccgaaacccguuguccagaaauagcacacacgagauguacugggugagcugcggaaccgguaacaucgucagugccgucaauaugacgucccggaugcuacugaaccgguucaccauggcucaccggaagcccaccuacgaacgcgacguagaccucggggcuggcacacggcacguggcagucgaaccagaaguggccaaucuagacauaauaggucagcgcauugagaacaucaaacacgagcacaaaaguacguggcacuacgaugaagacaacccauauaagacgugggcguaccacggauccuacgaggugaagccgagugguagcgccagcagcaugguuaauggggucgucaagcugcucaccaagcccugggacgugaucccaauggugacccagaucgccaugacugacaccaccccguucggccaacagcgugucuucaaggagaagguggacaccaggaccccaaaagcuaagcguggaaccgcccagauaauggaggucaccgcuaaguggcucuggggcuuuuugaguaggaacaaaaagccccgaaucugcacccgcgaggaguucacgcguaagguucgcagcaacgcagccaucggugccguauuuguggacgagaaccaauggaacuccgccaaggaggcuguugaagacgagcgguucugggaucugguacacagggagcgggagcugcauaagcaggggaagugcgcgaccugcguguauaacaugaugggcaaacgggagaagaagcugggggaguucgggaaggcuaaaggaagcagagccaucugguacauguggcucggugcucgcuuucuggaguucgaggcacugggauuuaugaaugaggaccacugguucagccgugagaacagccucuccggggucgagggcgagggacuucauaaacuuggguacaucuugcgagacauaaguaaaaucccagggggaaacauguacgccgacgacacggcuggcugggacacccguauaacggaggaugaccugcaaaacgaggcacguaucacagacauuauggaaccagagcaugcacuucuggcuaagaguauauuuaaguugacauaccagaacaaggugguacgcguccagaggcccgcuaagaacggcaccgugauggacgugauuagccgccgggaccaacgcggcuccgggcaggucggcacguauggucucaacacguuuaccaacauggaggcccagcuuauccgacagauggaaagcgagggaaucuucucccccagcgagcuugagacucccaaccuggcuaaacgcgucuuggacuggcuggagaaguauggcguagagcggcugaagcgcauggccaucucuggggacgacugcguugugaaaccgaucgacgaccgguuugcgacggcucucaccgcccugaacgauaugggcaaggugcgcaaggacaucccccaaugggaacccagcaagggguggaacgacuggcagcagguccccuucugcucccaccacuuccaucagcugauaaugaaggauggccgggagaucguggugcccugccgcaaccaggacgaguuggugggccgggcccggguuucgcagggagcuggauggagccugcgggaaaccgcuugucugggcaaguccuacgcccagauguggcaacucauguauuuccaccgccgggaccugcgacuggcggccaacgcaaucuguagcgccguccccgucgacuggauuccaaccucgcggacgaccuggucuauccacgcucaucaccaguggaugaccacggaagauaugcucucuguuuggaaucgcguguggauagaggagaaucccuggauggaggacaaaacgcacaucagcuccuggggcgacgucccauaccuagggaaacgagaggaucaguggugcggcucccugaucggacucaccgcacgggcgaccugggcaaccaauauccaaguggcgauaaaccaggugcgaaggcugauagggaacgagaacuaccuggacuacaugacguccaugaagcgcuucaaaaacgaaagcgaccccgaaggcgcgcuaugguag

SEQ ID NO: 24196 - RNA, 9879 nt, Artificial Sequence
  derived and/or modified CDS sequence (opt11) from DENV-1__FJ461319__SS-prME
agcgugaccaugcugcuaaugcugaugcccacggcccuggccuuucaucuaaccacccggggcggggaaccccauauggugguuucaaagcaagaacggggcaagagccuucuguucaagaccagcgccgggguaaauauguguacccucaucgccauggaccucggcgagcugugcgaagacaccaugaccuacaagugcccccggaucacagaagcagagccagacgacguggacugcuggugcaaugcuaccgauacgugggucaccuacgggaccuguucacaaaccggcgagcaccggcgagacaagcgcuccguggcgcucgcgccccacgucggcuuggggcucgagacucgcaccgagacguggauguccuccgagggagcauggaagcaaauacagcguguugagaccugggcccuccgccacccgggguucacggugaucgccuuguuccuagcccacgcuaucggcaccagcauaacccaaaaggggauaaucuucauccuccugaugcuggucacccccuccauggccaugcggugugugggcaucggcagccgcgacuucguggagggguuauccggcgccacgugggucgacgugguucuggagcacgggucuugcgugaccaccauggccaaggacaagcccacacuggacaucgagcuccugaaaacggagguuaccaacccggccauccugcggaagcucuguaucgaggcgaagauuuccaacaccaccacggacucucgcugcccgacccagggcgaggcgacccuggucgaggagcaggacgccaacuucguuugccgacguaccuucgucgacagaggcugggguaaugggugcggccuguucggcaagggaucccucaucacgugcgccaaguucaaaugcgugacaaagcuggagggcaaaaucguucaguacgagaaccugaaguacucgguaauugugaccguccacaccggcgaccagcaccaggugggcaaugaauccacggaacacggcaccaccgcgaccaucacgccccaggcccccacgaccgagauccaacucaccgacuacggagccuugacucuagacugcagcccccgcacgggccucgacuucaacgagauggugcugcugaccaugaaggagaagucuuggcuugugcacaagcagugguuccuggaccugccgcuccccuggaccagcggggccagcacaagccaggagacguggaaccggcaagaccugcuggugaccuucaagaccgcccacgcgaagaagcaggaagucgugguguuggguagccaggagggcgcuaugcacacugcccugacgggggccaccgaaauccaaaccucgggcaccacgaccaucuucgccgggcaccugaagugccgccuuaagauggacaagcugacccugaagggcaugagcuacgucaugugcaccggguccuucaagcucgagaaggaaguggccgagacacaacacggcaccgugcuggugcagaucaaguacgaggggaccgacgccccaugcaagauccccuucagcacccaggacgagaagggggucacgcagaacggccggcuaaucaccgccaauccgauagugaccgacaaagagaagcccgucaacaucgaagccgaaccgcccuuuggggagucauauaucgugaucggcgccggggagaaggcgcugaagcucagcugguucaagaagggguccagcaucggcaagauguuugaggccaccgcccgcggggcccgaagaauggcgauccugggugacacugcaugggauuucggguccaucggcggcguguucaccagcgucgggaagcugguccaccagauuuucgggaccgcauaugggguccuguucaguggggucuccuggaccaugaagaucggccugggcguccuacucacguggcugggccugaacucccgcagcaccucucuaagcaugaccugcaucgcggugggccucgucacccuguaucucggcgucauggugcaagccgacuccgguugugucaucaacuggaaggggagggaguugaagugcgggagcggaaucuucgugacgaacgaggugcacaccuggacggaacaguacaaauuucaggcugacagccccaagcgccuguccgccgccaucgggaaagccugggaggagggggucugcggcauccggagcgccaccagacucgagaacgugauguggaagcaaaucuccaacgagcucaaccauaucuuacucgagaacgacaugaaguucacaguugucgugggcgacguggcgggcauccuggcccaagggaaaaagaugauccggccccagcccauggagcauaaguacagcuggaaguccuggggcaaggcaaagauaaucggcgccgacguccagaacacgacguucauuaucgacgggccgaacacgccggagugccccgacgaucagcgcgcguggaacaucugggagguggaggacuacggcuucgggauuuucacuacgaauaucuggcuaaagcuccgggacuccuacacccaggugugcgaccaucgucuuauguccgcggccaucaaggacagcaaagccguccacgccgacaugggcuacuggaucgaaagcgagaagaaugagaccuggaagcucgcgcgcgccagcuucauugagguuaaaaccuguaucuggcccaaaagucacacacucuggagcaauggcgugcucgagagugaaaugauaauucccaagaucuacgggggcccgaucagccagcacaauuaccgccccggguacuucacacagaccgccggccccuggcaccuggggaaacuugagcuggacuucgaccugugcgagggcacgacggucguaguugacgaacacugcggcaaccgugggccgucccuccgcacaaccaccgucacaggcaagaucauucacgaguggugcugccggagcugcacucuuccgccgcugcgcuucaggggagaggacggcugcugguacgggauggagauccgccccgugaaagaaaaggaagagaaccucgugaaguccauggugagcgccgggagcggcgaaguggacuccuucagccugggccugcucugcaucucaaucaugaucgaggaaguaaugcggagccgcuggucgcgcaagaugcugaugaccgguacucuugccgucuucuuacugcucaucauggggcagcucacguggaacgaucugauccgccuguguaucauggugggcgcgaacgcuucugaccgcauggggaugggcaccacguaccucgcccugauggccacuuucaagaugcggccgauguucgccguggggcuguuauuucgccgacugacgucacgcgagguccuccuacucaccaucgggcugagccucguggcuuccgucgagcugccgaacucccuggaggaguugggggacggacuggccaugggcaucaugauccugaaauuacugaccgacuuccagucccaccagcucugggccacucuccucagcuugacauucauaaagaccacuuucucccuccacuacgccuggaagaccauggcgaugguccugagcauaguguccuuauuuccccuaugccugucuacgaccucccagaagaccaccuggcuucccgugcucuugggcagccuggggugcaagccgcugacgauguuccugaucgcugaaaacaagaucuggggccgucgaucguggccccugaacgaagggauuauggccgugggcaucgugagcauccuccugucuucccugcucaagaaugacgucccccuggccgggccacuaaucgccggcggcaugcuuaucgcguguuacgugauaagcggaagcagcgcugaccugucccuggagaaggcagccgagguaagcugggaagaggaagccgagcauuccggcgcgagccacaacauccuggucgagguccaggaugacgggaccaugaagauaaaggacgaggagcgagaugacacccugacgauccugcuuaaagccaccuugcuggcuguaagcggcgucuacccgcucagcauccccgccacgcuguuugugugguauuuuuggcagaagaagaagcaacguuccggaguacugugggacacccccagcccgcccgaagucgaaagagccgugcuggacgacggaauauaccgcaucaugcagcguggccuccuggggcgcucccaggugggcguuggcguguuccaagagaacguuuuccauaccauguggcacgucacccgaggcgcgguguugauguaccaggggaagcgccucgaacccagcugggccuccgugaagaaggaccucaucucauauggcggcggguggcggcugcaggguuccuggaauacgggggaggagguccaggugaucgcggucgagcccggcaagaaccccaagaacguccagaccgcccccggaaccuucaaaacgcccgagggcgaggugggcgccaucgccuuagacuuuaaaccggggacgaguggcucucccaucgugaaccgagaggggaagaucguaggccuauacggcaacggugucgugaccacaagcggcaccuacguuucggccaucgcccaggccaaggcgucccaggagggcccgcuuccugagaucgaagacgagguguuccggaagcguaaccucacgauaauggaccugcacccuggcagcgggaagacccggcgcuaucugccggccaucguuagagaggccaucaagcgaaagcugcgcacgcucauacuggcccccacgcggguagucgcgagcgagauggccgaggcccucaaaggcaugccgauucgcuaccaaaccaccgccgucaagagcgagcacacaggcaaggagaucgucgaucugaugugucacgccaccuucaccaugcggcuacucucucccgugcgcguuccuaacuacaacaugauaauuauggacgaggcccacuucaccgaccccagcuccaucgcggcccgagguuauaucagcacccgcgucggcaugggggaggcugcugccaucuucaugacugcgacgccgccuggcuccgucgaggccuucccgcagucgaacgccguaauacaagacgaggagagggacauccccgaacgcuccuggaacagcgguuacgaguggaucaccgacuuccccggcaaaaccgucugguucguccccuccaucaagagcggcaaugacaucgccaacugccugcggaagaaugggaagcgcgugauccaguuaucccggaagaccuucgauacagaguaucagaagaccaagaacaaugauugggauuacgucguuacuaccgacaucuccgagaugggggcgaacuuccgcgccgaccgcguaauugacccgcgccggugccuaaagcccgucauccugaaggacgggccggaacgcgugauccuggccggccccaugccgguaacgguggccuccgccgcucagcggcgcggucggaucggccgcaaccacaacaaggagggcgaucaauacaucuacauggggcagccccucaacaacgacgaggaucaugcccacuggaccgaggcuaaaaugcugcuggacaacaucaacacgcccgagggcaucaucccugcccucuucgaaccggaacgcgagaaauccgcagcgaucgacggggaguaccggcuacgcggcgaggcccggaagaccuuuguggagcuuaugcgcaggggugaccucccgguauggcuguccuacaagguggccagcgaggguuuucaguacagcgaccgccgguggugcuucgacggcgagcgcaacaaccaagugcuagaggaaaacauggacgucgagaucuggacgaaggaaggcgaacggaagaagcucagaccccguuggcuggacgcccgcaccuauuccgacccccuggcccuccgggaguucaaggaguucgcggccggccgccggagcgugucuggggacuugauacuggagaucgggaaacucccgcaacaccugacgcaacgcgcacaaaacgcacuggacaauuuggugauguuacacaacucggaacagggcgggcgggcguacagacacgccauggaggaacugccggacaccaucgagacgcucaugcugcuagccuuaaucgccgugcugaccggcggggucaccuuguucuucuuaaguggccgugggcugggcaaaaccucgauuggccuucucugcgugauggcauccagcguccuguuguggauggcguccguggagccccacuggauagccgccucgaucauccucgaguucuuucugauggugcugcucaucccagagccggaccgucagcggacgccccaggacaaccagcuagcuuacgucguaauaggcuuacucuucaugauccugacgguggccgcgaacgagaugggccugcuggagacgaccaagaaagaccuggggaucggccacgccgccgucggaaaucaucaccacgccgccaugcuugacguggaccuccaucccgcauccgccuggacucuguacgccguggccacuacgaucauuaccccgaugaugcgccacacgauugaaaauacgaccgccaacaucagccugacagccaucgccaaccaggccgcuauccucaugggccuggacaaaggcuggccaaucucaaagauggacauuggcguccccuugcucgcucuggggugcuacucucaaguuaacccuuuaaccuugacugcggccgugcugaugcuagucgcucacuacgccaucaucgggccaggccuccaggcgaaggcgacacgcgaggcccagaagcgaaccgccgcggggaucaugaagaauccuaccguggaugguaucguggcuaucgauuuagaccccgucguguacgaugccaaguuugagaaacagcugggucagauuaugcucuuaauccuuugcacgucccagauccuccugaugcguacuacaugggcccugugcgagagcauuacacucgccgccgggccgcugacgacucuuugggaaggaucuccggggaaguucuggaacacgaccaucgcggucagcauggccaacaucuuccggggcuccuacuuggccggggcugggcuggcguuuagccucaugaagucccucggcggagggcgccgggggacuggcgcccagggcgagaccuuaggggagaaguggaagcggcagcugaaccagcucaguaagagcgaguucaacaccuacaagcgauccgggaucauggagguagacagaucagaggccaaggaggggcugaaaaggggcgagaccacgaaacaugccgugucccggggcaccgccaaacuucggugguucguggagcgcaaccuggucaagcccgagggcaaggugaucgaccucggcugcgggcggggcggguggagcuacuauugcgcgggccugaagaaggugaccgaggucaaaggguacacgaaagggggccccggacacgaggagccgaucccgauggccacuuauggcuggaaccuggugaagcuccacuccggcaaagacguguucuucaucccucccgagaaaugcgacacuuuacugugugacauaggcgaaagcucccccaauccgaccaucgaggaggggcggacccuccggguccugaagaugguggagccguggcugcgcggaaaucaauucugcauaaagauccucaaccccuauaugcccagugucgucgagacgcuugagcagaugcaacggaaacacggcgggaugcuggugcgcaacccccucucccggaacaguacucaugagauguacuggguauccugcgggacugggaauauagucagcgcuguaaacaugacuucccgcaugcuucugaaucguuuuaccauggcccaccgaaaacccacguacgagcgcgacguggaccucggagccggcacccggcacguggcgguggagcccgaaguggccaaccuggacauuaucgggcagcgcaucgagaauaucaagcacgaacacaaaagcaccuggcacuacgacgaggacaaccccuacaaaacaugggccuaccacggcuccuaugaagucaaaccgucagguuccgccuccucgauggugaauggagucgucaagcugcucacgaagcccugggaugugaucccaauggucacccagaucgccaugaccgacacgacgcccuucggacagcagcgcguguucaaagagaagguggacacccgcacccccaaggcgaagcgcggcaccgcccagaucauggaggugacggccaaguggcucuggggcuuccugucccgaaacaaaaagccccggaucugcaccagggaggaguucacccgcaaagugcgcagcaacgccgcgaucggggccguguucgucgaugagaaccaauggaacuccgccaaggaggcgguggaggacgagcguuucugggaucucguacaccgcgagcgggaacugcacaagcagggcaaaugugcaaccugcgucuacaacaugaugggaaaaagggagaagaaacuuggugaguucgggaaggcgaagggcagccgggcuaucugguacauguggcucggcgcccgcuuccuggaguuugaggcacugggguucaugaaugaggaucacugguucucccgggagaacagccuuuccggcguggagggggaaggccugcauaagcugggauacauucugcgcgacauuagcaagauacccgguggcaacauguacgccgacgauacggcggggugggacacgcgcauaaccgaggacgaccuacagaacgaggcccgcaucaccgacauuauggagccggagcacgcacuccucgcgaagucgauauuuaagcugacguaccagaacaaggucguacgcguacagcggcccgccaagaauggcacaguuauggacguuaucagccgcagagaucagagaggcuccggucaggugggaaccuacgggcugaacaccuucacgaauauggaggcgcaguuaauacggcagauggaaucugagggcaucuuuucaccaucggagcuggaaacccccaaccuggccgagcgcgugcuagacuggcuugagaaguacggagucgagcggcugaagaggauggcaauuuccggcgacgacuguguggugaaaccgauugacgaucgguucgccacugcccucaccgcgcugaacgacaugggaaagguccgaaaagacaucccccaaugggagcccagcaaggguuggaacgacuggcaacaagucccauucugcucccaccacuuucaccagcugaucaugaaggacggcagagagaucguggucccgugccgaaaccaggacgagcucguggggagggcccgcgugagccaaggcgcgggauggucccugcgggagacggccugccugggcaaguccuacgcgcagauguggcagcucauguacuuccaccgacgcgaccuacgccuugccgccaacgccauuugcagcgccguccccguggacuggaucccaaccagccggaccaccuggagcauccacgcgcaccaucaguggaugacgaccgaagacaugcucuccgucuggaaucgcgucuggaucgaagagaacccuuggauggaagacaagacccacaucucguccuggggcgacguaccguaccugggcaaacgggaggaccaguggugcggcagccuaaucgggcuaaccgcccgggcaacaugggccaccaacgugcaggucgccaucaaccaggugcggcggcugaucgguaacgagaacuaccuggacuacaugacguccaugaagcgcuuuaaaaacgaaagcgaccccgaaggagcgcuaugguga

SEQ ID NO: 24197 - RNA, 9879 nt, Artificial Sequence
  derived and/or modified CDS sequence (opt11) from DENV-1__FJ461320__SS-prME
ucagugaccaugcugcucaugcugaugcccaccgcccuggccuuccaccugacuacccgggggggcgagccccauaugaucgugaccaaacaggagcgcggcaaaagccugcuguucaaaaccagcgcagggguaaacaugugcacccucaucgccauggaccugggggagcuuugcgaggacacaaugaccuacaagugcccccggaucaccgaggccgagcccgacgacguggauuguuggugcaacgccaccgauacaugggugaccuacgggaccugcucucagacgggagagcaccggagagacaagcggagcguagcacucgcgccacacgugggucuagggcuggagacgcgaaccgaaaccuggauguccagugaaggcgccuggaagcagauccagcggguggagacgugggcccuccgccaccccggguucaccgugaucgcgcuguuucuggcgcacgcuaucggcaccaguaucacacagaaggggaucaucuucauccuccugaugcuggugacgcccucaauggccaugcggugcgucggcaucggaucccgcgacuucguggaggggcucucaggcgccaccuggguggacgugguacuggagcauggguccugugugaccaccauggccaaggacaaacccacccuggacauagagcuccugaaaacggaagucaccaaccccgccgugcugcggaaacucugcauagaggccaagaucagcaacaccacaacagauucccgcugcccgacucagggcgaggccacccuaauggaggagcaggacgcgaacuucgugugcagacgcacguucgucgaucggggcugggggaacggcugcgggcuguucggcaaggggagccucaucacgugcgccaaauucaagugcgugaccaaguuggagggcaagauugugcaguacgagaaccucaaguacuccguaaucgugacgguucauacaggcgaccagcaucaggucggcaacgagagcacagaacacggcaccaccgcgaccauuacgccgcaggcccccaccuccgagauacagcugaccgacuacggggcccugacccuggacugcagcccccguacgggccucgacuucaacgaaaugguccuauuaaccaugaaggagaaguccuggcucguccacaagcagugguuccuggacuugccgcugccuuggaccagcggggcgagcaccucacaggagacguggaaccggcaggaccugcuggugaccuuuaagaccgcccaugcgaagaagcaagaaguggucgugcucgggagccaggagggcgcaaugcauaccgcgcugacgggggccaccgagauccagacauccggcaccacuaccaucuucgccggacaccugaagugucgacucaagauggauaagcugacccugaagggaauguccuacgugaugugcaccggguccuuuaagcucgaaaaggaaguugcagagacgcagcacggcaccgugcuggugcagaucaaguacgagggcaccgacgcccccuguaagaucccauucagcacucaggacgagaaggggguaacgcagaacggucggcugaucaccgccaacccgaucgugaccgacaaggagaagccugugaacaucgaggccgagccgcccuucggggaguccuacaucgucaucggcgcgggcgagaaggcccugaaacucagcugguucaagaagggcuccagcaucggaaagauguucgaggccaccgcccgcggugcccggcgcauggccauccugggcgacacggccugggacuucggauccgugggcggcguuuucaccagcgucgggaagcuuguccaccagaucuuuggcaccgccuacgggguccuuuucagcggcgucagcuggaccaugaagaucgggaucggcguucugcugacuuggcucggccugaacucccggagcaccucccugaguaugaccugcaucgcaguggggcucgucacgcuguaccuaggagugauggugcaggccgacuccgggugcgucaucaacuggaagggccgugagcucaagugugggucgggcaucuucguuacgaacgaggugcacacauggaccgagcaguacaaguuccaagcggacagcccgaagcgccuguccgccgccaucggaaaggccugggaagaggggguaugcggcaucaggucggccacccgccuggagaacauuauguggaagcagaucuccaacgagcuuaaccacauccuguuggagaacgacaugaaguuuaccgugguagucggggacguggugggcauccuugcgcaggguaaaaagaugauccggccccagcccauggagcacaaguacagcuggaagaguuggggcaaagccaagauaauaggcgccgacguccagaacacgaccuucaucaucgaugggccuaacaccccggagugccccgacgaccagagggcauggaacauaugggagguagaggacuauggcuucgggauauucaccacgaacauaugguugaaacugcgcgacagcuauacccaggucugcgaucaccgacucaugucugcggcaaucaaggauuccaaggccguucacgccgacaugggcuacuggaucgagucugagaagaacgaaaccuggaagcuggcccgggcgagcuucaucgaggugaagacuugcaucuggcccaagucacacacgcucuggagcaacggcgugcucgaguccgagaugauaauccccaagaucuacgggggcccgaucucacagcacaacuauaggccaggguauuucacccaaacggccgggcccuggcaccuagggaaacuggagcucgacuucgaucugugcgagggcaccacggucgugguggacgagcacugcgguaaccgggggccgucccugcgcaccaccaccgucacaggaaagaucauucacgagugguguugcaggagcuguacccugccgccacucagauuuaaaggggaggacggauguugguacgggauggagauccggcccguaaaggagaaggaggagaaucuagugaaguccauggucagcgcugguagcggugagguggacuccuucagccuugggcugcugugcaucuccaucaugguggaggagguuaugcgcagcagauggucccgcaagaugcucaugacgggcacccuggccguauuccugcuccucaucauggggcagcucacguggaaugaccucauccggcugugcaucauggugggcgccaacgccagcgaccgcaugggcaugggaaccacguaucuggcccucauggccacuuucaagauccgcccgauguucgcugucggccucuuauucagacgauuaacgucccgggaagugcugcugcucaccaucggucugagccuggucgccuccgucgaacucccgaacagccuggaggagcugggcgacggguuagcgaugggcauuaugauccugaagcuucuuaccgacuuccaaucgcaucagcugugggccacgcuguuaagccugacuuucauuaagaccacccucucccuccacuacgccuggaagaccauggccauggugcugucuaucgucucccuguuccccuugugccugagcacgacuucccagaagaccacguggcuccccguguuacugggcagccuggggugcaagccguuaacgauguuccugaucacagagaacaagaucuggggccgcaaguccuggccccugaacgaggggaucauggcggugggcgugguguccaucuuacugagcucccugcucaagaaugacgucccccuggcugggccgcugaucgcaggcgguaugcucauagccugcuacgugaucagcggcuccagcgcggaccugucucuggaaaaggcggccgaagugagcugggaggaggaggccgaacacucuggcgccagccacaacauacucguugagguccaagacgacggcaccaugaagaucaaggacgaggagcgggaugacacccugaccauccugcucaaggccacccugcuggcgguuuccgguguguacccgcucagcaucccagcaacccuguucgucugguacuucuggcagaagaagaagcaaagguccggcgugcugugggacacccccagcccgcccgagguggagagggccguccuggacgacggcauuuaccgcaucaugcagcggggccucuuggggcgcucccaggugggcgugggggucuuccaggagaacguguuccacaccauguggcacgugacgcggggugccgugcugauguaucagggaaaacgccuugagcccagcugggccuccgugaagaaggaccugaucagcuacggcggcggguggcgguugcagggcuccuggaacaccggggaggaagugcaggucaucgcuguggagcccggcaagaacccgaaaaacguacaaaccgcgccagguaccuucaagacuccugagggcgagguuggugccauagcacucgacuucaagcccggaaccucuggcucgcccaucgugaaccgggagggcaaaaucgucggccuguacggcaacggggucgugaccaccagcggcacuuacgucagcgccauugcgcaggcuaaggccucccaggaggggccgcugcccgagaucgaggacgaggucuuccggaagcgcaaccucaccaucauggaccuucaccccggaagcgggaagacgcggcgcuaccuuccggccaucgugcgggaggcgaucaagagaaagcuccggaccuuaauccuggcccccacgcgcguggucgcuuccgagauggccgaggcccucaagggcaugcccauacgcuaucagacaaccgcggucaagagcgagcacaccggcaaggagaucguggaccugaugugccaugccacguucaccaugagacuguuaucuccgguccgaguuccuaacuauaacaugauaauuauggacgaggcccauuucaccgaccccagcuccaucgccgcccguggguacaucagcacgagaguggggaugggagaggcggccgcgaucuucaugacggccacgccgcccggcuccgucgaggccuucccgcaaagcaacgcggugauccaggacgaggaacgggacauccccgagcgcuccuggaacagcggguacgaguggauaaccgacuuccccggcaagaccgucugguucgucccauccauaaaguccggcaacgacaucgccaacugccugcggaagaacgggaagcgcgucauccagcucucgcggaagacguucgacaccgaguaccagaagaccaagaacaaugacugggauuacguggugacgacggauaucagcgagaugggcgccaauuuccgcgcugaccggguaaucgacccucgccggugccucaagccggugauccugaaggacggcccugaacgcgugauccuggcgggccccaugccggugaccgucgccucugcggcccagcgccgcgggcggaucggccgcaaccacaauaaggagggcgaccaguauaucuacauggggcagccccucaacaaugacgaggaccacgcccacuggaccgaggcgaagaugcugcuggacaacaucaacaccccggagggcaucauccccgcccucuucgaaccagagcgggagaaguccgcugccauagauggcgaguaccgccucagaggagaggcccggaaaacguucguggagcugaugcgccgcggggauuuacccguguggcuguccuauaagguugcgagcgagggcuuccaguauucggaccgacgguggugcuucgacggcgagagaaacaaccagguguuggaggaaaacauggacguggagaucuggaccaaagagggggagcgcaagaaacuccgcccccgguggcuggacgcccgcaccuauuccgacccccuggcucuccgggaguucaaggaguucgccgccggccgccggagcgucuccggggaccugauccuggagaucggcaagcuuccgcagcaccugacccagcgcgcgcaaaacgcccuggacaaucuagugaugcuccacaacagcgagcaaggggggcgggccuaccgccacgccauggaggaguugcccgacaccaucgagacccucaugcugcuggcucucaucgcagugcugaccggcgggguaacccuguucuuccucuccggccgagggcugggcaagacguccaucggccuucucugugugauggccagcagcgugcugcucuggauggccagcgucgagccccacuggaucgccgcgagcaucauccuagaguucuuccugauggugcugcuaaucccggagcccgaucgacagcggacgccccaagauaaccagcuggcguaugugguaaucggucuccucuucaugauucugacgguggccgccaacgagaugggccugcucgagaccaccaagaaggaccugggaauuggccacguggcgguggagaaccaccaccacgcgacgaugcuggauguggaucuccaccccgccuccgccuggacccuguacgccguggccacuaccaucaucaccccgaugaugaggcacacgaucgaaaacaccaccgcgaacaucagccuaacggccaucgcuaaccaggccgccaucuugauggggcuggacaaaggcuggcccaucuccaagauggauaucggcguccccuugcuggcucuggggugcuauagucaggugaaucccuuaaccuuaaccgcggccgugcugaugcuggucgcccacuacgcgaucauaggcccggggcuccaggccaaagccacacgggaggcccagaagcguacugccgcgggcaucaugaagaaccccaccguugacgguaucguggccaucgaccuggaccccguuguguacgacgccaaguucgagaagcagcugggccagaucaugcucuuaauccugugcaccucgcagauccuccugaugcgcaccacgugggcauugugcgagagcaucacccucgcuaccggcccccugaccacgcugugggagggguccccuggcaaguuuuggaacacaaccaucgcugugagcauggccaacaucuuccgggguagcuaccucgccggcgcuggccuggccuucagccugaugaagucccucggaggcggccgccggggcacgggggcgcagggcgagacguugggagagaaguggaagcggcagcugaaccaacucucaaagagcgaguucaacauauacaagcgguccgggaucauggaggucgaccgcucagaggccaaagaaggccugaagcgcggggagaccacacgccacgcugucagccgcggcaccgcuaaguugcgaugguucguggaacggaaccuggucaagccugaggggaaggugaucgaccucggcugcggacgcgggggcuggagcuacuacugcgcggggcugaagaaggugacggaggucaagggcuacaccaagggcgggcccgggcacgaagagcccaucccgauggccaccuacggguggaaccuaguaaaacuccacagcggcaaggauguauucuuuacgccgcccgagaaaugcgacacgcugcugugcgacauaggcgagucuucccccaauccgacaauagaggaggggcggacccugcguguccugaagaugguggaaccauggcugcgggggaaccaguucugcaucaagauccucaaccccuacaugcccuccguggucgaaacccuugagcagaugcagaggaaacacggcgggaugcuggugcggaacccgcuuucccgcaauagcacccaugagauguacuggguguccugcggaacgggcaacaucgucagcgccgugaacaugacaucacgaaugcugcugaaccgcuucaccauggcccacaggaaacccaccuacgagcgggacguggaccucggcgccggcacgcgccacgucgcgguggagcccgaagucgccaaccucgacaucaucggccagcggaucgagaacaucaagcacgaacacaaaagcacguggcacuacgacgaggacaaucccuauaaaaccugggccuaucacggguccuaugaggugaagccgaguggcuccgccagcagcauggugaacggagucgugaagcugcucacgaagccuugggacgugauuccaauggucacgcagaucgcaaugaccgacaccacucccuucggccagcagcgcguguucaaagagaagguggauacgcggaccccgaaagccaaacgcggaaccgcccagauaauggaggugacugcgcgguggcuguggggcuuccugucccguaacaagaagccucggaucugcacgcgcgaggaguuuacuagaaaggugcguagcaacgccgcuauuggcgcgguguucgucgacgagaaccaguggaauagcgcgaaggaggccguggaggacgagcgguucugggaccuggugcagaaagaacgcgagcugcauaagcagggaaagugcgcgaccugcguguacaacaugaugggcaagcgggaaaagaagcugggugaguucggcaaggcgaaagggagccgggccaucugguacaugugguuaggcgcccgauuccuggaauuugaggcccucggauucaugaacgaggaccacugguucucccgcgaaaauagccucucggggguggagggggagggguugcacaagcugggcuacauccuccgggacaucucuaagauccccgggggcaacauguacgcugacgacaccgcgggcugggacacgcgcauuaccgaggacgaccugcaaaaugaggcaaagaucaccgacauaauggagccggagcacgccuugcucgccaccuccauuuuuaaacugacguaccaaaacaagguaguccgugugcagcgccccgcuaagaacgggaccgugauggacgucaucagcaggcgcgaccagcgcggcuccgggcaggugggcaccuacggacugaacacauuuaccaauauggaggcgcagcucauccggcagauggagagcgaggggauuuuucugccuucugagcuggagacccccaaucucgcggagcgcgugcuggacuggcuggagaaguacggcgucgagcggcucaagcgcauggccaucagcggagaugacuguguggugaagccgaucgaugaccgguucgccacugccuugacggcgcugaacgacauggguaagguccgcaaggacaucccccaaugggagcccuccaagggcuggaacgacuggcaacaagugcccuucugcagccaccacuuccaccagcucaucaugaaggauggccgggagaucgugguaccgugccgcaaccaggacgaguuaguaggccgggcacgcgugucgcagggggccggcuggagcuuacgagagacugccugccucggcaagagcuacgcccaaauguggcagcugauguacuuucaccggcgggaccugcgccuugcggccaacgccaucugcuccgccguccccguugacugggugcccaccagccggacgaccugguccauccacgcccaccaccaguggaugacgacagaggacaugcugagcgucuggaaccgcguguggauagaggagaaccccuggauggaggacaagacccacgugucaagcuggggcgacgucccguaccuggggaagagagaggaccaauggugcggcucccucaucgggcuaaccgcucgcgccaccugggcaagcaacauccaaguugccauuaaccaggugcgccggcuuaucggcaacgagaacuaucucgacuacaugacguccaugaagcgcuucaagaacgagggcgaccccgagggggcgcugugguag

SEQ ID NO: 24198 - RNA, 9879 nt, Artificial Sequence
  derived and/or modified CDS sequence (opt11) from DENV-1__FJ410225__SS-prME
ucggugaccauguugcucaugcugaugcccaccgcucucgcuuuucaccucaccacccgugguggggaaccccacaugaucguguccaagcaggagcggggaaagagccugcuguucaagaccagcgcuggcguuaacaugugcacccucaucgccauggacuuaggggaguuaugcgaagauacuaugaccuacaagugcccccgcaucacagaaaccgagcccgacgacguggacugcuggugcaacgccacggacacuugggugaccuacgggaccuguagccaaacuggcgagcaucggcgugacaagcgguccguagcccucgcgccccacgugggccuggggcucgagacgaggaccgagaccuggaugucauccgaaggcgccuggaagcagauucagcggguggagacaugggcccuccgccacccgggguucacuguuaucgcccuguuccuugcucacgcaauaggcaccagcaucacccagaaagggauuaucuucauucuccucaugcuggugacgcccuccauggccaugcggugcguuggcauaggcagccgcgauuuuguugagggccucucgggugccaccuggguggauguugugcucgagcaugggagcugcgugaccaccauggccaaggauaagcccacgcuggauaucgagcucuugaagaccgaagucacgaacccugccguacugcggaagcucugcaucgaggccaagauaagcaacacgacaaccgacucgcgcugcccgacucaaggcgaggccacccuuguggaggaacaggacgcuaacuucgucugccggcguacuuucguggaccggggcugggggaauggcugcggacucuucggcaaagggucccuaaucacgugcgccaaguucaaaugcguuaccaaacuggaaggcaaaaucguucaauacgagaaccuuaaguacagcguuaucgugaccguccauacgggcgaccagcaucagguggggaaugagagcaccgagcauggcaccaccgccaccauaacuccccaggcgcccaccaccgaaauucagcucaccgacuacggggcgcugaccuuggacugcagcccccgcaccggccucgacuuuaacgagaugguccugcucaccaugaaggagaaauccuggcugguccacaagcaaugguuccuggaccugccccucccguggaccagcggggccagcacgucccaggagacauggaaccggcaagaccuacuggugacauucaagaccgcccacgcaaagaagcaggaggucguagugcucggcucucaggagggggcgaugcacacggcccugaccggugcgaccgagauccagaccagugguacgacaacaaucuuugccgggcaccucaagugucgacuaaagauggacaaacugacacuuaaggggaugucauaugucaugugcacggggagcuuuaagcuggaaaaggagguugccgagacacagcacggcacggugcugguccagauuaaguacgagggcacugaugcucccugcaagauccccuucagcacgcaggaugagaagggggugacgcagaacgggcggcucaucacggcgaauccgauagugaccgacaaggagaagcccguuaacaucgaggccgagccgcccuucggggaguccuacaucguaaucggggccggcgagaaggcgcugaaacucagcugguucaagaaggguuccucaaucggcaagauguucgaggccacggccagaggggcacggcgcauggccaucuugggcgacaccgcgugggauuuuggguccaucggcgggguguucacguccaucggcaaacugguccaccagauuuucggcacugccuacggugugcuguucuccggcgugagcuggacgaugaagaucggaaucggcguccugcucaccuggcucggccugaacucccgcucgaccucccugagcaugaccugcaucgcugugggacucgugacguuauaccugggcguaauggugcaagccgacuccggcugcgugauuaacuggaaggggcgggaguuaaagugcgggagcggcaucuucgucaccaaugaggugcacaccuggaccgagcaauauaaguuccaggccgacagcccgaagcgucuguccgcggccaucgguaaggcaugggaggagggggugugcggcauccggagcgcuacccgacucgagaauaucauguggaaacagaucuccaacgagcugaaccacauccugcuggagaacgacaugaaguucacggucgucgugggggaugucgccggcauccuagcccaggggaagaagaugauccggccccagcccauggaguauaaguacagcuggaaaagcugggggaaagccaaaaucauuggggccgacguucagaauaccaccuucauuaucgacgggcccaacaccccggagugccccgacgaccagagggccuggaauaucugggagguggaggacuauggcuuugggauauucacaaccaacaucuggcugaagcugcgggacagcuacacucaaguaugcgaucaucgcuuaauguccgcggcgaucaaggacuccaaggccguacacgccgacaugggcuacuggaucgaauccgagaaaaacgaaaccuggaagcuggcccgggcgagcuucauugaagugaagacgugcauuuggccuaagucccacacccuguggagcaacgguguacucgaaucagaaaugaucauaccgaagauauacggagggccgauaagccagcauaacuaccgccccggguacuucacccaggcggccgggcccuggcacuuggggaagcuggagcucgacuucgaccugugcgagggcaccacggucgugguagacgagcauuguggcaaccgggguccgucacugcgcacaacaaccgugacaggcaagaucauccacgaauggugcugccgaagcugcacccugccuccccuccgcuuucgcggggaagacgguugcugguacgggauggaaaucagacccgugaaggagaaagaggaaaaccuagucaaguccaugguuagcgccggcagcggcgaagucgacucuuucucccucgggcuguuauguaucaguaucaugaucgaagaggucaugcggucgcgauggucucggcgcaugcucaugacuggcacgcuggccguguucuucuuauuaauaaugggacaacugacguggaaugaccugauccgccucuguaucauggugggagcgaacgcaucagaccggaugggaaugggaaccaccuaccuggcccugauggccaccuuuaagaugcgcccgauguucgcgguuggccuccuguuccggcgcuuaacuucccgggaggugcuucuucugaccaucgggcucagcuugguagcguccguagaacugcccaacucucucgaggagcugggcgacgggcuggccaugggcauaaugauccucaagcugcugacggacuuccagucccaccaacucugggcuacccuguuaagccucacguucauaaagaccaccuucucgcugcacuacgccuggaagaccauggcuaugguguugagcaucguaucccucuuuccccugugccugagcaccaccucccagaagaccacauggcuccccguucugcugggcucgcucgggugcaagccguugaccauguuccugaucgcggagaacaagaucuggggccgccgguccuggccguuaaacgagggaaucauggccgugggcauugucucgaucuuacugaguucccuccugaaaaacgaugucccccucgccggaccccucaucgccggggguaugcugaucgcuugcuauguaauaucagguuccagcgccgaccugagucucgagaaggcggccgaaaucagcugggaagaggaggcggagcacaguggcgcgucucauaacauuuuaguggagguacaggacgacgggacgaugaaaaucaaagacgaggagcgagacgacacccucaccauccuccugaaggcaacccuccucgcggugucuggcguauacccgcugucuauccccgccacguuauucguaugguauuucuggcagaagaagaagcagcgcucgggggugcucugggacaccccgaguccacccgaaguugagcgugccguacuggacgaugggaucuacaggaucaugcagcgcggccugcuggggcggagccaggugggcguugggguuuuccaagagaacguguuccacaccauguggcacgucacucgcggcgcgguguugauguaccaagggaaacggcuggagccgucuugggcauccgugaaaaaggaccugaucagcuauggcgggggauggcgccuccagggcuccuggaacacgggagaagaaguacaggugauugccguggaaccgggcaagaaccccaaaaacguccagaccgcccccggaaccuucaagacccccgaaggcgaaguaggugccaucgcauuggauuuuaagcccggcaccagcggcuccccgaucgugaaucgggaggggaagaucgucggccuguacggcaacgggguggugaccaccucuggcaccuacgucagcgccauugcccaggccaaagcgucccaagaggguccccuacccgagaucgaggacgagguguuccgcaagcggaaucuaaccaucauggaccuucaccccgguucugggaagacccgccgguaccucccggcuaucgugcgcgaggccaucaagcggaaacugcggacccugauccucgcccccacccgagucguggccuccgagauggcagaagcucugaaaggcaugcccauccgguaccagaccacggccgucaaaucggagcacacggggaaggagaucgucgaccugaugugucacgcgacauucacgaugcgccucuuaucccccgcaaggguaccgaacuacaacaugaucauaauggaugaagcgcauuucaccgaccccucuuccaucgccgcccgcggguauauaucuacccggguggguaugggugaggcagccgcgauuuuuaugaccgccacuccgcccggcuccguugaggccuucccgcagucgaacgcggugauccaggacgaggagcgcgacauccccgagagaucauggaacagcggguaugaguggauaaccgacuuccccggcaagaccgugugguucguccccuccaucaaaagcggcaacgacauagccaacugccuucgcaagaacggcaagcgcgugauccagcugucacgcaagaccuucgacacggaauaccagaaaacgaagaauaacgacugggacuaugugguuaccaccgacaucagcgagaugggcgccaacuuucgagcagacagagugauagacccacggcgcugccugaagcccgugauccugaaggacgggcccgagcgggucauccucgccggcccaaugccggugacaguggccuccgcggcucagcgccguggacgcaucggccgcaaccacaacaaggagggcgaucaguacaucuauaugggucagcccuuaaauaacgacgaagaccaugcccacuggaccgaggccaagaugcugcuugacaacaucaauacgcccgaggggaucauccccgcccuguucgagccggagcgggagaaguccgcugccauagacggggaauaucgccugagaggcgaggcccgcaagacauucguagagcugaugcggagaggggaccugccuguguggcuguccuacaaggucgccagcgagggcuuccaguacucggaccggcgguggugcuucgacggcgaacggaacaaccaggugcucgaagagaauauggacguggagaucuggaccaaggagggagagcgcaagaagcuacggccccgcuggcuagaugcccggacauacuccgacccccucgcgcugcgcgaguucaaggaguuugccgccggccgccgcucagucuccggagaccucauccuggagaucggcaagcugccgcagcaccugacucaacgggcccagaacgcgcuagacaaucuggugaugcugcacaauagcgagcaaggcgggagggccuacagacacgcaauggaggagcuacccgauaccauagagacgcugaugcugcucgcucugaucgcugugcugaccggcggggucacacucuucuuccuguccggccguggacugggcaaaaccucuaucggccuguugugcgugauggccuccagcguguuacucuggauggcgucggucgagccccacuggaucgccgccagcaucauccucgaguuuuuccugauggugcuccugaucccggagccggaccgacaacgcacuccccaggacaaccagcuggccuauguggucaucggacuccuguuuaugauccuuaccguggccgccaacgagaugggcuuacuggaaaccaccaagaaggaccuggggaucggccauguugccgucgagaaccaccaccacgccgccauguuagacguggaccugcacccagcguccgcuuggacacuguacgcuguggccacgacgaucaucacgccgaugaugcggcacaccaucgagaauacaaccgccaauaucagccucaccgcgaucgcaaaccaggcggccauuuuaaugggccuggacaagggcuggcccaucaguaagauggacaucggcgugccacuccuggcgcugggguguuacagccaggugaauccucucaccuugacggcugcugugcugaugcucgucgcccacuaugccaucaucggcccagggcugcaagcgaaggccacccgggaagcccagaagcgcaccgccgccggcauaaugaagaaccccaccguggacgggauaguugcgaucgaucuggacccugucguauacgacgccaaauucgagaagcaguugggccagaucaugcuccugauccucugcacgucccagauccuguugaugcggacaacuugggcccucugcgagagcaucacccuggcaacuggcccccugaccacccucugggagggcuccccgggcaaauucuggaacaccacgaucgccgugagcauggcaaacaucuuccgcggauccuaccuggccggagccggccuggccuucagcuuaaugaaaagccucggaggagggagacgcgggaccggggcgcagggggagacccugggcgaaaaguggaagcggcagcucaaccagcuguccaaaucggaguucaacaccuauaagcguuccgggaucauggagguugaccggucggaggccaaggagggcuugaagcgcggggaaacgaccaagcacgccgugucccgggggaccgccaagcuccgcugguucgucgagcggaaccuggucaagcccgaggguaaggugaucgaccugggcugcggccgcggcggcuggucguauuacugcgcgggccuaaagaaggugacugaggucaaggguuacacgaagggcgggccaggucacgaggagcccaucccgauggcuaccuacggguggaaccuggugaaauuacacuccggcaaggacguauucuucaucccgccugaaaagugcgacacacuacucugcgacaucggagaaagcucccccaacccgaccauagaggagggcagaacgcugaggguccugaagaugguggagccuuggcuccgggggaaccaguucugcaucaagauccugaaccccuacaugcccagcguggucgagacccuggagcagaugcagcgcaagcacggcggcaugcuagugcggaauccgcucucccgcaacagcacacacgagauguacuggguguccugcggcacaggaaacaucgucagcgccguaaacaugaccuccagaaugcugcucaaccgguuuacgauggcccaccgcaaacccaccuacgaacgcgacguggacuuaggggcaggcacucgccauguagcgguggagcccgaggucgcuaacuuagacaucaucgggcagcggaucgaaaauaucaagcaugagcacaaaagcacauggcacuacgaugaggacaacccauacaaaacgugggcuuaccacggguccuacgagguaaagccgagcggcuccgccagcucuauggugaacgggguaguaaagcuccucacuaagcccugggacgugaucccgauggugacccagauagcuaugaccgacacgacccccuucggccagcaacgcgucuucaaagagaaggucgacacccggacaccgaaggccaagcgcgggacugcgcagaucauggaagucaccgccaaguggcucuggggcuuccucucccggaacaagaagccccggaucugcacccgcgaggaguucacccguaagguacgaagcaaugccgcgaucggcgcgguguuuguggacgagaaccaguggaauagcgccaaagaagccguggaagacgagcgcuucugggaccuuguccacagagagagggagcuacacaagcaggggaagugugccacgugcgucuacaacaugaugggcaagcgggagaagaagcucggggaguucggcaaggccaaggggagccgcgcgaucugguauauguggcuaggcgcccgguuccuggaguucgaggcccucggcuucaugaacgaggaccacugguucucccgcgagaacucucugucagggguggagggcgaggggcugcacaagcucggcuacauccugcgcgacaucagcaagauccccgggggcaacauguacgcagacgacaccgccggcugggacacacgcaucacugaggacgaccugcagaacgaggcgcggauaacagacaucauggagccggagcaugcccuccucgccaaguccauuuucaagcugaccuaccagaauaaggugguccggguucagaggccagcuaagaaugggaccgugauggacgucaucucccggcgcgaucaacgaggcuccggccaaguggggaccuauggccucaacacuuucacaaacauggaagcccagcuaauucgccagauggagagcgaggggaucuucucccccagcgagcuagagacgcccaaccucgcggagcgggucuuggacuggcuggagaaauacggcguagagcgccuaaagaggauggccaucuccggugaugacugcgucgugaagcccaucgacgaccgcuucgccacugcccugaccgcccucaacgauaugggcaagguucggaaggacauaccacagugggagccaagcaagggcuggaacgauuggcaacaggucccguucuguagucaucacuuccaucagcucauaaugaaggauggcagggagaucgugguuccgugccggaaucaggaugagcuggugggccgugcgcgaguuagccagggggccgguuggagccugcgcgagaccgccugcuuagggaaguccuacgcccaaauguggcagcugauguacuuucaccggcgcgaccugcgacuggcggcaaacgcgaucugcagcgccguccccguggacuggauccccaccucccgcacgacguggagcauucacgcucaccaccaguggaugaccaccgaggacauguuaucuguauggaaccggguguggaucgaggagaaccccuggauggaggacaaaacccacaucagcuccuggggcgacgugccguacuuggguaagcgggaggaucaguggugcggcucucuuauuggcuugacggcucgcgccaccugggcgaccaacauccagguagccaucaaccaggucagacgcuugaucgggaacgagaacuaucucgacuacaugaccucuaugaagcgguucaagaacgagagcgauccggaaggcgccuuaugguga

SEQ ID NO: 24199 - RNA, 9879 nt, Artificial Sequence
  derived and/or modified CDS sequence (opt11) from DENV-1__FJ410226__SS-prME
agcgugaccaugcuguugauguuaaugcccaccgcgcuggccuuucaccucacgacccguggcggcgaaccccacaugaucgugagcaagcaggagcggggcaagucccuccuguuuaagaccucugccggagugaacaugugcacguuaaucgccauggaccuuggcgaguuuugugaggacaccaugacauacaagugcccccgcaucaccgaggccgagcccgacgacguggacugcuggugcaacgccacggacacgugggugaccuacgggacaugcagccagaccggcgagcaccggcgggacaagcggucgguggcccuggcgccccaugugggccucgggcuggagacgcgcaccgagaccuggaugagcuccgagggcgccuggaagcaaauccagagggucgagaccugggcguuacgccaccccggauucacggugaucgcccucuuucuggcgcacgcuaucggcaccagcauuacccagaaggggaucauuuucauccugcuuaugcuggugacccccuccauggcgaugcgcugcgucgggaucggaucgagagacuucguggagggguuguccggagcgacguggguggacgucguucucgagcacgggagcugcguuaccaccauggcaaaggacaagccuacccuggacauugaguugcucaagacugaggucacgaaccccgcugugcugaggaagcugugcaucgaggccaagauuuccaacacgaccacggauagccgcuguccgacccaaggagaggccacccucguggaggaacaggacgccaacuucgucugccggcguaccuucguagauagaggcugggggaacggcugcggacuguucggcaaagggucccugauaacaugugccaaguucaagugcgugaccaaacucgaaggcaaaaucguccaguaugaaaaucugaaguacagcgugauugugaccguccacacaggcgaccagcaccagguggggaacgagucuacggagcauggcaccaccgcgaccaucacaccccaggcccccaguacggaaauucagcugacagauuacggagcgcuuacucuggacuguuccccgcggaccggcuuagacuuuaacgaaaugguacuccugaccaugaaggagaaguccugguuggugcacaagcagugguucuuggaccugcccuuaccguggaccagcggggccucgaccagccaagaaaccuggaaccggcaggaccuccuggugacguucaaaaccgcucaugcgaaaaagcaggaagucguggugcugggaucccaggagggcgcaaugcacaccgcucucaccggcgcaacggagauccagacaagcggcaccaccacgaucuucgccgggcaccugaaaugccggcugaagauggacaaguugacguugaaggguauguccuacgucaugugcacagggagcuucaaguuagagaaggagguggcugagacccagcacggcacggugcucguucagaucaaguacgagggcaccgacgccccuugcaagauccccuucuccacucaggacgagaaaggggugacccaaaacggccggcuaauuacggccaacccuaucgugacugacaaggacaagcccgucaacauagaggccgaaccgcccuuuggggagagcuauaucgugaucggcgcgggcgagaaggcccugaaacugucaugguucaagaagggaucauccaucggcaaaauguucgaggcaaccgcgcgcggggcccggcguauggcgaucuugggcgacacggccugggacuuugggagcauaggcggcguuuucacguccgucgggaaacuggugcaucagaucuucggcaccgcauacggggugcuauucagcggcguguccuggaccaugaagaucgggaucggggugcuccugaccuggcuggggcugaacagccgcuccaccagccuauccaugaccugcauugcgguugggcuggucacccuguaucucggcguaauggugcaagccgacucugggugcguggugaacuggaagggccgggagcugaagugcgggucaggcauauucgugacuaaugagguccacacguggaccgagcaguacaaauuccaggcggauuccccgaagcgccucucugccgcuauaggcaaagcgugggaggaggggguguguggcauccgguccgccacccgccuggagaauauuauguggaaacagaucagcaacgaguuaaaccacauccucuuagagaacgacaugaaguucaccguggucgugggggauguggcgggaaucuuagcgcaggggaagaaaaugaucagaccccagcccauggaauacaaguacuccuggaaguccugggggaaggcaaagaucauaggcgccgacguccagaacaccacguucauaaucgacgggccgaacacuccggaaugccccgacgaccaaagggcguggaacaucugggagguagaggacuacggcuucgggaucuuuaccaccaacaucuggcucaagcugcgggacuccuauacccaaguuugcgaccaccgccugaugagcgccgcuaucaaagacuccaaggccgugcacgccgauaugggcuauuggauagagucugagaagaaugagacuuggaagcucgcgcgggccagcuucaucgaggugaaaaccuguaucuggcccaagucgcacacccuguggucaaauggagugcuggagagcgagaugaucaucccgaaaaucuacgggggaccgaucucccagcacaacuaccgccccggcuacuuuacucagaccgccggccccuggcaccucgggaagcuggaacuggacuucgaccucugcgagggcaccaccguaguuguggacgagcacugcggaaaccgcgggccgagcuugcgcacgacaaccgucacggggaagaucauucacgaguggugcugccgguccugcacacugccgccgcugcguuucaagggcgaagauggcugcugguacgggauggagauccggccagugaaggagaaggaagagaaccuggucaaaucgauggucagcgccggcuccggcgagguggauucauucucccuugggcugcugugcaucucaauaaugaucgaggaagugaugcgcucacgcuggucgcgcaagaugcugaugaccggcacucucgccgucuucuuccugcuuaucauggggcaacucaccuggaacgaccugauccggcugugcauaauggugggugcgaaugccuccgaccgcauggguauggguacgacuuaucucgcccugauggccaccuuuaaaaugaggccgauguucgcggugggccuccuguuccgccgccugaccucccgcgagguccugcuccugacgaucgggcugucgcucguggcuucagucgagcugccaaauucccuggaggaguugggcgacggcuuagccaugggcaucaugauucugaagcuccuaaccgacuuccagagccaccagcugugggccacccuccuguccuugaccuucaucaagacgaccuuuagccuccacuacgccuggaaaacaauggcgauggugcuguccaucgucagccuguuccccuuaugcaugagcacaacaagccagaagacaacauggcugcccgucuuacucgguucccuggggugcaagccgcugacuauguuccucaucgccgagaacaagaucuggggccggaaaagcuggccccugaacgagggaaucauggcagugggcaucgugagcauccugcucuccucacuucuuaaaaaugaugucccacuagccgggccgcugaucgccggcgguaugcugaucgcgugcuacguuaucuccgggucauccgcagaccucagccuggagaaagccgccgagguguccugggaggaggaggccgagcacuccggcgcuucccacaacauccuaguggaagugcaggacgaugggacgaugaagauuaaggacgaggagcgggacgauacccuaaccauacugcugaaggccaccuugcuggccgugagcggagucuacccgcuguccaucccagcgacccucuuugugugguacuucuggcagaagaagaagcagaggagcggggugcugugggacacgccgaguccgccggaggucgagcgcgccguguuggacgaugguaucuaucgcaucaugcagcggggccuccuugggcgcagccaggugggcguagggguguuucaggaaaacguguuccacaccauguggcacgucacgcggggcgcgguacugauguaccaggguaaacgucuggagccuucaugggcuagcgugaagaaggaucucaucuccuacgggggcggguggcggcugcaggguagcuggaacacuggggaagagguccaggucaucgccgucgagcccggcaagaaccccaagaacguucagacagcacccgguaccuuuaaaaccuccgagggagaggugggcgcuaucgcccuggacuucaagcccgggaccucugguagccccaucgugaaccgcgaggguaagaucgugggccucuacggaaacgggguggugacgaccuccggcacuuacgucagcgcgauugcucaggccaaggccucgcaggaggggccccugccggagaucgaggacgagguguuccggaagcgcaaccugaccauuauggacuugcaccccgggagcgggaagacgagacgcuaccugcccgccaucgugcgggaggccauuaagcgcaagcugcgcacgcucauccuggccccgacccgggucgucgccuccgaaauggcggaagcucugaaaggcaugcccauccgcuaucagaccacggccgucaagagcgaacacaccggcaaggagaucguugaccucaugugccacgccaccuuuaccaugcguuuacugucccccguacgagugcccaauuacaauaugauuaucauggacgaggcccacuucacugacccgagcucuauagcggcccggggguacaucagcacacgcguugguaugggggaggccgccgccauauucaugaccgcgacaccacccggcaguguggaggccuucccccaguccaaugccgugauccaggacgaggagcgggacaucccagagcgcuccuggaacaguggguacgaguggaucacggacuucccuggcaagaccgugugguucgugccauccaucaaaagcggcaacgacauagccaacugccucagaaagaacgggaagcgcgugauccagcuaucccggaaaaccuucgacaccgaguaccagaagacaaagaacaaugacugggauuacgucgugacgaccgacaucagcgagaugggcgcgaacuuucgcgcggaccgggugauugacccccgacggugccugaagccaguuauccucaaggacggucccgaacgcgugauucuggccgggcccaugccuguaacaguggccuccgcggcucagcgacgcgggcggaucggccgcaaucacaauaaggagggcgaccaguacguuuauauggggcagccacugaacaacgaugaggaccacgcccacuggaccgaagccaagaugcuguuagacaauauuaacacccccgagggcaucauccccgcccuguuugaacccgagcgggaaaagagcgcugcgaucgacggggaguacaggcuacgcggcgaagcccggaaaaccuuugucgagcugaugcgucgcggagaucugccgguguggcucucguauaagguggccuccgagggguuccaguacagcgaccgccgcuggugcuuugauggcgaacgcaacaaccagguccuggaggagaacauggacguggagaucuggaccaaggagggggaacgaaagaagcuccgccccagauggcucgacgcccgcacguacucggacccccuggcccucagggaguucaaggaguucgcggccggccgccggagcguguccggggaucucauccuggagaucggcaagcuaccccaacaccucacccagcgcgcacagaacgcacuggacaaucuggucaugcuccacaacagcgagcagggcgggcgggcguaucgccacgccauggaggaacugccugauaccaucgagacccugaugcuacuggcgcugaucgcgguacucaccggcgggguaacgcuguucuuccuguccggucggggacucggcaagaccagcaucggccugcugugcgucauggcuuccagcguacuacuauggauggcgucuguggagccccacuggaucgccgccucuaucauccuggaguucuuccucauggugcuccugauccccgagcccgaccgccagcggacgccgcaggacaaccaguuagcguacguggugaucgggcuauuauucaugauccugacaguagcagcgaacgagauggggcugcuugagacgaccaagaaggaccucgggauaggccacguggccguggagaaccaccaucaugccgccaugcuagacgucgaccugcaccccgcuucagcguggacucucuacgccguggccaccacgauuaucacccccaugaugcgacauaccaucgagaacaccacggcuaauauaagccuaacagccaucgcgaaccaggcugccaucuugauggggcucgacaagggcuggccgauaaguaagauggacauaggcgugccgcugcuggcccucgggugcuacucacaggugaacccucugacccugaccgcggcggugcucaugcugguggcccauuacgcaaucaucgggccuggucugcaggccaaggcgacgcgcgaggcccaaaagcgcaccgccgccggcaucaugaagaacccgaccgucgacgggaucguggcuaucgaccucgaccccguggucuacgacgcgaaguuugaaaagcaguugggccagauuauguugcugauccugugcacaucccaaauccugcucaugcgcacgaccugggcccugugcgaaagcaucacccuggcaaccggcccccucacgacccugugggagggcucgcccggcaaguucuggaacaccacuaucgccgugagcauggcaaauaucuuccgggggucguaucuugcgggcgcagggcucgccuucucccugaugaagucauuaggaggagggcgccgggggacgggggcgcaaggcgagacccucggugagaaguggaagcgccagcuaaaccagcuguccaagagcgaguucaacaccuacaagcgguccgggaucauggaggucgaccgcagcgaggcgaaggagggccucaagcgcggggagaccacgaagcacgccgucagucgcggcacggccaagcugcggugguuuguagagcgcaaucugguaaaaccagagggaaagguaaucgaccucggcugcggucguggugguuggagcuacuacugcgccgggcugaagaaaguuacagaggugaaggguuauaccaaagggggccccggccacgaggagcccauccccauggccacauacggguggaaccugguuaagcugcacuccggcaaggacguguucuuuaucccgcccgagaagugcgauacccuccugugcgauauuggggaguccucccccaacccaacuauugaggaaggccgaacccugcgggugcucaagaugguagaaccguggcugcgcgggaaccaguucugcaucaagauccugaaccccuauaugcccagcgugguggagacgcuagagcagaugcagcggaaacauggaggcauguugguccguaauccacugucgagaaacuccacccacgagauguacuggguguccugcggcacuggcaacaucgugagcgcggucaauaugacuucacgcaugcuccugaaccgguucaccauggcccaccggaaaccgaccuacgagcgcgacgucgaccugggggcaggcacccggcacgucgccguugagccugagguggccaaccucgacaucaucggccagcgcaucgagaacaucaagcacgagcauaagaguacguggcacuacgacgaggacaaccccuacaaaacgugggccuaccaugggucauacgaggucaagcccagcggcagcgccuccagcauggugaacgguguggucaaacuacuuacaaagccgugggacgugauccccauggugacccagaucgccaugaccgacaccacgcccuucgggcagcagcgggucuuuaaggagaagguugacacccgaaccccuaaggcuaagcgugggaccgcucagaucauggaagugacggccaagugguuauggggauuccuaucccgcaacaagaaaccgcggaucugcacucgcgaggaguucacucggaaagugaggagcaaugcggccauaggugccguguucguggacgaaaaccaguggaacuccgcgaaggaggccgucgaagacgagcgguucugggaccuggugcaccgugagcgagagcuccacaagcaggggaaaugcgcgaccugcguguacaacaugaugggcaagcgcgagaagaagcuaggggaguucggcaaagccaaggggucacgggccaucugguacauguggcucggcgcacgauuucucgaguucgaggcccugggauucaugaacgaagaccacugguucucccgcgaaaacagccuguccgggguggagggcgaggggcuacacaagcugggcuacauccugcgcgacaucagcaagaucccagggggcaacauguaugcggacgacacggcugggugggacaccaggaucaccgaggacgaccuccagaacgaggcaaagauaaccgauaucauggagccagagcacgcauuacucgcgaaguccaucuucaagcucacguaccagaacaagguggugcgcguucagcggccggccaagaacgggaccgugauggacguuauuagccgccgggaccagcggggcucuggccaggucggcaccuacggccugaauacguucacuaauauggaggcccagcuaauccgccagauggagucugaggggaucuucucccccucggaguuggagaccccaaacuuggcuggcagaguccuggacugguuggaaaagcacgggguggagcgccugaagcggauggcgaucuccggugacgacugcgucgugaagcccauugaugaccgcuuugcgaccgcccugacggcacucaacgacauggggaaggugagaaaggacauaccgcagugggagcccuccaagggcuggaacgacuggcagcagguucccuucugcucucaucauuuccaccagcugaucaugaaggacggccgugagaucguugugcccugccggaaccaggacgaguuaguggggcgcgcucgggucucccagggugccggguggagccuccgcgaaacggccugccugggcaagagcuacgcacagauguggcaacugauguauuuccaccggagagaucuccggcuggcagccaacgcaaucugcagcgccgugccuguagacugggugcccaccucgaggaccacguggagcauccacgcucaccaccaguggaugacgaccgaggacaugcuguccguguggaaccgggucuggauagaggagaaccccuggauggaggacaagacccacaucagcuccuggggagacgugcccuacuuggggaaacgugaagaccagugguguggaucucugauaggacucacugcccgggccacaugggccaccaacauacagguggccaucaaccaaguccgccgccucaucggcaacgagaacuaccuagacuacaugacgagcaugaagcgauucaagaacgagagcgauccugagggcgcccuaugguag

SEQ ID NO: 24200 - RNA, 9879 nt, Artificial Sequence
  derived and/or modified CDS sequence (opt11) from DENV-1__FJ410227__SS-prME
agcgugacaaugcuccucaugcugaugccuaccgcgcuggccuuccaccugaccacaagaggcggggagccucacaugaucguguccaagcaagagcggggcaagagucuacuguucaagaccuccgcgggcgugaauaugugcacucucaucgccauggaccuaggcgaguucugcgaagacacgaugacguacaaauguccucgcaucaccgaggccgagccagacgacguggacugcuggugcaaugcgaccgacacauggguaaccuacgggaccugcagccagacuggcgagcaccgacgggacaagcgguccguggcucucgcuccccaugugggccucgggcuggagacgcgaaccgagaccuggaugagcuccgaaggggccuggaagcagauccagcggguggagaccugggcccugcgccaccccggguuuacggugaucgcccucuuccuggcucacgccauuggcaccucgaucacccagaaggggaucaucuuuauccuacugauguuggugaccccuucuauggccaugcggugcgucggcaucggcagucgcgacuucguugaggggcugucgggcgccacguggguggacgucguucucgagcaugggagcugcgugaccacuauggcgaaggacaagcccacccuggauauugagcugcuaaaaacggaggucaccaaccccgcagugcugcggaagcuguguaucgaggcuaagaucucgaauacaacuacggacucccgcugcccgacucaaggcgaggccacccucguggaagagcaggacgccaacuucgucugccggcgcaccuucguggaccggggcugggguaacggcugugggcucuucgguaaggggucccucaucaccugcgccaaauucaagugugugaccaagcucgaaggcaagauaguucaguacgagaaccucaaauacagcgucaucgugaccguccacaccggcgaccagcaucaaguggguaacgaauccacggagcaugggaccaccgcgacgaucacgccccaggccccgucaaccgagauccagcugaccgacuacggggcccuaacccuggacugcucaccacggacuggccuggacuuuaacgagaugguccuccugacgaugaaagagaagaguuggcuggugcauaagcagugguuccucgaccuuccccugcccuggacgucgggggcgaguacaagccaggaaaccuggaaccggaaggaucuccuggugacguucaagaccgcccacgcgaagaagcaggaggucguggugcugggcucccaggagggagccaugcauaccgcccugacgggggccacggagauccagaccagcggcaccacuacgaucuucgccggccaccugaaaugcagacugaagauggacaagcucacccuuaagggcauguccuaugucaugugcacagggagcuucaagcuggagaaagaaguggcggagacgcagcauggcaccgugcucgugcagaucaaguacgagggcaccgacgcucccugcaagauucccuucuccacccaggacgagaagggggugacccagaacggacggcugaucacggccaacccgaucguaaccgacaaggaaaagcccguaaauauugaagcagagccgcccuucggggagucuuacaucgugaucggcgccggcgagaaggcauugaagcucagcugguucaagaaagggagcucuaucggcaaaauguucgaggcuaccgcacgcggcgcccggcguauggcgauccucggcgacaccgccugggacuucgggagcauuggugggguguucacgucugucgggaagcugguucaccaaaucuucgggaccgccuacggggugcuguucagcggcgucucauggacaaugaagaucgggaucgguguccucuuaaccuggcugggccucaacagccgcuccacuagccuuucaaugaccugcaucgccguggggcuggugacccucuaccugggcgucauggugcaggccgacucggggugugucaucaacuggaaaggccgagagcuuaaaugcggcucuggcaucuuugugaccaacgaggugcacacuuggaccgagcaauauaaguuucaagccgacuccccgaaacgccucagcgcugccaucgggaaagcaugggaggaaggggucugcggcauccgauccaccacccgccuggagaacauaauguggaagcagauuagcaaugagcuaaaccacauccuccuggagaacgacaugaaguucaccguggugguaggggacguggccggcaucuuagcgcaggggaagaagaugauccggccccaacccauggaguauaaguacuccuggaaauccuggggcaaagccaagaucauaggcgcugacgugcagaacacgaccuucaucaucgacgggcccaauaccccggagugccccgacgaccagcgcgcguggaauaucugggaagucgaggacuacgguuuugggauauucaccacgaacaucuggcucaaguuacgggacuccuacacccaggugugcgaccaccgccugaugagcgcggcuaucaaggacuccaaggccgugcacgccgacaugggcuacuggaucgagagugagaagaacgagacuuggaagcucgcccgggcguccuucaucgagguaaagaccugcauauggccaaagagccacacgcuguggucuaacggcgugcuggagagugaaaugaucauccccaaaaucuacgggggaccgaucucacaacacaacuaccgacccggauacuuuacacagaccgccggccccuggcaccucgggaagcucgaacuggacuucgaccucugcgaaggcaccacggugguaguggacgagcacugcggcaaccgggggccaagccuccgcaccaccaccguuacuggcaagauuauccacgagugguguugccgguccugcacccuuccgccccugcgcuucaagggggaggacggcugcugguacgggauggaaauccggcccgucaaggagaaggaggaaaaccuggucaagagcaugguuagcgcgggcuccggcgaggucgauagcuuuagucuggggcuucuguguaucucgaucaugaucgaggaagugaugcgcucccgguggagccgcaagaugcugaugacuggcacacucgccguguuuuuccugcugaucauggggcaguuaacguggaacgaccugauccggcugugcaucauggucggcgccaacgccuccgaccgcauggggaugggcaccaccuaccuggcucugauggccaccuucaaaaugcgcccgauguucgccgucggucuccuguuccggcgccuaacgucgagagagguuuuacuccugaccaucgggcuuucccugguagcgagcguagagcugccuaacucccuggaggaguugggcgacgggcucgcgaugggcaucaugauccugaagcuccugaccgacuuccagucucaucagcugugggccacccuacugucccugacguucaucaagaccaccuucagccuccacuacgccuggaagacuauggccaugguucuguccaucgucagccuguucccucucugccuuaguacgacaagccagaagacuaccuggcugccggugcuccugggcucccuagggugcaagccgcucacuauguuccuuaucgcugaaaacaagaucuggggccgaaagagcuggccgcuuaacgaagggaucauggccgucgggaucguuagcauucuccugaguagccugcucaagaacgauguuccccuggccggcccccuaaucgccggcggaauguuaaucgccugcuacgucaucuccgggagcagugcggacuugagccuggaaaaggcggccgagguguccugggaggaggaagccgaacacagcggggcuucccauaacauacucguggagguccaggaugacgggacgaugaaaaucaaggacgaggagagagacgacacccugaccauacugcucaaggcgacccuucuggccgugucuggcguguacccgcuaucaauccccgcgacacucuuugucugguacuuuuggcaaaagaagaagcagcguucaggggugcuuugggauacucccuccccgcccgagguggagcgggcuguccucgacgacggcaucuaucgcauaaugcaacggggccugcugggccgcucucaggugggcgugggggucuuucaggagaacguguuccacaccauguggcacgugacacguggcgcuguccugauguaccaagguaaacgccucgagccuuccugggcgucagugaaaaaagaccugaucuccuacggaggcggguggaggcuacagggcucuuggaacacgggggaggaagugcaagucaucgcgguggagcccggcaagaaccccaagaacgugcaaaccgcgccagggaccuucaagacuuccgagggcgaggucggggccaucgcgcucgacuucaagccggggaccagcggcagccccaucguaaacagagaggggaagauagugggucuguacggcaacggagucgugaccacuuccggcaccuacgugucugcgaucgcccaggccaaggccucccaagaggggccccugccggaaaucgaagacgaggucuuccggaagcgcaaccugacgaucauggaccugcaccccggcagcgggaagaccaggcgcuaccugcccgcuaucgugcgggaggccaucaagcguaagcuacggacccugauccucgccccgacgcgcgugguggcuucagaaauggccgaagcguuaaagggaaugcccauacgcuaucagacgaccgccgugaagucagagcauaccggcaaggagaucguggauuugaugugccacgcgaccuucacgaugagacugcucucccccguccgcgugccaaacuacaacaugaucaucauggacgaggcgcacuucaccgacccuagcuccauagccgcgcggggcuacaucagcacccgcgucggcaugggugaggccgcagccaucuuuaugaccgccacgccccccggcagcguagaggcguucccccaaagcaacgccgugauccaggacgaggagcgggacaucccagagcggagcuggaacucaggguacgaguggaucaccgacuuccccggcaagacggugugguucguccccuccauuaaaucugguaaugauaucgccaauugccuccggaaaaaugggaaacgcgugauccagcugagucgaaagaccuucgacacggaguaccagaagaccaagaacaacgacugggacuacguggucaccacggauaucagcgaaaugggugccaacuuccgcgccgaucgggucaucgauccccgccggugccucaagcccgugauuuuaaaggacgggcccgagagggucauucuggcugggccuaugccggugacggucgccucagcggcccagcggcguggccggaucggccgcaaccacaacaaggagggagaucaguacauauacauggggcagccgcucaacaacgacgaggaccacgcccacuggaccgaggccaagaugcuucuggacaauaucaacacacccgaggguaucauaccggcccuauucgagcccgagcgggagaagucggcggccauagacggagaguaccgccugcggggcgaagcgcgcaagaccuucguagagcugaugcgccgcggcgaccucccggucuggcuaagcuacaaggucgccuccgagggcuuccaguauagcgaucgacgguggugcuucgacggcgaaaggaacaaccaagucuuagaggagaacauggacguggagaucuggacgaaggagggggagcguaagaagcuccgcccccgguggcucgacgcccgcaccuacucagacccccuggcccuccgggaguucaaggaguuugccgcgggccgucggagcguguccggggaccugauccucgagauagggaagcucccccagcaccugacccagcgcgcccaaaaugcucucgacaaucucgugaugcugcacaauucggagcagggcgggcgggccuaccgccacgcgauggaagagcugccugacaccaucgagacucucaugcugcuggcacugauagccgugcucacaggcggggucacucuauuuuuccuauccggucggggccugggcaagacaagcaucggccuguugugcguaauggcuuccagcguguuacuguggauggcgagugucgaaccacauuggauugcugccagcauuauccuagaguucuuccugauggugcuauugauucccgaacccgaccgccaacggacgccacaggacaaccaacuggccuacguggugaucggacuccucuucaugauccugacagucgcagccaaugagaugggccugcucgaaaccaccaagaaggaccuggggaucggccacguagcggccgagaaccaccaccacgccgccaugcuggacgucgacuugcaccccgccuccgcguggacccucuaugccguggccacgaccaucaucacccccaugaugcgccacaccaucgagaauacgaccgccaacaucagccugaccgccaucgcgaaccaggcugcaaucuuaauggggcuggacaaggguuggccgaucuccaagauggacaucgguguaccacuucucgcccugggguguuauagccaggucaacccccugacccucacugcugcaguacugaugcugguggcccacuaugcaaucauaggccccgggcuccaggccaaggcgacccgcgaggcccaaaagcgcacggccgccggaauaaugaagaacccaaccguggacgguaucguggccauagaccuggaucccguggucuacgaugcaaaauucgagaagcaacugggccagaucaugcuccugauccugugcacgucccagauccuccugaugcgcaccacaugggcccugugcgaaagcauaacccucgcuacuggaccuuuaaccacccugugggagggaucccccggaaaauucuggaacaccacgaucgccgugucuauggccaacauauuucgggggucuuaccucgcgggcgcuggcuuggccuucagucugaugaaguccuuggggggcgggcgccggggcaccggggcccagggcgaaacgcugggcgagaaguggaaacgccagcugaaccagcuuuccaagagcgaguucaacacguacaagcggagcgggauuauggagguagaccgcagugaggcgaaagaaggcuuaaagcgcggggagacaaccaaacacgccguuucccgcggcaccgccaagcugagaugguucguggagcgcaacuuagugaagccugaggggaaggucauugaccugggcugcggacgcggcggguggagcuacuacugcgcgggccugaagaaagugaccgagguaaagggguacacaaagggcgggccaggccacgaagagcccauccccauggcuaccuacggguggaauuuggucaagcuccacuccggcaaggacguguucuucaucccgcccgagaaaugcgacacgcuguuaugugacaucggugaaagcagcccgaaccccacaaucgaggagggccgaacucuccgggugcugaagaugguugagccguggcugcgcgggaaccaguucugcauuaagauccucaaccccuacaugcccucuguaguggaaacccuggagcagaugcagcgaaaacacggcggcaugcucguccgcaaccccuuaucccguaacagcacccacgaaauguauugggugucgugcgggaccgguaacauugugagcgccgucaacaugaccucccgcaugcuguugaaccgguucacuauggcgcaccgcaagccaacguacgagagggacguggacuuaggcgccggcacgagacauguggcuguugagcccgagguggccaacuuagauaucaucggccagcguaucgagaauaucaagcacgagcacaaaagcacguggcacuaugacgaggacaaucccuacaagacgugggcguaccacggguccuacgaggugaagcccucaggcagcgccuccagcauggucaacgggguggucaaacugcuuacuaaaccuugggacgugauuccuauggugacucagauugccaugaccgacacgacucccuucggccagcagcgggucuucaaggaaaagguggacacacggacucccaaggccaaacgggggacggcgcagaucauggaggugaccgcgaagugguuguggggauuccugucccgcaacaagaagccgcggaucugcacccgcgaggaauucacccggaaaguccgcagcaacgccgccauaggagccguguucguggacgagaaucaguggaacuccgcgaaggaggcggucgaagacgagcgguucugggaccuagugcaccgcgaacgggagcuucacaagcaggggaagugcgcuacgugcguauacaacaugaugggcaagcgcgaaaagaagcugggggaguucggaaaggccaagggaagccgggccaucugguacauguggcucggcgcgcguuucuuagaauucgaagcccugggcuucaugaaugaggaccacugguucucccgggagaacagccucucugggguagagggagaggggcugcacaagcugggcuacauacuccgcgacauuagcaagaucccuggggguaacauguacgccgacgauaccgccggcugggacacccgaauuaccgaggaugacuuacaaaacgaggccaagaucacggauaucauggagcccgagcacgcgcugcucgcgaaguccauauucaagcugaccuaccaaaacaagguggugcgcguccagcggccugccaagaacgggaccgugauggaugugaucagccgccgcgaucagcgcggcuccgggcaggucggcacuuacggccucaacacguucacaaacauggaggcgcagcugauccgccagauggaaagcgaaggcaucuucucccccagcgaguuggagacucccaaccuggccggccggguuuuggacuggcuggagaagcaugggguggagcggcugaagcggauggcaaucucgggcgacgacugcgucgugaagcccaucgacgaccguuucgcuacagcucucacggcccugaacgacaugggcaagguccggaaggacauaccccaaugggagcccagcaagggcuggaacgacuggcaacagguccccuucugcucucaccacuuccaccagcugauuaugaaggacggccgagagauagugguucccugccgcaaucaggacgagcucgucggacgcgcucgggugucccagggcgcgggguggucccugcgugaaaccgccugccugggaaaguccuacgcccagauguggcaguuaauguacuuccacagacgcgaucugagacuggcugcgaacgcaaucugcucggcagugccggucgacugggugcccacgucgcgcaccacguggaguauacacgcccaccaccaguggaugaccaccgaggacauguugucaguguggaaccggguuuggaucgaggagaaccccuggauggaggauaagacucacaucucuucuuggggagacgugccauaccugggcaagcgcgaggaccaguggugcggcagcuuaaucggccucacggcccgggcgacuugggccaccaacauccagguggcaauaaaccagguccgccgcuugauaggcaaugagaauuaccuggacuacaugaccuccaugaagcgguucaagaacgagagcgacccggagggggcccugugguga

SEQ ID NO: 24201 - RNA, 9879 nt, Artificial Sequence
  derived and/or modified CDS sequence (opt11) from DENV-1__FJ859029__SS-prME
agugugaccauguugcuuaugcuuaugcccaccgcccuggccuuucauuuaacuacucgcggcggugagccccacaugaucguguccaaacaggaacgcggcaagagcuuacuguucaagacgagcgccggggugaauaugugcacucuaaucgcuauggaccuuggcgaguuuugcgaggauaccaugaccuacaagugcccccggaucaccgaggccgagcccgacgacguggacugcuggugcaacgccaccgauacgugggucaccuacggcaccugcagccagacaggcgagcaccggcgugacaagcgcucaguggcccuggcgccucacguaggucucgggcuggagacgcgcacugagaccuggaugagcucggagggagccuggaaacagauccagaaagucgagacaugggcccugagacacccuggcuucacggugaucgcguuauuucuggcgcacgccauaggcaccagcaucacccaaaaggggaucaucuucaucuugcucaugcuugugacucccuccauggccaugcgcugcgucggcaucggcagccgggacuuuguggaagggcuguccggugccacguggguggacguugugcucgagcacgggaguugugugaccacgauggccaaggacaagcccacccuggacaucgagcugcucaagaccgaggucaccaaucccgcgguccuaaggaagcugugcaucgaggcuaagaucuccaacacuaccacggacagccguugcccgacccagggcgaagcaacccucguagaggagcaggacgccaacuucguaugccgccggaccuucguggacagaggcugggggaacggcugcgggcucuucggcaaaggcucccugaucacgugcgccaaguucaagugcguuaccaaacucgagggcaagacuguacaacacgagaauuuaaaauacagcguuaucgugacuguccacacgggcgaccagcaccagguggggaacgaguccaccgagcauggaaccacggccaccaucacaccgcaggcccccagcaccgagauccagcugacagacuacggggcgcucacccuggacugcagcccgcggacuggacuggacuucaaugagaugguacucuuaaccaugaaggagaagaguuggcuggugcacaagcagugguuucucgaucugccgcugcccuggaccaguggggcauccaccagccaggagacguggaacaggaaggaccugcucgugacuuuuaagaccgcacacgcgaagaaacaggaagugguaguccugggcucucaagagggcgcuaugcauaccgcccuuacuggcgccaccgagauccagaccagcgguaccacgaccauauuugccggucacuugaagugcagacugaagauggauaagcucacccuuaaaggcaccucauaugucaugugcacggggagcuucaagcuggagaaggaggucgcggagacacagcacggcaccgugcugguucaaaucaaguaugaaggcacggacgcccccugcaaaaucccauucuccacccaagacgaaaaaggggugacacagaacggucgcuugaucaccgcaaaccccaucguaaccgacaaggagaagccugucaauauugaagccgagccgccguucggggaaagcuacauagucaucggugcgggcgagaaggccuuaaagcuguccugguuuaagaaagggagcuccaucggcaagauguucgaggccacggccaggggggcccgucggauggccauccuaggagacaccgccugggacuucgggagcaucggcggugucuucaccuccgucgggaaauuagugcaccagaucuucgguaccgccuacggcguccuauucaguggcgucuccuggacaaugaagauugguauuggcguucuacucaccuggcugggacucaacagcagauccacaagccugucaaugaccugcaucgccgugggacuggucacacucuacuugggggugaugguccaggcagacagcgguugcgucaucaauuggaagggccgcgagcuaaagugcgguagcggcaucuucgucaccaacgaggugcacaccuggaccgagcaauacaaguuccaggcggacucgccgaagcggcucagcgcggccaucggaaaggcuugggaggagggugucugcgggauacgcucugccacacggcuggagaauaucauguggaagcagaucagcaacgagcucaaucacauucucuuagaaaacgacaugaaguucacgguggucguaggggacguggcagggauccuggcccaggggaagaagaugaucagaccccagcccauggaguauaaguauuccuggaaauccuggggaaaggccaagaucauuggagccgacguccagaacaccacauucaucaucgacgggcccaacaccccggagugccccgacgaccaacgggcguggaauaucugggagguggaagacuacggcuuugggaucuucacgaccaacauuugguugaagcuccgcgacaguuacacccaagugugcgaccaccgucugauguccgccgcgaucaaagacucgaaagccguccacgccgauaugggcuacuggauagagagcgaaaagaacgagaccuggaagcucgcucgcgcguccuuuauagaggucaagacgugcaucuggcccaagucucacacacucugguccaacggggugcuggagagcgagaugaucauccccaagaucuaugggggaccuaucagccagcacaacuacagacccggguauuucacccagacagccggucccuggcaccucggcaaacuggaacuggauuucgaccucugcgagggcacaacggucguugucgacgagcacugcggcaauagagggccgagccuacggaccaccacggucaccggcaagaucauccacgaguggugcugccggucguguacgcugccuccccuccgcuucaagggggaggauggcuguugguacgguauggagauacgcccggugaaagagaaagaggagaaucuggucaaguccaugguuagcgccggcucgggcgaggucgacagcuucucccuaggucuccuaugcaucagcaucaugaucgaggaggugaugagaucccgcuggagccggaagaugcugaugacuggaacgcucgccguguuccugcugcucaucaugggacagcugacguggaacgaccugauaaggcucugcaucaugguuggcgcgaacgccagugaccgcaugggcaugggcacgaccuaccuugcguugauggcuacguucaagaugcgcccgauguucgccguggggcuccuuuuccgccggcugaccagccgcgagguucugcuccugaccaucgggcucucacucguagcgagcguggagcugcccaacucccucgaagaguugggugacggacuggccaugggcauaaugauccucaaacuucugaccgacuuccagucccaucagcuaugggcuacucugcuguccuuaaccuuuaucaaaaccaccuucagccugcauuacgccuggaagacgauggcgaugguccuguccaucgugagccucuuuccccugugccuuucuaccacaagccagaagaccacguggcuccccguucuacucggcucccucggaugcaagccucugaccauguuucucaucgcggaaaacaagauauggggccgcaaaagcuggcccuuaaaugagggaaucauggccgugggaaucgucagcauacugcuuucaagucuccugaagaacgacgucccgcuggcggggccccuuauugccgggggcaugcugaucgcguguuacgucauuuccgggagcuccgccgaccugucgcucgagaaagccgccgagguguccugggaggaggaggccgagcacucuggcgcaucccacaacauccugguggagguccaggaugauggaacaaugaaaaucaaggacgaggagcgugacgacacucugacgauucuccugaaagcaacgcuucuggccgugagugggguguacccgcugucuauuccugcuacccuguucgucugguacuucuggcagaagaagaaacaacggucugggguguuaugggacacaccaagcccucccgagguggagcgagccgucuuagaugaugguauauaccgcaucaugcagaggggucuucuugggcggagucaggugggcgugggggucuuccaggagaaugucuuccacacgauguggcacgugacccgcggcgccguguugauguaccagggaaagcgccuggaacccaguugggccucuguaaagaaagaccuaaucaguuacggcggcggauggagacuccaaggcagcuggaacaccggcgaagaaguucaggugauugccgucgagcccggcaaaaacccaaagaacgugcagaccgcccccgggaccuuuaaaacauccgagggcgaggugggugccaucgcccuggacuuuaagcccgggacaagcggcucaccuaucgugaaccgggaggggaagaucgugggccuguacggcaacggggucguaaccacuuccggcacguacgugagcgccaucgcccaggcuaaggccucccaagaggggccucucccggagaucgaggacgaggucuuccgcaagcggaaccuaaccaucauggaucuucaccccggaagcgguaagacacgaagauaccucccagccaucgugcgcgaggccaucaagcggaagcugcgcacccugauacuagcccccacgcggguaguugccuccgaaauggcggaagccuuaaagggcaugcccauacgauaccaaaccaccgccgugaagggcgagcauacggggaaggagauaguggaucugaugugccaugccacauucacgaugcgacuccucagccccguccgggugccgaacuacaacaugaucaucauggacgaggcccacuucacugacccauccagcauugcggcccgcggcuacaucaguacucggguggggaugggcgaggccgccgccaucuucaugacggcgacaccccccgggucagucgaggccuucccccagucgaacgccgugauccaggacgaggagagagacaucccggagcggagcuggaacucaggguacgaguggauaaccgauuuucccgggaagacugugugguucgucccuuccaucaaguccgggaacgacaucgcuaacugucugagaaagaacggcaaacgggugauccagcuaagucgcaaaacguucgacaccgaauaucagaagacgaagaacaaugacugggacuacgucgucaccacggacaucuccgagaugggggccaacuuccgggccgaccgcgugaucgacccucggcgcugucuaaagccagugauccugaaggauggccccgaacggguuauccuggccgggcccaugcccgugacagucgcuagcgcagcucagcgcaggggccgcaucggccggaaccacaacaaggaaggcgaucaguacaucuacauggggcaaccguugaauaacgacgaagaccaugcccauuggaccgaggccaagaugcuacucgauaacaucaauaccccggaggggaucauccccgcccuguucgaaccagagcgcgaaaaguccgcugcgaucgacggagaguaucggcugcgcggggaagcccguaagacauuuguggaacucaugcggcgcggugauuuaccgguguggcugagcuacaagguagcaagcgaggguuuccaguauuccgacaggcgcuggugcuucgauggggaacgaaacaaccaggugcuggaggagaacauggauguggaaauuuggacgaaagagggcgagcgcaaaaagcugaggccccgguggcuggacgcgcggaccuacagcgaucccuuagcccugcgcgaguucaaggaauucgcggccgggcggagguccgucagcggggaccugauccuggagaucggcaagcugccccagcaucugacccagcgggcgcagaacgccuuggacaaucuggugaugcugcacaauagcgagcagggcgggcgcgccuaucggcacgcgauggaggagcucccggauacgaucgagacucucaugcugcuagcccugauugccguguuaaccgggggcgucacgcucuucuuccugucugggcgcggccugggcaagaccuccaucgggcuccugugcgugauggccagcuccgcguugcuguggauggccagcguggagccucacuggaucgccgcauccaucauuuuagaguucuuccuuaugguccuccugauucccgagcccgaucggcagcgaacuccgcaggacaaucaacuggccuacguggugauuggcuugcuauucaugauccugacugucgcggcaaacgagaugggccuccuggagaccaccaagaaggaucugggcaucgggcacguugcaguagagaaccaucaccacgccgccaugcucgacgucgaccuucaccccgcgagcgccuggacacuguacgccguggccaccacaauuaucacccccaugaugcggcacacgaucgagaauaccaccgcuaauaucuccuuaaccgcgaucgccaaccaggcggccauucugaugggcuuggacaagggguggccgaucagcaaaauggauaucggggugccucugcuggcccugggcugcuacucacaagugaacccccucacgcugaccgccgccguccugaugcucguggcccacuacgcuaucauuggacccggguuacaagccaaggccacccgcgaggcccaaaagcggacugccgcaggaaucaugaagaacccuacggucgauggcaucgucgcgaucgacuuagacccuguggucuacgacgccaaguucgaaaagcaacucgggcagaucaugcugcugguguuauguacuagccagauccuccugaugcgcaccaccugggcccucugcgaguccaucacucuggccacugggccccugaccacccucugggaaggaagccccgggaaguucuggaacacgaccaucgccguguccauggcgaacaucuuccgcggcagcuauuuggccggagccgggcuugcauucagccucaugaagucgcugggcgggggccggagggggaccggagcccagggcgaaacccuuggugagaaguggaagcggcaacucaaucagcugaguaaguccgaauuuaacacuuauaagcgcagcggcaucauggaggucgaccgcucagaggcaaaggagggacugaagcgcggcgagacaacgaagcacgccgugucuagggggaccgcaaagcuccggugguucguggagcggaaccugguuaagccggagggcaagguaauagaccucggcugcggccguggagggugguccuauuacugcgccggccuaaagaaggugacggagguaaagggguacacgaagggcgggcccgggcacgaggagcccaucccgauggcgaccuacggcuggaaccuggugaagcugcacagcgggaaggacguguuuuucaucccuccggagaagugugacacccuacucugcgacauuggcgagucgagccccaacccgacgauagaagaggggcguacccugcgcgugcugaagaugguggagccguggcugcgggguaaccaguucugcauaaagauucugaacccauauaugcccuccguggucgagacccuugagcagaugcagaggaagcacggcggcaugcucguccgaaacccccugucacgcaacuccacccacgagauguacuggguguccuguggcacagggaacaucguuuccgccgucaacaugacgucacgcaugcuccucaaccgguucacgauggcccaccggaaaccgaccuacgagcgcgacguggaccugggcgccggcacccgccacgucgccguagagccugaaguggcaaaccuggauauuaucgggcagcggaucgagaacauuaaacaugagcacaaguccacauggcacuacgacgaggacaacccguauaagaccugggccuaccaugggucuuacgaggcgaagcccagugggagcgcgagcuccauggucaacgguguaguuaaauuacugacaaaaccgugggacgugauccccaugguuacccagauagccaugacagacaccacgcccuucgggcagcagcgcgucuuuaaggaaaaggucgacacgaggacgcccaaggcuaagcgcggcaccgcacagauaauggaggugaccgccaaguggcuguggggcuuucugagccggaauaagaagccgcgcaucugcacccgggaggaguucacacguaaggucagguccaaugccgcgaucggagccguguucgucgacgagaaccaguggaacagcgccaaagaggccgucgaggacgagcgcuucugggaucuggugcaccgggagcgagagcuucauaagcagggcaagugcgcuaccugcguguacaauaugaugggcaagcgggagaaaaagcucggcgaguuugggaaggcgaagggcucgcgcgccaucugguacauguggcugggugcccgguucuuagaguuugaggccuugggguuuaugaacgaggaccacugguucagccgagagaacucccuuucgggaguagagggcgagggcuuacacaagcucggguacauucugcgggacaucuccaagaucccaggcggcaacauguacgccgacgacaccgcggggugggacacccgcaucacggaggacgaccugcagaaugaggccaagaucaccgacauuauggaaccagagcacgcccuccuggcgaagucaauuuucaagcugaccuaccagaacaagguggugcgagugcagcgccccgccaagaacgguacagugauggacgugaucucccgacgcgaccagcgcgggaguggucaggucggaacguauggacugaacacauuuacgaacauggaggcccagcugauccgacagauggaguccgaggagauuuucucucccagcgagcuggaaaccccgaaccucgcaggccgcguucuggacuggcucgagaagcacgggguggagcggcucaaacgcauggccaucagcggcgaugacugcgucgugaagccgaucgaugaccgguucgcaacagcccucacugcgcugaacgacauggggaaggugcgcaaggacauuccccagugggaacccuccaaaggcuggaacgauuggcagcagguccccuuuuguagccaccacuuucaccagcuuaucaugaaggaugggcgcgagauaguggugcccugccguaaccaggaugaguuggucggacgggcccgugugucccagggagccggguggucccuccgggagaccgccugucucgguaaaaguuacgcgcagauguggcagcugauguacuuccaccgccgcgaccugcgccuggccgcaaacgccauaugcucugccgugccggucgacuggguacccaccucgcggacgacgugguccauccaugcgcaccaccaguggaugaccaccgaggacaugcugucaguguggaaccgcgucuggaucgaggagaacccguggauggaagauaagacgcacaucuccagcuggggcgacgugccguaccugggcaagcgggaagaucaguggugcggcucucucaucggucugaccgcacgcgcuacgugggccaccaacauacaagucgccaucaaccagguccgacgucuuauaggcaacgagaacuaucucgauuauaugacuuccaugaagagauucaagaacgaaagugacccggaaggggcgcugugguga

SEQ ID NO: 24202 - RNA, 9879 nt, Artificial Sequence
  derived and/or modified CDS sequence (opt11) from DENV-1__FJ547065__SS-prME
agcguaacgaugcugcucaugcugaugccuacagcccuggccuuucaccuaaccacccguggaggcgaaccccauaugauugugagcaaacaggagcggggcaagucacugcuuuucaaaaccucagccggugugaacaugugcacgcucaucgcgauggaccugggcgagcucugcgaggauacgaugaccuacaagugcccacgcauaacagagacugaacccgaugacguggacugcuggugcaacgcgacggacaccuggguuaccuacggaaccugcagucaaaccggcgagcaccggcgcgacaagcgguccguagcacucgcgccccacgucggauuagggcuggagacaaggaccgaaaccuggaugagcuccgagggcgcguggaaacagauucagcggguggagacaugggccuugcgccaccccggguucaccgugauugcccuguuccuugcccacgcuauaggcacuagcaucacccagaaagggauuaucuucauauugcugauguuggugacacccuccauggccaugcggugcgucggcaucgguagccgcgacuuugucgagggcuuguccggcgccaccugggucgauguggugcuggagcaugguagcugcgugaccaccauggcaaaggauaaaccaacgcuggacauugagcuccuuaagaccgaggucaccaacccagccgugcugcgaaaguugugcaucgaagcgaagaucucuaacaccacgaccgacagccgcuguccgacccagggcgaggcaacccugguggaagaacaggaugccaauuucguaugccggcgcacguucguggaccggggcugggggaauggcugcggucuuuucggcaaggggucccucaucacgugugccaaguucaagugcguaacgaaacuggagggaaagauaguucaguacgagaaccucaaauacagugugauagugaccguccacacgggcgaccaacaccagguggguaaugaauccaccgagcacggcaccacagccaccaucacgccgcaggcgccgaccaccgagauccagcuuaccgacuacggggcccugacucuggacuguagcccccgcaccggccucgacuuuaacgagaugguccugcugacaaugaaggagaaguccuggcuaguucacaagcaaugguuuuuagaccugccccuaccuuggaccucuggggccagcacaucgcaggagacuuggaacagacaagaccuccugguaacuuucaagaccgcacacgccaagaaacaggagguugugguuuugggcagccaggagggcgcaaugcacacggcacugacuggggccacugagauacagaccuccgguacuaccaccaucuucgccgggcaccugaagugccgcuuaaagauggacaaguugacccucaaaggcaugucuuacgucaugugcaccggauccuucaagcucgagaaggaaguggccgaaacccagcacggaacaguacugguccaaaucaaguacgaaggcacagacgcgcccugcaagauccccuuuagcacacaggaugagaaggggguuacacagaacggucgccugaucacggccaacccgaucguaacugacaaggagaagcccgucaacaucgaggccgagccgccuuucggagagaguuauaucguuaucggcgcgggagagaaggcgcugaagcucagcugguucaagaaggggucuagcaucggcaagauguuugaggcgacggcccgcggggcccggagaauggccauacugggagauaccgcgugggacuucggaucuauuggcggugucuucaccagcgucgggaagcuggugcaccagauuuucggcaccgccuacgguguguuauucuccggugucuccuggacgaugaagaucgggaucggagugcuguuaacguggcucggacugaacucacguagcaccucccugagcaugaccuguaucgccguggggcucgucacucuauaccugggcguuaugguccaggcggacuccgguugcguuauaaacuggaaggggcgcgaacugaagugcgggagcgggauuuuugugaccaaugagguucacacauggaccgagcaguacaaguuccaggccgacagcccgaagcgacuguccgcggcgaucgggaaggcuugggaggaggguguaugcggcauccgcagcgcuacccgcuuagaaaacauuauguggaaacaaauuucaaaugagcucaaccacauccuacucgagaacgacaugaaguucacagucguggucggagauguagcugggauccucgcgcaagggaaaaagaugauccggccccagcccauggaguauaaauacucguggaaguccuggggaaaggccaagaucaucggagccgacgugcaaaacaccaccuucaucaucgauggucccaacacuccggaaugccccgacgaccuccgugccuggaacaucugggaggucgaagacuacggcuucgguaucuucaccaccaacaucugguuaaaguugagagacagcuauacccagguuugcgaccaucgccuaaugucggcggcuauuaaggacucaaaagccgugcacgccgauaugggcuacuggaucgaguccgagaagaacgagaccuggaagcuggcccgggcgucuuucaucgaggucaagacgugcaucuggcccaagucccacacccucuggucgaacggcguucuggagucugagaugauuauccccaagaucuacgguggcccgauaagucagcauaacuaccgucccggguauuucacucaggccgccggccccuggcaucugggaaagcucgagcucgacuucgauuugugcgagggcacaacggucgucguggacgagcacugcggcaaccgggggccgucccuccgcaccacuaccgugaccggcaagaucauccacgaguggugcugccguuccuguacccuaccgccccuucgcuuucgaggggaggauggcugcugguaugggauggagauucggcccgucaaggagaaggaggaaaaccuagugaaguccaugguuagcgccggcucaggagagguagacuccuuuagccuuggacugcuaugcauauccaucaugauugaggaggugaugcggagccgcuggucccggcguaugcugaugacuggcaccuuggccgucuucuuucuccuuaucaugggccagcuaacguggaacgaccucauccgccugugcaucauggucggcgcgaacgccucugaccggauggggaugggcaccaccuaccuggcccucauggccaccuucaagaugcggccgauguuugcaguggggcugcuguuccggcgccucacgucccgggaggugcugcuucugaccauaggcuuaagccugguagcguccguggaguuacccaacagccuggaggagcuaggcgacgggcucgccauggggauaaugauucuuaaacuacuuaccgacuuccaaagucaccaacugugggccacccugcucagccugacguucauuaagaccaccuucucgcugcacuacgccuggaagaccauggcgaugguccuuagcauuguauccuuauucccucugugccuuagcacaaccucccagaagacuaccugguuacccguucugcucggcagccugggaugcaaaccgcucacgauguuccuuauagccgagaacaagauuuggggccgccggagcuggccacugaacgaggggauaauggcggucggcauugucagcauacugcucuccagccugcugaagaaugaugugccccuagccggaccucugaucgccggcgguauguuaauugccuguuacguuaucuccgggaguagcgccgaccucucucuggaaaaggccgcggaggugagcugggaggaggaggccgaacacuccggcgcaagccacaacauccugguagaggugcaagacgauggcaccaugaagaucaaggacgaggagcgcgacgacacauugacgauacuacuuaaagcaacccuccuggccguuuccggcguguacccccuuagcauucccgcgacgcucuucgucugguacuucuggcagaagaagaagcagcgaucaggggugcugugggacacacccucuccaccagagguggagcgugcuguccuggacgacggcaucuaccgaaucaugcagcgcggccuacucgggcggucccaagugggcguggggguguuccaagagaacgucuuucacaccauguggcacgugacccgaggcgcugucuugauguaccagggcaagcggcuggagccuagcugggccagcguuaaaaaggaccucaucaguuacggcggcggguggcgccugcaggguuccuggaacacgggggaggaggugcaggucaucgccguugagcccggcaagaaccccaagaacgugcagaccgccccggguaccuucaagacucccgagggcgaggugggcgccaucgcucucgacuucaaacccgguaccuccggcucccccaucgugaacagagaagggaagaucgugggccucuaugguaacggggucgugacaacuagcggcaccuacguuuccgccaucgcccaggccaaggcaucccaggaggggccgcuaccagagaucgaagacgagguuuucaggaagaggaaccucaccaucauggaucuccaccccggcagcgggaagacucgccgguaucugccggcgaucgucagagaagccauuaagcgcaagcugcggacccugauucuggcgccuaccagggugguugccucggagauggcggaggcccuuaagggcaugcccauccgauaucagaccacagcagucaagagcgagcacaccggcaaggagaucguggaccucaugugccacgcaaccuucacgaugcgcuugcuuucccccgugcgagugcccaauuacaacaugauaaucauggaugaggcccacuucaccgaccccucguccaucgcggcacguggguauauaucgacucgggugggaaugggggaggcagccgcgauauucaugacggcgacaccgcccggcuccgucgaagccuuuccgcagagcaacgcagugauccaggacgaggagcgcgacaucccggagcggucuuggaacagcggguacgaauggaucaccgacuucccgggcaagacggucugguucgucccaucgauaaagagcgggaacgacauagccaacugccucagaaagaacgggaagcguguuauccagcugucucgcaagaccuucgacacggaguaccagaagacccggaacaaugacugggauuacguuguaacgacggacaucagcgaaaugggugcgaacuuccgcgcagaccgggugaucgacccucgacggugccugaagcccgugauccuaaaggacgggcccgagcgcgucauacucgccggcccuaugcccgugacgguugccuccgccgcgcaaagacgcgggaggaucggcagaaaccacaauaaggagggcgaccaguacauauacaugggccagccccuuaacaacgacgaagaccaugcccacuggaccgaagcaaagauguuacuggacaacaucaacacccccgagggcauaauccccgcccuuuuugagcccgagcgcgagaagucagccgcgaucgacggggaguaccggcucagaggcgaggcuagaaagaccuucgucgagcugaugagacgcggggaccugcccguguggcucucguacaaggucgcaagcgaagguuuccaguauagcgaccguaaguggugcuucgacggagagcggaacaaucaggugcuggaggagaauauggauguagagauauggaccaaggagggugagagaaagaagcugcgcccccgcuggcucgaugcccggaccuacuccgacccccuggccuuacgcgaguucaaggaguucgcugcaggacggcgcagcgucuccggggauuugauucuggagaucggcaagcuaccgcagcaccuuacccaacgggcccagaacgcccuggacaaccuagugaugcuacacaacagcgagcagggcgggcgcgcuuaccggcacgccauggaagagcuacccgauaccauugaaacguuaaugcuacuggcccuaauagccguucucaccggaggggucaccuuauucuuccuuuccggccgcggcuuggggaaaaccucuaucggacuccuguguguuauggcguccagcguccucuuauggauggcgagcguugagccacauuggaucgcugcaucaaucauucuggaguucuuccucaugguguuacugauccccgagccggaccggcagcgcacgccccaggacaaucagcucgccuacguagucaucggccuacuguucaugauccugacgguggcugcgaacgagaugggcuuacucgagaccacuaagaaagaucucggaaucggccacguggccgucgagaaccaucaucacgccgccaugcuggacguggauuuacaccccgccuccgcguggacccuuuaugccguggcgaccaccaucauaaccccgaugaugcgccacacgaucgagaacacgaccgcuaacauaagcuugaccgccauagcgaaccaagccgccauccucauggggcucgacaagggcuggccgaucuccaagauggacauuggcgucccccuguuagcucuggggugcuauagccaggugaacccucugacacugacggcggcugugcuaaugcugguggcucacuacgccaucaucggcccgggguugcaggccaaggcgacccgggaggcccagaagcgcacugccgcuggcaucaugaagaaucccaccguggacgggaucguggccaucgauuuagaccccgucguguacgaugcuaaguuugagaagcaauugggccagaucauguugcucauccugugcacgucccagauccuccucaugcggacaacuugggcccuuugugagagcaucacccuggccacgggcccacucaccacccucugggagggaucccccggcaaauucuggaacaccacgaucgccgucagcauggcuaacauauuucgcgguucuuaccuagcgggcgccggccuggcuuuuagccugaugaagucccucgguggcggccggcggggcaccggggcccagggcgagaccuuaggcgagaaguggaagcggcagcugaaccaguuaaguaagucugaguuuaacaccuacaaaagguccgggaucauggagguugaccggucagaagcgaaagagggccucaagcggggggaaacgaccaagcacgccgucuccagaggcacggccaagcugcgcugguucguggagagaaaccuggucaagcccgaggggaaaguuauagaccugggcugcggccgcgggggcuggagcuauuacugugccgggcucaagaaagugacugaagucaagggcuauacgaagggaggacccggccacgaggagcccauccccauggccaccuacggauggaaccuggugaagcugcacucaggcaaggacguguucuucaucccgcccgagaagugcgacacccuccuuugcgacauuggggagagcucccccaacccgaccaucgaggaagguagaacucugcgcguucucaaaaugguggagcccuggcugcgggggaaccaguucugcauaaagauccuuaaccccuacaugcccagcguugucgaaacccuugagcagaugcaacgcaagcacgguggaaugcuggugcguaacccccuuucccgcaacucaacucacgagauguacuggguguccugcgggaccggcaauaucgucagcgcgguaaauaugaccucccgaaugcuacugaaccgcuuuacgauggcacaccgcaaacccaccuaugagcgggacguggacuugggggccggcacccgccacguagccguggagcccgagguggcgaaccucgacauuaucggccaacggaucgaaaacaucaaacacgaacacaaaucaaccuggcauuacgacgaagacaaccccuacaagacgugggcguaucacggguccuacgaagucaagccgagcggcuccgcgagcagcauggugaauggggucguaaaacuccugaccaagccuugggacgugauccccauggugacccagauagcaaugaccgacacuacuccguucggccagcaacgcgucuucaaagagaagguggacacccggacaccgaaagccaaacgcgggacggcccagaucauggaagucacagcaaaaugguuguggggguuccugucgcgcaacaagaagccucggauaugcacccgagaggaguucaccagaaaggugcggagcaacgccgccaucggcgcaguguuugucgaugagaaccaguggaauuccgcgaaagaggcaguggaggacgagcgauuuugggaccuggugcaccgggagcgggagcuccacaagcagggcaagugcgcuaccugcgucuacaacaugaugggcaagcgggagaagaagcugggggaguuuggcaaggccaaggggucgcgcgcaauaugguacaugugguugggcgcccgguuccucgaguucgaggcccucggcuucaugaacgaagaccacugguuuucucgugagaacagccuaucugggguggagggcgaggggcuccauaagcuuggauacaucuugcgagacaucucgaagauccccgggggcaacauguacgccgaugacaccgcggggugggacacccguaucaccgaagaugaucuccagaacgaggcgagaauuacggauaucauggagccggagcacgcgcugcuggcuaagaguaucuucaagcuaacauaccagaacaaggucgugcgagugcagaggcccgccaagaacgguacggugauggacgucauaagcagacgugaccagagagguuccggccaaguuggcaccuacggucugaacacguucaccaacauggaggcccagcugauucggcagauggagagcgaggggaucuuuucccccagcgagcuagaaacccccaacuuggccgagcgcgugcuggacuggcucgagaaguacggcgucgagcgacugaagcggauggcuauuuccggggacgacugcgugguaaaaccgaucgacgaccgcuucgcaaccgcccugacggcacucaacgacaugggcaaggucagaaaggacaucccccagugggagccaucuaagggguggaacgacuggcagcagguucccuucugcucccaccauuuucaucaguugauaaugaaggacggccgggaaaucguggugccgugccggaaccaggacgaacuggugggccgcgccagggucagccagggcgcgggauggagccuccgcgagacugccugucuagggaaguccuacgcccagauguggcaguugauguacuuucaucggcgcgaccucagacuggccgcuaacgccaucugcucggccguccccgucgacuggauacccaccucacgcacaacguggucaauccaugcccaccaccaauggaugacaaccgaggacaugcugucuguauggaaccgcguguggaucgaggagaaccccuggauggaagauaaaacacacaucagcuccuggggcgauguuccguaccuugggaagcgggaggaccaguggugcgguucacuaaucggccugacggcccgcgcgaccugggcuaccaauauccagguggcaaucaaccagguacggcggcucaucggaaaugagaacuaccuggauuacaugacguccaugaagcgguucaagaacgagucugacccggagggcgcccugugguga

SEQ ID NO: 24203 - RNA, 9879 nt, Artificial Sequence
  derived and/or modified CDS sequence (opt11) from DENV-1__FJ410230__SS-prME
agcgugacgauguuacugaugcugaugcccacggcucuggccuuccaccucaccacccguggcggggagccccauaugaucgugagcaagcaagagcgggggaaaucucucuuauuuaagaccuccgccggggucaacaugugcacucucaucgcaauggaccugggugaacugugcgaggacacgaugaccuacaaguguccccggaucaccgagaccgagcccgaugacguggacugcuggugcaacgcaacugacaccugggucacuuacgggacaugcagccagacgggcgagcaucgccgcgacaagcgauccguggcccucgcgccccacgucggcuuggggcuggagacgcggacagagaccuggaugagcuccgagggcgcguggaagcagauccagcgggucgagaccugggccuuacgccauccuggguucacggugaucgcccuguuccuggcccacgcgaucggcaccagcaucacccagaaagggaucaucuucauccuccugaugcuagugacucccuccauggccaugcggugcgucgguaucggcagucgcgacuucguggaggggcuauccggcgccaccuggguggacguagugcuggagcaugggagcugugugaccaccauggccaaggacaaacccacgcuggacaucgagcuccugaagaccgaagucacaaacccagccgugcugcgcaagcucugcaucgaggcgaaaaucuccaacacaacgacagauucgcgcugcccgacucagggcgaggccaccuugguagaggaacaagacgccaauuucgucugccggaggacguucguggaccggggcugggggaacggcugcgggcuguuugggaaaggaucccucaucacgugcgccaaguucaagugcguaacuaagcuggagggcaagaucguccaauaugagaaccugaaguacagcgugaucgugacgguccacacgggagaccagcaccagguggggaacgagucgaccgagcacggcacaacagcuaccaucacgccgcaggcgcccacaaccgagauccagcucaccgacuacggggcucugacgcuugauuguagcccccgcacuggccucgacuucaacgagaugguccugcugaccaugaaggaaaaguccuggcucgugcacaagcagugguucuuagaucugccccuccccuggaccucuggggccagcacgucccaggaaaccuggaaccggcaggaucugcuggugaccuucaagacagcccacgcgaagaagcaggaggucgugguacuugggagccaggaaggcgcgaugcacacagcucugaucggggccaccgagauccagacguccggaaccacgaccaucuucgccggucaucuaaagugccgccucaagauggacaagcugacgcugaagggcaugaguuacgucaugugcaccgguuccuucaagcucgagaaagagcuggcugagacgcagcacggaaccgugcuggugcagaucaaguacgagggcacggacgcucccugcaagauccccuuuagcacccaggacgagaagggcgucacgcagaauggccggcugaucacagccaacccgauugugaccgacaaggagaagcccguuaacaucgaggccgagccgcccuucggggaauccuauaucguaaucggcgccggcgagaaggccuugaagcugucaugguucaagaagggguccagcaucggcaagauguucgaagcaaccgcccgcggagccagacguauggccauucugggugacacugcgugggauuucggguccaucgguggcguuuucaccagcguggggaagcucguccaccaaaucuucggcacggcuuacggggugcuauucagcggcgugagcuggaccaugaaaaucgggaucggcguguuacugacguggcugggccugaacucccgcagcaccucccucaguaugaccugcaucgccgugggguuagugacccucuaccucggggugaugguacaagccgacucagggugugugauaaacuggaagggccgggagcugaagugcgggucuggcaucuucgucacgaacgaggugcauacguggaccgagcaguacaaguuucaggccgacaguccuaagcgacuguccgcggccaucggcaaagccugggaggagggggugugcggcauccgaagcgccacccgccucgagaacaucauguggaagcagaucucaaacgagcugaaccacauccuguuagagaacgacaugaaguuuaccguagucgugggggacgucgccggcauccuggcgcaggggaagaaaaugauccgaccccagcccauggagcacaaguacagcuggaaguccuggggcaaggccaaaaucauaggcgccgacgugcagaacacaaccuucaucaucgacgggccgaacaccccggagugccccgacgaucagcgugccuggaacauuugggagguggaagacuacggcuucgggaucuucacaacgaacauuuggcugaagcuccgggacagcuacacgcaggucugugaucaccgccugauguccgcggccaucaaggacaguaaagcugugcacgcugacaugggcuauuggaucgagagugagaagaacgagaccuggaagcuagcacgggcgagcuucaucgaggugaagacuuguauuuggcccaaaucccauacgcucuggucgaacggcgugcuggagucagagaugauaauacccaagaucuacgggggcccgauuucucagcacaauuaucgcccuggguacuucacccagaccgcaggccccuggcaucuggguaagcucgagcuggacuucgaccugugcgagggcaccacgguaguggucgacgagcacugcggcaauagggggccgucccuccgcaccacgaccgucacggguaagaucauccacgaguggugcugccggagcugcacguugccgccuuuacgcuuccgcggggaggacggaugcugguacgggauggagauccgccccgugaaggagaaggaggagaaccucguaaagaguauggucagcgcaggcucaggcgaggucgauuccuucagucuggggcugcucugcaucuccauuaugaucgaggagguuaugcggagccguuggucccggaagaugcugaugaccgggaccuuagcaguguuuuuccuccucaucaugggacagcugacguggaacgaccucauccggcugugcaucauggugggcgccaacgcuagcgaccggauggggauggggaccaccuaccuggcacucauggccaccuucaagaugcggcccauguucgccgucggccugcuguuccgucggcuaacgucccgcgaggugcugcugcucacuaucgggcugagccugguggcgucuguugagcucccaaacagccuggaggagcugggcgacgggcucgccaugggcaucaugauccugaagcuccucaccgauuuccagucccaccagcugugggccaccuugcucagccugacguucauaaagaccaccuucucccugcacuacgccuggaagaccauggccauggugcucucaaucgucucucuguuuccccugugccuaagcacgacgucccagaagaccacguggcugcccgugcugcuuggcucacugggguguaagccgcugacgauguuccucaucgcugagaacaagauauggggccggcgcucuuggccccugaacgaggggaucauggccgucggcauagucuccauccuguugagcucccugcugaagaacgauguaccgcucgccgggccccugaucgcaggcggcaugcugaucgcgugcuacguuaucagcggguccagcgcggacuugucccuggaaaaggccgcggagguuucgugggaggaggaggccgagcacucuggcgcaucccacaacauacuuguggaggugcaggacgacgggaccaugaagauuaaggacgaggagcgggacgacacccucaccauccucuuaaaggcgacccuucuggccgucuccggcguguacccgcugagcauccccgcaaccuuguucgugugguacuucuggcagaagaagaagcagcgcuccgguguccucugggauacccccaguccucccgaaguggagcgggcugugcuggacgacggcaucuaccguaucaugcagcggggcuuacucggacgcucccaggucggcguugggguauuccaagagaacgucuuccacacuauguggcacgugacccguggagcugugcugauguaccaggggaagcgacuggagcccagcugggcgagugugaagaaggaccucaucucauauggcggcggguggcggcugcagggcaguuggaacacgggggaggagguccaggucaucgcggucgagccaggcaagaauccgaagaacgugcagaccgcgcccgggacauucaaaaccccagagggggaggugggcgccaucgcccuggauuucaagccugggacgagcgggucccccaucgucaacagggaggggaaaauugugggccucuacggcaacgggguggucaccaccagcggcaccuacguuagcgcaauagcccaagccaaagccucccaggaggggccgcugcccgagaucgaagacgagguguuuagaaagcgcaaccuaaccauuauggaccuccaccccggcagugggaagacccggcgcuaccucccggcuaucguacgggaggccauuaagcgaaaguugcgcacccucauccuugcacccacccgggugguggcauccgagauggccgaggcgcuaaaaggcaugccgauccgcuaccaaacgaccgccgucaaguccgagcacaccgguaaggagaucguggacuuaaugugccacgccaccuuuacgaugcgucuucuguccccuguucgcgucccuaacuacaacaugaucauaauggacgaggcacauuucaccgaccccagcucgaucgccgcgcggggguacaucagcacacgcgugggcaugggggaggccgccgccauauuuaugaccgccacgccgcccggcaguguggaggcguucccgcagagcaacgccguaauccaggacgaggagcgggacaucccggaacgcuccuggaacuccggguacgaguggaucaccgacuuccccggcaagaccgugugguucgugccauccauuaaguccggaaacgacaucgccaacugccuccggaagaacgggaagcgcgucauacaguuaucccggaagaccuucgacacggaguaccaaaagaccaagaacaaugacugggacuacgucgugaccaccgacaucagcgagaugggcgcaaacuuucgcgcggaccggguuaucgacccgaggcggugccugaagccugucauucucaaggacggucccgagcgcgugauccuggccggacccaugccggucacgguggccagcgccgcccagcggcgcgggcggaucggccgcaaccacaauaaggagggcgaccaguauaucuacauggggcagccccugaacaacgaugaggaccacgcgcacuggaccgaggccaagaugcuccucgacaacaucaacacccccgagggcaucauucccgcccuguucgagccggaacgcgagaaauccgccgcuaucgacggcgaauaucgucuacgcggcgaggcgaggaaaaccuucguggagcugaugcgccgcggugaccuccccguuuggcucuccuacaagguggccagcgagggcuuccaguacagcgacaggcgguggugcuucgauggggagcgcaacaaccagguccuggaggagaacauggacguugagaucuggacgaaggagggggagcggaagaagcugcgaccccgguggcuugacgcccgcacguacuccgacccccuggcccugcgggaguucaaggaguucgccgcgggccgccggucaguguccggggaccucauucuggagaucggcaagcugccgcagcauuuaacccagcgcgcccagaacgcccuggacaaccuggucaugcuccacaacuccgagcagggcgggcgggccuacaggcaugcgauggaggagcuccccgauaccaucgagacgcugaugcuccuggcccugauagcagugcuuaccggcgggguaacccuguucuuccucucaggccgggggcucggcaagacaagcauuggauuacuuugcgucauguccagcuccgugcuccuguggauggccuccguggaaccgcacuggaucgcugcauccaucauucuggaguucuuccucaugguccuucugauccccgagccggaccgccaaaggacgccccaggacaaccagcucgccuauguggugauugggcugcuguucaugauccucacggucgccgccaacgagaugggccugcucgagacuacaaagaaagaccucgggaucggucacguagcggucgagaaccaccaccaugcggccaugcuggacgucgacuuacaucccgccagugccuggacccuuuacgccguugcgacgaccauuauaacaccgaugaugcgccacaccauugagaauacgaccgccaacaucucccugacugccauugccaaccaggccgcgauccugauggggcucgacaagggcuggcccaucagccgcauggacaucggggugccccuuuuagcgcucgggugcuauagccaggucaacccccuaacccugacggccgcaguacugaugcugguagcucacuaugccaucauuggcccggggcugcaggccaaagccacccgggaggcccagaagcgcacagcggcagggaucaugaagaaucccaccgucgacgggaucguggccaucgaccucgaucccguggucuacgaugcgaaguucgaaaagcagcugggccagauaaugcugcucauacugugcacgagccaaauacuccucaugaggacgaccugggcccugugcgagucgaucacccuggcgacgggacccuugaccacgcugugggaggggagcccgggcaaguucuggaacaccacgauagccguauccauggcgaacauuuuccgcgguagcuaccuggccggcgccggacucgcuuuuaguuuaaugaagucccucgggggcgggagacgcgguacaggggcacaaggggagacuuuaggugagaaauggaagcggcagcugaaccagcuaucuaaguccgaguucaacaccuacaagcgcagcggcaucauggagguggacagaagcgaggcgaaggagggccuuaagaggggggagacgaccaagcacgccgugagccgaggcaccgcgaagcuucggugguucguggagagaaaccuggugaaaccagaggggaaagucaucgaccugggcugcggacgcgggggcuggagcuacuauugcgccggacucaagaaagugaccgagguuaaaggcuauacuaaaggcgggccgggucacgaggagccgaucccuauggccaccuacggguggaaccuugucaagcugcauagcggcaaggacguguucuucauaccgcccgagaagugcgacacccuucugugcgauauaggggaguccagccccaacccgaccaucgaggagggccggacacugcgcgugcucaagauggucgagcccuggcugcgagggaaccaguucugcaucaagauccucaaccccuacaugccguccgugguggagacacucgagcagaugcagcgcaagcacggcgggaugcuggugcggaacccgcugagccgaaacuccacccacgagauguacugggugagcugcgggaccggcaacaucguuuccgccgucaacaugaccagccgcaugcuccugaaccggcugacgauggcccaccggaaacccaccuacgagcgggacguggaccuuggggcgggcacgcgacacguggccguagagcccgaaguggcgaaccuggauauuaucggucagcggaucgagaacaucaagcacgagcacaaauccaccuggcacuacgacgaggacaacccuuacaaaacgugggccuaucacgggucauacgagguuaagccguccggcagcgccagcuccaugguuaacggggugguaaagcugcucaccaagcccugggacguaauccccauggugacccagaucgcgaugaccgacacaacccccuucggccagcagcgcguauuuaaggagaagguggacacccggaccccaaaggccaagcgcgggacugcccagaucauggaggugaccgcgaagugguugugggguuuucugagccggaauaagaagccuagaaucugcacccgagaggaauucacccgcaagguccgguccaacgccgcgaucggcgccguguuuguggacgaaaaccaauggaacuccgccaaggaggccguggaggacgagcgauucugggaccuugugcaccgugagagagagcugcacaagcaggggaagugugcgacgugcguguauaacaugaugggcaagcgagagaaaaagcucggggaguuuggcaaagccaaggggucccgcgccaucugguacauguggcuaggagcccgguuccuggaguucgaagcccuggguuuuaugaacgaggaccacugguucagcagggaaaacagucucagcggcgucgaaggcgaaggucugcacaagcugggcuacauccuacgagauaucuccaagaucccggggggcaacauguacgcggacgacacagccggcugggacacccgcaucacugaggacgacuugcagaacgaggcccgcauaacggacaucauggagccugagcacgcccugcucgcuaaguccaucuucaaacugaccuaucagaacaagguggugcggguccagcgcccagcaaaaaacgguaccgugauggacgugaucucccggagagaccagaggggcagcgggcaggucgguaccuacggccugaacacguucaccaacauggaggcccagcucauccgccaaauggaauccgaagggaucuucagccccuccgaguuagagacccccaaccuggccgagcgggugcuggauuggcuggagaaguacgggguggagcgccugaagcggauggccaucagcggggaugacugcgucguuaagccuaucgacgaccgcuucgccaccgcucuaacggcccugaacgacaugggcaagguccggaaggauaucccgcagugggaacccagcaagggguggaacgacuggcaacagguccccuucugcagccaccacuuccaccagcugaucaugaaggacggccgugagaucguggugccgugccggaaccaagacgagcucgugggccgcgcucgugugucgcagggagccggauggucccuucgcgaaaccgccugccucgguaagaguuacgcgcagauguggcagcuaauguacuuccaccggcgugaccugcggcuugccgccaacgccaucugcuccgcgguccccgucgacuggauccccaccagccgcacgacgugguccauccacgcccaccaccaauggaugaccaccgaggauaugcucagcguguggaaccgcguguggaucgaggagaaccccuggauggaggacaagacacauaucuccucauggggggacguaccauaucuggggaagcgcgaggaccaguggugcggcuccuugaucggucucacggcccgcgccaccugggccaccaacauccagguggcgauaaaccaggugaggcgccuaauuggaaacgagaacuaccuggacuacaugaccagcaugaagcgguucaagaacgaguccgaccccgagggugcccucugguag

SEQ ID NO: 24204 - RNA, 9879 nt, Artificial Sequence
  derived and/or modified CDS sequence (opt11) from DENV-1__FJ410231__SS-prME
agcguuaccaugcugcucaugcucaugccgaccgcauuagcuuuccaccucacgacaagaggaggggaaccccauaugaucgugaguaagcaggagcggggcaagagccugcuguuuaagacaagcgccggggugaacauguguacccugaucgccauggaccuaggcgagcugugcgaggacacaaugaccuacaagugcccccgcaucaccgagguggaacccgacgacguggacugcuggugcaacaccaccgacaccugggugacauacgguaccugcagccagacgggcgagcaccggcgagacaaacgcagcguggcacucgcgccccacgucggccuggggcuggaaacgcgcgcugagaccuggaugagcuccgagggcgcauggaagcagauucaaaagguggagaccugggcccuccggcaccccgguuucaccgugaucgcgcuguucuuggcccacgcgaucggcaccagcaucacccagaaggggaucaucuucauccuccugauguuagucacucccuccauggcgaugcggugcguggggaucggcagccgggacuuuguggaggggcucuccggcgcaacgugggucgacgugguucuggaacauggcagcugcgucaccaccauggccaaagacaaacccacccuggacaucgagcuacuaaaaacggaagugaccaaccccgccgugcugcgcaagcucugcauugaggcgaagaucagcaacaccaccacggacagccgcuguccgacccaaggcgaggcaacccugguagaggagcaagaugccaacuucguaugccggcggacguucguagaccgcggcugggggaacgguugcggccucuucgggaaggggucacucauaacgugcgccaaauucaagugcgugaccaaguuagagggcaagaucguacaauacgagaaucuuaaauauagcgugaucguuaccgugcacaccggugaccagcaccagguggggaacgaguccacggagcacggcaccaccgccaccaucacgccccaggcccccaccagcgagauccagcucacugacuacggggcccugacucuggacugcagcccccggaccggccucgauuuuaacgagaugguccugcuuacgaugaaggagaagucauggcucgugcacaagcagugguuuuuggaccucccgcuccccuggaccagcggggccuccacgagccaggagacguggaaccgccaggaccugcuggucaccuucaagaccgcucacgcgaagaagcaggaggugguuguccucggcucccaagagggcgcuaugcauacagcccugaccggggccacugagauccaaaccagcggcaccaccacgauuuucgcaggacaccugaagugucggcucaagauggacaagcugacccuuaagggcauguccuacgugaugugcaccggcagcuucaaacucgagaaggagguggccgaaacacagcacggcacgguccucgugcagauaaaguaugagggcaccgacgcgccaugcaaaauccccuucuccacccaagacgagaagggcgugacccagaacggccgacugaucacagccaacccgaucgucacggacaaagagaagcccgugaacauagaggcugagccaccuuucggggagagcuacaucgugaucggugcuggcgagaaggcccugaagcucuccugguuuaaaaaggggagcuccaucggcaagauguucgaggccacagccagaggggcccgccggauggccauccugggcgauaccgccugggacuucgggagcaucggcggcguuuucacauccguggggaagcuggugcaccagaucuucgggaccgccuacggaguucuauucucuggcguguccuggaccaugaagaucgggaucgguguguugcuaaccuggcucggccugaacagccgcucuacgagccuguccaugaccugcaucgccgucgggcucgugacccuguaccugggcgugaugguccaggccgacuccgggugcgugaucaacuggaagggccgcgagcuaaagugcgggagcggcaucuucguaaccaacgaggugcacacguggaccgagcaguacaaguuccaggccgacuccccgaagcgguuaagcgcggccaucggcaaggccugggaagaggggguuugcggcauccgauccgccacccggcuggagaacaucauguggcgccagaucagcaacgaacuaaaucacauccugcuggagaaugauaugaaguucaccguaguugugggugacguggucggcauccuggcccagggaaagaagaugauccggccucagcccauggagcacaaguacucauggaaguccuggggcaaggcgaagaucaucggcgccgacgugcagaacaccacguucaucaucgaugggcccaacaccccggaaugccccgacgaccagcgcgccuggaacauaugggagguggaagacuacggguucggcaucuucaccacaaacaucuggcugaagcugcgggacucuuacacacaggucugcgaucaccggcucaugagcgcggcgaucaaagacuccaaggcugugcacgccgacaugggcuacuggauagagagcgagaagaacgaaaccuggaagcuggcccgggccuccuucaucgaggugaaaaccugcaucuggcccaagagccacacccuuugguccaacggcgucuuggagagcgaaaugaucaucccaaaaaucuacgggggcccgaucucccagcacaacuaccgccccggguauuucacgcagaccgcagggcccuggcaccugggcaagcuggagcucgacuuugacuugugcgagggcaccaccgugguggucgaugagcacugcgguaaccgggggccgagccugcgcacgacuacuguuacaggcaagauuauacacgaguggugcugccguuccugcacucugccgccccuccgcuucaagggggaggacggcugcugguacgggauggagauccgacccguaaaggagaaggaagagaaccuggucaaaagcauggugagcgcgggcuccggcgagguggacagcuucucccucggccugcugugcaucagcaucaugaucgaggaggucaugcgcucccgguggagcaggaagaugcucaugaccggcacccuggccguguuuuuccugcuuaucauggggcagcuuacuuggaacgaccugauccggaguugcaucaugguuggcgccaacgcgagcgaccggauggggauggggacgaccuaccucgcgcugauggccaccuucaagaugcgcccgauguucgcaguggggcuauuguuccgacgccuaaccucgcgggagguacugcuccugacgaucgggcugucgcuggucgccuccguggagcugccuaacucccuggaggagcucggcgacgggcuggcuauggguaucaugauccugaagcucuuaaccgacuuccaguccuaccagcugugggccacccuccugagccuuaccuucaucaaaacgaccuucucccuacacuacgccuggaagacaauggccaugguucugagcaucguaucccugcucccccugugucugagcacgacuucccagaagacgacguggcuccccgugcugcugggcagcuugggguguaagccucugacuauguuccuaaucgccgagaacaagaucuggggccgcaagagcuggccccuaaacgaggggauuauggcugugggcauagucuccauccugcugagcucccuccuuaagaacgaugugccccuggccgguccccucaucgccggcggaauguugaucgccugcuacgugauuagcgggucuucagccgaccugucccucgagaaggcggcugaggucagcugggaggaggaagccgagcauucaggcgccagccacaacauccugguggagguucaggacgaugggacuaugaagaucaaggacgaggagcgggacgacacccugaccauccuccugaaggccacccugcucgcugucaguggcguguacccgcugagcauccccgcgacccuguucgugugguacuucuggcaaaagaagaagcagcgcuccgggguccucugggacacgcccagcccgccugagguggagagagccguucucgacgauggaaucuacaggaucaugcagcggggccuucugggacgaucccaggucggcguggggguguuccaggagaacgucuuccacaccauguggcaugugacccggggagccgugcucauguaccaggggaagcgccuggagccaagcugggccucggucaagaaggaccugaucagcuacggaggaggguggcggcuccaaggcuccuggaauacgggggaggagguccaggugauagcggucgagcccggcaagaaccccaagaacgugcagacugcccccgggaccuucaagacccccgagggcgagguuggcgccauugcccuggauuucaagccgggaaccucaggcagccccaucguuaaccgcgaggggaagaucgugggccuguacgggaacgggguagugacgaccuccggcacuuacgugagugccaucgcacaggccaaggccucccaggaggggccgcuccccgagauugaggacgaaguguuccggaaacgcaaccugaccaucauggaccuucaccccggcagcgguaagacgcggcgcuaccucccggcaauuguccgggaggcuaucaagaggaagcugaggaccuuaauccucgcccccacccgcgugguggccagugagauggccgaggcgcugaagggcaugcccauccgcuaccagaccacagcggucaagagcgagcacaccgggcgggagaucguggaucugaugugucacgccaccuuuacuaugcgccuccugucccccguccgggucccgaacuacaacaugaucaucauggacgaggcgcacuucacagacccgucgaguaucgccgcccgcggguacaucagcacacgggugggcaugggagaggcggccgcgaucuuuaugacagccaccccgccuggguccguggaggccuucccucagagcaacgcugucauccaagacgaagaacgcgacauccccgagcgguccuggaauagcggguacgaauggaucacggacuucccuggcaagaccgugugguucgugcccuccaucaagagcggcaacgacaucgccaacugccugcgcaagaacggaaagcgggucauccagcucucccgcaagacuuucgacaccgaguaccagaagacgaagaacaacgauugggacuacguugugaccaccgacaucagcgaaaugggcgcaaacuuccgggcggaccgcgucaucgauccucgacgcugccugaagccggucauccugaaggacgggcccgagcgggucauccucgcgggccccaugccggugaccgucgccuccgcagcccagcgccgggggagaauagggcggaaccacaacaaggagggcgaccaauauaucuacauggggcagccccuaaacaacgacgaggaccaugcacacuggaccgaggcgaagauguuacucgacaauaucaauacucccgaggggaucaucccagcccuuuucgagccggaaagagagaaguccgccgccaucgacggggaguaucgccugcgaggcgaggcccgcaagacauucguggaguugaugcggcgcggugacuuacccgucuggcugagcuacaagguggccuccgagggcuuccaauacagcgaccggcgcuggugcuucgauggggagcgcaauaaccagguacucgaagaaaacauggauguggagaucuggacuaaggagggggagcgcaagaagcuccgcccucgcuggcuggacgcccggacauacagcgacccccucgcccuacgcgaguucaaagaguucgcggccggacggcgcagcguguccggggaccugauucucgagauaggcaaguugccgcagcaccuuacccagcgggcacagaaugcccucgacaaccugguaaugcugcacaauagcgagcagggcggccgcgccuaccggcacgccauggaggaacuccccgauaccaucgagacccugaugcuccucgcgcugaucgccgugcugacuggcggggugaccuuguucuuccuguccggcaaggggcugggcaaaaccuccaucggccuccugugcgucauggcgaguagcgcgcuccucuggauggccuccguggagccccauuggaucgcugccucgaucaucuuagaguucuuccugauggucuuacuuauaccugagccggacagacagcgcacgccccaggacaaccagcuggccuacgucgugaucggucuccuguuuaugauccugaccguggccgccaacgagaugggcuuauuggagacaaccaaaaaggaccuggggaucggccacguagcgguggagaaccaccaccacgccaccaugcuagacguggaccugcaccccgccucagccuggacccuguacgccgucgcaacgaccaucaucacaccaaugaugcgucacaccauugagaacacgacugccaacaucagucucaccgccaucgcaaaucaggcugcgauccugauggggcuggauaagggcuggcccaucuccaagauggauaucggcgugccccuccuggcccugggcugcuacagucaggugaacccccucacccugacggccgccgucuugaugcucguggcgcacuacgcaaucaucggcccggggcugcaggccaaggccacacgggaggcucagaagcggaccgcggcuggcaucaugaagaaccccaccgucgacgguaucgucgccauugaccuggaccccgugguauacgaugccaaguucgagaagcagcucggccagauuaugcugcuuauucucuguacgucccagaucuugcugaugcgcacgaccugggccuuaugcgagucaauuacccucgcgacgggcccccugaccacccucugggagggguccccggguaaguucuggaacaccacgaucgcuguaagcauggccaacaucuuccgggggagcuaccuggccggcgccggccuagcguuuucccucaugaagucgcucgggggcggacgccgcgggaccggcgcccagggcgagacucuaggcgagaaguggaagcgacagcucaaccaacugucaaagagcgaguucaacaccuacaagagguccgggaucauggaggucgaccggagcgaggccaaggaaggccuucggcgcggggagacaaccaaacacgccgugucccgaggcaccgcgaagcugcgcugguucguugagcguaaccuggugaagcccgaggggaaggugauugaccugggcugcggaagagggggcuggagcuacuacugcgccgggcugaagaaggucacugaggugaagggcuacacgaagggugggcccggccacgaggagccuaucccgauggcaaccuacggcuggaaccucgucaagcugcacaguggcaaggaugucuuuuucauuccacccgagaagugugacacccugcucugcgacaucggggagagcucccccaacccgaccaucgaagagggccggacgcugcgcguucugaaaaugguggagcccuggcuccggggcaaccaguucuguaucaagauccugaaccccuacaugcccagcguuguggaaacacuggagcagaugcagcgcaagcauggcggcaugcucgugcggaauccgcugucccgaaauucaacccacgagauguacuggguauccugugggaccggaaacaucguuagcgccgugaacaugacaucacggauguugcucaaucgcuucacgauggcccaucgcaaacccaccuacgaacgggaugucgaccugggggcgggcacccgccacguggcuguggaacccgaggucgccaaccuggacaucaucggacagcggauagagaauaucaagcacgagcacaagagcacauggcacuacgaugaagauaaccccuacaagacgugggccuaccacggguccuacgaggugaagccuagcgguagcgccucuuccauggucaacgggguggugaaguugcuaaccaagcccugggaugugauccccauggugacccagaucgcgaugaccgacacgacccccuucggccagcagcgcguauucaaagaaaagguagacacccggacacccaaggccaaaagggggacggcccagaucauggaggucacggccaaguggcuguggggcuuuuugucccggaacaagaagccucgcaucugcacucgggaggaguucacccgcaagguucgaaguaacgccgcgauuggugccgucuucguggacgaaaaccaguggaacuccgccaaggaggcuguggaggacgagcgcuucugggaccucguucaucgggaacgcgaacugcauaagcaggggaagugcgcgacgugcgucuacaacaugauggggaaacgggagaagaaacucggcgaguucggcaaggccaaagguagucgcgccaucugguauauguggcugggcgcccgguuccuggaguucgaggcccucggauuuaugaacgaagaccacugguucucccgcgaaaacagcuuaucggggguggagggcgagggguuacacaaguugggcuacauucugcgggacauuagcaagauucccggaggcaacauguacgccgacgacaccgccggcugggacacccgaaucaccgaggacgaccugcagaacgaggccaagauuacugacaucauggagccggagcacgcccuccuagccacgagcaucuucaagcucaccuaccagaacaagguggugagagugcagcgccccgcgcgcaacggcacagucauggacgugauaagccggcgcgaucaaagagggucgggccaggugggcaccuacggcuuaaacaccuucaccaauauggaggcccaguuaauccgccagauggagagcgaagggaucuucuccccuagcgaguuagagacucccaaucucgccgagcggguccuggacuggcuggagaagcauggcguggagcgccucaagcggauggcaaucuccggggacgauugcguggucaagcccaucgacgaccgguucgccacggcgcugagcgcccuaaacgacaugggcaagguucgaaaggacaucccgcaaugggagcccagcaagggauggaacgacuggcagcaaguccccuucugcucccaccacuuccaccagcugaucaugaaggauggacgcgagaucgucgugccgugccggaaccaggaugagcuggugggucgcgcccggguuagccaaggcgccgguuggucccugcgugagaccgccugccucggcaagagcuacgcgcaaauguggcaguugauguacuuccaccggcgcgaccugcggcucgcagcgaacgcgaucugcagugcggugcccguagacuggguccccaccucgcgcaccacgugguccauccaugcccaccaccaguggaugacaaccgaggauaugcuaagcguguggaaccggguguggaucgaggagaacccauggauggaggacaagacccacauaagcuccuggggcgaugucccguaccugggaaagcgcgaggaucaauggugcggcucacucaucggccugacggcgcgcgccaccugggccaccaacauccagguugcgaucaaccaggugcgucgccuaaucgggaacgagaacuaccucgacuacaugaccagcaugaaacgguucaagaacgaaucagaccccgagggagcccugugguga

SEQ ID NO: 24205 - RNA, 9879 nt, Artificial Sequence
  derived and/or modified CDS sequence (opt11) from DENV-1__FJ461323__SS-prME
uccgugacaaugcuacuaaugcucaugccgaccgcgcuagcguuccaccuaacgaccagaggaggggaaccacacaugauagucagcaaacaagagcggggaaagagcuuacuauucaaaacaagcgcagggguaaacauguguacacucauagccauggaccuaggcgagcugugcgaggauacgaugaccuauaaaugcccuagaauaacugaggccgaaccggaugacguagacugcuggugcaacgcuacagauacauggguaaccuacgggacaugcucacaaacaggggagcaucggcgggauaaaaggucagucgcgcuagccccacacgugggacucgggcuggaaacccggacugaaacuuggaugucgagcgaaggggccuggaaacagauacaacggguggaaacuugggugcugagacacccggguuuuacagugauugcacucuuccucgcacacgcaauugguacgucuauaacacaaaaaggcauaauauucauccugcuaauguuaguaacgccauccauggcaaugcgaugcguugggaucggauccagagacuucgucgaaggacugagcggagccaccuggguagacguaguucuugaacauggcuccugcguaaccacgauggcaaaagacaaaccaacccucgacauagaacuacuaaagacggaggucaccaacccagcuguucuccgcaaguuaugcauagaagccaagaucuccaacacaacaacugacagucguugcccaacccaaggcgaagccacccucgucgaggaacaagacgcgaacuucguauguaggcgaacauucguagaccgcggcugggggaacggcugcggccuauucggaaaaggaagucucaucacgugcgcaaaauucaaaugcgucacaaaacuagaagggaaaauugugcaauaugagaaccucaaguacucagugauaguaacuguacacaccggcgaccagcaccaagucggcaacgagaguaccgagcacgggaccacagccacaauaacuccccaagccccgacgacggagauucaauuaacggacuacggcgcuuugacccuggacugcucuccgagaacuggacucgacuucaacgagaugguccuccucaccaugaaggaaaaaucuuggcucguccauaaacagugguuucucgaccucccccuacccuggacaucuggggcuagcaccagccaggaaacguggaacagacaggaucuacucguaaccuucaaaaccgcccacgcgaagaagcaggaaguaguaguacuagguucccaagaaggcgcuaugcacacagcuuuaaccggcgcgaccgagauacaaacaucaggaacaacgacaauauucgcuggccaccucaagugcagauugaaaauggacaaacugacauuaaagggaaugagcuacgucaugugcacggguucauucaaacuagagaaagaagucgcggagacccaacauggcacgguacugguacaaauaaaauacgagggcaccgaugcgccuugcaaaauaccauucagcacgcaagacgaaaagggcguaacccagaacggcagauuaaucacggcaaauccuauaguaacugauaaagagaagccggucaauauagaggcggagccacccuuuggggaaagcuacaucgucaucggcgccggagaaaaagcacuaaaguugaguugguucaagaaaggcucaagcaucggaaagauguucgaagcaacagccagaggcgcgcggagaauggccauucuaggugacaccgccugggacuucggaucaauaggcggagucuuuaccagcgucgguaagcuaguacaccaaaucuucggcaccgcuuauggggugcuguuuaguggggucagcuggacaaugaaaauagggaucggcgugcuacuuacuugguuaggguuaaauucccgcagcaccucccuaagcaugaccugcaucgcugucggcuugguuacccuauaucuaggaguaaugguccaggcagacagcggcugcgucaucaacuggaaaggacgagaguuaaagugcgggagcggaaucuucguaacaaaugagguccauaccuggaccgaacaguauaaauuucaggcugacuccccgaaacgacuaagcgcugcgaucgguaaggcuugggaagaggguguuugcgggauucgcucugcaacuagacuggaaaacauaauguggaagcaaaucaguaacgagcuaaaccacauccuucuugaaaacgacaugaaacugacuguaguagugggugacgucgcuggaauccucggucagggcaagaaaaugauucgcccccagccgauggaauacaaauacaguuggaaauccugggggaaagccaagauaauuggcgcagacgcccagaauaccacguuuauaaucgacggcccaaacacaccggaaugccccgaugaucagcgugccuggaacauaugggaagucgaagacuauggcuucgguauauucacgacaaacaucuggcuuaagcuccgagacucguacacgcagguuugugaccauagguugauguccgcagccaucaaagacagcaaggccgugcacgcagauaugggauacuggauagaaucggaaaagaacgaaacauggaaacuggcacgcgcgagcuucaucgaggucaaaaccuguaucuggccgaagucacacacacuauggucuaauggcgugcuggagucggaaaugauaauucccaaaaucuacggcggaccgauaucucagcacaacuauagaccaggguacuucacccagacagcaggacccuggcaccugggaaaacucgaacuggacuucgaccuaugcgaaggcacaacaguagugguagacgagcauugcggcaaucgaggacccagcuuaagaaccaccaccguaacuggcaaaaucauccacgaauggugcugucgcagcuguacccucccaccccuuagauuccgcggagaggauggauguugguacggaauggaaauacgccccguaaaggagaaggaagaaaaccuagucaagagcaugguauccgcuggcaguggggaaguagacucguucagccuggggcuccucuguaucucaauuaugauagaagagguaaugcggucgcgauggucgcguaagaugcugaugaccgguacacuagcugucuucuuccuccucaucauggggcaauuaacguggaacgacuugauacggcucuguauaaugguaggagcaaaugcgagugauaggauggggauggggacaaccuaccucgcuuugauggcgacauucaagaugaggccgauguucgccguagggcuacuuuucaggcgauuaacaucccgcgaaguccugcuacucacgauagguuugagcuuagucgccagcgucgaacucccaaacagccuggaggaauuaggggauggucucgccaugggcaucaugauccugaaguuacugaccgauuuccaaucucaccagcuaugggccacucuacugagccugaccuucaucaaaacaacuuucucccuccacuacgcauggaagacaauggccaugguacuauccaucgucucccucuuuccauugugucuaaguacaacgagucaaaagacgaccuggcuuccaguguuacuaggaagccuagggugcaaaccuuuaaccauguuccugaucgcagaaaacaaaauuugggggcgaaagagcuggccccuaaacgaagggaucauggcgguugggauaguuaguauacuacugagcucgcuacucaaaaacgacguaccucuggccgguccccuaaucgccgggggaaugcuaaucgcaugcuaugucauaagcgggaguucggcagaccuuucccuggaaaaggcagcggaaguauccugggaggaggaggcagagcauucaggagccagccacaauauccuagucgaggugcaagaugacgguacaaugaagauaaaagaugaggagcgagacgacacccuaacgaucuuacucaaagccacauugcuggccguaucagggguguauccacuauccauaccagcaacgcuauucgucugguauuucuggcaaaagaaaaagcagcgaucaggcguguugugggacacuccauccccgcccgagguugagagagcaguccucgacgacgggauauaccggauuaugcaaaggggacucuuagggcguagccaggugggcgucgggguauuucaggaaaacgucuuccauacuauguggcaugucacuaggggcgccguucuaauguaucagggcaagagacuugagccgucuugggcgagcguaaagaaagaccucauaucauacggcgggggauggcgccuacgggggucguggaauaccggcgaagaaguacaaguuaucgcaguggaaccggguaaaaacccaaagaacguucagaccgcccccggcaccuuuaagaccccagagggagaagucggagcuauagcgcucgacuuuaaaccuggcacauccggcagccccauugucaauagagaagggaagauagugggccuguauggaaacggaguagucacgacgagcggaaccuacguaagcgcgauagcgcaagccaaggccagccaggaaggcccccuccccgagauagaggacgaaguguuccggaagcgaaaccugaccaucauggaccuacaccccggaucugggaaaacaaggagguacuugccggcgaucgugagggaggccaucaaacgaaaacuaagaacguuaauucuggccccuacacgagucguugcaagcgagauggccgaggcacuaaaggguaugccaauccguuaccaaaccacagcuguaaaaagugagcacacaggcaaagaaauagucgaccugaugugccaugcgaccuucacaaugcgccucuuaucucccguucgcgugccaaacuauaacaugauaauaauggaugaagcgcacuucacagacccaaguagcaucgcagcaagagguuacaucagcacacgcgucggaaugggcgaagccgcagccauauucaugacagcaacaccucccggaaguguagaggccuucccccaaucaaacgcaguaauccaggacgaagaacgcgacauccccgagcguaguuggaacucuggauacgaauggauaacggacuuuccuggcaaaaccguaugguucguaccgagcauaaagagcggcaacgacauugcaaacugccuccggaagaacgggaaacgagugauucagcuaagccgaaaaacguucgauacagaauaucagaaaaccaagaacaaugauugggauuauguggucacaaccgauaucagcgaaaugggggcaaauuuccgggcagauagggucaucgacccacgccgcugccucaagcccguaauucuaaaggacggaccagaacgcgucauccuggcaggccccaugccagucaccguagccucggcggcccagcggagaggacgcauuggaagaaaccauaauaaagagggcgaucaguacauauacauggggcaaccccuaaauaaugacgaagaccaugcgcauuggacugaggcgaaaauguugcuagacaacauaaacacgccggaaggcaucauaccugcccuauucgaaccagaacgcgagaaaagugcagcaguagacggggaguaccggcuuagaggcgaagcacggaaaacauucgucgaacugaugcgcaggggcgaccuaccagucuggcugagcuacaaaguagcuuccgagggguuucaauacucagaccgacgcuggugcuucgacggcgaacggaacaaccaggugcuugaagaaaacauggauguagagaucuggacuaaggaaggagagagaaagaaacuccgccccagguggcucgacgcaagaaccuacuccgacccauuagcacuccgagaguuuaaagaguucgcagccggcagacguaguguaucaggagaccucauucucgagaucggaaagcuaccacaacaccugacucaacgagcgcagaaugcgcuagacaaucuagucaugcuucacaacagcgaacagggaggacgggccuacaggcacgccauggaagaacugccugacaccaucgaaacacuaaugcuauuagccuuaauugccguacuaacgggcgggguuaccuuauucuuccucucgggacgcgggcucgggaagacaaguauaggguuacuuugcgugauggcgucauccguguuacucuggauggcuuccgucgagccccacuggauagccgcaaguaucauucuagaguucuuccuuaugguucuucucauaccagaacccgaucgccaacgcacgccgcaagauaaccaacuagccuacgucgugauaggccuauuguucaugauccuaacgguggccgcaaaugaaaugggauuguuggaaacgacuaaaaaggaccucggcauaggacacguagcgguugaaaaccaccaucaugccgccaugcucgacguugaccuacaccccgcaucagccuggacguuguaugcaguagcaacaaccaucauuacccccaugaugaggcacacaauagagaacaccacugcaaauaucucacuaaccgcaaucgcgaaccaagcagcaauucucauggggcuagauaagggcuggccuauuucaaaaauggacauagggguuccacuucuagccuugggguguuacagucaaguaaacccgcuaacguuaacggcagcuguucugaugcuggucgcgcacuacgcaaucaucggcccuggucuacaagcgaaagcuacccgcgaagcgcagaagcgaacagcagcggggaucaugaaaaacccaaccguagacggaauaguagcaauagaccuagauccugugguauacgacgcaaaauucgaaaaacaacuugggcaaauaaugcugcugauccucugcaccucccaaauccuacugaugcgaacuacaugggcccuaugcgaaagcaucacccuagcaaccggaccacucaccacacuaugggaaggcucgccaggaaaauucuggaauacgaccauagcaguuuccauggcgaacaucuuccgaggaagcuaccuggccggggccggacuggcguucagccugaugaaaucacuaggcggaggacguagggguacaggggcacagggcgaaacauugggcgaaaaguggaagcgccaacuuaaccaauuaagcaaaagcgaauuuaacacguauaaacggagcggcauaauggaagucgaucgcagugaagccaaagaggggcuaaaacgcggggagacgacuaagcaugccguauccagggguaccgcaaaacuccgcugguucgucgaacggaaccuaguuaagccggaggguaaagucaucgaucuagguugcgggcgaggcggaugguccuacuacugcgcggggcugaaaaaggugacagaaguaaagggguacacaaaaggcgggccgggccacgaagaaccaauaccuauggcuaccuacggauggaaccucgugaagcugcacaguggcaaagacguguucuucaucccuccagagaaaugcgacacguugcucugugacaucggggaaagcucccccaacccgacgaucgaagaagggcgcacucuacggguccuaaaaauggucgaaccauggcuacggggaaaccaauucugcauuaaaauccuaaaccccuacaugcccucgguaguagagacccuggaacaaaugcaacgaaaacacggcgggaugcuaguucgaaauccccucagccgaaacuccacacaugaaauguacuggguaaguugcggcacaggcaauauaguguccgcagucaacaugacaagcagaaugcuacucaaccgcuucacgauggcgcacagaaagccaacguacgagcgcgacgucgaucuagguaccgggacucggcauguggcuguagaaccagaaguagcaaaucuagacauuaucggucaacgaaucgaaaacaucaagcaugagcacaagucuacauggcacuacgacgaggacaauccauacaagaccugggcauaccacgggucuuaugaagucaaaccuuccggcagugcaucgagcaugguuaacgggguaguaaaacuacucacgaagccaugggacgucaucccgauggucacccaaauagcgaugaccgacacgacgccauucggacaacaaagagucuucaaagaaaaaguggauacuagaacccccaaggccaaaagagggaccgcucaaaucauggaggugaccgcccgauggcuguggggguuucuaucacgaaacaagaaaccacgcaucugcacucgugaagaguucaccaggaagguucggucgaacgcggcgauaggcgccgucuucguggacgaaaaucaguggaacagcgcgaaggaggcagucgaggacgagcgcuuuugggaccuaguccacagagaaagagaauugcauaagcagggcaaaugcgcaacaugcgucuacaacaugaugggaaagcgagagaagaaacuaggcgaguucggcaaggcaaaagggagccgcgcgauaugguacauguggcugggcgcaagauuccuagaguucgaggccuuagguuucaugaacgaggaucacugguucagcagagaaaacucccucagcgggguagaaggagaagggcuacacaaacugggcuauauccugcgcgauauaucaaagauaccuggcggcaauauguacgcggacgacaccgcgggaugggacacgcggauaaccgaagacgaucugcaaaacgaggcgaaaauaacagacauaauggaacccgaacacgcacugcucgccaaggccauauucaagcuaaccuaucaaaauaagguagugcgcguacaacgaccugccaaaaaugggaccguuauggauguaauuagccgaagggaccaacgaggguccgggcagguaggaaccuauggguugaacacguucacgaacauggaggcccaacucauucgacaaauggagagcgaggggauauucagccccuccgaacuugagacaccgaacuuggccgaacgagcccuagacugguuagagaaguacggcgucgaacgacuaaagcguauggccauaucgggugacgacugcgucgugaaaccgaucgacgaucgguucgcaacagcgcucacggcgcucaacgacaugggaaaagucagaaaagauauaccccaaugggagccaagcaaaggguggaaugacuggcaacaagucccauucugcucucaccauuuccaccagcucaucaugaaggacgggagagaaauagucgugccgugcaggaaccaagacgagcuggucggccgcgcccguguaucgcagggagcaggcuggagccugagagagaccgcgugccuaggaaaauccuacgcccagauguggcagcucauguauuuucaccgaagggaccuacgccuagccgcaaacgcuauaugcuccgcagucccaguagacuggguaccuacgucgcgaacaacuuggucaauacacgcccaucaccaauggaugacgacggaggauaugcucucgguuuggaacagggucuggaucgaggaaaacccauggauggaggauaagacccacauuaguuccugggaagacguaccguaccuaggaaaacgagaagaucaauggugugguucacucauagggcuaacagcucgggcaacaugggcaaccaacauucagguggcaauaaaccagguaagacgacugaucggaaacgagaacuaccuggacuacaugaccagcaugaaacgcuucaaaaacgagacagacccagaaggggcucucugguaa

SEQ ID NO: 24206 - RNA, 9879 nt, Artificial Sequence
  derived and/or modified CDS sequence (opt11) from DENV-1__FJ461325__SS-prME
agcgugacgaugcugcucaugcugaugccaaccgcacuggccuuccaccucaccacccggggcggugagccccacaugaucgugagcaagcaagagcggggcaagagccuacuguuuaagaccucagcuggggugaauaugugcacccucaucgccauggaccugggggagcugugcgaggacaccaugacuuacaaguguccccgcaucacggaaaccgagcccgacgauguggacugcugguguaacgcuacggacaccugggugaccuaugggaccuguagucaaaccggcgagcaccggcgcgacaagcgguccguggcccucgccccccacgugggccuggggcuggagacacgcacggagaccuggaugagcuccgagggcgccuggaaacagauacaacggguagaaacgugggcccucagacaccccggguucaccgugaucgcccuguuccuggcccacgcgauagguaccagcauuacucagaaggggaucaucuucauccuccugauguuagucacgcccucuauggccaugcggugcgucggcauuggcagccgcgacuucguagagggucucuccggagccaccuggguggacgugguacuggagcacggaagcugugugacuaccauggccaaggacaaacccacgcuggacauugagcuccugaagaccgaggucacuaaccccgccgugcugcggaagcucugcaucgaggcgaagaucuccaacaccacgaccgacagccgcugcccgacccaaggcgaggccacccuaguggaggagcaagacgccaacuucgucugccggaggacuuucguugaccggggcugggggaacggcugcggguuauucggcaaggggagccucaucacgugcgcaaaauucaagugcguaaccaaacuggaaggcaagaucguccaguacgagaaccugaaguacucagugauagugacaguccacacgggcgaccagcaccagguggggaacgaguccaccgagcacggcaccacagccaccauaacgccccaggcaccuaccacggagauccaguuaaccgacuacggugcccucacgcuagacugcucgcccaggaccggcuuggacuucaacgagaugguccugcugacaaugaaggaaaaguccuggcuggugcacaagcaaugguuuuuggaccugccccuacccuggaccucuggggccagcacgucccaggagaccuggaaccggcaggaccugcuggugaccuucaaaaccgcccacgccaagaagcaggaggugguggugcucggcucacaagaaggcgccaugcacaccgcccucaccggggccacagagauccagaccuccggaacgaccaccaucuucgccggucaucugaagugucgccucaaaauggauaaacugaccuugaagggcaugagcuacgugauguguacgggguccuuuaagcucgagaaggagguggccgagacccagcacggcaccguucucguccagaucaaguacgagggcacggacgcgcccugcaagauccccuucagcacccaggacgagaaaggggugacccagaacggccgucugauaacugccaacccgaucgugaccgauaaagagaaacccgucaacaucgaggccgaaccgcccuucggggagucguacauagugaucggcgccggcgagaaggcgcugaagcucagcugguucaagaaaggguccagcaucgguaagauguuugaggccacggcccgcggggcccggcguauggccauccucggugacaccgcaugggacuucggguccaucgguggcguguucacgagcguagggaagcuugugcaccagaucuucggcacggccuacggggugcuguucucgggcguaagcuggacgaugaagaucgggaucggcgugcugcugaccuggcucggccugaacucccgcagcaccucccuuagcaugaccugcaucgccguaggccucgucacguuauaccugggcgugauggugcaagccgacagugggugcgucaucaacuggaagggccgggagcucaagugcgggagcggcaucuucgugaccaacgaagugcacaccuggacggagcaguacaaauuccaggccgauagcccgaagcgucuguccgcggccauugguaaggcaugggaggagggggucugcggcauacggagcgcuacccgacuggagaacaucauguggaagcagaucuccaaugagcucaaccacauccuguuagaaaacgacaugaaguucacggugguggucggagacguggccgggauucucgcucaggggaagaagaugauccggccgcagccaauggaguacaaguacagcuggaagucauggggcaaggccaagaucaucggcgccgacguacagaacaccaccuucauuaucgacgggccaaacacgccggaaugccccgacgaucagcgcgccuggaacaucugggaggucgaggauuacggcuuugggaucuucacgaccaauaucuggcugaagcugcgggacagcuacacccaagucugcgaccaccgccucaugucggcggccaucaaagauaguaaagccguacacgccgacaugggcuacuggaucgaauccgagaagaacgaaaccuggaaacuugcccgagccucguucauagaggucaagacgugcaucuggcccaagucccacacccuguggagcaacggggugcucgaguccgagaugauaauccccaaaaucuacgggggcccgaucagccaacacaacuaccgccccggguacuucacucaggccgccggaccauggcaccuaggaaagcucgaacucgacuucgaucuuugcgagggcaccacgguggugguugacgagcacugcgguaaccgggggccgucccugcgcaccaccaccgugacugggaagauaauccaugaguggugcugucgaagcugcaccuuaccgccccuccgcuuccgcggggaagacggcugcugguacgggauggagauccgccccgucaaggagaaggaggagaaccuggugaaguccauggucagcgccggcagcggcgaggucgacucguucucacugggacuccuguguauauccaucaugauagaagaggugaugcggagccgcuggucccggcgcaugcucaugacgggcacccuggccguguucuuccugcucaucauggggcaguugacguggaacgaucugaucagacuuugcaucauggucggcgcgaacgccagcgacaggauggguaugggcaccaccuaucuggcccugauggccaccuucaaaaugcgcccuauguucgccgugggccuucuguuccggcgccugacaucacgggagguguuauugcugaccaucggguugagccuggucgccuccguggagcugccgaacagccucgaagagcugggcgacgggcuggccaugggcauaaugauccucaagcuguugaccgacuuccagucccaucaacucugggccacccugcucagccucacguucaucaaaaccaccuucucccugcacuacgccuggaagaccauggcgauggucuugagcaucguaucccuuuucccccugugccugucuacgaccucccagaagaccaccuggcuccccguguuguugggcucccucgggugcaagccgcugacuauguuccugauaaccgagaacaaaaucuggggacgccgguccuggccgcucaacgaggggaucauggccgucggcaucgugagcauccugcugagcucccuccugaaaaacgacgugccccuggccggaccccucaucgcgggcggcauguugauugccugcuacgucauaagcggguccagcgcggaccugucccucgaaaaggcagccgaggugagcugggaggaggaggccgagcauuccggcgccagccacaacauccugguggagguacaggaugacggaacuaugaagaucaaggaugaggagagggacgacacccugacaaucuugcugaaggcgacgcugcuggccgugucuggcguguacccgcugagcauccccgcaacccuguucgugugguacuucuggcagaagaagaagcagcggucagggguguugugggacaccccguccccgcccgaaguagagagggccguuuuggacgacgguaucuaccggaucaugcagcgggggcuucuugggagaucccaggugggaguggggguauuccaggagaacguguuccacaccauguggcacgugacacgcggcgccguccucauguaccaggggaagcggcuggagcccagcugggcguccgugaagaaggaccugaucagcuacgguggaggguggcgccuccagggauccuggaacaccggggaagaggugcaggucauugccguggagcccggaaagaaccccaaaaacgugcagaccgccccaggcaccuucaagacgcccgaaggugaggucggugccaucgcucuggacuucaagcccgggaccagcggcucccccaucgugaaccgggaaggaaaaaucgucggacuguacgggaacgggguagugaccaccagcggcacguacgugagcgcgaucgcccaagcuaaggcaucccaggaggggccguuacccgagaucgaggacgaaguguuccgcaagcggaaccuaaccauuauggaccugcaccccggcagcgggaagacccgccguuaccucccggccauagugcgugaggccaucaagcgcaagcugcggaccuuaauccucgcccccacgagaguggucgccuccgagauggccgaggcguuaaaggggaugccaauccgguaccagaccaccgccguaaaaucugagcacacaggcaaggagaucguggaccuuaugugucacgccacuuuuaccaugcgccuccugucccccguccgggugccgaauuauaacaugaucauuauggacgaggcccacuucaccgaucccagcucaaucgccgcgcgcggguacauuagcacacggguuggaaugggggaggcggcugccaucuucaugacggccacgccgcccggcuccguugaggcguucccgcaguccaacgccgugauccaggacgaagagagggacauccccgagcgguccuggaacagcggguacgaguggauuaccgacuuccccgguaagaccgugugguucguacccuccaucaagucgggcaacgacaucgccaacugccugaggaagaacgggaaaagagugauccagcucucccgcaagacguucgacaccgaguaccagaagaccaagaauaacgacugggacuaugucgucaccacggacaucagcgagaugggcgccaacuuccgggccgaccgcgugaucgauccgcgccgaugccugaagcccgugauccugaaggaugggcccgagcgggucauccucgccggccccaugccggucacagucgccucugccgcccagcgccgaggucgcaucggucgcaaucauaacaaggagggcgaccaguauaucuacaugggacagccccugaacaacgacgaggaucaugcgcacuggacagaggcaaagaugcugcucgauaauauaaacacacccgagggcauuauccccgcccuguucgagccggagcgcgagaaguccgccgccauugacggggaauaccgccugcggggcgaggcgcgcaaaacguucguggagcucaugcggcgaggggaccugccuguguggcuguccuacaaggucgccagcgagggauuccaguacagcgauaggcgcuggugcuucgacggagaacggaacaaccagguacuagaggagaacauggacguggagaucuggaccaaagagggagagcguaagaagcugcggccccgcuggcuggacgcccggaccuacucagacccccucgcccugcgcgaguucaaggaguucgccgcgggccggcgcucugucuccggggaccugauccuagagauaggcaagcugccccagcacuugacccagcgggcacagaacgcacuugacaaucuggugauguuacacaacagcgagcaaggcgggcgagccuaccggcacgcgauggaggaauugcccgauacgaucgagacccugauguugcucgcgcuaaucgcagugcugacaggcggggucacccucuucuuccuguccggacgcgggcugggcaagaccagcauaggccuccugugcgugauggccuccagcgugcuucucuggauggccagcguggagccccacuggaucgcggccagcaucauccuggaguucuuccugauggugcuccugaucccggagccagaccggcagcgcaccccacaggacaaucagcucgccuacguggucaucggucuucuguuuaugauccugacgguggccgccaacgagaugggccuccuggagaccaccaagaaagacuuaggaauuggccacguagcagucgagaaccaccaucacgccgcaaugcucgacguugaccugcaccccgccagcgccuggacgcuauacgcgguggccacaacaaucaucacccccaugaugcgccacacgauugagaacaccaccgccaacaucucacugaccgcaaucgccaaccaggcggcuauccugauggggcuggacaagggauggcccaucuccaagauggacaucgguguaccccuccuggcccuggguugcuacagccaagugaacccauugacucuuaccgccgcggugcuuauguuagucgcccauuacgccaucauagggcccgggcugcaggccaaggccacgcgggaagcgcagaagcgcaccgccgccggaaucaugaagaaucccacuguggauggaauagucgccaucgaccucgacccugucgucuaugacgccaaguucgagaaacagcucggccagauaaugcugcugauccuuugcaccucccagaucuuauugaugcggaccaccugggcgcuuugcgagagcaucacgcuggcgaccggcccccugaccacccuuugggagggcuccccugggaaauucuggaacacaaccaucgccgugucaauggccaacauauuccgagggagcuacuuagccggcgcgggcuuagccuucagccucaugaagucacucggaggcggccggagagggaccggggcgcagggugagacccugggggagaaguggaagaggcagcugaaccagcucucaaagagugaauuuaauacguauaagcgcuccgggaucauggaggucgaccggagugaggcgaaagagggauugaagcgcggggagaccacaaagcacgcggugagucggggcaccgcuaagcuacgcugguucgucgagcgaaaccucgugaagcccgaagggaaggucaucgaccuaggcugcggccgcggaggauggagcuacuacugcgcuggacugaagaaggugacggaaguaaagggcuacaccaagggggggcccggccacgaggaacccaucccgauggccaccuauggguggaaccucgugaagcugcacucgggcaaagacguguucuucauaccgcccgagaagugcgacacccugcucugugacauuggggagagcuccccuaacccaacgaucgaggagggccggacccugcgaguccugaagaugguggagcccugguuacgggguaaccaauuuugcaucaagauccucaaccccuacaugccguccguagucgagacccuggagcagaugcaacgcaagcacggcggaaugcucgugcggaacccgcugucccguaacagcacccacgagauguacugggugucuugcggaaccggcaacaucgugagugccgucaacaugacaucccgaauguuacuaaaccgguucaccauggcgcaucgcaagccuaccuacgagcgggacguagacuuaggggccggcacccgccauguggccguggagcccgagguggccaaccuggacauuaucggccagcggaucgagaacauuaaacaugagcacaagagcacguggcacuacgacgaggacaaccccuacaagaccugggccuaccacgggucauacgagguaaagccgagcggcuccgcgaguagcauggugaacgggguugugaagcuucugaccaagcccugggacgugauccccauggucacgcaaauagccaugacggacaccacgcccuucggccagcagcgcguguucaaggagaagguggacacgcggacgccgaaggccaagcgcgguacagcccagaucauggaggucaccgccaaguggcuguggggauuccuuucuagaaacaagaaaccccgcauuugcacgcgggaggaguucacgcgcaaggugagaagcaacgcggccaucggagccguguuuguugacgagaaccaauggaacagcgcuaaagaggcggucgaggacgagcgcuuuugggaccuggugcaccgggagcgagagcuccacaagcaggggaagugcgcgaccugugucuacaauaugaugggcaagcgggagaagaagcucggggaguucggcaaggccaaggggagucgggcgaucugguacauguggcugggcgcacguuuccuggaguucgaggcacucggauucaugaacgaggaccacugguucucccgcgagaacagccugucagggguggaaggcgaggggcugcacaagcucggcuauauccugcgggacauuagcaagauacccgggggcaacauguacgccgacgacaccgcgggaugggauacccgcaucacggaggacgaccugcagaacgaggcgcgcaucaccgacaucauggagccggagcacgcccuccuggcgaaguccaucuucaagcugaccuaccagaauaaggugguccgggugcagcgccccgcaaagaaugggacagugauggacgucaucagccggcgcgaccagcggggcuccgggcagguggggacguauggcuuaaacaccuucaccaacauggaggcccagcugauccgccaaauggagagcgaggggaucuucucucccagcgagcucgaaacccccaaccucgcugagcgggugcuugacuggcuggagaaguacggugucgagcgccucaaacggauggccauuucgggggaugacugcgucgugaagccgaucgacgaccgcuucgcgacggcgcugaccgcccuuaacgacaugggaaagguccggaaagacaucccccagugggagcccagcaagggguggaacgauuggcagcagguccccuucugcucccaccacuuucaccagcugaucaugaaagacggccgcgagaucgugguacccugccggaaccaggacgagcuggugggcagggcccgggugagucagggagccggcuggucacugcgcgagacggcgugccuagggaaguccuacgcccagauguggcagcugauguacuuccaccggcgggaccugcggcucgccgcgaacgcgaucugcagcgccguccccgucgacuggaucccuaccuccagaacgaccuggagcauccacgcccaccaccaguggaugaccaccgaggacaugcuguccguguggaaccgcgucuggaucgaggaaaacccuuggauggaggacaagacgcauaucucauccuggggugacgugccguacuuagggaagcgggaggaucaguggugcggcagccucaucggucugacugcccgcgcgaccugggcgaccaacauccagguggccaucaaccagguccgaaggcugauugggaacgaaaacuaccucgacuacaugaccaguaugaaacgguucaaaaacgaaucugauccugaaggcgcacugugguga

SEQ ID NO: 24207 - RNA, 9879 nt, Artificial Sequence
  derived and/or modified CDS sequence (opt11) from DENV-1__FJ410232__SS-prME
ucugugaccaugcugcucaugcuuaugcccaccgcccuggccuuccaccucaccacacgcggcggggagccgcauaugaucgugagcaagcaggagcggggaaagagccugcuguucaagaccagcgccgggguaaacaugugcaccuuaaucgcgauggaucugggagagcugugcgaggacaccaugaccuacaagugcccucgcaucaccgaggccgagcccgaugacguggacugcuggugcaacgccaccgacacgugggugaccuacgggaccugcagccaaacgggcgagcaucggcgcgacaagcgguccguugcccuagcgccucacgugggccugggacuggagacacgcacagagaccuggaugucguccgagggcgccuggaagcagauccagagggucgagaccugggcccuccgccacccaggguucacggugacagcccuuuuccuggcgcaugccauaggcacaagcauuacccagaaagggaucaucuucauccuccugaugcuagugacgccauccauggccaugcgcugugucggcauaggcagccgcgacuucguggaggggcucucgggcgccaccuggguggacgucguucuggagcacggaagcugcgugacaaccauggccaaagacaagcccacgcuggacaucgaacuccugaaaacggaggucaccaaccccgcggugcugcggaagcugugcaucgaggccaagaucucaaacaccacgacugacucgcggugcccgacccagggggaagccaccuuaguugaggagcaagacgccaacuucgucugccgucggacguucguggauagagguuggggcaacgguugcggacuauucgggaagggaucccugaucacgugcgccaaguucaagugcgugaccaagcuagagggcaagauuguccaguacgagaaccucaaguacagcgugaucgugaccguccacacgggugaccagcaccagguggggaacgaguccaccgagcacggcacuaccgcgaccaucacgccccaagcacccaccacggagauacaguugaccgacuacggagcccugacucuugacuguagccccagaaccggccucgauuucaacgagauggucuuacugaccaugaaggagaaguccuggcucguacauaagcagugguuccuggaccugccccugcccuggaccaguggggccagcacgucccaagagaccuggaaccggcaggaucugcuugugaccuucaagaccgcccacgcgaagaagcaggaggucguggugcucgguagccaggagggcgccaugcacacugcucugaccggggcuaccgagauccagaccuccggcacgaccaccaucuucgcgggccaccuuaaguguagacucaagauggacaaauugacccugaaaggcaugagcuacgucaugugcacaggguccuucaaauuggagaaagagguggcggagacccagcacggcaccgugcugguccagaucaaguacgagggcacggacgcuccgugcaagauccccuucagcacgcaggacgaaaaaggggugacacagaacgggcggcucaucaccgcuaacccgaucgugaccgacaaggagaagccagucaacaucgaagcagagccgcccuucggggagaguuacaucguaaucggcgcgggcgagaaggcccucaagcuuagcugguucaagaagggcuccagcaucggcaagauguucgaggcaacggcucgcggggcccggcgcauggcaauccugggcgacaccgccugggacuucggguccaucggcggcguguuuaccagcguagggaagcuggugcaccagaucuuuggcaccgccuauggaguccucuuuuccggggucagcuggacgaugaagaucgggaucggagugcuacucacauggcucggccugaacucccgcagcaccucccuuucaaugaccugcaucgccgucgggcucgucacgcucuaccugggagugauggugcaggccgacuccgggugcguuauuaacuggaagggccgggagcucaagugugggagcggcaucuucguaaccaacgagguacacaccuggaccgagcaguacaaguuccaggcggacucgccgaagcgccuguccgcggccaucgggaaggccugggaggagggggucugcggcauccgaagcgcgacgaggcuggagaacaucauguggaagcagaucuccaacgaacucaaccacauccuguuggagaacgacaugaagcucacggugguggucggggacguggcgggcauccuggggcagggaaagaaaaugauccggccccagcccauggaguacaaguacagcuggaagucaugggguaaggccaagaucaucggugcggacgcccagaacaccaccuucaucauagacggccccaauacuccggagugucccgacgaccagcgcgcguggaauaucugggagguugaagauuacggguucggcauuuucacuacgaacaucuggcugaagcuccgggacagcuauacccagguaugcgaccaccgccuaauguccgccgccaucaaggacagcaaggccgugcacgccgacaugggcuacuggaucgaguccgaaaagaacgagaccuggaaacuugcgcgggccagcuucauugaggugaaaacgugcaucuggccaaaaucacacacccucuggagcaacgggguccuggagucggagaugaucauccccaaaaucuauggcgggccgaucagccagcacaacuaccgccccggcuacuucacucaaaccgcggggcccuggcaccugggcaagcucgagcuggacuucgaucugugcgagggcacgacaguggucgucgaugagcauugcgggaacagaggcccgucccuccgaaccaccacgguuaccgggaagaucauccacgaguggugcugucggagcugcacccugccaccacugcgcuuccggggcgaggacgggugcugguacgggauggaaauucgccccgugaaggagaaggaggagaaccucgucaaguccauggucagcgccggcagcggggagguggauuccuucagccugggacugcucugcaucucuaucaugaucgaggaggucaugaggagccgcuggucccggaagaugcugaugacggggacucuggccguguucuuucucuugaucaugggccagcugacauggaacgaccucauacgccugugcaucauggugggggccaacgccucagaccgcaugggcaugggcaccaccuaucuggcccucauggcaacguucaagaugcgaccgauguucgccguugggcugcuuuuccgccggcucaccagucgcgaggugcugcuacucaccaucggccugagcuuaguggcguccgucgagcuccccaauagccuggaggagcugggggacggccucgccaugggaaucaugauccugaagcugcucacagacuuccagucccaccagcugugggccacccugcucucccugaccuucaucaagaccaccuucagccuccacuaugccuggaagacaauggcgauggugcucagcaucgugucccucuuuccacugugccucagcaccaccucccagaagaccacguggcuacccgugcuguuaggaagccugggcugcaagccgcugaccauguuccuaauugcagagaacaaaaucugggggcggaaaucguggccccugaacgagggcaucauggccguggguaucgucucuauccugcucagcuccuugcugaagaaugacgugccccucgccggcccccugauugccggcggcauguugaucgcgugcuacguaauaucuggcuccagcgccgaccucucccuggagaaggccgccgaggucuccugggaggaggaggccgaacacuccggggcgagucacaacaucuugguggaggugcaagacgacggcaccaugaagaucaaggacgaggaacgagacgacacacugaccauccuguugaaagccacgcuccuggccgucagugggguguauccgcugagcauccccgccacccucuucgugugguacuucuggcagaaaaaaaagcagcggaguggcgugcuaugggacacccccagcccucccgagguggagcgggccgugcuagacgacggcauauaucggaucaugcagcgcgggcugcucggucgaucccaggucggggugggcguguuccaggagaacgucuuccacaccauguggcacguuacgcgcggggcgguccugauguaccagggcaagcggcuggagccgaguugggccagugucaagaaggaccucaucagcuacggcgggggcuggcgccugcgggggucauggaacaccggggaggagguccaggugauugcagucgagcccgggaagaaccccaagaaugugcagacugcccccgggacauucaagacgccugaaggcgaggugggugccaucgcgcuugacuucaagcccggcaccagcgggucccccaucgucaaccgcgaaggcaagaucguggggcucuacgggaauggcgugguaacaaccagcgggaccuacgugagcgcaaucgcccaggccaaggcgucucaagagggcccgcugcccgaaaucgaggacgaaguguuucgaaagcgcaaucugacaaucauggaccuccauccugggagcggcaagacccggcgcuaccugcccgccauaguccgggaggccauaaagcgcaagcugcgcacacugauccuggcccccacgcguguuguggccuccgagauggccgaagcccugaagggcaugcccauccgcuaccagaccaccgccgucaagagcgagcacaccgggaaggagaucguggaccucaugugccacgccacguucaccaugcggcugcugucacccguacguguccccaacuauaacaugaucauaauggacgaggcccacuucaccgaccccucauccauagcggccaggggguacaucagcacccgcguggggaugggcgaggccgccgcaaucuucaugacggcgacgccgcccggguccguggaagccuucccccagagcaacgcugucauccaggacgaggagcgggacauccccgagagaucguggaacagcggcuacgaguggaucaccgauuuccccggcaagaccgugugguucgugccaucuaucaagagcggaaacgacaucgccaacugccugcggaagaacggaaagcgcgucauacagcugagccggaagacguuugacaccgaauaccagaagaccaagaacaacgacugggacuacguggugaccacggacauuagcgagaugggggcgaacuuccgcgcugaccggguuaucgacccucgcagaugcuugaagcccgugauucucaaggacggcccugagcgcgugauccuggccgggcccaugccgguuacaguagccuccgccgcgcagcggcgcggucggaucgguagaaaccacaacaaggagggcgaccaauacaucuacaugggccagccccugaacaaugacgaggaccacgcucauuggaccgaggcaaaaauguuauuggacaauaucaacacccccgaggggaucauccccgcccucuucgaaccagagcgggagaaguccgcagcgguagauggcgaguauagacuccgcggggaggcgcguaagacguucguugagcugaugcgccggggggauuuacccguguggcucaguuacaaggucgccuccgagggcuuccaguacuccgaccgccgguggugcuucgacggggagcgcaacaaccaagugcuugaggagaauauggacguggaaauuuggacgaaagagggcgagcguaagaagcugagaccccgauggcucgacgcccgcaccuacuccgacccccuggcccugagggaauuuaaggaguucgcggccgggagaaggagcguuuccggggacuuaauucucgagauuggcaagcugccgcagcaccucacccaacgugcucaaaacgcccuggauaaccuggugaugcuccacaacagcgagcagggagggagagccuaccgucacgccauggaggagcugccggacacgauugagacccugaugcuccuggcgcugaucgccgugcucaccggaggcgucacgcuguucuuccuguccgggcggggccucggcaagaccagcaucgggcugcugugcgugauggccuccucuguccuucuguggauggccagugucgagccccacuggaucgccgccagcauaauccuggaguucuucuugauggugcugcugauccccgaaccugaccgucaacggacgccgcaggauaaucagcucgccuacguagucaucggccugcuguucaugauccucaccguggccgcgaacgagauggggcugcuggaaaccacaaaaaaggaccucgguauagggcacguggccguggagaaccaccaccacgcugccaugcuggacgucgaccugcauccugccucagcguggacgcuuuaugccguggcaaccaccaucaucaccccgaugaugcgucacacgaucgagaauaccaccgccaacaucucacugaccgccauagcgaaccaggccgcuauucugaugggccuagacaaggguuggcccaucaguaagauggacaucggaguccccuuacuggcccucggcuguuacucacaggugaacccccugacgcugaccgcggccguacucaugcuuguugcccacuacgccaucaucgggccgggccugcaggcaaaggcgacccgugaagcgcagaagcggacagcggccgggaucaugaagaaccccacgguggaugggaucgucgccaucgaccucgaccccguagucuaugacgcgaaguucgagaaacagcucgggcagaucaugcugcucauccuguguaccucacagauccugcucaugcgcaccaccugggcccugugcgagagcaucacgcuggccaccgguccccucaccacccugugggaaggcuccccgggaaaguucuggaacacgaccauugcagugucaauggcaaacaucuuccggggcagcuaccuggcgggcgccggucucgccuucagccugaugaagucucugggcgggggccgccggggcaccggcgcccagggggagacccucggggagaaauggaagcgccagcugaaccagcugucuaagagcgaguuuaacacguacaagcgguccgguaucauggaggucgaccgcagcgaggcgaaggaagggcucaagcggggcgagaccaccaagcacgccgugucccgcggaaccgccaagcuacggugguucguggaacgcaaccugguaaagcccgagggcaaggugauugaccucggcugcgggcggggcggguggagcuacuacugugccggccucaagaaggugacggaggucaaaggguacaccaagggaggcccggggcacgaggagcccaucccgauggccaccuacggauggaaucuggugaagcugcauuccgggaaggacgucuucuucaucccgcccgagaagugcgacacccuucugugcgacaucggcgagucgucccccaacccgacgaucgaggaggggcgcacccugcggguccucaagaugguggagcccuggcuacgcggcaaccaguucugcaucaagauacugaacccuuacaugccuucugucgucgagacccucgagcagaugcagcggaagcacggagggaugcugguucgcaauccguugucucggaacagcacccacgagauguacugggucuccugcgggaccgggaauaucguaagcgcggugaacaugacaagucgcaugcuccugaacagguucaccauggcacaccggaagccuaccuacgagcgcgacguggaccuggguaccggcacgaggcacgucgccguggagcccgagguugcuaaccuugacauaaucgggcagcgcaucgaaaacaucaagcacgagcacaagucgaccuggcacuaugacgaggauaaccccuacaagaccugggccuaccauggcuccuacgaggucaagccuagcggguccgcgagcagcauggucaacggcgugguuaagcugcugaccaagccuugggacgugaucccgauggucacgcagaucgccaugaccgauacuaccccuuucgggcagcaacggguguucaaggagaaaguggacacgcggacuccgaaggccaagcggggcaccgcgcaaauaauggaggucaccgcccgcuggcucuggggcuuccugagucggaacaagaagccgcgcaucugcacgagggaggaguucacacgcaagguccgaagcaaugccgccauaggggccguauucguugacgagaaucaguggaacuccgccaaagaggcgguggaggaugagcgcuuuugggaccuagugcaccgggagcgcgagcuccauaagcaggguaagugcgcaaccugugucuacaacaugaugggcaagcgugagaagaaguuaggcgaauucgguaaggccaaaggcagccgcgccaucugguacauguggcugggcgcccgguuccucgaguucgaagcgcugggguucaugaacgaggaccacugguucucccgggagaacagccuguccggcguggagggggagggccuccacaagcugggguacauccugagggacauaagcaagauccccggcggcaacauguacgcugacgacaccgcagggugggacacgcgcaucacggaggacgaccuccagaacgaggccaagauaacggauauuauggagccagagcacgcccugcuggcaaaggccaucuucaagcucaccuaucagaacaaagugguccgugugcagaggcccgccaaaaauggcacugugauggacgucaucagucgccgagaccagcgcggaucaggccaggugggcaccuacgggcugaacaccuucaccaacauggaagcacaguugauccggcagauggaauccgaaggcaucuucagcccuuccgaacucgagacgcccaaucuggcugagcgggcgcuggacuggcucgagaaguacggcguggagcgcuugaaacgcauggccaucucuggcgacgacugcgucgugaagcccaucgacgaccgguucgccaccgcucugacagcccucaacgacauggggaaagugcgcaaggacaucccccagugggagcccuccaagggcuggaacgacuggcagcagguccccuucugcucucaccacuuccaccagcugauaaugaaggauggccgggagauuguggugccgugccggaaccaagaugagcucguugggagagcccgggugucccagggcgcaggguggucgcuccgggagacggccugccugggcaaaaguuacgcgcagauguggcaacugauguauuuccacaggcgggaccuccgcuuggcggccaacgccaucugcuccgccgugcccguagacugggugcccacgucucggaccaccugguccauccaugcccaccaccaguggaugaccacggaggacaugcugagcguuuggaaccgcgucuggaucgaggagaacccauggauggaggacaagacucauaucuccagcugggaggacgugccguaccucgggaagcgcgaggaccaguggugcggcucccugaucggccugaccgcgcgggcaaccugggcuaccaacauccagguggcaaucaaccagguucgccgacuaauagggaacgaaaacuaccucgacuauaugaccagcaugaaacgcuucaagaaugaguccgaccccgagggcgcccugugguaa

SEQ ID NO: 24208 - RNA, 9879 nt, Artificial Sequence
  derived and/or modified CDS sequence (opt11) from DENV-1__FJ461327__SS-prME
agcguaaccaugcuucucauguuaaugcccaccgcacuagccuuccaccuuaccacgcggggcggggagccccacaugaucgugagcaaacaagagcggggcaagucacugcuuuucaagacaucggccgggguaaauaugugcacccuaaucgccauggaccuuggcgagcugugcgaggacaccaugaccuacaagugcccccgaauuaccgagacagaacccgaugacguggacugcuggugcaacgccacggacacgugggugaccuaugggaccugcagccagacgggcgagcacaggcgcgacaagcgguccguggcccuagcgccccacgugggcuuaggucuggagacucgaacagagacauggaugagcucagaaggggcguggaaacagauucagcggguugaaaccugggccuugcgccaccccggguucacuguaaucgcacuguuccuggcccacgcuauaggaaccuccaucacgcagaaggggaucaucuucauccugcugaugcuggugacgcccuccauggccaugaggugugucgggauuggaucccgcgacuuuguggaggggcuaaguggcgcaaccuggguagacgugguauuggaacacgggagcugcgugaccacuauggccaaggacaagccuacgcuggacaucgagcuccugaagacagaggucaccaaccccgccgugcuucggaagcuuugcaucgaggcaaagaucuccaauacgacgaccgacucucgcugcccgacacaaggggaggccacgcugguagaggagcaggacgcgaacuucgucuguagacgcacguucguggaccggggcugggguaacggcugcggucuguuugguaaagggagucucaucaccugcgccaaguucaaguguguuacaaaauuggagggcaagauaguucaguacgagaaucugaaguauucagugauugugacaguccacacgggcgaucagcaccagguggggaaugaguccaccgagcauggcaccaccgcaacaauuacgccucaggcgcccacuacggagauccagcuaaccgacuauggggcgcugacacuggauugcagcccccgcaccggccuagacuucaacgaaaugguuuugcucacuaugaaagagaagagcuggcucguacacaagcagugguuccuggaccugccccuucccuggacaagcggagcguccacgucgcaggaaacguggaaccggcaggaccuguugguuaccuuuaaaaccgcccaugccaagaagcaggaggucguuguccucggaagccaagagggagcuaugcacacggcccuaacaggggccaccgagauccagaccuccggaacgacuaccaucuucgccgggcaccugaagugccgacugaagauggacaagcugacgcugaagggcaugagcuacgucaugugcaccggguccuucaaguuggagaaggagguagccgagacccagcaugggacggugcugguucagaucaaguacgaaggaaccgacgcccccuguaagauccccuuuaguacgcaggacgagaagggggugacucagaacggcagacucaucaccgcaaacccgaucgugaccgacaaggagaaaccuguuaacauagaggcugagccaccauucggagagaguuacauugucaucggggcuggcgagaaagcgcuuaagcucaguugguucaagaaaggaucguccaucggcaagauguucgaggcaacugcgcgcggcgcccgccgcauggccauccuaggcgacaccgcgugggacuucggauccaucggcggcguuuuuaccagcgucgggaaacuggugcaccagaucuucggcaccgccuacggggugcuguucaguggcgucagcuggacgaugaagaucgggauuggagugcuucucaccuggcuaggccucaacuccaggagcaccucccugagcaugacaugcaucgcggugggccucgucacgcuguaccugggcgugauggugcaagccgacuccgggugcgucaucaacuggaagggucgggaacucaagugugggucuggcauuuucguuaccaacgaggugcacacuuggacagagcaguacaaguuccaggcggacaguccgaaacgccuguccgcggcuauagggaaggcuugggaggaaggggucugcggaauuaggagcgccaccaggcuggaaaacaucauguggaaacaaaucuccaacgagcucaaccacauccucuuggagaacgacaugaaguuuacagugguggucggggacguggccggcauccucgcgcaggggaagaaaaugauccggccccagcccauggaguacaaauacagcuggaaaucauggggcaaggccaagauuauuggugccgacguccagaacacaaccuucaucaucgacgggcccaacaccccggagugucccgacgaccaacgcgccuggaacauaugggaagucgaggacuacggcuuugguaucuucacaaccaacauauggcugaagcugagagacagcuacacacaggugugcgaucaccgucucaugagugcagccaucaaggacagcaaggcgguucacgcagacaugggcuacuggaucgagucggaaaagaacgaaaccuggaaauuggcacgugcgagcuucaucgagguuaagacguguaucuggcccaagucccacaccuuauggagcaacggcguguuagaguccgagaugaucauccccaagaucuacgggggcccgaucagccaacacaacuaucgucccggguauuucacucaggccgccggccccuggcacuugggaaaacuggagcuugacuucgaccugugcgagggaacuacgguggucguggacgagcacugcggaaaucgcgggccguccuugcggaccacuaccguuacgggcaagauuauccacgagugguguugccggagcugcacccuaccccccuugcgcuucagaggagaggauggcugcugguauggcauggaaauacgccccgugaaggagaaggaggagaacuuggugaaguccauggugagcgccgggagcggcgagguggacuccuuuagucucggccuucuguguaucucgauaaugaucgaggaggugaugcggagccgcuggucccgacggaugcucaugacgggaacccucgcagucuucuuccugcucaucauggggcagcugacauggaacgaccugauccgccucugcaucauggucggcgccaacgccagcgaccgcauggggaugggcaccaccuauuuggcucuaauggccaccuucaagaugcgcccgauguucgccgugggccuccuguuccggcggcuuacgagccgggaggugcuccugcuaaccaucgggcuaucccuggucgcguccguggagcugcccaacagccucgaggaguugggcgacgggcuggcaaugggcaucaugauccucaaguuauuaaccgacuuucagagccaccaacucugggccacccuacucagccucacauuuaucaagaccaccuucucccugcacuacgccuggaagaccauggcgaugguacugagcauugugucacuguucccccugugccugagcacaacuucccagaagaccaccugguugccaguacugcugggcucuuugggguguaagccgcuaacgauguuucuuaucgccgagaacaagaucuggggacgccguuccuggccucucaacgaagggaucauggcggucggcaucguuagcauacuacugagcagccuccugaagaaugacgugccccuggccgguccauuaaucgccggcgggaugcucauugccuguuacgucauaagcgggucaagcgccgaccuaagccucgagaaagccgcagaaguguccugggaggaggaggccgaacauuccggagcgucccacaacauccuaguugagguccaggacgaugggacgaugaagaucaaggacgaggagcgcgacgacacccuaaccauccuccugaaggcgacccugcucgcgguguccggcguguauccguuaagcauaccugccacgcucuucgucugguacuucuggcagaagaagaaacaacgguccgggguguuaugggacacccccucaccgccagagguugaacgcgcgguccuggaugacggcauuuacaggauaaugcagcgcggccugcuggggcggucccagguaggcgugggggucuuccaggagaacgucuuccacaccauguggcacguuacucgcggcgcgguccucauguaucagggaaagcggcuggagccuagcugggccagcgugaagaaggaucugaucagcuauggcgggggcuggcggcuccagggcucuuggaacaccggggaagaggugcaggucaucgccguggagccgggcaaaaauccaaagaacgugcagaccgcccccgggaccuucaagacucccgagggagaggucggcgccauagcgcuggacuucaaacccgggacgagcggcuccccuauagugaacagagaggggaagaucgucggccuguacgguaacgggguggugacuacguccggcaccuacgucagcgccaucgcccaggcuaaagcgucccaggagggaccgcuccccgaaaucgaggacgaggucuuccgcaagcggaacuuaacgaucauggaccugcaccccggcagcgggaagacccgacgcuauuuaccggccaucgugcgcgaggccauuaagcgcaagcugcggacacugauccucgcacccacacgcguagucgccucggagauggcggaggcccuuaaaggcaugcccauccgguaccagacgacggccgucaaaucggaacacacuggcaaagaaauuguagaccuaaugugccacgcuaccuucacgaugagacucuugucucccguccgaguuccaaacuacaacaugauuaucauggacgaggcccacuuuaccgaccccagcucaaucgcggcccgcggguauaucagcacccgggugggcaugggggaggcggcugccaucuucaugaccgcuacgccgcccggauccgucgaagcuuucccgcagucaaacgcugugauccaggaugaggaaagggacauccccgagcgguccuggaacagcggguaugaguggaucaccgacuucccugguaagacuguuugguucguucccuccauaaagaguggcaacgauauagcuaacugcuugcgcaagaacggaaagcgcgugauccagcucucccgcaaaacuuucgacacggaguaccagaagaccaaaaacaacgacugggacuauguggucaccacggauaucagcgaaaugggugcgaauuuccgggccgaccgcgugaucgacccucgccgcugucugaagcccguuauacucaaggacgggcccgaacgggucauccucgcaggccccaugccggucacaguagcuucggcagcgcaacgccgagggcgaaucggaaggaaccauaacaaagagggagaccaguacauauauauggggcagcccuugaacaaugacgaggaccacgcccauuggaccgaggccaagaugcuuuuggacaacaucaacacucccgaaggcaucaucccagccuuguucgagccggagcgggagaaguccgccgcgaucgauggugaguaccggcuccggggcgaagcucgcaaaacguuuguggagcuaaugcggcgcggggacuugcccguguggcuguccuacaagguggcuagcgagggcuuccaguacagcgaccggcguuggugcuucgacggcgagcggaacaaccaggugcucgaagagaacauggacguggaaauuuggacaaaggagggggagcgcaagaagcugcggccccgcugguuagacgcccggacguacucggauccccucgcccuacgcgaguucaaggaguucgcggcgggccggcgcagcgucucaggggaccugauccucgagaucgguaagcucccgcaacacuugacucaacgggcccagaacgcccuggacaacuuggugaugcuacacaacucugagcagggcggucgcgcguaccggcaugccauggaggagcuccccgacacgaucgagacucuuaugcuacuagccuugauugccguccucaccgggggggucacccucuucuuccucuccggccgaggacuggggaagaccagcaucggacuccugugcgugauggcaucuagcguucuacucuggauggcgagcgucgagccccacuggaucgccgcguccaucauccuagaauucuuucugauggugcuccugauuccagagccggaccgccagaggacuccccaagauaaccaacuggccuauguggucaucgggcuccuuuucaugauccuaacgguggccgcuaacgagauggggcuccuggagaccaccaagaaagaccuggggaucggucacguggcagucgagaaccaccaccacgccgcaaugcuagacguagaccuucaccccgccuccgcuuggacccuguacgccguggccacgacgaucaucaccccgaugaugcgccauaccaucgaaaacacgaccgccaacaucagcuugaccgccauugcgaaucaagccgcaauacugaugggucuggacaaaggcuggcccauaucuaaaauggacaugggcguuccccuccuugcccucgguugcuacucacaggugaacccucucacccugacggcggccguucucaugcuagucgcccacuacgcaaucaucggcccgggauugcaggccaaggcgacacgugaagcccagaagcgcacugccgccggcaucaugaagaaccccacgguagacgggauuguggccaucgaccuggaucccgucguguacgaugcaaaauucgagaagcaacucgggcagaucaugcugcuuauccuaugcacgagucaaauccugcugaugcggacgacuugggcacucugcgaaucgaucacgcuagccacaggcccucucaccaccuugugggagggcucgccgggaaaguucuggaacaccaccaucgcaguuagcauggccaacaucuuucguggguccuaucuggcgggggccggccuggcuuuuucccugaugaagucccucgggggugggcggcgcgggaccggggcccaaggcgagacauugggcgagaaguggaagaggcagcucaaucaacuguccaagagcgaguucaacaccuauaagcgcuccgggauaauggagguggacaggucagaggcgaaggagggccugaagcggggggagacgaccaagcacgcagugucacggggcaccgccaagcuccgcugguucguagaaagaaaucuggucaagcccgaggggaaagucaucgaccugggcuguggccgcggagguuggagcuacuacugcgccggucuuaagaaagucaccgagguaaagggguacacuaagggcggacccggccacgaagaaccaaucccgauggcuacuuacggcuggaaucuugugaagcugcacuccggcaaggacguguucuucaucccgcccgagaagugcgauacccuucucugcgacauuggcgagagcucccccaaccccaccaucgaagagggacggacuuuacggguccugaagaugguugaaccauggcuccgggggaaccaguucuguaucaagauccuuaaccccuacaugccaagcgugguggagacucuugagcagaugcagcgcaagcacggugguaugcuugugagaaacccgcugucccgcaacaguacccaugagauguacuggguguccugcgggaccggcaacauugucagcgcggugaacaugaccucgcguaugcuguugaacagguucacgauggcccacaggaaaccaaccuacgagcgagauguggaccugggcgcgggcaccaggcacgucgcggucgaaccugagguggccaaucuggauaucaucggccaaagaaucgagaauaucaagcacgagcauaagucuaccuggcacuacgacgaggacaaccccuacaagacgugggccuaucacggaucguacgaggucaagccgagcggauccgcaaguagcauggugaacggggucgugaagcuccuaaccaaacccugggacgugauccccaugguuacccaaaucgcaaugaccgacacgacccccuucggccagcagaggguguucaaggagaagguggacacccggaccccgaaggcaaagcgcgguacggcacagauaauggaggucaccgcaaaauggcuguggggauuccucagucggaacaagaaaccccgcaucugcacccgggaggaguuuaccagaaaggugcggagcaacgccgccaucggcgcgguguucguugacgagaaccaguggaauucugcgaaggaggccguggaggacgaacgcuucugggaccuggugcaucgggagcgugagcuacacaagcaggguaagugcgccacgugcgucuauaacaugaugggcaagagagagaagaagcucggggaguucggcaaagccaaggggucacgagcgaucugguacauguggcugggggcgcgguuucuggaauucgaggcccucggcuuuaugaaugaggaucauugguucagucgcgagaauucacuuucagggguugaaggcgaggggcugcacaaguugggcuauauacuacgggacaucaguaagauaccggggggcaauauguacgccgacgacaccgccgggugggacacccggaucaccgaggacgaccugcagaaugaggcccgcaucacggacaucauggaaccggagcacgcgcuucuggccaagagcauauucaagcugacauaccagaacaagguuguccgggugcagcgcccugccaagaacgggaccgucauggacgugaucagccgccgcgaucagcggggcagcggacagguggggaccuauggauugaacaccuucacuaauauggaagcccagcuuauucgucagauggagagcgaggggaucuucucccccucugagcuggagacacccaacuuggcugagcgcgugcuggacuggcuggaaaaguacggagucgaaaggcucaagcggauggcaauaaguggcgacgacugcguagugaagccgaucgacgacagauucgccaccgcccugacggcccuuaacgacaugggcaaggugcggaaagacaucccccagugggaaccaucgaaaggguggaacgacuggcagcagguuccauucugcucgcaucacuuccaccagcucauuaugaaggauggcagggaaaucguggucccguguaggaaccaggacgagcuagugggccgugcacggguuucccagggagcuggcuggagccugcgcgagacugcaugccuagggaaguccuacgcccagauguggcagcugauguacuuccaucggagagaccugcggcucgccgcgaacgccaucuguagcgccguccccguggauuggaucccuacaucccgaaccacgugguccauucacgcccaccaccaauggaugacgaccgaagacaugcucuccgucuggaaccgcgucuggauagaggagaauccguggauggaggacaaaacccacaucagcuccuggggggacgugccguaccuggggaaacgggaggaucagugguguggcagccugaucggacugacggcccgcgccaccugggccaccaacauccaaguggccaucaaccaggugcggcgccugaucgggaacgagaacuacuuagacuacaugaccucgaugaagcgcuucaagaacgaaagcgaucccgagggcgcucugugguga

SEQ ID NO: 24209 - RNA, 9879 nt, Artificial Sequence
  derived and/or modified CDS sequence (opt11) from DENV-1__FJ461328__SS-prME
agcgugacaaugcugcugaugcugaugccaaccgcccuggccuuccaccucaccacccggggcggcgagccgcauaugaucgucucuaagcaggagcggggcaagagccugcuguucaagaccagcgccggaguuaacaugugcacccucaucgcuauggacuuaggugagcucugcgaagacacaaugaccuauaagugccccagaauuaccgaagccgaaccggacgauguagacugcuggugcaacgccacggauacgugggucacguaugggaccugcucucagacgggcgaacaccgacgugaaaagcgguccguagcccucgcgccccacgucggccuggggcuggagacccggaccgagaccuggaugagcuccgagggcgccuggaagcagauccagcgcgucgagaccugggcccuccgccaccccggguucaccgugaucgcuuuauuccucgcgcaugcgaucggcacaagcaucacacagaagggcaucaucuucauccuccugaugcuuguuacgccaucuauggccaugcggugcgucggcaucggcucacgcgacuuuguggaggggcucaguggcgccacguggguggaugucguguuggagcacgggucaugcgugaccacuauggccaaggacaagccgacccuggacauagaacuccugaagacggaggucacuaauccugcggugcuacgaaagcucugcaucgaggccaagauuuccaacaccaccacugacagccgcuguccgacccagggcgaggccacccugguggaagagcaggacgccaacuucguaugcaggcguaccuucguggaccggggcugggguaauggcugcggacuguucggcaagggcucccuccugacgugcgccaaguucaagugcgugaccaagcuggagggcaagaucguccaguacgagaaccucaaguacagcgucaucgugacgguccacaccggcgaccagcaccaaguugggaacgaguccacggagcacggcaccacggcgaccauaacgccccaagcccccacaaccgaaauccagcugacggacuacggggcccugaccuuggacugcucaccccgcacgggcuuggacuucaacgagaugguccugcucacgaugaaggagaaguccuggcuggugcauaagcagugguuucuggaccuuccucugcccuggaccucuggggccagcaccucccaggagacguggaaccggcaagaucugcucgugacuuucaagaccgcccacgccaagaagcaggaggucguggugcugggcucacaggagggcgccaugcacaccgcccugacgggggccaccgagauccagaccucaggcaccacgacaaucuucgcagggcacuuaaaaugccgccuaaagauggauaagcugacgcuuaagggcaugagcuacgucaugugcaccggguccuuuaagcuggaaaaggagguagcggagacacagcacggcaccgugcuaguccagaucaaguacgaaggcaccgacgcccccugcaagauacccuucagcacccaggacgagaagggggugacacagaacggccggcugaucaccgccaacccgaucgugaccgacaaggagaagcccgucaacaucgaggccgagccccccuucggugaauccuacaucguaaucggcgcgggugagaaggcccucaagcugucgugguucaagaagggguccagcaucggcaagauguucgaggccaccgcccgaggggcccggcgcauggcgauucugggcgacacggcaugggauuucgggucaaucggcggcguguucaccagcgucgggaagcucgugcaccagauauuuggcaccgccuacgggguguuauucuccggaguuagcuggaccaugaagaucgggaucggcgugcuguugacuuggcuggggcucaacucccguagcaccagucucucaaugaccugcaucgccguggggcuugucacucuguaucucggcgugauggugcaggccgauuccgggugcgucaucaacuggaaaggcagagagcugaaaugugggagcggcaucuucguuacgaaugaagugcacaccuggaccgagcaguacaaguuccaagcagacucuccgaagcgccuguccgccgcgauuggcaaggcuugggaggagggggucugcggcauacggucagccacacgccuggagaacaucauguggaagcagaucuccaacgagcuuaaccacauacugcucgaaaacgacaugaaguucaccgugguggucggcgauguggcgggcauccuugugcaggggaagaagaugauccggccccagcccauggaguauaaguauagcuggaaauccuggggcaaggccaagaucaucggcgcggacguacaaaacagcacguucaucauugacgggccgaauaccccggagugcccggacgaucagcgcgccuggaacaucugggagguggaggauuacggcuucgggauauucaccacuaauauauggcugaagcuacgagacuccuacacccaggugugcgaccaucgccugaugagcgcagccaucaaggacuccaaagccguccaugccgacaugggguacuggaucgagagugagaagaacgagacauggaagcuggcgcgggcguccuuuaucgaggugaagaccugcauauggccgaaaucgcacaccuugugguccaacggcguucuggagagcgagaugauaauccccaagauccacgggggaccgaucucacagcacaacuaccgcccuggguauuucacgcagaccgccggccccuggcaccugggaaagcuggagcucgacuucgaccugugugaggggaccaccgucgucguggaugagcacugcgguaaccgggguccaagccuucgcacgaccaccguaaccggcaagaucauccaugaguggugcugucgguccugcacgcugccgccccugcgcuuccgcggugaggauggcugcugguaugggauggagauucgccccgugaaggagaaggaggagaaccucgucaagucgaugguuagcgccggcaguggggagguggacagcuucucacuggggcuacuaugcaucaguauuaugaucgaggagguuaugcggucccgauggagccggaagaugcuuaugaccgggacccuggcggucuucuuccucuuaauaaugggacaguugaccuggaacgaccucauacgcuuauguauaauggugggagcuaacgccucugaccgcauggguaugggcacgaccuaccuggcccuaauggccaccuuuaagaugcggccgauguucgcggugggccuguuauuccgccgacucaccucccgcgagguacuguugcucacgaucgggcugagucuaguggcaagcgucgagcucccuaacucccuggaggaguuaggggacgggcucgcgauggguaucaugauccugaagcugcucaccgauuuccagagcuaccagcugugggccacccuguuaagccuuaccuucaucaagacgaccuucagccugcacuacgcguggaaaacaauggcgaugguucucaguauugugagcuuauucccacugugccucagcaccacgagccagaagaccacguggcugcccgugcugcucggcuccuuggggugcaagccgcuaaccauguucuuaauagcagagaacaagaucuggggccgcaagucauggccccugaacgagggcaucauggccgugggcauagugagcaucuuacucuccucacuguugaagaaugacgucccccucgccgggccccugaucgcagggggcaugcuaauugcaugcuacgugauauccggguccuccgcggaccucagccuggagaaggccgccgaaguguccugggaggaggaagccgagcacaguggcgccucgcacaacauacugguugagguucaggacgacggaacgaugaaaaucaaggacgaggaaagggacgauacccucacaauccugcuaaaggcgacgcuccuggcggugagcggcgucuacccgcuguccauccccgccacauuguuuguguggcacuucuggcagaagaagaaacagcggagcgggguguugugggacacccccagcccgcccgagguugaacgcgcugugcuggacgacggcaucuaccggaucaugcagcgcggccugcucgggcggagccaagugggcgucgggguguuccaggagaacguguuccacaccauguggcacguuacccggggcgcuguguuaauguaccaggggaagcggcuagagccuuccugggcaagcguaaagaaggaccucauaucguauggcggaggguggcgcuuccagggcucguggaauacaggggaggaaguccaggugaucgcuguggagccaggcaaaaauccuaagaacguccagaccgcccccggaaccuucaaaacccccgagggugaggugggcgccaucgccuuggacuuuaaacccgggaccaguggcucucccaucgugaaccgggaggggaaaaucgucgggcuguacggcaaugggguggugacgaccagcggcaccuacgucuccgcgaucgcacaggccaaggcgagccaggaggggccgcuccccgagaucgaggaugaggucuuccgcaagcggaaccugaccaucauggaccugcaccccggcuccggcaagacgcgccgguaccucccggcgaucgugcgcgaggccauaaaacggaagcugcgcacccuaaucuuggcgcccacccgcgucguggcaagcgagauggccgaggcucuaaagggcaugccuauucgguaccagaccacggccgugaagagcgagcauaccggcaaggagaucguugauuugaugugccacgcaaccuucaccaugagacuucugagccccgugagggucccgaauuauaacaugaucauuauggacgaggcccacuuuaccgaccccuccagcaucgccgcgcgcggguacaucuccacccgggucgggaugggagaggcagcggccaucuucaugacggccacaccgcccggcagcauggaggccuucccgcaauccaacgccgugauccaggacgaggagcgcgacauccccgagcggagcuggaacuccggguacgaguggaucacggacuuccccggcaagaccgugugguucguccccucgaucaaggccggcaacgacauugccaacugccugaggaagaacgggaagcgagugauccagcucucccgcaagacuuucgacaccgaguaucagaaaacgaagaacaacgacugggacuacguggucacuaccgacaucucugagaugggcgcgaauuuccgggcagaccgcguaauugacccgcggcgcugccugaagcccguaauccugaaggauggcccugagcgggucauccucgcgggccccaugccggucaccgucgccuccgcggcgcaacgccgggggcgcaucggcagaaaccauaacaaggagggugaucaguacaucuacauggggcagcccuugaauaacgacgaggaucacgcccacuggacggaagcgaagauguuguuagacaacaucaacacccccgaggguaucauucccgcucuuuucgaaccggagagagagaaauccgccgcaaucgacggggaguaccggcuacggggcgaagcacgcaaaacguuuguagagcucaugcggcgcggggaccugccuguguggcuuagcuacaaagucgccagcgagggcuuccaguacagcgaucggagguggugcuucgacggcgagcggaacaaccagguguuggaagaaaacauggauguggagaucuggaccaaggagggcgagcgcaagaagcugcggccccgauggcuagacgcccggacauacuccgauccauuagcccugcgcgaauucaaagaauucgcggccgggcggcgcagcgucucgggcgaucugauccucgagauaggcaagcugccgcaacaccugacccaacgggcccagaacgcccucgacaaucuggugaugcugcacaacagcgagcaaggcggucgcgcuuaccggcacgcaauggaggagcucccagacaccauagagacccugauguuacucgcgcugaucgccguucugaccgggggggucacccucuucuuccuuucuggcaaggggcugggcaagaccagcauuggccuccucuguguuauggccuccagcgugcugcuguggauggcguccguugagccccauuggaucgccgccagcaucauccuggaauuuuuccugauggugcuccugauccccgagcccgaccgccagcggacgccccaagacaaccaguuagcauacguggucauagggcuccuguuuaugauccugaccguggccgcgaacgagauggggcugcuagagaccaccaaaaaggaucuggggaucggccauguggccgucgagaaccaccaccacgccgcaaugcucgacguggaucugcacccggccuccgcguggacccuguacgcaguugccaccacgaucaucaccccgaugaugagacacaccauugagaauacaacagccaacaucagccucacagcgaucgcaaaccaggccgcuauacugaugggucuggacaagggcuggcccauaaguaagauggauauaggcgucccccuccuggcacuggggugcuacagccaggugaacccccucacccuaaccgcggccgugcugaugcucgucgcccacuacgccauuaucggcccggggcuacaggccaaggcgacucgggaggcccagaagcgcaccgccgccggcaucaugaaaaacccgaccaucgacggaauuguggccauagaccuggauccagugguuuaugacgcgaaguucgagaagcagcucggccagaucauguugcuaauccucugcaccucccagauccuguuaaugcgcaccaccugggcccuaugcgaaagcaucacucuggccaccggcccccugacgacgcucugggaggggagcccuggcaaauucuggaacaccaccaucgccgugaguauggccaacaucuucagaggguccuaccuggcaggcgccggacuggcauucagccucaugaagucccucgggggcgggagacgggggacaggggcccagggggagacccuuggagaaaaguggaagcgccagcucaaucagcugucuaagagcgaguucaacacauacaagcguagcgggaucauggagguugaucgcagcgaggcgaaagagggccugaagcgcggcgagacgacgaagcacgccgucucccgcggaacggccaagcuccgcugguucguggagaggaaccugguaaagcccgaggggaaaguuaucgaccugggcugcggccgcgggggcugguccuauuacugcgccgggcugaagaaggugacggaagugaagggguauacaaaagguggccccggacaugaagagcccaucccaauggccacguacggguggaaccucgucaagcuucacuccggaaaggacguuuucuucauuccucccgagaagugugauacccuccucugcgauaucggugagagcucacccaacccuaccaucgaggaggguagaacccugcggguacugaaaaugguagaacccuggcuccgcgggaaccaauuuugcaucaagauacugaacccguacaugcccagcgugguugagacacuggagcagaugcagcggaagcacggcggcaugcucguucgcaacccgcucucccggaacagcacccacgaaauguacugggugucgugcgguacuggcaacaucguauccgcggucaacaugaccucccguaugcugcucaauagguucacgauggcccaccgcaagcccacuuacgagcgcgacguggaccuuggggccggcacgcgacauguugcugucgagcccgagguggcaaaccuggauauaaucggccagcgaauugaaaauaucaagcacgagcauaagagcacuuggcacuacgacgaggacaaccccuacaagacuugggccuaccacggguccuaugaggugaagccgucuggcagugcaagcagcauggucaacggugugguuaagcuccuuaccaagccaugggacguuauaccgauggugacccagauugcgaugaccgauaccacccccuucggccagcagcggguauucaaagagaagguagacaccaggaccccaaaggccaagcgcgguaccgcgcagaucauggaggugacggcgcgcugguuguggggguuccuuucccggaacaagaaaccccgcaucugcacucgagaggaguucacccgcaagguccggagcaacgccgccauaggcgccguauucguggacgagaaucaguggaauuccgcaaaggaagccgucgaggacgaccgcuucugggaccuggugcaccgggagcgcgagcuucauaagcaggggaaaugcgcgaccugcguguauaacaugaugggcaagcgggaaaagaagcucggggaguuuggcaaagccaaggggagucgcgccaucugguauauguggcugggcgcucgguuccucgaguucgaggcccucggcuucaugaacgaggaccacugguucucaagagagaauagccucuccgguguggagggcgaggggcugcacaagcuagguuacauacugcgggacaucagcaagauaccggggggcaauauguacgccgaugacacggccggcugggacacccgcaucaccgaagacgaccugcagaacgaggccaagauaaccgacaucauggagccggaacacgcucugcuugccaaaagcauuuucaaacuuacguaccagaacaaagugguccggguccaacgaccugccaagaacgguaccgugauggacgugaucagccgacgggaccagcgcggguccgggcaagucggcaccuacggccucaacacguucacgaacauggaggcucagcugauccggcagauggagucggaggggaucuuucuacccaacgagcucgagacccccaaccuggccggaagggugcuggacuggcucgaaaaguacgguguggagcggcugaagcgcauggcgaucuccggagacgacugcgucguaaagcccauagaugaccgguucgccaccgcccugacagcccucaacgacaugggaaaggugcgcaaggacauuccccagugggagcccagcaagggcuggaacgauuggcagcagguccccuucugcagccaucacuuccaccagcugauuaugaaagauggccgagaaaucguggucccguguaggaaccaagacgagcuggucgggagggcucgaguaucgcaaggcgccggguggucccuccgggagacggccugccuuggcaagagcuacgcccaaauguggcagcugauguacuuccaccgaagagaccuccguuuagcggccaacgccauauguagcgccguucccgucgauugggugcccaccucccggaccaccuggagcauccacgcucaccaucaguggaugacgaccgaggauaugcuguccguguggaaccgcgucuggaucgaagagaaccccuggauggaggacaaaacccguaucuccuccugggaggacgugcccuaucucgggaagcgcgaggaucaauggugcgguagccugauaggccugacugcgcgggcgacgugggcgaccaacauccaagucgccaucaaccaaguucggcgacucaucggcaacgagaacuauuccgauuacaugaccagcaugaagagauucaagaaugagagugagcccgagggcgccuugugguaa

SEQ ID NO: 24210 - RNA, 9879 nt, Artificial Sequence
  derived and/or modified CDS sequence (opt11) from DENV-1__FJ410234__SS-prME
agcgucacuaugcugcucauguuaaugcccaccgcgcuggcauuucauuuaaccacccgcggcggggagccccacaugauagucucgaagcaggagaggggcaaaagccuguuguuuaaaacaagugcgggcgugaacaugugcacgcucauugcgauggaccugggcgagcucugcgaggacacuaugaccuacaaaugccccaggauaacggaggccgagccggacgauguggacugcuggugcaaugccaccgacaccugggugaccuauggcacgugcucccagaccggugagcacagacgggacaagagauccguggcccucgcaccccauguaggucuugggcucgagacucgcacggagaccuggaugagcuccgagggagccuggaagcagauccagagagucgagacgugggcucuccgccaccccggauucacugugaucgcgcuauuuuuggcccacgccaucggaaccagcauaacccagaaagggaucaucuuuauccuccugaugcuugugaccccaagcauggccaugcggugcgucgggauagggucgcgugauuuuguggaagggcuaucaggcgccacguggguggacguaguucuugaacacgggagcugugugacuacuauggccaaagacaagcccacccuggacaucgagcuccugaagaccgaggucaccaaccccgcugugcugcgcaagcucugcauugaagccaaaauuuccaacaccacgacggacucucgcugcccgacccaaggcgaggccacacuuguagaggaacaagacgcaaacuucguaugcagacgcacauucgucgaccgaggcugggggaacgguugugggcuguuugggaaggggucccucaucacgugcgccaaguucaagugugugaccaagcuggagggcaagaucguccaguaugagaacuugaaguacagcgugauugugaccguccacaccggggaucaacaccagguggggaacgaguccacggagcauggcacgaccgcgaccauaacuccccaagccccaaccaccgagauccaacucaccgacuacggugcacugacacuggacugcagcccccgcacgggucucgacuucaacgagauggucuuacuaaccaugaaagaaaaauccuggcucgugcacaagcaaugguucuuggaucugccgcuccccuggacaagcggggcgucgacaucccaggagacuuggaaccggcaggaccugcuggucaccuucaagaccgcacacgccaaaaagcaagaagucguggugcucggcagccaagagggugccaugcacaccgcacuaacgggagcgacggaaauacagacauccgggacgacaaccaucuucgcugggcaccugaaguguagauuaaagauggacaagcugacccugaaaggcaugagcuacguuaugugcaccggguccuucaagcucgagaaggaaguggcugaaacucagcacggcaccgugcugguccagauuaaauacgaggguaccgaugccccuuguaagauccccuucagcacccaagacgagaagggggugacccagaacggccgguuaauaacagccaacccgaucgugaccgacaaggagaagccggucaacaucgaggccgagccgcccuucggggagucguauauugucaucggcgccggcgagaaggcccugaagcucucaugguucaagaaagguucauccaucggcaaaauguuugaggccacugcgcguggggcccggcgcauggcgauccugggagacacagccugggacuucgggagcaucggagguguguucacgucgguuggaaagcugguucaccagaucuucggcacagccuacgggguucucuucuccggugucagcuggacgaugaagaucggcaucggcguucuguuaacuuggcucggccuaaacucccgcagcaccucccuuagcaugaccuguaucgcaguggguuuggugacccuguaccugggcgugauggugcaggccgacuccgguugcguaaucaacuggaagggccgggaguugaagugcgggagcggaauauucgugaccaaugaggugcacaccuggaccgagcaguauaaguuccaagcggauucgccuaagcgccuguccgcugcaaucggaaaagcaugggaggagggggucugcggcauccgaagcgcuaccaggcuggagaauauaauguggaagcagaucagcaaugagcugaaccacauccuccuggagaacgacaugaagcuaaccgugguggucggggauguggcugggauccuagggcagggcaagaaaaugaucaggccacagccaauggaguacaaauacaguuggaaguccuggggaaaggcgaaaaucauaggcgccgacgcccagaacaccaccuucaucaucgacggcccaaacacaccggaaugccccgaugaccagcgggcguggaacaucugggagguggaggacuauggcuucgguauuuucaccacgaauaucugguugaagcuccgggacagcuacacccaggucugcgaccaccggcuaauguccgccgccauaaaagauaguaaggccgugcacgccgacaugggguacuggaucgagucagagaaaaacgagaccuggaaguuggcccgagccucuuuuaucgaaguuaagaccuguauuuggccuaagucccacacguuguggagcaacgggguauuagaguccgagaugaucaucccuaaaaucuauggcgggccgaucagccaacauaacuaccggcccggcuacuuuacccaaaccgcaggacccuggcaucuuggcaaacucgaguuggacuucgaccugugcgagggcaccacggugguggucgaugagcacugugguaaccgagggccgucccuccgcacgacaaccgugacgggcaagauaauccacgaauggugcugccguucauguaccuuaccuccccuaagguuccggggcgaggacgguugcugguacggcauggaaauucgccccgugaaggagaaggaggagaaucucgucaaguccauggugucagccgggagcggggagguggacucauuuucauuaggcuugcuaugcauauccaucaugauugaggaagugaugcggucgcgcuggagucggaagaugcugaugaccgggacccuggccguauucuuucuccuaaucaugggccagcugacauggaacgaccucauccgccucugcaucauggugggggcuaacgccagcgaucgcaugggcaugggcaccaccuacuuggcccugauggccaccuucaagaugcgcccgauguucgccgucgggcuacucuuccggcggcucacgucgcgcgaggugcuuuugcuuaccaucggcuuaucauuaguagcguccgucgaacucccuaguucgcuggaggagcugggggacggccucgccaugggcauuaugauccugaaguuacucacggacuuccaaagccaucaguugugggccacccugcuaagucuuacauucaucaagacggccuucagccuucauuacgcguggaaaacaauggccauggugcucuccaucgucagccuguucccccugugccucuccacgaccucccaaaagaccacuuggcugcccguccugcucggcucccugggcugcaaaccguuaaccauguuccucaucgcagaaaacaagauaugggggagaaaguccuggccccugaacgaaggaaucauggccgucgggaucgucucuauacugcuuucgagcuugcugaagaacgacgugccucucgcaggcccguugaucgcaggcgggaugcugauugccuguuacgucauuucagggagcuccgcagaccucagccuggaaaaggccgccgaagucaguugggaggaggaggcggagcacucuggcgccucccauaacaucuuaguggaagugcaggacgaugggaccaugaagaucaaggaugaggaacgcgacgauacccucaccauccugcuuaaggcgacacuccuggccgucuccggagucuacccgcuauccaucccugccacccucuucgugugguauuucuggcagaagaagaaacagcguagcgguguacugugggacacgccgagcccgccugaggucgagcgcgcggugcuagaugacggcaucuaccggaucaugcagcgcggucuguuaggccggagccaggucggcguaggcguguuccaggagaacguguuccacaccauguggcacguuacccgcggggcggugcugauguaccagggcaagcgacuugagcccucuugggccagcguaaagaaggaccuuauuucuuacggcgggggauggcgccugcgggguagcuggaacacuggcgaggaaguucaagugaucgccgucgagcccgggaagaaccccaagaacgugcagacggcacccggcacguucaagacacccgagggagagguuggggcgaucgcccuggacuucaagcccggcaccuccgggucucccaucgucaaccgagagggcaagaucguaggccucuacgggaacggcguggugacgacgucggggacuuacguuuccgccaucgcacaggccaaggccucacaggaggguccgcugcccgaaaucgaagacgaaguguuccgaaagcgcaaccugaccaucauggaucuccacccaggguccgggaagacacgucgcuaccugccagcaaucguacgggaggccaucaagcgcaaacuucgaacccucauccuagccccaacccggguaguugccucagagauggcagaagcccugaaaggcaugcccauacguuaccagaccacggccguaaagagugagcacacugggaaggaaaucguggaccucaugugccacgccaccuucaccaugcggcugcugagccccguccgcgucccaaacuauaacaugaucauuauggacgaagcgcacuucacggaucccuccagcauagccgcccgaggguauaucuccacucgagugggaaugggcgaggcggccgcgauauucaugaccgcuacgccgcccgggaguguggaggccuucccgcaauccaacgccgucauacaggaugaggagagagacauccccgagcgcucuuggaacuccggcuacgaguggaucacggauuuccccggcaagaccgugugguucgugcccucuaucaaguccgguaacgacaucgcgaacugcuugaggaagaauggcaagcgagucauucagcugucgaggaagacguucgacaccgaguaccagaagacgaagaacaacgacugggacuauguagugaccaccgacaucagugaaaugggggcaaacuuccgcgccgaccgggucauugacccaagacggugccugaagcccguaauacuaaaagaugggccggaacggguaauacuugcugggcccaugccgguuaccguggccagcgcggcgcagcgacgcggcagaauuggacgaaaccauaacaaggagggugaccaauacaucuauaugggccagccccugaacaacgacgaagaccacgcacauuggacggaggccaaaaugcuccucgauaacauaaacacacccgaggggauaaucccagcccuuuuugaaccagagcgcgaaaagagugcugccgucgacggcgaauaccggcuccgcggugaggccaggaaaaccuucguagagcugaugcgcaggggcgaccuuccuguguggcucagcuacaaagucgccagcgaaggcuuccaguauuccgaccgucgguggugcuucgacggggagcgcaacaaucaggugcuggaggagaacauggacguggagaucuggacgaaggagggcgagagaaagaagcugcgcccccgguggcucgacgcccgcacguacagcgacccguuagcacugcgagaguucaaggaguucgccgcagggaggagaagcgugagcggggaccucauccucgagauaggcaagcugccgcagcaccucacccaacgcgcacagaaugcgcuagacaaccuggugaugcuccauaacucugaacaaggcgggcgggccuaccgucacgccauggaggagcugcccgauaccaucgagacccugaugcucuuggccuugauagcugugcucacuggcggcgucacccuguucuuucugagcgggcguggccucggcaagaccucaauuggccugcugugcguaauggcgaguucaguguugcuguggauggccaguguagaaccccacuggaucgcggccuccaucauccucgaguuuuuccucaugguacugcuaaucccugaaccggaccgucagcguaccccacaggauaaucaauuggcguacguggucaucgggcugcuguuuaugauccucaccguggccgccaacgaaaugggacuccuggagacaaccaagaaggaccuaggcaucgggcaugucgccgucgagaaccaccaccacgccgccaugcuggauguggaccuucaucccgcgagugccuggacccuauacgcuguggcgaccacgaucauaaccccgaugaugagacacaccaucgagaacaccacagcaaauaucucccucaccgcuaucgcuaaccaggccgcgauucuuaugggccuagacaagggcuggccgauauccaagauggauauaggggucccccuuuuggcgcucgguugcuauagucagguaaacccacugacccugacugccgcaguacucaugcuggucgcgcacuacgcgaucaucgggccgggccugcaggcgaaggccacucgagaggcccagaagcguacugccgccgguaucaugaaaaaccccaccguagauggcauaguugcgaucgaccucgacccgguaguguacgacgccaaauuugagaaacagcugggccagaucauguuacucauacuauguacuagccagauccugcugaugaggacgacaugggcccuuugcgaauccauuacgcuggcgaccgggccacucacuacucugugggaggggagcccggggaaauucuggaacaccacgaucgccgugucgauggcuaauauuuuccggggcagcuaccuggcgggcgcagggcucgccuucucgcugaugaagagucucggcggaggccgccgggggaccggcgcucaaggcgagacauugggggaaaaguggaagcggcagcugaaucagcucagcaagagugaguuuaauaccuauaagcgguccgggauaauggagguggaccgguccgaagcgaaggaaggacugaagcggggcgagaccaccaaacaugcgguguccagaggaaccgccaagcuccgcugguucguggagcgcaaucugguaaagccagagggaaaggugauagaccugggcugcggucggggcgguugguccuacuacugcgcaggccuaaagaaggugacugaagucaagggguacacuaagggcggccccgggcaugaggagcccaucccgauggcgacguacggauggaaccugguaaagcuacacagcgggaaggacguguucuuuaucccgcccgagaaaugcgacacccucuugugcgacaucggcgagagcagcccgaauccgacgaucgaggaggggcguacgcuaagaguccucaaaaugguggagcccuggcugcgcggcaaccaguuuugcauuaagaucuugaacccguacaugccuuccguuguugagacuuuagagcaaaugcaaaggaagcauggagggaugcuggugcgaaacccgcucagccggaacuccacucacgagauguacugggugagcugcgguacagggaacaucguauccgcagugaacaugacgagccgcauguugcugaacagauucacaauggcucaccggaaaccgacguacgaacgcgacguagaccuggggaccggcacccgccacgucgcaguagagcccgaggucgccaacuuagauauaaucgggcagcgcaucgagaacauaaagcacgagcacaagaguacauggcacuacgaugaggacaacccuuacaagacgugggcguaccacggcucguaugaggucaagccgucugguucagccagcuccauggugaauggcgucgugaaacuucucaccaaacccugggacgugauccccaugguaacccagaucgccaugaccgauacgacgccauucggacagcagcgcguguucaaggagaagguugacacuagaaccccgaaggcaaaaagaggcacagcccagaucauggaagucaccgcgcgcugguuguggggcuuccugucgcggaauaaaaagccccggaucugcacucgggaggaguucacucgcaaaguacgcuccaacgccgccaucggugcuguauuugucgacgagaaccaguggaacagcgcgaaggaggccguugaggacgaacgauucugggaccuggugcaccgagaacgugagcuacauaaacaggguaaaugcgcaaccugcgucuacaacaugaugggcaagcgcgagaagaagcugggcgaguucgggaaggccaaaggcucccgcgcgaucugguauaugugguugggugcgcguuuccucgaguucgaggcacugggguucaugaacgaggaccacugguucagccgcgaaaauagccugagcggcguggagggggagggccuccacaaauuaggauauauccugcgggauauuuccaaaauccccgggggcaacauguacgccgaugacacagccgguugggacacccgcaucacugaggacgaccuccaaaacgaggccaagauaacggacaucauggagccggagcaugcgcuccuugccaaggccaucuucaagcucaccuaccagaacaaaguuguacgcguccagaggccugccaagaaugggacggugauggacgucaucagccgccgggaccagcgcggguccggucaggugggcaccuacgggcugaacacuuucaccaauauggaggcgcagcuaauccggcagauggagucugagggcauuuucuccccaagcgagcucgaaacccccaaucuggcggagcgugcccuggacuggcuagagaaguacgggguggaacggcugaagcgcauggccaucuccggggacgauugcgucgucaagccgaucgaugaccgguuugccacugcacugacggcguugaacgacauggggaaggugcggaaggacaucccccagugggagcccuccaagggauggaacgacuggcagcaggucccuuuuugcucgcaccacuuccaucagcugaucaugaaggauggccgggagaucgucgugccaugccgcaaucaggacgagcugguugggcgagcccgcgugagccagggcgcgggguggagucuccgggagacggcgugccugggcaagaguuacgcgcaaauguggcagcugauguacuuucacaggcgggaccugcgcuuagcagccaacgcgaucuguucagccgucccaguugacugggugcccaccucccgaaccacguggucuauccaugcacaccaccaguggaugaccaccgaggacaugcucuccguauggaaccgcguguggaucgaggagaacccguggauggaggacaagacacacauuucuuccugggaagacgugccguaccuggggaaacgcgaggaccaaugguguggcagccuaauuggccugacugcucgggccacuugggccaccaacauucaaguagccauaaaccaaguccgccggcucaucggcaacgaaaauuaccuggacuauaugaccuccaugaagcgcuucaaaaacgagagcgaccccgagggcgcguuaugguga

SEQ ID NO: 24211 - RNA, 9879 nt, Artificial Sequence
  derived and/or modified CDS sequence (opt11) from DENV-1__FJ410235__SS-prME
ucugugaccaugcugcucaugcugaugccaaccgcccuggccuuccaccuaacgacccgcggcggggagccccacaugauugugagcaagcaggagaggggcaagucacugcuguucaagaccagugcaggggugaacaugugcacucucaucgccauggaucucggcgaguucugcgaggacacuaugacguacaaguguccucgcauaaccgaggcggagccggacgacgucgacugcuggugcaacgcgacugauacgugggugacauacgggaccuguucgcagacuggcgagcacaggcgcgacaaaagauccguggccuuggcgccucacgugggccucggguuagagacgcgcacggagaccuggaugagcuccgagggcgccuggaaacagauccagcgcguggagaccugggcccugcgacaccccggguuuacggucaucgcgcucuuucuggcgcaugccauaggcacaagcaucacacagaaggggaucaucuucauccugcuaauguugguaacucccuccauggcaaugcggugcguaggcaucgguagccgcgacuucguggaggguuugucaggggccacguggguggacguggugcucgagcacgguagcugcgugaccaccauggcgaaggacaagcccacgcuggacaucgagcugcuaaagacggaggugaccaaccccgcggugcugcggaaguugugcaucgaggccaaaaucuccaacaccaccacggacagccgcugccccacccaaggagaggccacacuuguggaggaacaggacgcuaauuucgucugccgucguaccuucguggaccggggcugggguaauggcugugggcuguuuggcaaggggucccugaucacgugcgccaaguucaagugcgugaccaaauuggaggguaagaccguccaguacgagaaccugaaauacagcgugaucgugacaguccacacgggugaucagcaucagguggggaacgaaucaaccgagcacggaaccaccgcuaccaucacgccccaggcgccgagcacggagauucagcugaccgauuacggugcccucacccuggacuguagcccccgaacgggccuggacuucaaugagaugguccuucuuacaaugaaggagaagaguuggcugguccacaaacagugguuucuggaccugccgcugcccuggaccagcggggccaguacaagccaggagacauggaaccggaaggaccucuuggugaccuucaagacggcccacgcgaaaaagcaggaggucguggugcugggcucccaggagggcgccaugcauacagcccucacgggggccaccgaaauccagaccuccgguaccacgaccauuuucgccggucaucuaaaaugucgccuaaagauggacaagcuuacccugaagggcaugaguuacgucaugugcaccgggagcuucaaguuggagaaggaggucgcugagacgcaacacggcaccguccucguccagauuaaauacgagggcacagacgcccccugcaagauccccuucagcacccaggacgaaaagggggugacgcagaacggccguuuaaucacgaccaaucccaucgugacugacaaagagaagcccgucaacaucgaggccgaaccacccuucggggagucguacaucgugaucggcgcgggggagaaggcguuaaaacuaagcugguuuaagaaggguucauccaucgggaagauguucgaggccacggcucggggugcucggcgcauggcaauccucggcgacaccgcgugggacuuugggagcaucggcggcguauucaccagugucgggaaacuggugcaccaaaucuucggaaccgccuacggagugcuauuuagcggaguauccuggacuaugaagaucgggaucggggugcuccucaccuggcuggggcuaaacagcagaucaaccagccuguccaugacgugcaucgccgugggucugguuacauuauaccuaggaguuaugguccaggccgacagcgggugcgucaucaacuggaagggccgggagcuuaaaugcgggagcgguaucuucgugaccaaugagguccacacauggaccgagcaguacaaguuucaggccgacaguccgaagcgucucuccgcugcuauaggcaaggccugggaggaggggguuugcggcauccgguccgccaccaggcuggagaauaucauguggaagcagaucucgaacgaauuaaaccacauucucuuggagaacgacaugaaguuuacggugguggucggggacguugccgguauccuggcgcaggguaagaagaugaucagaccucagcccauggaguacaaauacuccuggaaguccuggggcaaagcuaagaucauaggcgcagacguccagaacaccaccuuuaucaucgaugggccaaacaccccagagugccccgacgaccagagggcuuggaacauaugggagguggaagacuacggcuucgggauuuucacaacgaacaucuggcuaaagcugcgggacucauacacccaggugugcgaccaucgacugaugagcgcggccaucaaggacuccaaggccgugcaugccgacaugggguacuggaucgagagcgagaagaacgagacauggaagcucgcccgggcaucguuuaucgaggugaaaacuuguaucuggccgaagagccacaccuuguggaguaacggcguacuugagucagaaaugaucguuccgaaaaucuacgggggcccuauuucccaacacaacuaucgcccuggguacuucacccaaacagcuggcccuuggcaccucggcaagcuggagcuggauuucgaccucugcgaggguacuaccgucgucguggacgagcauugcggaaaccgggggccgagccuucgcaccacgaccgugaccggcaaaaucauccacgaguggugcugucgguccugcacacugccgccgcugcgcuuuaagggggaggacggcugcugguacggaauggagauacggcccgucaaggagaaggaggagaacuuggucaagagcauggucucugcuggcuccggugagguggacaguuuuucccucggccugcugugcaucagcaucaugaucgaagagguuaugcgauccagguggucgcgcaaaauguuaaugaccggcacgcuggccguauucuucuugcugaucauggggcagcucaccuggaaugaccugaucagacugugcaucauggucggcgcaaacgcguccgaccgaauggggaugggcacaacuuaucucgcccugauggcuacguucaaaaugcgcccuauguucgccguggggcuacuguucaggcgccucacguccagagagguccugcuccugacgaucggacugucucucguugccagcgucgaguuaccaaacucccuggaggaguugggggacggguuggcgaugggaaucaugaucuuaaagcuccugacagauuuucagagccaccaacuaugggccacgcuccugucccuuaccuucaucaagaccaccuucagucuccacuaugcguggaagaccauggcuauggugcuguccaucgucagccuguuuccucucugccugagcaccaccagccagaagaccacguggcuaccuguacuccugggcuccuuagguugcaagccacucaccauguuccugaucgcggagaauaagaucuggggccgcaagaguuggccccugaacgaggggaucauggccgugggaaucgucagcauacuacuguccucacuauugaaaaacgauguucccuuggcagguccccuaaucgcuggcggcaugcucaucgcguguuacgugaucuccgggagcucggccgaccugucacuggagaaggccgcugagguaagcugggaagaggaggcagagcacagcggagccucccacaauauccuaguggagguccaggaugacgggaccaugaagauuaaggacgaggaacgggacgacacccugaccauacuguugaaggcgacgcugcuggcagucucaggcguguacccgcucuccauucccgcuacacuguucgugugguauuucuggcagaagaagaagcagcgcucuggggugcucugggacacccccagcccgcccgaagucgagcgggccgugcuggacgacggcauauaccgcaucaugcaaagggggcugcugggccggagccaggugggcguggguguauuccaagagaacguguuccacaccauguggcauguuacgcgcggcgccguucuaauguaccagggaaagcgccucgagcccucaugggcgagcgugaagaaggaccugaucucuuacggcggcggguggcgauugcagggcuccuggaauaccggggaggaaguacaggugaucgccguggagcccggaaagaacccaaagaacguccagacagcccccgggacuuucaaaacgagugagggcgaggucggcgccauagcccucgacuucaagcccgggaccagugguagcccaauugucaaccgcgaggggaagauugucggccuguacgguaaugggguggugaccaccucaggcacguacgugagcgcgauagcccaagccaaggcuucucaagaggggcccuuaccggagauagaggacgagguguucaggaagcgcaaccuaacuaucauggaccugcaccccggcuccgggaaaacccggcgcuaccugcccgcgauagugcgggaggccaucaagcgcaaacucagaacacucauacuggcaccuacgcgcgucguagcguccgaaauggccgaggcauuaaagggcaugcccauucgcuaccagaccaccgccgucaaaagcgagcacacaggcaaagaaauuguagaccugaugugccacgccaccuucacgaugcggcugcucucgcccgugagaguccccaacuacaacaugaucauuauggacgaggcgcauuuuacugacccgagcaguaucgccgcucggggguacauuagcacccgcgugggcaugggcgaggccgccgccaucuuuaugaccgccacgccgcccggaucaguggaggccuuuccccagucaaacgccauuauccaggaugaggagcgcgacauuccggagcgcaguuggaacucuggguacgaguggaucaccgauuucccaggcaagacggugugguuuguaccguccaucaagagcgguaacgacaucgccaacugccuccggaagaacgggaaaagagugauucaacugaguagaaagacuuuugacaccgaguaccagaagaccaagaacaacgacugggauuauguggucaccacggacaucagugaaaugggagccaacuuccgcgcagaccgggugauugacccccgccggugccucaagccggugauacugaaggacgggcccgagcgcgugauccucgcgggucccaugcccgugacggucgccucggccgcccagcggcgcgggagaauaggccgcaaccacaacaaggagggcgaucaguacaucuauauggggcagccguuaaacaacgacgaagaucacgcgcacuggaccgaggcaaagaugcugcuggacaacaucaacacgcccgagggcauaauccccgcccucuucgagccugagagagagaaaucugcugcaauugauggagaguaccgccugcgcggcgaagcucggaagacguuuguggagcugaugcgccgcggcgaccucccaguguggcugucuuacaaggucgcguccgagggcuuccaguauagcgaucgccgguggugcuucgacggcgagcgcaacaaccagguccuggaagagaacauggacguggaaaucuggaccaaggagggugagcggaagaagcuucgcccccgguggcuggacgcucgaaccuacuccgacccccuagcacuccgggaguucaaagaguucgcggcggggagacggagcgucucuggggauuugauccuggagaucggcaagcucccucagcaccugacgcagcgugcccagaaugcccuggacaaccuagugaugcugcacaacagcgagcaaggcgggcgggccuaucgccacgcuauggaggagcugccggacacuauugagacccucaugcugcuggcccucauagcggugcuaaccggggggguuacccuauucuuccucucgggccgggggcucggcaaaacgagcaucgguuuacucugcguaauggccuccagcguguuguuauggauggccuccguggagccacacuggaucgcggcuagcaucauacucgaguucuuccugauggugcuguugauucccgagcccgaccgccaacggacaccgcaggauaaccagcuggccuauguggucaucggguuacuguucaugauccugacaguagcugccaaugaaaugggccuacucgaaaccaccaagaaggaccuugggauuggacacguggcgguggagaaucaucaccacgccgcgaugcuagacguggaccuccaccccgcuuccgccuggacgcuguacgcaguggccaccaccaucaucacgcccaugaugcgacacacgauugagaacacgaccgccaacauaagccugaccgccaucgcuaaccaggcggccaucuugauggggcuggacaagggcuggccgauaucgaagauggacaucggagucccgcugcucgcccuggggugcuacagccaaguaaauccguugacgcucacagccgcggugcugaugcuuguagcucacuacgcuaucauaggcccggggcugcaggccaaggccacccgggaggcgcagaaacguaccgccgccggcaucaugaagaacccgacgguggacgggaucguugcuauugaccuggaccccguaguguaugacgcaaaauucgagaaacaacugggacagaucaugcuccuuauucuuugcaccucccagauacuccugaugcgcaccacgugggcgcuuugcgagagcaucacgcucgccaccgggccgcuuacgacccugugggaggggucucccggcaaguucuggaacacaaccaucgcugucagcauggcgaauaucuuccgggggagcuaccucgccggggcuggccuggccuucuccuuaaugaagagucuggguggcgggcgccgcggcaccggcgcccaaggggagacucugggcgaaaaguggaagcgccagcugaaccaacuuggaaagagcgaguucaacacguauaaacggagcggaaucauggaagucgaccgcucagaggccaaggaggggcugaagagaggcgagaccaccaagcacgcggugucgcgugggacggcaaagcuucgcugguucguggaacgcaaccucgucaagccugaggggaaagugaucgacuuagguugcggacgggguggcuggucuuauuacugugccggccugaagaaggucacagaggucaaaggguauaccaaaggagguccugggcacgaggagccuauucccauggcaaccuacggguggaaucuggugaagcuccauagugggaaggacguguucuucaucccgcccgagaagugcgacaccuuacugugcgacaucggcgaguccuccccuaacccuacgaucgaggaggggagaacccuccggguccugaaaaugguagaaccguggcugcgcggcaaucaguuuuguaucaagauccucaaccccuacaugcccucaguggucgagacccuggagcagaugcagcggaagcacggcgguaugcugguucgcaacccccucagucggaacuccacccaugagauguauugggugucuugcggcaccgggaacaucguuagugccguaaacaugacgagccguaugcugcugaaccgguucacuauggcgcaccgaaagccgaccuaugaacgcgacguggaccuaggggcaggaacccggcaugucgcgguggaacccgagguggcuaaccuggauaucaucgggcagcgcauugaaaauauuaagcacgagcacaagagcacguggcacuacgacgaggacaaccccuacaagaccugggcguaccacggcagcuacgaagucaagccgagcgggagcgcgucguccauggugaacggcgucgugaagcugcucaccaagccaugggacgugaucccaaugguaacccagauagccaugacggacaccaccccauuuggucagcagagaguguucaaggaaaagguggauacccgcacgcccaaggccaagcgcggcaccgcccagaucauggagguaaccgcuaaguggcuguggggcuucuugagccguaacaaaaagccgcggaucuguacccgcgaggaguuuacgaggaaagugcgcuccaaugcggcuaucggggccguguucguagacgaaaaccaguggaacucugccaaggaggcgguugaagacgaacgguucugggaccucgugcaccgcgagcgggaacugcacaagcagggcaagugugccaccugcgucuacaauaugauggguaagcgugaaaaaaaacugggggaguuugguaaggcuaagggcucccgggccaucugguacaugugguuaggcgccagauucuuggaguucgaggcucugggguucaugaacgaggaccauugguucagccgcgagaacagccucucggggguugaaggagagggccugcacaagcugggguacauccuccgagacaucagcaaaaucccuggagggaacauguacgccgacgacaccgccggcugggacacgcggauaaccgaagacgaccugcagaaugaggcaaagaucacagacaucauggagccggagcacgcccugcucgcgaagagcauauuuaagcugacauaucagaacaaggugguccgcguacagcggccggccaagaacggcacagugauggacguuauuuccagacgagaucagcguggaagcggccaggugggcacguacgggcugaacaccuuuaccaacauggaagcccaacucauccgccagauggagagcgaggggaucuucagccccuccgagcuagaaacccccaaucuggccgggcgcgugcuugauuggcuugagaaacauggcguagagcggcugaagcggauggccaucagcggggacgacugcguggugaagccaaucgaugaccgcuuugcgacggcacucacugcccugaacgacaugggcaaaguccggaaggauauaccccagugggagcccuccaagggcuggaacgacuggcagcagguccccuucugcagccaucacuuccaccagcugaucaugaaggacgggcgcgagaucgugguaccuugccggaaucaggacgaguuggugggccgcgcccgugugagucagggggcuggauggucccugcgcgagaccgcuugcuuaggaaagaguuacgcccagauguggcaacuuauguacuuccaccgcagggaccugcggcuggccgcuaaugcgaucugcucggccgucccgguggauugggugccgaccucucgcaccaccugguccauccacgcccaucaccaguggaugacaaccgaggacauguugagugucuggaaccggguguggaucgaggaaaaccccuggauggaggauaagacucacaucaguucauggggcgacgugccuuaucucggcaaacgcgaggaccaauggugcgggucgcuaaucggucucacagcccgagccacaugggcgaccaacauucagguggccaucaaucaagugcgcagacugaucgguaacgagaacuaccuagacuauaugaccagcaugaagcgauucaaaaacgaguccgacccagaaggcgcccucugguga

SEQ ID NO: 24212 - RNA, 9879 nt, Artificial Sequence
  derived and/or modified CDS sequence (opt11) from DENV-1__FJ410236__SS-prME
ucuguaacaaugcuacuaaugcucguaccuacggcccucgcauuccaccuaacaacucgcggcggggaaccacacaugauaguguccaaacaggaacgggggaaaucgcuauuguucaaaacgagcgcaggggucaauauguguacacuaauagcaauggaucugggcgaacuuugcgaagacacaaugacauauaaauguccgcguaucaccgaaacggaaccugacgaugucgacugcuggugcaacgcaaccgacacauggguaaccuacgguacguguucucaaacaggcgaacaccgccgcgacaaacggaguguagcccuugcaccucacguagggcucgguuuagaaacacgcacagagaccuggaugagcuccgaaggcgcuuggaaacagauccaacgggucgaaacgugggcccuucgccauccuggauucaccguaauagcacuauuccuagcccacgccaucggcacuucgauuacgcaaaaaggcauaauauucauccuccucaugcuagugacgcccucaauggccaugcguuguguagggaucggcagccgcgacuuuguggaagggcuaucgggcgcaacaugggucgacguaguacuugaacaugguagcugcgucacaaccauggcgaaagacaaacccacacucgacauagaguugcucaaaacagaaguuaccaacccugccguccuccgcaaacugugcaucgaggccaagaucuccaacacaaccacugacagccgcuguccaacucaaggagaagcgaccuuaguagaggaacaagacgccaacuucgugugccgacggacuuucgucgaccggggcuggggaaacggguguggacuauucgggaaggggucccucauuaccugugcgaaguucaagugcguuaccaaauuggaaggcaaaaucguacaauaugaaaaccuaaaguacuccguaaucguaacgguacauacgggagaucagcaccagguggguaacgaauccacugaacacgguacuacagccacgauaacaccacaagcgccaaccacggaaauccaguuaaccgauuacggagcgcugacgcucgacuguucaccacgaaccggacuagacuucaacgaaauggucuugcugacgaugaaagaaaagucuuggcuaguccauaagcagugguuccuagaccuaccucuaccauggaccucaggggccagcacuagccaggagacguggaacaggcaggaccuccuaguaaccuucaaaacugcucacgcuaagaaacaagagguagucguuuugggaucccaggaaggcgcaaugcacaccgcccuaaccggagcaacggagauucaaacaagcgggaccacaaccauauucgccggacaccuaaaaugucgacuuaaaauggacaaacuaacacuaaaggggaugagcuaugugaugugcaccggaucguucaaauuagaaaaagaaguagcugaaacgcagcacggcaccgugcuuguccaaaucaaauaugaagggacagacgcucccugcaagauccccuuuuccacgcaagaugagaaaggugugacacaaaauggccgccucauaaccgcuaauccgaucguaaccgacaaggaaaaaccggugaacaucgaagcagaaccacccuucggagaaagcuacaucgucauaggcgccggggaaaaggcgaugaaacugucuugguucaagaaaggauccucaauuggaaagauguucgaggccaccgccaggggagcucggagaauggccauccucggcgacacugccugggauuucgggagcaucggaggaguauucacauccgucggaaaacuuguccaccaaauauuuggcacagcguauggggugcuguucaguggagucaguuggaccaugaagaucgguauuggcgucuuacucacauggcuuggacuaaauucgcgcuccacgucccuauccaugacaugcauugccgucggucuaguaacacuuuaccucggagugaugguccaagccgacucaggaugcguaaucaacuggaaagggcgugaacucaaaugcggaagcgggauauucgucacgaacgaaguccacacguggacagaacaguauaaauuccaagcagauucucccaaacgucuaucugcagcaaucgguaaggcuugggaagagggaguuugcggcauacggagugcaacucgacucgagaacaucauguggaagcaaauaagcaacgaacuaaaucauauauuacucgaaaacgacaugaaguucacagucgugguuggggacguagcgggcauucucgcccagggcaagaaaaugauccggccacaacccauggaauacaaauauagcuggaaaagcuggggcaaagcgaaaauaaucggugcagacguacaaaacacaacauucauaauagacggcccuaauacaccagaguguccggacgaccaaagggcguggaacauaugggaagucgaggauuacggcuucggaauauucaccaccaacauauggcuaaaguuaagagauaguuacacacagguaugcgaccaccggcugauguccgccgccaucaaagacucaaaggcaguccacgcagauaugggcuacuggaucgagucggagaagaacgaaacauggaaacuugcucgagcaucauucauugaggugaaaacaugcauauggccaaagucccacacacucuggucgaacggcguucuagaguccgaaaugauaaucccuaaaauauacggagguccaaucagccaacacaacuacagaccgggauacuucacacagacagcgggacccuggcaccucggcaaacuagagcuggacuucgaucucugcgaaggaaccacugucguaguugaugaacacugcggaaacagaggaccgucuuugcgcacgaccaccgucacaggcaagauaauacacgaauggugcugccgcagcugcacccuacccccacugagauuccguggagaggacggauguugguacgggauggaaauacgaccugucaaagaaaaggaagagaaccuagugaagucaaugguaucugccgggucaggugaaguggacucauucagccugggccuccucugcauaagcauaaugauagaagaggucaugaggucgcgauggagccgcaaaaugcuuaugacagggacguuggcaguauucuuccuccuaauaaugggccaacuaacuuggaaugacuuaaucaggcuauguauaaugguuggggcuaacgcaucagaccggaugggcaugggcacgacauaccucgcgcuuauggcuacauuuaaaaugcgucccauguuugcaguaggacuccucuuuagacgacucacaagccgcgagguacuacucuuaaccaucggccuaucccuaguugcuucggucgaguuaccgaacagucuggaggaacugggagacgggcucgcgauggguaucaugauccuaaagcuccugacagacuuccaaagccaccaacuaugggcgacacuacuaucccucacguuuauaaaaaccaccuucucacugcacuaugccuggaaaacgauggccaugguacuaagcauaguauccuuauucccacucugcuuguccacgaccagccagaaaaccacuugguugccuguucucuuagggaguuugggcugcaagccgcucacgauguuucuuauugccgagaacaagauauggggccgucguagcuggccccuuaacgaagggauuauggcuguaggaauaguaagcauccuacuuagcucgcucuugaaaaacgacgucccgcuagcaggaccccucauagcaggcggcaugcucaucgcaugcuaugucauauccggcaguagcgccgaucugucgcuagaaaaggccgcggaggugaguugggaggaggaagccgaacauagcggcgcgucccacaauauauuggucgaaguccaggacgacgggacaaugaagauuaaggaugaagaacgagacgacacccucaccauacugcuaaaggcaacacuccuugcggucagcggagucuacccgcugagcauacccgcgacgcuuuucguaugguacuucuggcaaaagaagaagcaacgcuccggagugcugugggacacacccucaccaccagaaguugaaagagccguacucgacgauggcaucuaccgaauuaugcaaagaggccuccucggaagaagccaggugggagucgggguuuuccaagagaauguguuucauacgauguggcacguaacacggggagcgguacucauguaccagggaaagcgccucgaaccaagcugggccucgguaaagaaagacuugaucagcuacggcggcggcuggcgacuccaaggcagcuggaacacaggagaagaagugcaagugaucgcagucgagccuggcaagaaccccaaaaacguccaaacugcucccggaacauuuaaaacccccgaaggagaggugggcgccauugcccuagacuuuaaacccggaacgucuggcagccccaucgucaauagagagggaaagauagucggccuuuacggcaaugggguaguuacaacaucggggacauacgucuccgcgaucgcgcaggcaaaggcaucccaagaaggcccuuuacccgaaauagaagaugaaguguucaggaaacgaaauuuaacaauaauggaccugcacccugggagugggaagacccgucgcuaccuacccgccauuguccgagaggcgaucaagcgcaaacuucggacauugauccuggcgccgaccaggguagucgcaagugaaauggcagaggcguuaaaggguaugccgauccgcuaccagacaacagcaguuaagagcgagcacacagggaaagaaauaguagaccugaugugucaugccaccuucacuaugcgcuuacuguccccuguccgagugccgaacuacaacaugauaaucauggacgaagcccacuucacggacccuuccaguauugcagcccgaggauacaucucgacgcgcguaggaaugggggaggcggcagcuauauucaugacagcuacaccacccgguagugucgaagccuucccacaaaguaacgccguuauacaagaugaagagagggacauaccagaacguaguuggaacuccgguuacgaguggaucacugacuucccuggcaaaacaguuugguucgugccaucaauaaagagcggcaacgacaucgcaaauugucuaaggaaaaaugggaaaagaguuauccagcugagcaggaagacauucgacacggaauaccagaaaacuaaaaacaaugacugggacuacguaguaaccacagacaucagcgaaaugggagcuaacuucagggcggaccgaguuauagacccgcgacggugcuuaaagccugucauccuaaaagacggccccgaaaggguaauucucgcgggcccgaugccgguaaccguagcuagcgcggcacaaaggcgagggcggaucgguagaaaucacaacaaagaaggggaccaauacaucuacaugggccagcccuuaaauaacgacgaggaccacgcgcacuggaccgaagcuaagauguuacucgacaauaucaauaccccagagggcaucauaccagcacuuuucgagccagaacgggagaagucagcagcaauagacggagaguaccgacuaagaggggaagccagaaaaacauucguggaacugaugcgacggggagaccuacccguauggcucagcuacaaagucgcuuccgagggguuccaauauagugacagacgguggugcuuugacggcgaaagaaacaaccaagugcucgaagaaaacauggacguggagauuuggacgaaagagggggaaagaaagaaauugaggccacgcuggcuagacgcgaggacuuacucggacccuuuagcacuaagggaguucaaagaguucgcagcgggacggcgaucuguuucgggagaucugauacucgagauuggcaagcucccccagcaccuuacgcaaagagcacaaaacgcccuggacaaccuuguuaugcuccauaacucagagcaaggcgggcgggcauaccgacaugcuauggaggaacuccccgacacuauagagacacuaaugcuucuggcacuaauagccguacuaaccgggggcguaacauuauucuuccuaagcgggagggguuuaggcaaaacaaguauaggucugcuuugcgugauggccucguccguccuacuauggauggcgucgguagaaccacacuggaucgcagcaaguauaauccuggaauuuuuccuaaugguacuccuuauacccgaaccagacaggcaaaggacaccacaggacaaccaguuggcguacgucgucaucggacugcucuuuaugauacucacaguagcagcgaacgagaugggacuauuggaaacaacaaagaaagaucuuggcauaggacacguagcuguagagaaccaccaccacgcugccauguuagacguagaccuacacccggccucagccuggacgcuuuacgccgucgcaacgacuauaauuaccccaaugaugcgacacaccauagagaacacgacugcgaauauaucucugacggccaucgccaaucaagcugcaauccugaugggacucgauaagggauggccuaucucgaagauggacauaggcgugccccuucuggcacuaggaugcuauucgcaaguaaauccacugacccucacagcagcaguuuuaauguuaguggcgcacuacgcaauuauagggccagggcuccaagcuaaggcuacccgagaggcccaaaaacgaacagcagccggaaucaugaaaaacccaacaguugauggcaucgucgccauugaccuagacccgguaguguacgacgccaaguuugaaaagcagcucggccaaauaaugcuacuaauuuugugcacgucacaaauacuccuaaugaggaccacuugggcucucugcgaaagcauuacacucgcaacaggaccacuaacaacucuaugggaaggaucaccaggcaaguucuggaacacaacaaucgcagucuccauggcuaacaucuuucgcggcuccuaucuagcgggcgccggucuagcuuucagucucaugaagucacucggcgggggacgccgagguacaggggcacagggcgagacccucggagaaaaguggaaacgacagcuaaaccaacucuccaaaucugaguucaacaccuacaagcgcuccggaauaauggaggucgaccggagcgaggcgaaagaagggcugaagcgcggagaaacaacgaaacacgcagucucacggggaacggccaaacuccgaugguucgucgaacgaaaccuggucaaaccggaagguaaaguaauagaccuaggaugcggcagaggaggguggagcuacuacugcgcgggacuuaagaaagucacggaaguaaaaggguacaccaaggguggaccagggcacgaggaacccaucccuauggcgacauacggauggaaccucgugaagcuacacagcggaaaggacguauucuuuauaccaccggagaaaugcgauacacuguuaugugacauuggagaaagcaguccuaaccccacaaucgaggaaggccgaacgcugcggguucuaaagaugguggagccaugguuacgagggaaucaauucugcaucaaaauacuuaaccccuauaugccaaguguugucgaaaccuuggagcagaugcagagaaaacacggggguaugcuaguacgcaacccacucucccgaaacucaacccacgaaauguacuggguaaguugcgggacaggcaauauugugagcgcggugaacaugaccucccgcaugcuccucaaccgcuuuaccauggcucaccgaaagccaaccuacgagagagacguggaccucggcgccgguacgagacacgucgcgguagagcccgagguggcaaaccuggacauaauaggccaacguaucgaaaauauaaaacaugagcacaagagcaccuggcacuaugacgaagauaaccccuacaaaacaugggcauaccauggcucguacgaaguaaaacccuccggcagcgccucgagcauggucaauggcgugguaaaacuauugacgaagccgugggacgucauaccaaugguaacccagaucgcgaugacugauaccacgccauuuggucaacaacgaguauucaaggaaaaagucgauacacgaacgccaaaagccaagcgcggcaccgcccagauuauggaggucaccgcgaaauggcuauggggauuccucucccgcaacaaaaagcccagaauaugcacucgggaagaguucaccagaaaaguucgcaguaaugccgccauaggagcgguguucguugacgagaaucaauggaacagcgcuaaggaggcgguagaagacgaacgauuuugggaucuaguccaucgagaacgugagcugcauaaacaggguaaaugugcaacuugcguauacaacaugaugggaaaacgugagaagaaauugggagaguucgggaaggcaaagggcuccagagccauaugguauauguggcugggcgcccguuuucuugaguucgaagcucuaggcuuuaugaacgaagaccacugguuuucgcgcgaaaauucacugagcggaguagagggagaaggucuccacaagcucggguacauacuacgggacauaagcaaaauacccgggggaaacauguacgccgacgauaccgcaggcugggacacuagaaucacagaagacgaccuccaaaacgaggcccgaauaacagacauaauggaacccgagcacgcucuccuugccaaguccauuuuuaagcucaccuaccagaacaaggucgucagagugcaacgaccagccaaaaauggaacagugauggauguuauaucacggcgugaccaacgggggagcgggcaagucggaaccuacggccucaacacguucaccaacauggaagcccagcuuauucgacaaauggaaagcgagggcauuuucucaccgagcgaauuagaaacccccaaccucgcugagcgaguacucgacuggcuagaaaaauauggagucaagcgccugaaaagaauggccauaucaggagaugauugcgucgucaaaccuaucgacgaccgcuuugcgaccgcguuaacagcacucaacgacauggggaaaguccgaaaggauauaccacagugggagccauccaagggcuggaacgacuggcagcaaguacccuucuguucgcaccauuuccaucaguuaauuaugaaggaugggagagaaaucgucguucccugccgaaaccaggaugagcuagucggcagggcgaggguaucccaaggagccggauggucccuacgcgagaccgcgugccuagggaagucguacgcccaaauguggcaacucauguacuuccaccgaagagaccugcggcuggcagcgaaugccauaugcucagcagucccaguagacuggauaccaacaucucgaacuacguggagcauccaugcgcaccaccaauggaugacaaccgaagacaugcugucaguauggaauaggguuuggauagaagaaaacccuuggauggaagacaaaacacacaucagcuccuggggagacguaccuuaucuaggcaaacgugaagaucaauggugcggaagucuuauaggccuaaccgcgcgcgcgacaugggcaacgaauauacaaguggcaaucaaccaaguaaggagacuaaucggaaacgaaaauuaccucgacuauaugacuucaaugaagcgcuuuaagaacgaaagcgacccagaaggagcacucugguaa

SEQ ID NO: 24213 - RNA, 9879 nt, Artificial Sequence
  derived and/or modified CDS sequence (opt11) from DENV-1__FJ410238__SS-prME
agugugacgaugcugcugaugcugaugcccaccgccuuggccuuccaucucaccacccgggggggcgagccccacaugaucgugucaaagcaggagagaggcaagagccuccuguuuaaaaccagcgccggcgugaacauguguacccuuaucgccauggacuuaggcgaguuuugcgaggacacgaugaccuauaagugcccccggaucacagaggccgagcccgacgacguugacuguuggugcaacgccaccgacacgugggugacuuacgggacguguagccagaccggagagcaccggcgggacaagcgguccguggcuuuagcuccccacgugggccucgggcuggagacgcgcaccgagacauggaugagcagugagggcgccuggaagcagauccagcggguggagaccugggcccuacgccaucccggguucacagugaucgcccucuuucuagcgcaugccaucggaacuagcauaacccagaagggcauuaucuucauccugcucaugcuggugacccccuccauggccaugaggugcgucggaaucgguucgcgcgauuucguugaggggcuguccggcgccacuugggucgacguagugcucgagcacggaagcugcguuaccaccauggcgaaggacaagcccacccuagacaucgaacuacuaaagacggagguaacgaaucccgcgguucuucggaagcuuuguaucgaagccaagauuuccaacaccaccacagacagccgcuguccgacccagggcgaagccacccucguggaggagcaggacgccaacuucgucugucggaggaccuucguggaccgaggcuggggcaacggcugugggcuguucggcaaggggucgcuaaucacgugcgccaaguucaagugcgugaccaagcucgaagggaaaaucguccaguacgagaaccugaaguacuccgucauagugacuguccacaccggcgaccagcaccagguggguaacgaguccacugagcacggcacgaccgcuaccaucacaccccaagcacccagcaccgaaauccaacugaccgacuacggggcccucacgcuggacugcagccccaggaccggccuggauuucaaugagaugguccuccugacaaugaaggagaaaaguuggcugguacacaagcaaugguuucucgaccugccgcuacccuggaccagcggggcauccaccagucaggagacuuggaaccggcaggaccuacuggugacguucaaaaccgcucacgcgaagaagcaggaggucguuguccugggcucgcaagagggcgccaugcacaccgcgcucacgggagcgacugagauccaaaccagcggcacaacgacgaucuucgccggucaccugaagugccgccugaagauggauaagcucacccugaagggcauguccuacgucaugugcaccggcagcuucaagcuggagaaggaaguggcggaaacccagcacggcacgguucucguccaaaucaaauacgagggaacggaugcgcccuguaagauccccuucuccacccaagaugagaagggggugacucagaacggaaggcugaucacggccaacccgaucgucaccgacaaggaaaaacccgucaauaucgaggccgagccgccuuucggggagagcuacauugucaucggggcaggcgagaaggcucuaaagcuguccugguuuaagaaggggagcagcaucggcaagauguucgaggccaccgccagaggugcgcggcggauggcgaucuuaggcgacacggccugggacuucgggagcaucggcggggucuuuacauccgucggaaaguuaguacaccagaucuucggcaccgcauacggggugcuguucaguggcgucucuuggaccaugaagaucgggaucggcgugcuccuaaccuggcugggccucaacucgcgguccacgagccuguccaugaccuguauagccguaggcuuggucacccuguaccuuggcgugaugguucaggccgacagcggaugugucauuaacuggaagggccgugagcugaagugcgggagcggcaucuucgugacuaacgaggugcacacguggaccgagcaguacaaguuucaggccgacuccccuaaacgacuuagcgccgccaucggaaaggccugggaagagggggucugcggcaucagguccgccacccgucuggagaacaucauguggaaacagauaagcaacgagcugaaccacauccuccuagagaacgauaugaaguuaaccgugguggucggggacguggcgggcauccucgcccaggggaagaagaugaucagaccccaacccauggaguacaaguacuccuggaaguccuggggcaaggcgaagaucaucggcgccgacgugcaaaauaccacguucaucauagacgggcccaacaccccggagugucccgacgaccagcgcgcguggaacaucugggaagucgaggacuauggcuuugggaucuucaccacaaauaucuggcuaaaguuacgggacuccuacacccaggugugcgaccaccgcuugaugagcgcagccauaaaggacuccaaggccgugcacgccgacaugggcuacuggaucgagagcgaaaagaacgagacauggaagcuggcacgggccuccuucaucgaggucaagaccugcauuuggcccaaaucucacacucucuggucuaacggcguuuuagaaagcgagaugauaauaccgaagaucuacggggggccgaucucccagcacaacuaucgccccggguacuucacgcagacagccggccccuggcaccuaggaaagcuggaacuggacuucgaccugugcgagggcaccacgguggugguugacgaacacugcggcaaucgggggcccagccugaggaccaccacagugacgggcaaaaucauccacgaguggugcugccgcuccuguacguugccuccccucagauuuaagggggaggacggcuguugguacgggauggaaauacggcccgucaaggagaaggaggaaaaccugguaaagucaauggugagcgccggaaguggggaggucgacuccuuuucccuuggccugcuaugcaucucgauuaugaucgaagaggugaugcgcucccgguggagccgcaagaugcucaugaccgguaccuuagcuguguuuuuccugcucauuauggggcagcugaccuggaacgaccugauccgccucuguaucauggucggugccaacacguccgaccgcaugggcaugggcaccaccuaccuggcccugauggccacguucaagaugcgcccgauguucgccgugggccuccuguuccggaggcugacgagcagagaagugcuccugcugaccaucggucucucccuggucgccagcgcggaacugcccaacucccucgaagagcugggcgacggucuagccaugggcauuaugauccucaagcugcugaccgauuuccagagccaccagcucugggccacccugcugucccucacguucauccggacuacauuuagccugcacuacgccuggaaaacgauggcuaugguucuauccauagucagccucuucccucugugucuauccacgaccagucagaagaccaccuggcuccccgugcugcuaggcucccuugggugcaagccgcugacaauguuccugaucgcagagaacaagaucugggggcgcaaguccuggccccucaacgaagggauaauggccguggguaucguuaguaucuuacugaguagccuccugaagaacgaugugccucuggccgggccccucaucgccgguggcaugcugaucgcgugcuacgugaucuccgggagcuccgcggaccuaagucucgagaaggccgccgaagucuccugggaggaggaggccgagcauagcggcgcgucccacaacauacuaguagaggugcaggacgacgggacgaugaagaucaaggacgaggagcgcgaugacacccugaccauccuccugaaggcgacgcugcucgcugucagcggcguuuacccccuguccauacccgccacgcuguucguuugguacuucuggcagaagaagaagcagagaagugguguccuuugggacacgccgagcccucccgagguggagcgggcuguucuggacgacggaauauaucguaucaugcaacgcggccugcuggggcggagccaggucgguguggguguauuccaggagaacgucuuccacaccauguggcacgugacccgcggcgcggugcucauguaccaggggaagaggcuagagccuuccugggccucugucaagaaggaucugaucuccuauggaggaggguggcgacuccaaggcagcuggaacacgggagaggagguccaggugaucgccguugagcccggcaagaaccccaagaacgugcagaccgcccccgggaccuucaagacauccgagggcgaaguaggcgccaucgcgcuggauuuuaagccgggcacgucaggcucaccaaucgucaaccgggaggggaagauaguaggccuguacggcaaugggguugucacgacaucagggaccuacgugagcgccaucgcccaggccaaggcgucgcaggaggggccccuaccggagauugaagacgagguuuuccgcaagcggaaccugacgaucauggaccugcaccccggcagcggaaaaacccgccgguaccuccccgccaucgugcgcgaggccaucaagagacgcuugcgcacccugauccucgccccgacccggguggucgcauccgagauggccgaggcgcugaagggcaugcccauucgcuaucagacaaccgccgucaagucagagcacacgggcaaggagaucguggaucugaugugccacgccaccuuuacgaugcgacuccuaucccccgugcgcguccccaacuacaacaugaucauuauggacgaggcccacuucacagacccuagcaguaucgcggcccggggguacaucagcacgcgcgugggcaugggggaggccgccgccaucuucaugacagcuacgccgccagguuccguggaggccuucccccagagcaacgccgucauccaggacgaggagcgggacaucccggagagauccuggaacagcggauaugaguggaucacugacuuccccgguaagaccgugugguuugugccguccaucaagagcggcaacgacaucgcaaacugccugcggaagaacgggaagcgcgucauccagcucucccggaagaccuucgacacagaguaccaaaagacuaagaauaacgacugggacuacguggugaccaccgacaucagcgagaugggcgccaauuuccgcgcggaccgggucaucgacccccggagaugucugaagccggugauacugaaggacgggcccgagcgcgugauacucgcuggcccuaugccggucacgguggccucugcggcgcagcggcgagggagaauaggacgaaaucauaacaaggagggcgaccaguauauuuacauggggcagccgcugaauaacgacgaagaccacgcgcacuggacggaggccaagaugcuccuagauaacaucaacaccccugagggcaucauccccgcccuguucgagccugagcgcgagaagucugccgcgaucgacggcgaguaccgguugcgcggcgaggccagaaagaccuucgucgagcucaugcgccgaggggaccugccgguguggcuguccuacaagguugccuccgaaggcuuccaauacagcgaccgucgguggugcuucgacggcgagaggaauaaccaggugcucgaggagaauauggacguggagaucuggacaaaagagggagagcggaaaaagcugcgccccagguggcuagacgcccgaaccuauuccgacccccucgcccuacgggaguucaaggaguucgcggccggccgccggagcguguccggagaccugauccucgagauuggcaaacugccccagcaccugacccagcgcgcccagaacgcccucgacaaccugguaaugcugcauaauagcgagcagggcgggcggguguaccgccacgcuauggaggaguuaccugacacgaucgagacgcugaugcugcucgcgcugaucgccguacugacuggcggggucacccucuucuuccuauccggccggggguuaggaaagaccuccaucggacuccugugcgugauggccuccagcgugcuguuguggauggccuccguugagccccacuggaucgcggccagcaucauccuggaguucuuuuugauggugcuccugauacccgaacccgaccgccagcggaccccacaggacaaccaacuggcauacgucgucauugggcuccuguucaugauucugacgguggccgccaacgaaauggggcuccuggaaaccaccaagaaggaccuggguaucggacacguggcggucgagaaucaccaccaugcggcaauguuggacguggaccugcacccagccucugccuggacccuguacgcgguugcaacgaccaucaucacccccaugaugcgccauaccauagagaacacgaccgccaauauuagccucaccgcgauagccaaccaagcggccauccugauggggcuggauaaaggguggccaaucucuaagauggacaucggcgugccccuccuggcccugggguguuauucucaaguuaacccccucacccugacggccgcggugcugaugcucgucgcccacuacgcuaucaucgggcccgggcugcaggccaaggccacccgcgaggcucagaagcggaccgccgcaggcaucaugaagaacccaacaguugacgggaucguggccauagacuuggaccccguugucuacgacgccaaauucgagaaacagcucggacagaucaugcugcugauccucugcaccucgcagauacugcugaugcgcaccaccugggcucucugcgaaagcauuacccuggccaccggcccccugacaacccucugggaggggucccccggaaaauucuggaacaccacgauagcaguuagcauggcuaacaucuuucgagggagcuaucuggccggcgcgggccuggcuuucagccucaugaagucccucgggggggggcgacgcggaacaggugcccagggcgagaccuuaggcgaaaaguggaaacgccaguugaaccaguuguccaagucagaauucaacaccuacaaacgguccgggaucauggaagucgaccgcagcgaggccaaagagggccugaagcgcggggagacgacuaagcacgcugugucccgcggcaccgcaaaacuccgcugguucguggagcgcaaccuggucaagccggaggggaaggugauugaccugggcugcggccguggcggguggucuuauuacugugccggccugaagaaagugaccgaagucaaaggguacacgaagggcggcccggggcacgaggagcccaucccuauggcuacauacggguggaacuuggugaaguugcauuccggcaaggacguguucuucauucccccugagaagugugacaccuugcucugcgacauuggugagagcuccccuaaccccacgaucgaggaggggcgcacguuacggguucugaagaugguggagccguggcuccgcggaaaccaguucugcaucaagauccugaauccauacaugcccucuguaguugagacccuggagcaaaugcagcggaagcacgguggcauguugguucgcaaccccuugucccggaauucgacccacgagauguacugggugagcugcgggacgggcaacaucgucagugccgugaacaugaccagccgcaugcugcucaaccguuucacgauggcgcaccguaagccgaccuacgagcgcgauguggaccuaggagccggcaccaggcaugucgcgguggaacccgagguggccaaccuggauaucauaggccagcgcauugagaacaucaagcaugagcacaagucaacguggcacuacgacgaggauaaucccuacaagacgugggccuaccacggcucuuaugaggugaagccaagcgggagugcuuccagcaugguuaacggggucgugaagcuccugaccaagccgugggacgugaucccaauggucacccagaucgcgaugacugacacgacccccuucggccagcagcggguguucaaggagaaagucgacacccgcacccccaaagcuaagcgggggacggcccaaaucauggaagucaccgccaaguggcuguggggcuuucucucccgcaacaagaagccgcgaaucugcacacgcgaggaguucacacggaaggugcgcucaaacgcggccaucggcgccguguucguagacgagaaucaguggaacuccgcuaaggaggcgguggaggaugagcgguucugggaccugguacaucgcgagcgggagcugcacaagcaagggaaaugcgcuacaugcguuuacaauaugaugggcaaacgcgagaagaagcucggugaguucggcaaggccaaggggagccgggccaucugguacauguggcuaggcgcccgcuuucuggaguucgaggcgcucggcuucaugaacgaggaucacugguucucccgggagaacagccugucugguguagagggcgaggggcugcacaagcucggcuacauacuacgcgacaucagcaagauccccgggggcaacauguacgcagaugacaccgccggcugggacacgcguauaaccgaggacgaccugcagaacgaagccaaaaucacggacaucauggagccugagcacgcccuccuggcgaaguccauuuucaagcuaacuuaccagaacaaggugguccgggugcagcgcccagccaaaaaugggacugugauggacgucaucagccggcgcgaccagcgaggcuccggccaggugggcaccuauggccucaacacguucaccaacauggaggcccagcucauccgccagauggagagcgagggaaucuucuccccaagcgaguuggagaccccgaaccucgccggccggguauuggauugguuagagaagcaugguguggagcgccucaagcggauggcgaucuccggcgacgacugcguggugaaaccaauagacgacagauucgcgaccgcccuuacggcccugaacgacauggggaaaguccggaaagacaucccgcagugggaacccagcaaagguuggaacgauuggcagcaggucccguucugcagccaccacuuucaucagcucaucaugaaggacggccgggagaucgugguucccugccggaaccaggacgagcugguugggagggcccgggugucccaaggcgccggguggagcuugcgcgagacugcgugcuugggcaaguccuaugcucagauguggcagcugauguacuuccaccggcgggaucuacggcucgcggcuaacgcgaucugcagcgcagucccuguggacugggugcccacaucccguaccacuuggucaauacacgcucaccaccaguggaugaccaccgaggacaugcuguccguuuggaaccggguauggaucgaggagaacccuuggauggaagacaagacgcacgugucuucuuggggcgacguccccuaccucggcaagcgcgaggaucaauggugcggcagccuuauugggcugacggcccgcgccaccugggcgacgaacauacagguggcuaucaaccagguacgcaggcugcucggcaacgagaacuaccuggacuacaugaccucuaugaagcgguuuaaaaacgagucugacccggagggggcucugugguga

SEQ ID NO: 24214 - RNA, 9879 nt, Artificial Sequence
  derived and/or modified CDS sequence (opt11) from DENV-1__FJ410239__SS-prME
agcgugaccaugcugcugauguugaugcccaccgcacuggccuuucaccuuaccacccggggcggggagccccacaugauagugucuaaacaagagcggggcaagucucugcuguucaagaccucugccggggugaauaugugcacucucaucgccauggacuuaggcgaacugugcgaggacaccaugacguacaaguguccccggaucaccgaaaccgagccagacgacguggacugcuggugcaacgccaccgauacgugggugacguacggcacaugcucgcagacgggugaacaccggcgggacaagcgauccguugcccucgcgccccacguaggccugggcuuagagacccgcaccgagacuuggaugagcuccgagggcgccuggaaacagauccagcgggucgaaacgugggcccuccggcaccccggcuucaccgugaucgcgcuauuccuggcccacgccaucgguacuagcaucacccagaaagggauuauuuucauacuccuaaugcugguuacgccauccauggccaugcggugcgucggaauuggcagccgcgacuucguggagggauuauccggagccaccuggguggaugucguacuggagcacgggagcugcguaacuacuauggcgaaggacaaaccaacucuggacaucgagcugcugaagacggaggucaccaauccugccgugcuucggaagcucugcaucgaggccaagaucuccaacaccacuaccgauagccgcugcccgacccaaggcgaggccacccugguugaggagcaggaugccaauuucguaugccggcgcaccuucguggacaggggcugggggaacgguugcggacuguucggcaaagggucccucauaaccugugccaaguucaaaugcguaaccaaguuggagggcaagauuguacaguacgagaaucugaaauacagcgugauuguuaccguacacacgggugaccaacaccagguagggaaugagagcaccgagcacgggaccacugccaccaucacuccacaggcgcccaccaccgagauacagcucaccgacuauggggcccucacccuggauuguucccccaggaccgggcucgacuucaacgagaugguccugcuaaccaugaaggagaaguccuggcucgugcauaagcagugguuccuggaccugccccuccccuggacgagcggugccagcacgucccaggagaccuggaaccggcaggaccugcugguaaccuucaagacggcccacgccaagaagcaagagguagucgugcucgguucgcaggagggcgcgaugcacacggcccugacgggggccacggaaauucagaccucuggcacaaccacgaucuucgcgggacaccugaagugccgccucaagauggacaagcugacccugaagggcaugucauaugucauguguacgggauccuuuaaacucgagaaggaacuagccgagacccagcacgguaccgugcuagugcagaucaaauacgaagguaccgacgcacccugcaagauccccuucagcacgcaggaugagaaaggcgucacccaaaacggccgccucaucaccgcgaaccccauagucaccgacaaggagaagcccgugaacauagaagcagagccgcccuuuggggaguccuacauugucaucggcgccggcgagaaggcguugaagcugagcugguucaagaaggguagcagcauaggcaagauguuugaggccacggcucgcggggcccggcgcauggccauccugggcgacaccgcgugggacuuuggauccaucgggggaguguucacuuccgcagggaagcuggugcaccagaucuucggcaccgcguacgggguccuauucuccggggugagcuggacgaugaagauagggaucgguguucugcuuacuuggcugggccuaaauucccggagcacaucccucagcaugaccugcaucgcggucgggcuggugacccuguaccucggggugaugguacaggcugacuccgguugcguuaucaacuggaagggacgggaacugaaaugcgggagcggcaucuucgugaccaacgagguccacaccuggaccgagcaguacaaauuucaagcggauagcccgaagcggcucuccgccgccauagggaaggcgugggaggaaggggugugcggcauccgcagcgccacucgccucgagaacaucauguggaagcagauuagcaacgagcuuaaccacauccugcucgagaacgacaugaaguucacggugguugugggggacguagcuggcauccuggcccaagguaagaagaugauccggccccagcccauggaguacaaguacagcuggaagucuuggggcaaagccaagaucaucggcgcugacguccagaacacuacguucaucaucgacggcccaaacaccccggagugccccgacgaccaacgcgcguggaacaucugggagguggaagacuacggcuucgggaucuucacgacaaacaucuggcuuaagcuccgggacagcuacacccaagugugcgaucaccggcugauguccgccgccauaaaggauucaaaggcgguucacgccgacaugggcuacuggauagaguccgagaagaacgagaccuggaagcuggcgagggccagcuucaucgaggucaagaccuguaucuggcccaagagccacacccucuggagcaacggcgugcuggaaucagagaugauuauccccaagaucuacggggguccgauaucccagcacaacuaccggcccggguacuucacccagaccgcuggccccuggcacuuggggaagcucgagcuggauuucgaucugugcgagggcacgaccgugguggucgacgagcauugcggcaaucggggaccgucccuccggacuaccacgguuacaggcaagaucauucaugagugguguugccguucaugcaccuugccgccccugagauuccgcggugaggacggcugcugguacgggauggagauccgccccgugaaggaaaaagaggagaaccucgugaaguccauggucucugccggcuccggagagguggacuccuucagcuugggucuacuaugcaucuccaucaugauugaggagguaaugaggagccguugguccaggaagaugcucaugaccggcacgcuggcagucuucuuucuccugaucaugggacagcugaccuggaacgaccugauccgguugugcauuauggugggagccaaugccagcgacagaauggggaugggcacaacuuaccuggcccucauggcaaccuucaagaugcggcccauguucgcagugggccugcuguuccgccggcucaccucgcgcgaagucuugcuccucaccaucggcuuaagccucguagcguccguggagcuccccaacagcuuggaggagcugggagacggauuggccaugggcauuaugauacuaaaguuacucaccgacuuccagucccaucaguugugggccacguugcucagccugacauucaucaagaccacuuucucauugcacuacgccuggaagacgauggcgaugguccuguccaucguuucccuguuccccuugugucucucuaccaccucacaaaagaccacguggcugcccgucuuucuuggcucacugggcugcaagccgcugaccauguucuuaauugccgaaaacaaaaucuggggaaggcgcagcuggccccucaaugagggaaucauggcagucggcaucgugagcauccuacugagcagucuucugaagaacgacgucccucucgccgggccguuaauagccggcggcaugcugaucgcgugcuacgugauuagcggguccagcgccgaccuguccuuagagaaggccgccgaggugucaugggaagaggaggcggagcacucuggcgcgucucacaacaucuuggucgaagugcaggacgacggcacaaugaagaucaaggacgaggagcgggacgacaccuugaccauccuccugaaagccacgcugcucgccgucucgggcgucuacccgcuuagcauacccgccaccuuauucgugugguacuucuggcagaagaagaaacaacgcuccggggugcucugggacaccccuucuccgccggaggucgagcgcgcaguccuggacgacggaauauaccgcaucaugcagcggggccugcugggacgaucucaggugggcgucggcguguuccaggaaaacguuuuccacaccauguggcauguuacgcgcggagcggugcucauguaccaggggaaacgccuggaacccagcugggcguccgugaagaaggaccugaucagcuauggcggcggguggcggcugcagggauccuggaauaccggugaggagguccaagucaucgcuguagagccuggcaagaaucccaagaacguccagacagcccccggcaccuucaaaaccccggagggugaggucggcgcuaucgcccuagacuucaaacccgggaccucaggcucccccaucgucaaccgggaggggaagaucgucggccuuuacggcaacggggugguaaccaccaguggaacguacgugagcgcuaucgcacaggcgaaggcgucccaagaggguccgcuccccgagauagaagacgagguguuccggaagcggaaucugaccaucauggaccugcaucccggcucagguaagacucggcgcuauuuaccggcaauaguucgggaggccaucaagcgcaagcugcgcacucugauccucgcccccacccgggucguggccuccgagauggcugaagcccugaagggcaugcccauccgcuaucagacaaccgccguaaagagcgaacacaccggcaaggaaauugucgaccugaugugccacgccacguucacaaugcggcuccugucccccgugcgcgucccgaacuauaauaugauuaucauggaugaggcccacuucaccgaccccucgucgaucgcugcacgcggguacaucagcacccgugucggcaugggggaagccgcagccaucuuuaugacugcgacgccaccgggcuccguggaggccuucccacagagcaacgccgugauccaagaugaggagcgggacauaccugagcguucguggaacagcggauacgaguggaucaccgauuuccccggcaagaccgugugguuugugcccuccaucaagagcggaaaugacauagccaacugccucaggaagaacgggaagcgagucauccaacucucccguaagaccuucgauaccgaguaucagaagaccaaaaacaacgacugggacuacguugugacgacagauaucucggagaugggcgccaacuucagggcugaccgggugaucgacccgcgucggugccugaagcccguuauccugaaggacgggcccgagcgcgugauucucgccggccccaugccggugaccguugccuccgccgcgcaacggagggggcggauuggccgcaaccacaacaaggagggcgaccaguacauauacauggggcagcccuugaacaacgacgaggaccacgcccacuggacggaggccaagaugcuucucgacaacaucaacacucccgaaggcauaauaccggcccuuuucgagccggaacgcgagaagucugccgcgaucgacggggaguaucguuuacgcggcgaggcccguaagacguuuguggagcucaugcgccguggggaccugcccgucuggcugagcuacaagguggccucagagggcuuucaguauucagaccgccgguggugcuucgacggcgagcgcaacaaucaagugcuagaggagaauauggacgucgagaucuggaccaaagaaggggagcggaagaagcugcguccccgguggcuggacgccaggacguacuccgaucccuuagcccugcgggaguucaaggaguuugcagccggccgccggagcgugucuggggaccuaauccuugagauaggcaagcugccacagcaccucacucaacgcgcccagaacgccuuagacaaccugguaaugcugcacaacagcgagcagggcggccgggccuacagacacgccauggaggagcuccccgacacuaucgaaacucugaugcugcucgcccuaaucgccgucuugacggguggggugacccucuucuuccuguccggccggggucucggcaagacaagcaucggccuccugugcguuauggcaucaucagucuuguuauggauggcgucuguggagccgcacuggaucgccgcuaguauaauauuagaguucuuucuaauggugcuccugauccccgagcccgaccgccagcggacaccccaagacaaccagcuggccuacgucgugauuggacuccucuucaugauacugaccguggccgcgaaugagaugggcuuguuagaaacuaccaagaaggaccuugggaucgggcacgucgcgguggaaaaccaccaccacgccgccaugcucgacguggaccugcaucccgcaagcgcauggacgcuguacgcaguugcuaccacaaucauaacccccaugaugcggcauacgaucgagaacaccacggcuaauaucagcuugaccgcuaucgcgaaccaggccgccauccugauggggcuggauaagggcuggccaauaucaaaaauggacauaggcgucccucuccuggcccuggggugcuacagccaggugaacccacucacgcugacugcggcuguccugauguuaguggcucacuacgccauuaucggcccggggcuucaggcuaaggcgacacgcgaggcccagaagcgaacagccgcaggcaucaugaagaaccccaccguugacgggaucguggccaucgaucucgaccccgugguuuaugaugcgaaguucgaaaaacaguugggccagaucaugcuguugauccucuguaccucacagauccucuuaaugcgcaccaccugggcucuaugcgaguccaucacgcuggccaccggcccccugaccacacucugggaaggcuccccgggcaaguucuggaacacgaccaucgccguuagcauggccaacaucuuccggggguccuaccuggcgggcgccggcuuagcuuucagccuuaugaagucgcuugggggcgggcgucgggggaccggagcucagggcgagacgcugggcgaaaaauggaaacggcaacucaaccagcuuuccaagucugaguucaauacguacaaacgguccgggaucauggagguggaucgcagcgaggcgaaggagggccugaaacgcggggagaccaccaagcacgcggugucacgcgggaccgccaagcugcggugguuuguagagcgcaaucucgugaagcccgaggggaaggugaucgaccugggcugcggccguggggguuggagcuauuacugcgccgggcugaagaaagucacggaggucaaaggcuauacaaagggaggcccagggcacgaggagcccauaccaauggccacguauggguggaaccucguuaagcugcauuccggcaaggacguuuucuucauaccgccggagaagugcgacacccuguugugcgacaucggugagagcucacccaacccuacgaucgaggagggacgcacccugcgggugcugaagaugguugaaccuuggcuccgcgggaaccaauucuguaucaaaauccugaaccccuacaugcccucugucgucgagaccuuggaacagaugcagaggaagcaugggggcaugcucguccgcaacccgcuguccagaaauucgacccacgaaauguauugggucucguguggcaccgggaacaucgugagcgcggugaauaugacgucacgcaugcugcucaaucgcuuuacgauggcccaccguaagcccacauacgagcgcgacgucgaccugggugccgggacccggcacgucgccguggagccggaggucgccaaucuggacauaauuggccaacgcaucgagaacaucaagcacgagcacaagagcacauggcacuacgacgaggacaaccccuacaagaccugggcuuaccacggguccuacgagguuaaaccgucgggguccgccucgaguaugguuaauggcgucgugaaacuccugacaaaaccgugggaugucauccccaugguuacccagaucgccaugacggacacgaccccguucggccagcaacggguguucaaggagaaggucgacaccaggacgccgaaggcuaagcgggggaccgcucagauaauggaggugaccgcaaaguggcuguggggauuccuaucccgcaauaagaagccgagaaucugcacucgugaggaguucacaaggaagguccgcagcaacgccgccaucggcgccgucuucguggacgagaaccaguggaacagugcgaaggaggccguggaggacgaacgauucugggaccucguccaucgugaacgcgaguuacacaagcagggaaagugcgcuaccuguguguauaauaugaugggcaagcgcgagaagaaauuaggggaauuuggcaaggcgaaggggagccgggcaaucugguacaugugguuaggcgccagguuccuggaguucgaggcccucggauuuaugaacgaagaccacugguuuuccagagaaaacagccuguccgggguggagggggagggucugcacaaacucggcuacauccucagagacauaagcaagaucccagggggcaacauguacgcugacgacacugccggcugggauacacggaucacagaggacgaccuacaaaacgaagcccgcaucacggauauuauggagccggagcacgcguugcuggccaaauccaucuucaaacuuacauaccaaaauaaggucgugcgagugcagcggcccgccaaaaacgggacaguaauggacguuaucagccgccgggaccagcgcggcucugggcaaguugggacguacggcuuaaacaccuucaccaacauggaggcucagcugaucagacaaauggaaagcgagggaauauucuccccaagcgagcuggagacacccaaccucgccgagagaguccuggacuggcuagagaaguacggggucgagcggcucaagcgaauggcgauuagcggggacgacugcguugucaagccgauagacgaucgcuucgcaacggcucugacggcccucaacgacaugggcaaggugcguaaggacaucccucagugggaacccucgaagggguggaacgacuggcagcagguccccuucugcucccaccauuuucaccagcucaucaugaaggauggccgagagaucgucgugccgugccgcaaccaggacgagcuggucgguagagcccgcgucagccagggggcuggcuggagccugagggagaccgccugucucgguaaauccuacgcccagauguggcagcugauguacuuccauaggcgcgaccugcgccucgccgcuaaugcgaucugcagcgccgugccuguggacuggaucccgaccagucgaacuacauggaguauccacgcccaccaccaguggaugacuaccgaggacaugcuguccgucuggaaccgcguguggauagaagagaaccccuggauggaggacaagacucauauaagcucguggggugacguuccguaucuggggaagcgggaggaccaguggugcggcucccucaucgggcugaccgcccgugcgaccugggccaccaacauccagguggccauuaaccaagugcggaggcugauugggaacgagaacuaccucgacuauaugaccuccaugaagcgguucaagaacgaaagcgacccggagggagccuugugguga

SEQ ID NO: 24215 - RNA, 9879 nt, Artificial Sequence
  derived and/or modified CDS sequence (opt11) from DENV-1__FJ410240__SS-prME
agcgugaccaugcuguuaaugcuaaugcccaccgcccucgccuuccaccucacgacacgggguggggagccccacaugauagugagcaagcaggagcgggggaagagccugcuguucaagacaagcgcgggggugaacaugugcaccuuaauagccauggaccuaggcgaguucugcgaggacacaaugaccuauaagugcccccgcaucaccgaggcagagcccgaugacguggauugcuggugcaacgccaccgacacgugggucaccuacgggaccugcagccaaaccggcgagcaccguagggacaagcgguccgucgcccuggcaccccacgucggccugggguuggagacucgcacggagaccuggaugucauccgaaggugccuggaagcagauccagagagucgagaccugggcccugcggcaccccggguucacggugaucgcccucuucuuggcacacgccauaggaaccagcaucacccagaagggaaucaucuucauccugcugaugcuggugacccccagcauggccaugagaugcgucggcaucggaagcagggacuucguggaggggcuguccggagcuacguggguggacgugguacucgagcacgggagcugcgugaccacuauggccaaggacaaacccacccuggacaucgagcugcuaaagacggaggucaccaacccggcgguucuacggaagcugugcaucgaagccaagaucuccaauaccaccacggacagccgcugcccgacccagggcgaggccacccugguggaggagcaggacgcaaacuuugucugccggcgcaccuuuguggacagaggcuggggaaacggcugcggucuguucgguaaggggagucugaucacgugcgccaaguucaagugcgugaccaagcucgaaggaaagacgguccaguacgagaaccugaaguacagcgugaucgugaccgcgcacacgggcgaccagcaucaggucggcaacgaguccaccgagcacggcaccaccgccaccaucacgccccaggcacccagcacggagauccagcucaccgacuacggggcccucacccuggauugcagcccccggacgggccuggauuucaacgagauggugcuccugaccaugaaagagaaguccuggcugguccacaagcagugguuccucgaccugccguuacccuggaccagcggggccaguaccagccaggagacauggaaccggaaggaucuacugguaaccuucaaaaccgcgcacgccaaaaaacaggagguagucgugcuaggcucccaggaaggagcuaugcacaccgcccucacgggggccaccgagauccagaccagcggcaccacgacaaucuucgcggggcaccugaagugccgccucaagauggacaagcucacccugaaggguauguccuacgugaugugcaccgggucauucaagcuggagaaggaggucgccgagacgcagcauggcacggugcucgugcaaauaaaguaugagggaaccgacgcccccugcaagauccccuucucgacccaggacgagaaaggggucacgcagaacggccgauuaaucaccgccaacccgaucguaaccgauaaggagaagccagugaacaucgaggccgaaccccccuucggggaaagcuacaucgucauaggcgccggcgaaaaagcucugaaguuauccugguucaagaaggggagcuccaucgguaagauguucgaggccaccgcucgcggggcucggcgcauggccauucuuggcgacacggccugggacuucgguagcaucggcggcgucuucaccuccguugggaagcugguccaccagauauucggcaccgccuacgggguccuguucucgggcgugucauggaccaugaagaucgguaucggcgugcuccugacguggcuggggcugaacagcagguccaccucucuguccaugaccuguaucgccguggggcuggugacccucuaccugggcgucauggugcaagcggacagcgggugcgugaucaacuggaaaggccgggagcugaagugcggguccggcaucuucguuacaaacgagguacacaccuggaccgagcaguauaaguuucaggcugacuccccgaaacgucucagcgcagccaucggcaaggccugggaggagggggugugcggcauccgguccgcgacccgccuggagaacauuauguggaaacaaaucagcaacgagcugaaucacauccuccuggaaaacgacaugaaguucaccgucgucguuggggacguggcgggcauccuggcccaggguaagaagaugaucaggccgcagcccauggaguauaaguacaguuggaaguccuggggcaaagccaaaauaauaggggccgaugugcagaauacgaccuucaucaucgacggccccaacacgcccgagugccccgacgaccagcgcgccuggaacaucugggagguagaggacuacggcuuugggaucuucaccacgaacaucuggcucaagcuacgggacuccuacacccaggucugcgaucauaggcugaugagcgcugccauuaaggacuccaaggccguacacgcggacaugggcuacuggaucgaaagcgagaagaacgagacguggaagcucgcccgggccucguucaucgaggugaagacuugcauauggcccaagucgcauacccugugguccaacggcguuuuagagagcgaaaugaucauccccaagaucuacggggggccgaucucacagcauaacuaccgccccggguacuucacccagacugccggcccauggcaucuggggaagcuggagcuggacuucgaccucugcgagggcaccacggugguggucgaugagcauugcggcaaccgggggccgagccugcgcaccaccacggugaccggcaagaucauccacgaauggugcugccgcucuugcacuuugccacccuugcgcuucaagggggaggacggcugcugguacgggauggagauccgacccgugaaggagaaagaggagaaccuggucaaaagcauggucagcgccggcuccggcgagguggacucuuucagucuuggacucuuaugcaucagcaucaugaucgaggaggucaugagaucacgguggagccggaagaugcugaugaccggaacccucgcgguguucuuucugcugaucauggggcaacucacguggaacgaccugauccggcuguguaucauggugggcgcuaacgccucggaccgcauggggaugggaacuaccuaccucgcccugauggccaccuuuaagaugcguccgauguuugcggucgguuugcuuuuucggcgccugacgagccgggaggugcugcuccugacuaucgggcugucccucguggccagcgucgagcugcccaacagucuggaggaacuuggugacggguuggcgaugggcaucaugauccugaagcugcugaccgacuuccagagccaccaacugugggccacacuccugucccugacguucauuaagaccaccuucagccuccauuacgcguggaagacgauggcgaugguccuguccauugucagccuguucccccucugccuuuccacaaccagccaaaagaccaccuggcugcccgugcuccugggcuccuuggggugcaaaccgcucacaauguuucugaucgccgagaacaaaaucuggggccgcaaaagcuggccccucaacgaggggauaauggccgugggaaucgucucaauccuccuguccagccuuuuaaagaacgacgugccccuggccgggccucugaucgcgggcggcaugcucaucgccuguuaugugauuuccgguagcuccgccgaccugucccuagagaaggcggcugaggucagcugggaggaggaggcagagcacagcggcgcaucacacaacauccucguugaggugcaggacgaugggacuaugaagaucaaggacgaggaacgggaugacacccugaccauccugcucaaggccacccugcuggcggucucgggcguguacccuuuauccaucccugccacgcuguucguaugguacuucuggcagaagaagaagcaacgcagcgggguccucugggacacaccgagcccgcccgagguggagcgggcggugcucgacgacggcaucuaccgcaucaugcagcggggccugcuugggcgcagccaggucggcguggggguuuuccaggagaacguuuuccacacuauguggcacgugacccggggggccgugcugauguaccagggcaagcgccucgagcccuccugggccagugucaaaaaggaccugauuaguuacggcggagguuggcggcugcagggcagcuggaacacgggggaggagguccaggugaucgccgucgagccgggaaagaaucccaagaacgugcaaaccgcacccgggaccuucaagaccucugagggcgaggugggcgcgaucgcccuggacuucaagccagguacgagcggcagccccauagucaaccgcgaaggaaagauuguaggacuguacggaaacgggguggucaccaccucuggaacguacgugagcgcuaucgcccaggcgaaagccucccaggaggggccccugccggagaucgaggacgaaguguuccggaagcgcaaccucacgaucauggaccugcauccgggcagcggcaagacccggcgcuaccuucccgccaucguacgggaggccaucaagcgcaagcuucgcacacugauccuggcccccacccgcgugguggcguccgagauggccgaggcgcucaaaggcaugcccauccgcuaccagaccaccgccgucaagagcgagcacaccggcaaggagaucguggaccucaugugccacgcgacuuucacgaugcggcuauugucgcccguucgcguccccaacuacaacaugaucaucauggacgaggcgcauuucaccgacccgagcuccauugcggcccgggguuacaucucgacccgcguggguaugggcgaagccgccgcgaucuucaugacggccacgccgcccggcuccguggaggcguucccccaaagcaacgccgucauccaggaugaggagcgugacaucccggagcgcucauggaacagcggguaugaguggauuaccgacuuccccggcaaaacagugugguucgugccguccauuaagagcggcaacgacaucgcgaacugccugcggaagaacggcaaaagggucauccaacugucccgcaagacauucgacacggaguaccagaagaccaagaacaacgacugggacuacguggugacuacagacaucagcgagaugggugccaacuuccgugccgaccgggucauugacccccgacggugccucaagccggucaucuugaaagacgggcccgagcgcgucauccuggcgggccccaugccugucacgguggccucugcggcucagcggagagggcggauaggccgcaaccacaacaaggagggcgaccaauacaucuacauggggcaaccgcucaauaacgacgaggaccacgcccacuggaccgaggccaagauguugcuagacaacaucaacacccccgaggggaucauaccggcccuguucgaacccgagcgggagaaguccgcggcaauugauggugaguaccgccuccgcggggaggccaggaagacuuucgucgagcugaugcgccgaggggaccucccgguuuggcuguccuauaagguggccuccgagggcuuucaguacagcgaccgccgguggugcuucgacggcgagcgcaacaaccagguccuggaagagaauauggacguagagaucuggacuaaggagggggagcggaagaagcucaggccucgguggcuggacgcccgcacauacucggauccccuggcgcucagggaguucaaagaguucgcagccggccgccggucaguguccggggaccugauccuggagaucggcaaauuaccacagcaccuaacccaacgcgcccaaaaugcccuggacaaccuggucaugcuucacaacagcgagcagggugggcgggccuaccgccacgccauggaggagcugccggacaccaucgagacgcucaugcugcuggcccucauugccgugcugaccggcggggugacucuguucuuccucuccggccggggcuuaggcaagacuucaaucggcuugcucugcgucauggcgucgagugugcuguuguggauggccuccguggagccccacuggaucgccgcaagcaucauccucgaguucuuccugaugguguugcucauccccgagcccgaccgccagcggaccccccaggacaaccaauuggcguacguggugaucgggcuccucuucaugauccugacggucgcggccaacgagauggguuuguuggagaccaccaagaaggaccuggggauaggccacguggccguggagaaucaccaccacgcagccaugcuugacgucgaccuccauccugcguccgccuggacccuguacgccguggccacgacaaucaucacaccgaugaugcgccacaccaucgagaacaccaccgccaacauaagccugacagcgaucgcuaaccaggccgccauccucaugggguuggacaaaggcuggccgaucucgaagauggacauaggcgugccccuccucgcgcuggggugcuacagccaggucaacccccugacccucacggcagccguucugaugcugguggcccacuacgccaucauuggcccgggguuacaggcgaaagccacccgggaggcacagaagcgcacagccgccggcaucaugaagaacccgaccgucgacggaaucguggcgaucgaccucgaccccguggucuacgacgccaaguucgagaagcagcuuggccagaucaugcucuuaauucugugcacuucccagauccuccugaugcgcaccaccugggcgcugugcgagucuaucacccucgcaacgggcccucuuaccacccugugggaggguucccccgguaaauucuggaacaccacgauagccgugagcauggcgaacaucuuucgggggagcuaccucgccggcgccggccuggccuucucccugaugaagucccuugggggcggucgccggggcaccggggcccagggcgagacccugggcgagaaguggaagcgccaacugaaucaacucagcaagagcgaauuuaacaccuacaagagauccgggaucauggagguggaccgcagcgaggccaaggagggccuuaaacgcggagaaacgaccaagcacgccgucucccguggcaccgccaaacugcggugguuuguggagcgcaauuuggugaagccugaggggaaggucauagaccugggcugugggcgcggaggauggucauacuauugcgccgggcucaagaaggugaccgaagugaagggguacacuaagggugggcccgggcacgaagagccgauacccauggcgaccuauggguggaaucuggucaagcuccacuccggcaaggacguuuucuuuaucccgcccgaaaaaugugacacucugcugugcgacauuggggaaaguucucccaaccccaccaucgaagagggccgcacgcuccgggugcuuaagauggucgagccguggcugcgcgggaaccaguucuguaucaaaauccucaaccccuauaugcccagcguuguugagacccucgagcagaugcagcggaagcacggggggaugcugguccggaacccucucucccggaacaguacccacgagauguacuggguuuccugcgggaccgggaacauugugagcgccgucaacaugacgucccgcaugcuguugaaccgguucacgauggcucaccguaagccuaccuaugagcgcgacguggaccucggggccggcaccagacacguggccgucgagccagagguggcgaaccuggacaucaucgggcaacgcauagagaacaucaagcacgagcacaagagcacauggcacuacgacgaggacaacccauacaagacgugggcguaccacggguccuaugaggugaagcccagcggcagcgccucgagcauggucaaugguguggucaagcuuuuaaccaagccgugggacgugauccccauggucacccagaucgccaugaccgacacaacacccuucggccagcaacgggucuucaaggagaagguugauacccgcacucccaaggcaaagcgggguaccgcgcagauaauggaggugacugccaaguggcuguggggauuccugucccggaacaagaagccgcggaucugcacgcgcgaggaguucacccggaagguccgcucgaacgccgccaucggagcgguguuuguggacgagaaucaguggaacuccgccaaggaagccguggaggacgagagguucugggaccucgugcaucgcgagcgggaguugcacaagcaggggaagugugcaacgugugucuacaacaugaugggaaagagggagaagaagcugggggaguucggaaaggccaaggggucccgggcuaucugguacauguggcucggcgcgagguuccuggaguucgaggcccuggguuuuaugaaugaggaccacugguucucacgggagaacagccucuccggugucgagggcgaggggcugcacaagcugggcuacauccuccgggacauaucuaagauccccgggggcaauauguacgccgacgacaccgccggcugggacacccggaucaccgaggacgaccuucagaaugaggcgaagaucacggacaucauggagcccgagcacgcccugcucgccaaguccauauuuaaacugaccuaccagaacaaaguggugcgcguccagcggccggcgaagaacgggaccgugauggacgugauuagucgccgcgaccagcgggguagugggcaggucggcacuuacggccugaacacauucacaaacauggaggcccagcucauccgccagauggaauccgaagggaucuuuucccccagcgagcucgaaaccccaaaccuagcgggacgagugcucgacuggcucgagaaacacgggguagagcgacugaagcggauggccaucaguggcgaugacugcgucgugaagccuaucgacgaccgguucgccaccgcucuuacggcucucaacgacauggggaagguacggaaagacaucccgcagugggagcccagcaaaggcuggaaugacuggcaacagguccccuucugcagucaccauuuccaccagcugauaaugaaggacggccgcgagaucguugugcccugccggaaccaggacgagcucgucgggcgcgcgcgggugucccaaggugccggguggucacugcgcgagaccgccugccugggcaaguccuacgcccagauguggcagcucauguacuuucaccggcgcgaccugcggcuggcggccaacgcgaucugcagcgcgguaccggucgacugggugcccacaucacgcaccacguggagcauccacgcucaccaccaguggaugacgaccgaggacaugcucuccguauggaaccgggucuggaucgaagagaaucccuggauggaggacaagacacacaucagcuccuggggcgacguccccuaccugggcaagagagaggaccaguggugugggagccugaucgggcucacggcgcgggccaccugggccaccaacauacagguggcgauuaaccagguccgccgccuaaucggaaacgagaacuaccuggacuauaugaccuccaugaagcgauucaagaacgaauccgauccggagggggcccucugguga

SEQ ID NO: 24216 - RNA, 9879 nt, Artificial Sequence
  derived and/or modified CDS sequence (opt11) from DENV-1__FJ410242__SS-prME
ucggugaccaugcugcucaugcugaugccgaccgcgcuggccuuccaccucaccacccgggggggggagccgcacaugaucgugagcaaacaagagcgggggaagagccuucuguucaagacuagcgcaggcgugaacaugugcacccucaucgcuauggaccugggagaguucugcgaagacaccaugacauacaaaugcccgcgcaucaccgaggcugagcccgacgacgucgacugcuggugcaacgccaccgacacgugggucaccuacgguacuugcagccaaaccggcgagcaccggcgggacaagcggaguguggcgcuagcuccccacgugggcuuaggguuagagacccgcaccgagaccuggaugagcucggagggcgcuuggaagcagauacagcggguugagacaugggcccugcgucauccggguuucacgguuaucgcccucuuccucgcgcaugcaaucggcaccucuauuacccagaaggguaucauauuuaucuugcucaugcuggucacccccucuauggccaugcggugcgucggcaucgggagccgcgacuucguggaggggcuguccggagccacguggguggacgucgugcucgagcaugggagcugugugaccaccauggcuaaagacaagcccacgcuggacaucgaauugcugaaaacggaaguaacuaaccccgcgguguuacggaaacugugcauugaagccaaaauauccaacaccacuacggacagccguugcccgacccaaggcgaagcgacguuaguggaggagcaggacgccaauuucgugugccggcgcaccuuuguggaccgcggcugggggaacggaugcgggcuguucggcaaagggucccugauaacgugcgcgaaguucaagugcgugaccaaacuugagggaaagaucguccaguacgaaaaccugaaauauagcgugaucgugaccguccacaccggggaucagcaccaaguggggaacgaauccaccgagcacggcaccacggcgacuaucacgccgcaagcacccagcacggagauccaguugacugacuauggagccuuaaccuuagacugcagcccgcggacaggcuuggacuucaacgagaugguccuauugacgaugaaggagaaaucuuggcugguucacaagcaaugguuccucgauuugccgcugccauggaccagcggagcguccacuagccaagaaacuuggaaccggaaggaccucuuagugacuuuuaagaccgcccacgcgaagaaacaggaaguuguggugcugggaucccaggagggcgccaugcacaccgcccucaccggggcuacugagauccagaccagugguacaacuacaaucuuugcagggcaucuuaagugucgccugaagauggacaaacuaacccugaagggcauguccuacgucaugugcacaggcagcuuuaaauuagaaaaggaggucgcggaaacacagcacggcacgguucucguccagauuaaguaugagggcaccgacgcccccugcaaaauuccguucuccacccaagacgaaaagggcgugacccagaauggacgauuaaucacggcgaacccgaucgugacugacaaggaaaagccggucaacaucgaggccgagccgccuuucggggagagcuacaucguaaucggcgcgggugagaaagcccugaaacuguccugguucaagaaaggaagcuccauugggaagauguuugaggccacggcacgcggggcccggcgcauggcgauucucggagacaccgcaugggauuucgggagcauuggcggcguguuuacauccguugggaagcuggugcaccaaauuuucggcaccgccuacggugugcuguucagcggggucuccuggacgaugaagauagggauaggcguguugcugaccuggcuggggcucaauagcagauccacgagccuguccaugacaugcaucgcuguggggcuggugacccucuaccugggcgugaugguacaagcggacagugggugcgucaucaacuggaagggccgggaacugaagugcgggagcggcaucuuuguaacaaaugagguacacacguggaccgaacaguacaaauuccaggcggacuccccaaagcgccucagcgccgcgaucgggaaggccugggaagaggggguuugcggcauccgcuccaccacacgguuagaaaacaucauguggaaacaaaucucuaaugaguuaaaccacauccuacuugagaacgacaugaaguucaccguuguagugggggacguggccggcauccuugcgcaggggaagaagaugauucggccgcagcccauggaguacaaguacucguggaaguccuggggaaaagccaaaauuaucggcgccgaugugcagaacacaacguucaucaucgacgggcccaacaccccggagugcagugacgaccagcgcgccuggaacaucugggaggucgaggauuacgguuucgggaucuucaccacgaacauauggcucaagcuccgggacagcuauacccaagugugcgaucaccgacugaugagugcggcuaucaaggauagcaaggcugugcaugccgacaugggcuacuggaucgaguccgaaaagaacgagaccuggaaauuagcccgugcuagcuucaucgagguuaagacgugcaucuggcccaagucucauacgcuguggagcaacgguguccuggagucugagaugaucauccccaagaucuaugggggaccgaucagccaacacaauuaccggccgggauacuucacccagacagccgggcccuggcaccuugggaaguuggagcuugacuucgaccuuugcgaaggcaccacggugguugucgacgagcacuguggcaaccgggggcccucccuacgaaccaccacagugacggguaaaaucauucaugaguggugcugccgcucguguacccucccgccccuccgcuucaagggggaggacggcuguugguauggcauggaaauccgaccugucaaggaaaaggaagagaaucuugugaagagcaugguaucugcgggcagcggcgaagucgacuccuucucauuaggucuccugugcauauccaucaugaucgaggaggugaugcggagcagguggucccgcaagaugcugaugaccggcacucucgcaguauucuucuuacugaucauggggcagcucacguggaaugaccugauccgguugugcaucauggucggcgccaacgcgucggaucggauggggaugggcaccaccuaccuugccuugauggcgaccuucaagaugcgucccauguucgccgugggccuccuguuucggcgcuuaacgagcagggaggugcugcuccuuaccauugggcuaagucucgucgccuccguggagcuaccgaacagccuggaggagcuuggggaugggcuggcgaugggcaucaugauccugaagcuccugaccgacuuccagucgcaccagcucugggccacccuccugagccuaaccuucaucaaaaccacuuucucccuccacuaugccuggaagaccauggccaugguacugucaauugugucccucuuccccuuaugccucagcacuacaucccagaaaacuacgugguugcccguucuucuugguagucuggguugcaagccccucacgauguuuuuaaucgcggaaaacaagaucuggggccguaagucguggccuuugaacgaggggaucauggcugucggcaucguguccauccucuugucuagucugcucaagaaugacgugcccuuggcagggccccuuaucgccggcggcaugcucauugccugcuacgugaucucuggcuccagcgcugaccuguccuuggagaaggccgccgaagugucgugggaagaagaggccgagcacucuggcgccagccacaacauccucguggagguccaggacgacgggaccaugaagaucaaggacgaggaacgggacgacacccuaaccauacugcugaaggcgacccuguuagccgugucugggguguacccccucagcaucccggccacgcuguucgucugguauuucuggcagaagaagaagcagcgcuccggggugcuaugggacaccccuucuccgcccgaaguggagcgggcuguccucgacgaugggaucuaccgcaucaugcagcgagggcugcuggggcgcucccaggugggcgugggaguguuucaggagaacgucuuccacacgauguggcacgucacgcggggcgcaguacugauguaucaggggaaacgccucgagccgucuugggcguccgugaaaaaagaccugaucaguuacggcggcggcuggcggcugcaggggagcuggaauacgggggaagagguccaagucaucgccgucgaaccggguaagaaccccaaaaacgugcagaccgcccccgggaccuucaagacgucagagggggaggucggcgccauagcucuugacuucaaaccggggacguccggcucacccaucguuaaccgagaggggaagaucgugggccucuauggcaacggggucgugacgaccagcggaaccuacguguccgcgaucgcccaggccaaggccucacaggaggggccccugcccgagaucgaggacgagguguuccgaaagcggaauuuaacgaucauggaccugcacccgggcuccgggaagacccgccgcuaccugcccgcaauugugagagaggccaucaagcgcaagcuucgcacgcucauccuggccccaacacgcguagucgcgagcgagauggccgaagcgcucaagggcaugccgauucgcuaccagacgacagccgugaagagcgaacauacaggcaaggaaauaguggacuugaugugccacgcgaccuucacaaugcggcuccucagccccguacgaguacccaacuacaauaugaucaucauggacgaagcccacuucacggaccccucuagcaucgccgcccggggauauauuuccacgcgcgugggaaugggggaggccgccgccaucuucaugacagccacgccgccgggcagcguagaagcguucccccaguccaacgccgugauacaagacgaggaacgugacauuccagaaaggaguuggaacuccggauaugaguggaucaccgacuucccggggaaaacgguaugguucgugcccagcauaaaguccggcaacgacaucgccaacugccuacgcaaaaauggcaaacgcgugauucagcuuagccggaaaacauuugacacggaguaccagaagacaaagaauaacgacugggacuaugucgucaccaccgacaucuccgagaugggcgccaauuuccgcgcggacagagugaucgauccucgcagaugccucaagcccgugauccuuaaagacgggccggagagggucauacuggcgggcccaaugccggugacagucgccucggcagcccagcggcgcggccggauaggucgaaaccacaauaaggaaggcgaccaauacauauacaugggucagccccuuaacaaugaugaggaucacgcgcacuggacagaggccaagauguugcuggacaacauuaauaccccggagggcauuaucccggcgcucuucgaacccgagcgggagaagucggccgccaucgauggggaauacagauugcgcggggaagcgcggaaaaccuucguggagcugaugcgccgcggggaucuccccguuuggcucuccuacaaggucgcgagcgagggauuucaguacagugaccgccgguggugcuucgacggagagagaaauaaccaagugcuggaagagaacauggacguggagaucuggacgaaggagggcgagcggaagaaacucaggccucgcuggcuggacgcccgcaccuacucggauccccuggcccuccgugaauuuaaggaguucgccgcgggccgccguagugucuccggagaucugauucuugagauuggcaagcucccccagcaccugacccagcgugcccagaacgcgcuggacaaccucguuaugcugcacaauuccgaacaaggcgggcgugccuaucgccaugcgauggaggaacugccggacaccauagagacccuaaugcucuuagcccucauagcaguuuugaccggcggcguuacccuuuuuuuccucagcggacgagggcugggcaagaccuccaucggccugcucugcgugauggcaagcucuguacugcuguggauggccuccgucgagccgcacuggaucgcggccucuaucauccucgaguuuuuuuuaaugguucugcuaauccccgagcccgacaggcaacggacaccucaggacaaccagcuagcuuacgugguuaucgggcuccuuuucaugauccugacaguagccgcuaaugagaugggcuuauuagagacgaccaagaaagaccuagguauaggccacguggcagcagagaaccaucaccaugcagccaugcuagacgucgaccuucacccggccagcgcguggacauuguacgccguugccacaaccaucauuacaccaaugaugcgccacaccaucgagaacacuaccgccaauaucucccuuacagccauugcgaaucaagccgcaauccucauggggcucgacaagggcuggccaaucagcaaaauggacaucggcgugccucuccucgccuuagggugcuauucccaagucaauccccugacccucacugcugccguguuaauguuagucgcccacuacgccauuaucgggcccgggcuccaggcgaaggcgacgcgggaagcucagaagcgcaccgccgccggaauuaugaagaaccccacugucgaugggaucguugccauagaccucgacccggugguguacgacgcgaaguuugagaagcaacuggggcagauuaugcugcugauacuuugcacgagccagauccucuugaugcgcaccaccugggcgcugugcgaguccaucacccucgcuacaggcccacugaccacgcugugggaggguagucccggcaaguucuggaauaccaccaucgcggugucuauggcgaacauauuccguggcuccuaccuagccggcgccggcuuggccuucagcuugaugaaguccuuaggugggggucgacgggguaccggcgcccagggagaaacccugggggagaaguggaagcgccagcugaaccagcuguccaaguccgaguucaauaccuacaagcgauccgggaucauggagguagaccgcuccgaagcgaaggagggcuugaagaggggcgagacgaccaagcaugccguuucgcgagguacugcgaaacugcggugguucguagaacggaaccucgucaaacccgaggggaaggucaucgauuuggggugcggccgcggcgguugguccuacuacugcgcagggcugaagaaaguuacagaggugaagggauacacaaagggggggccgggccacgaggaacccauaccgauggcaaccuacgguuggaacuuggugaaacuucacagcggcaaggacguguucuucauaccgccugagaagugcgacacucuguugugcgacaucggggaguccucuccaaacccaaccaucgaggagggccgcacgcuccggguucugaaaauggucgagcccuggcuucgcggaaaucaauucugcaucaagauccucaaccccuauaugcccuccgugguugagacccuggaacagaugcaaaggaagcacggcggaaugcugguccgaaacccccucagccggaacuccacccaugagauguacugggugagcuguggaacugguaacaucguguccgcggucaacaugacaucgaggaugcugcucaaucgguuuaccauggcccaccgcaagcccacuuacgagcgcgacguggaucucggcgccgggaccaggcacguggcggucgagcccgagguggccaaccuggacauuaucggccagagaauagaaaauaucaaacacgagcacaagaguaccuggcacuacgacgaagacaaccccuacaagacgugggccuaccaugggagcuacgaggugaaacccucuggcagugccagcaguauggucaauggcgucgucaagcucuuaaccaagcccugggacguuaucccaauggugacgcagauugccaugaccgacacaaccccauucggacagcagcgcgucuuuaaggaaaagguggauacucgcacccccaaagcaaaacgagguacugcccagaucauggaggugacagcgaagugguuguggggcuuucugagccgcaacaaaaagccacggaucugcacucgcgaggaguucacacggaagguccgaucaaacgccgccauaggcgccguauucguggacgaaaaccaguggaauagcgcgaaggaggccgucgaggacgaacgguuuugggaccucguccaccgagagagggagcugcacaagcaggggaagugugccacguguguuuauaauaugaugggcaagcgcgagaagaaguugggggaauuuggcaaagccaaggggucccgggcgaucugguacauguggcucggcgcgcgguuccuggaauuugaagcccuuggcuucaugaacgaagaucacugguuuagccgagagaacucccuuaguggcgucgagggcgagggucugcacaagcugggcuacauccuccgggacauuuccaagaucccgggggggaacauguacgcagacgauacagccggcugggauacccggaucacagaggacgaccugcaaaacgaggcaaagaucacagauaucauggaaccggagcacgcgcuucuugcuaagagcauauuuaagcugaccuaccagaacaaggucgugcgcguacagaggcccgccaagaacgggaccgugauggacgugauuucccgcagggaccagagaggcucaggucaagucgguacauacggccucaacacguuuaccaacauggaggcgcaacucauccgccagauggaaagugaggggauauucucgccuuccgaacuggagacccccaaucuggcuggccgcgugcucgacuggcuugagaagcacggggucgaaagacuaaagcguauggcgaucagcggcgacgacugcgucgugaagccuaucgacgaccgcuuugccaccgcccugacggcccuaaacgacaugggaaaagugcgcaaagacaucccacagugggagcccagcaagggauggaacgacuggcagcaaguccccuucugcucccaccacuuccaccaacugaucaugaaagacggccgggagaucgugguucccuguaggaaucaagaugagcuugucgggcgagcccgggugagccagggcgcgggguggagccugcgagagaccgccuguuugggcaagagcuacgcucagauguggcagcucauguacuuucaccggagggaccuccggcuggccgcgaacgcgaucuguuccgccgugccagucgacugggugccgaccagccgcaccacgugguccauucaugcgcaccaccaauggaugacaaccgaggacaugcucagcguguggaaccggguauggauugaagagaaccccuggauggaggacaagacccacaucucauccuggggcgacgugcccuaccugggcaagcgcgaagaccaguggugcggcuccuuaaucggccuaacugcgagggcgacuugggccacuaacauccaggucgcuaucaaccaaguucgccgcuuaaucggaaacgagaauuaucuagacuacaugacaucuaugaagagauucaagaaugaguccgaccccgagggagcccuaugguaa

SEQ ID NO: 24217 - RNA, 9879 nt, Artificial Sequence
  derived and/or modified CDS sequence (opt11) from DENV-1__FJ410243__SS-prME
agcgugaccauguuguugauguuaaugcccaccgcgcuggcguuccaccucaccacccgcggcggggagccgcacaugaucguuucgaagcaggagcgggggaagucccuguuguuuaaaaccagcgcgggagugaacauguguacccucaucgcaauggaccugggagaguucugcgaggauacgaugaccuacaagugcccccgcaucaccgaagccgagccggacgacguugacugcuggugcaacgcaaccgauacgugggucacguacgggacuugcagccagaccggcgagcaucggcgcgacaagcggucgguggcccuugcgccccacgugggccucgggcuugaaacgagaaccgagacauggaugucguccgaaggcgccuggaagcaaauacagaggguggagacaugggcucugcgucaucccggguuuacgguuauagcucucuuccuggcgcaugccaucggcaccuccaucacccagaaggggauaaucuucauacuacucaugcuggugacccccuccauggcuaugcggugcguggguauuggcagccgggauuucgucgaggggcuguccggugccacauggguugacguagugcucgagcacggcucaugcguuacgaccauggcgaaggacaagcccacucuggacaucgaacugcucaagacggaagucaccaaucccgcaguccuccggaagcugugcaucgaggccaagaucuccaacaccaccacggacucucggugccccacacagggcgaggccacacucguggaagagcaagacgcaaacuuugucugccgccgcaccuuuguggaccggggcugggggaacggcugcgggcuguuuggaaagggguccuugaucacaugcgcaaaguucaagugcgugaccaagcucgagggcaagaccguccaguacgagaauuuaaaguauucugugaucgugaccguccauacaggggaccagcaucaaguggggaacgaguccaccgaacacggcaccaccgcuacgaucacgccccaggcucccagcaccgagauccagcuuaccgacuauggggcgcucacccuagacugcagcccccggacuggccuggacuucaacgagaugguacuccuuaccaugaaggagaaggccugguuagugcacaagcaaugguuucucgaccugccgcugcccuggaccagcggggccucgaccucccaagagacguggaaucgaaaggaccuccuggugaccuucaagaccgcgcacgcgaagaagcaggaggugguuguacuggguagccaagagggcgccaugcacaccgcccucacuggggcaacagagauacagaccuccgguacgacgaccaucuuugcggggcaccugaagugucgucugaaaauggauaagcucacccuucgcggaaugucguaugucaugugcaccggcuccuuuaaauuggagaaggaggucgcugagacucagcacggcaccguacucguccaaaucaaguaugagggaaccgacgcucccugcaaaaucccguucagcacgcaagacgagaagggcgugacgcaaaacggucgcuugaucaccgccaaccccauagugaccgacaaggagaagcccgugaacaucgaagcggagccgcccuuuggggaguccuacaucgugaucggugcuggcgagaaggcucugaagcugucaugguuuaagaagggguccucgaucggcaagauguucgaggcaaccgcccgcggggcucguaggauggcaauucucggcgauacagcaugggacuucggauccaucggcggcguguucaccuccgucgggaaacuggugcaucagaucuuuggcacagccuauggggugcuguuuagcggcgucagcuggaccaugaagaucgggaucggcgugcuacugaccuggcugggccuuaacagucggagcacaucccugucaaugaccugcaucgccgugggguuggucacgcucuacuugggcgugauggugcaggcggauuccggcugcgucauuaacuggaagggccgcgaacugaagugcgggagcggcaucuuugugacgaacgagguccacacauggaccgagcaguacaaguuccaggcggauagcccgaagcgacucucagccgccaucggaaaagccugggaagaaggggucuguggcauucgcucggcaaccaggcuggagaauaucauguggaagcagaucuccaacgagcugaaucacauccuguuggagaacgacaugaaguucacagucguugugggugauguggcaggcaucuuagcccaggggaagaagaugauccgcccacagccaauggaguacaaguacagcuggaaguccuggggcaaggccaaaauaauuggagcugaugugcagaacgccacguucaucaucgacggcccaaacacgccggaaugccccgacgaccagcgggcuuggaacaucugggaggucgaggacuacggauucgggauuuucaccacuaacauauggcucaagcugcgcgacuccuacacccaagugugcgaucaccgacugauguccgccgcaaucaaggauagcaaggcggugcacgccgauaugggcuacuggaucgaguccgaaaagaacgagaccuggaagcucgcacgcgccaguuucauagagguaaaaaccugcaucuggcccaagucccacacccuguggagcaacggcguccucgaaagcgagaugaucauccccaaaaucuauggcggcccuauaagccaacauaacuacaggccgggguauuucacgcaaaccgcgggucccuggcaucucgggaagcuggaacuggacuucgaccugugcgaggguaccaccguagucguugacgagcacugcggcaaccgcgguccgucacuucggacgaccacagugaccgggaaaauuauccacgagugguguugucgaagcuguacgcucccgccgcugcgguucaagggggaggacggcugcugguaugggauggaaauccgccccgucaaggaaaaggaggagaaccuggugaaguccaugguuuccgcgggcuccggcgagguggauagcuucagccugggguuacugugcauauccaucaugauugaggaggugaugcgaucucgcugguccaggaagauguuaaugaccggcacccuugccguguuuuuccugcugauuauggggcagcucacuuggaacgaccuaauccgucugugcaucauggucggcgccaacgccagcgaccgcaugggcaugggcacgaccuaccucgcgcuuauggcgacuuucaagaugaggccgauguuugccguggggcuccuguuccgacggcuuacuucucgcgaagugcuacucuugacgauugggcuuagcuuagucgccaguguggaacugcccaacucccuggaagaacucggggacgguuuagcuauggggauaaugaucuuaaagcuccugacggacuuccagucccaccaacucugggcaacccuucuaagccugaccuucauuaagacuaccuucucccuccacuacgcauggaagaccauggcuaugguuuugagcauagugucucuguucccccucugccugagcacaacgucccaaaagacuaccuggcuccccguacuccugggaagcuuaggaugcaagccguugacaauguuccugauugccgaaaacaagaucuggggccggaaauccuggccccugaacgaaggaaucauggccgucgggaucgugagcauccuccugucuucucuccucaagaacgaugucccccuagcugggccgcugauugccgguggcaugcucaucgccugcuacgucaucagcggguccagcgcagacuuauccuuagaaaaggccgcugaaguaagcugggaggaagaagccgagcacuccggcgccagccacaacauccuaguggagguccaggacgacggucccaugaagauuaaggaugaggagcgcgacgacaugcugacaauccugcuuaaagcgacccugcuggccgugaguggaguuuacccccucaguaucccagcgacccuuuucgucugguauuucuggcagaagaagaaacagcgguccgggguccugugggacacgcccagcccccccgaaguugaacgcgcggugcucgacgaugguauauacagaauaaugcagcgcggccugcuggggcggucccagguggggguaggcguuuuccaggagaacguguuccacaccauguggcaugucacgcgcggagccguccugauguaucagggcaagcggcucgagccaaguugggccagcgugaagaaggaccuuaucaguuacggcgggggauggcgccuccaggguuccuggaauaccggggaagaggugcaggucaucgccguagagcccggcaaaaauccgaagaauguacagacggcgcccgguaccuucaagacgagcgagggagagguuggcgcuauugcacuugacuuuaaacccgggaccuccggcagccccaucgugaaucgggaggggaagauaguuggccuguacggcaacggggucgugacgaccagcggcacguacgugucagccaucgcgcaggcgaaggccucgcaggaggggccucugcccgagauagaggacgaaguauuucgaaaacggaaccucacuaucauggaccuucaucccggcuccggcaagacccgccgguaccugccagcaauagugcgagaggccaucaagcgcaaacuacguacucugaucuuggcccccacgcgcguagucgccuccgagauggccgaagcguuaaaagguaugcccaucagguaccaaaccaccgcggugaagucggagcacacagguaaggagaucguagaccugaugugccacgccacuuucaccaugcgcuuacucucgcccguccgagugccgaacuacaacaugaucaucauggacgaggcccacuuuacagacccguccucuauagccgcccgcggguacauauccacccgggucggcaugggcgaagcggcggcgauauuuaugacggcaacuccaccugguuccauggaggccuucccgcaguccaacgcaguuauccaagaugaggagcgcgacauucccgagagaagcuggaacagcggcuacgaauggaucacugauuuccccggaaagacagugugguucgugcccagcaucaaaagugguaacgacaucgcuaacugccugcggaagaacgguaagcgggucauccagcugagccggaagacguucgauacggaguaccaaaagaccaaaaacaaugacugggacuaugugguaaccaccgauaucucagagaugggcgccaacuuccgggccgaccgcguaauagauccgcggcgcugccucaagcccgugauucuuaaggaugggccugaacgcguaauucuggccgggcccaugcccgucaccguggcgagugccgcccaaagaagggggcgcauuggccgaaaucacaauaaagagggggaccaguacaucuacaugggacaaccacucaacaaugacgaggaccacgcccacuggaccgaggcaaagaugcugcuagauaacaucaauaccccugaaggcaucauccccgcucucuucgagcccgaacgcgagaaguccgccgccauugacggggaguaccgacugcgaggcgaggcccgcaaaacauuugucgaacucaugcggcgcggagaccugccaguuuggcuuucuuacaaagucgccucagagggcuuccaauauuccgaccgucgcuggugcuucgauggcgagcggaacaaucaggugcuggaagagaacauggauguugaaaucuggaccaaggaaggggaacgcaagaaacuccggccgagguggcuggaugcgcggaccuacagcgacccucuggcgcugcgugaauucaaggaauucgcugccggcaggaggaguguaucgggcgaccugauccucgagaucgguaaguugccgcagcaccugacgcagcgggcgcagaacgcguuggacaacuuagucauacuacacaacuccgagcaaggcgggcgggcuuacaggcacgccauggaggagcugcccgacacgaucgagacgcucaugcugcuggcccucaucgcaguccugacuggcggggugacccuuuuuuuccucucgggccgcgggcugggcaaaacuuccaucggacuuuugugcgucauggccagcuccguacuguuauggauggccucuguggaaccccacuggaucgccgcuuccaucauccucgaauucuuccugaugguacugcucauccccgagccggaucggcagcgcacgccgcaggacaaccagcuggcauacguggugaucgggcuacuguucaugauucugaccgucgcagccaacgagaugggcuuguuagaaaccacaaagaaggacuuagggaucggccacgucgccgucgagaaccaccaccaugccgcgaugcuggacguggaccugcaccccgccuccgcauggacgcucuacgccguggccacgaccaucaucaccccgaugaugcgccacacgaucgaaaacaccaccgcgaauaucucccugaccgccaucgccaaccaggcugcgauccucaugggacuggacaaggguuggccgauuagcaagauggauaucggcgugccacugcucgcccuggggugcuacucccaggugaauccacugacgcucaccgccgccgugcuuaugcugguggcacacuacgccaucaucggcccgggccuccaggccaaagccacccgcgaggcccagaagaggaccgccgcgggcaucaugaaaaacccgacgguugacgggaucguggcuauugaccuggaccccguuguuuacgauaccaaguucgagaagcaacuuggccagaucaugcuucugauucugugcaccagccaaauccuccugaugaggaccacgugggccuugugcgaguccauaacccucgccaccggcccgcugaccacgcucugggaaggguccccgggcaaguucuggaacacaaccaucgccguguccauggcgaauaucuuucgcgggucguaucucgcgggugccggucuggccuuuucacugaugaaaucccuugggggggggcggcgcggcacuggggcgcagggcgagacgcugggugagaaauggaaacgacagcuaaaccaacucaguaaaucggaguucaacaccuacaagcguuccgggaucauggagguggaucgguccgaagcaaaggaaggccucaaaaggggagagaccaccaagcacgccgucucucggggcacggccaaguugaggugguucguggagcgcaaccucgugaagccugagggcaaaguuaucgacuuaggcugcggacgcggggggugguccuauuacugugccgggcugaagaaggucaccgagguuaagggcuacacgaagggcgggccaggccaugaggaacccauaccgauggcaaccuacggguggaacuuagucaagcuucacucggggaaggacguuuucuucauuccgccugaaaagugcgacacucugcugugcgacaucggggaguccagccccaauccgaccaucgaggaaggccggacccucagaguacuuaagaugguugagcccuggcugcgggggaaucaguucugcaucaaaauacucaaucccuauaugccgucuguggucgagacccuggagcagaugcagcguaagcacggcggcaugcugguuagaaacccucucagccggaauuccacgcacgaaauguauuggguaucaugugggaccggaaacaucguguccgccgucaauaugaccucccgaaugcugcuuaaccgcuucacaauggcccaucguaagcccaccuaugaacgugauguggaccucggggcaggcacgaggcacguggcgguagagcccgaaguggcgaaccuggacaucaucggccaacggauugagaacauuaagcaugagcacaaaucgacauggcacuacgacgaggacaaccccuacaagacaugggcauaccacgggagcuacgaggucaaaccaucaggcagcgccagcuccauggucaaugggguggucaaacugcuaaccaagcccugggaugugauacccauggugacgcagaucgcuaugacagauacuacucccuuuggccagcaacgcgucuuuaaagagaagguugacacgcggaccccaaaggccaagcgcgggaccgcgcagaucauggaggugacggcaaaguggcugugggguuuccugagcaggaacaagaaaccucgcaucugcacacgggaagaguucacccgcaaggucagaucuaaugccgcgaucggcgcggucuuugucgaugagaaccaguggaacagcgcuaaggaggccgucgaggacgagagauucugggaccucguacacagagagcgugaacuacacaagcaggggaaaugcgcaaccugcguguacaauaugauggggaagcgggagaaaaagcugggagaguucggcaaggccaagggcucccgcgcaaucugguacauguggcucggcgcccgguuucuugaguuugaggcccugggcuucaugaacgaagaccacugguucagucgcgagaacucacuaagcggcgucgagggagaggggcugcacaagcugggauacauauuacgggacauuucaaagaucccagguggcaacauguacgccgacgacaccgcggguugggacacgaggaucaccgaggaugaccugcagaacgaggccaagaucaccgacauaauggagccggagcacgccuuacucgccaaguccaucuucaagcugaccuaccaaaacaaaguggugagaguccagaggccagcuaagaacggaacggucauggacguuauuucccgccgggaucagaggggaagcggucagguuggaaccuacggucuaaacaccuuuacaaacauggaggcgcaacucauccgacaaauggaguccgaggguaucuucagcccuuccgagcuggaaacacccaaucuagcgggccgcgugcucgacuggcuggagaagcacggcguggagcgauugaagcgaauggcgaucagcggggaugacugcgucgugaaaccgauagacgaccgguuugccaccgcccucacggcccugaaugacauggguaaggugcgcaaggacaucccgcaaugggagccauccaagggcuggaacgacuggcagcagguccccuucugcucacaccacuuucaccagcugaucaugaaggacggccgggagauuguaguuccuugccgaaaucaggacgagcucguugggcgggcgcgcgugucccagggcgccggguggucccugcgggagaccgcaugccugggaaagagcuaugcacagauguggcagcucauguacuuccaccgccgggaccugcgccuggcggccaaugcaaucugcagugccgugcccgucgacuggguacccacgagccggacgaccuggucuauccacgcucaccaccaauggaugaccacggaggauaugcucagcguguggaaucgagucuggaucgaagaaaaccccuggauggaggacaaaacccacaucuccucuuggggugacgugccguaccuuggcaaacgggaggaucaaugguguggcucccugaucgggcuaaccgcgcgcgcgaccugggcuacgaacauccaaguggcuaucaaucagguccgucggcugaucgguaacgagaacuaccuugacuauaugaccaguaugaaacgcuucaagaacgagauagaccccgagggagcauugugguga

SEQ ID NO: 24218 - RNA, 9879 nt, Artificial Sequence
  derived and/or modified CDS sequence (opt11) from DENV-1__FJ410244__SS-prME
ucgguuaccaugcugcucauguugaugccuaccgcucuggccuuccaccucacaaccagaggaggcgaaccccacaugaucgugagcaagcaggagcgcgggaagagccugcuuuucaagacaagcgcgggcgugaacauguguacccucaucgccauggaccuaggcgaauucugcgaagacacaaugaccuacaagugcccgcggaucaccgaggccgagcccgacgacguagacuguuggugcaacgccaccgauacgugggugacguacgguaccugcucccaaaccggcgagcaccggagagacaaacgguccguggcccuggcgccccaugugggccucgggcuggagacgcgcacugagaccuggaugagcuccgagggcgccuggaagcaaauccagcggguggaaaccugggcccugagacaccccggguucacggucaucgcccuuuuccuggcgcaugccaucggaaccagcaucacacagaaggggaucauuuucauccugcugaugcuggugaccccauccauggcuaugcgcugcgucggcaucggcagccgcgacuucguggaagggcuuuccggcgcuacguggguggacgucguguuagagcacgguucgugcguuaccacuauggccaaggacaagcccacgcucgacaucgaguuacucaagacggaggucaccaaucccgcggugcuacggaaauugugcaucgaggccaagaucuccaacaccacgacagauagccgcugcccgacccagggcgaggcuacccucguggaggagcaggacgccaacuucgucugccgccgcacauuugucgaccggggcugggggaacggcugcgggcuguuuggcaagggcucccugaucaccugcgccaaguucaagugcgucaccaaacuugagggcaagaccguccaguacgaaaaccugaaauauucggugaucgugaccgugcacacgggcgaccagcaccagguugggaacgaguccaccgaacacggcaccaccgcgaccaucaccccgcaggcgcccagcacugagauccagcugacagacuacggggcccuaaccuuagacugcucaccacggacuggguuagacuucaacgagaugguacuccugacuaugaaggagaaguccuggcucguacacaagcagugguuccuagaccugccguugccuuggaccuccggggcguccaccucccaggaaacuuggaaucggaaggaccuccuggugacguucaagacugcccaugccaaaaaacaagaagugguggugcugggcucccaggagggcgccaugcacaccgcccucacgggggccacugaaauacagaccagcggcaccacuacgaucuucgcugggcaccugaagugccgccugaagaugaacaaguugaccuuaaagggcauguccuaugucauguguacagggagcuucaagcuggagaaggagguagcggagacacagcacggcacugugcucguccagaucaaguacgaaggcacugacgcccccugcaagaucccuuucuccacacaggacgagaaggggguuacgcagaauggcaggcugaucaccgcuaacccuauugucaccgacaaggagaagcccgucaacauugaagccgagccacccuucggugagucauacaucgugaucggcgcaggcgagaaggcacugaaguuauccugguuuaagaaggggagcuccaucgggaagauguucgaggccacugcucgcggggcccggcgcauggcgauccucggugauacggccugggauuuugggagcaucggaggcguguucaccuccgucgguaagcucguccaucagaucuuuggaacugccuacgggguacuguucucuggcgucucuuggacaaugaagaucgguaucggcguacuccugaccuggcugggguuaaacagccgaucuaccucucugucuaugacuuguauagcagugggucugguuacucucuacuuaggcguuauggugcaggccgacagcgguugcguaaucaauuggaagggacgggagcuuaagugcgguucuggcauuuucguaacgaacgaggugcacaccuggaccgagcaguacaaauuccaggccgacuccccgaagcgccugagcgccgccaucggcaaagccugggaagagggggucugugggauccggucggccacgcgccuggagaacauuauguggaagcagaucagcaaugagcugaaccacauccuccuagagaacgacaugaaguucaccgugguggucggggacguggcgggcauccuggcccaagggaagaagaugauccggccccagcccauggaauauaaguacuccuggaaguccugggguaaggccaagauuaucggcgccgacgugcaaaacacgaccuucaucaucgacgggccuaacaccccggagugccccgacgaccaaagggcguggaauauuugggaggucgaggacuacggcuuugggaucuucaccacaaacaucuggcucaaccuucgggacuccuacacccagguuugugaccacaggcucaugagcgccgccauuaaggacuccaaggccguucacgcagacauggguuacuggauagagucggagaagaacgagaccuggaagcucgcgcgggcuuccuucaucgaggucaaaaccugcauuuggccuaagagccacacgcugugguccaacggcguauuggagucggagaugauuauccccaaaaucuaugggggcccaaucucccagcacaauuaccgccccggguacuucacccagaccgccggcccauggcaucucgggaagcuagagcuugacuuugaucucugcgagggcaccacgguagucgucgacgagcacugcgggaauagagggccgagccuucgcaccaccaccgugacgggcaaaaucauccacgaauggugcugccgguccugcacuuugccgccccugcguuucaagggagaggacggaugcugguacgggauggagauucggcccgucaaggaaaaggaggagaaccuggucaaaucaauggugagcgccggcucgggcgaggucgacucauucucccuggggcuacucugcauaagcauaaugauagaggaggugaugcgcucaagauggagcagaaaaaugcugaugaccgggacccuugccguguucuuucuacugaucauggggcagcucacguggaacgacuugauccggcugugcauuauggucggcgcgaacgccagcgaccgcauggggaugggcaccaccuaucucgcccugauggcgaccuuuaagaugcgccccauguucgccgugggccuccuguucagacgccugacgagcagggaggugcuacuccugaccauuggacugucccucgucgcgagcguggagcugcccaauucccuggaagagcucggugacggccuggccaugggcaucaugaucuuaaaguugcugaccgacuuccagagccaccaacugugggccacacuccugucccugacguuuaucaagaccaccuucagccuccauuacgccuggaagaccauggcuaugguccuaucuaucgugucacuguucccccucugccuguccacgaccagccagaagacaaccuggcugcccgugcuauugggcuccuuaggaugcaagccacucacgauguuccugaucgccgagaacaagaucuggggccgcaaaucuuggccccugaacgaggggaucauggccgucggcauaguaucgaucuuacuguccucacugcuaaagaacgacgugccgcuggccgggccgcugauugccggcgggauguuaaucgcgugcuacgucaucuccgggucguccgccgaucuuucgcuugagaaggccgccgagguaaguugggaagaagaggcugagcauagcggcgcgucccacaauauacuuguggaaguccaggacgacggaaccaugaagauuaaagaugaagagagagaugacacccucacuauucugcucaaggcuacccugcuggcagugagcggcguguacccccucuccauucccgccacacuguucgugugguacuucuggcagaagaagaaacagcgcucgggggucuugugggacacccccagcccgcccgagguggagcgagcgguccucgacgacggaaucuaccgcauuaugcaacggggcuugcuggggcgcagccaagugggcgugggugucuuccaggagaacguguuccacaccauguggcacguaaccaggggcgcugucuugauguaccaagggaagcgccucgagccauccugggcguccgugaagaaagaccuuaucuccuacggcggcggauggagacugcaagggucauggaauacgggcgaggagguacaggucaucgccguggagccaggcaagaaccccaagaauguucagaccgcccccgggaccuucaaaaccucagagggcgaggucggcgcgaucgcgcuugauuucaaacccgguaccuccggcagccccaucgugaaccgcgaggggaagaucguaggacuguauggaaacggggucgugaccaccuccgguacuuacgugagcgccaucgcucaggcuaaagcuucccaggagggcccccugccggagaucgaggacgaggucuuccggaaacgcaauuuaacgaucauggaccugcaucccggcucggggaagacgcggagauaccuccccgccaucguucgggaggcaaucaagagaaagcuccggacccugauccuggccccgacccgcgugguggccucagagauggcggaggcccucaaggggaugccgauccgguaccagacaaccgcagucaaaucugagcauaccggcaaagaaaucgucgaccugaugugccacgccacauucacgaugcgguuacuaucccccguccgcguccccaauuauaacaugaucaucauggacgaggcccacuuuaccgacccgagcuccaucgccgcacggggguacaucagcacacgagugggcaugggagaggcggcugccaucuucaugaccgcgacaccccccgguuccguugaggccuuuccucagagcaacgccaucauccaggaugaggagagggacauuccagagcgcuccuggaacagcggguacgaguggaucaccgacuuccccggcaagaccguaugguucgugcccuccaucaagagcggcaacgacaucgccaacugccugcggaaaaacgggaagcgcguuauccaacugucccggaagaccuuugacacggaguaucagaagaccaagaacaacgacugggauuacguggugacuaccgacaucucggagaugggcgcgaacuuccgcgccgaucgggugaucgacccccgccgcugccugaagcccguaauccucaaggacgggcccgaaagggugauccuggcgggccccaugcccgucacgguggccuccgccgcgcagcggcgagggcguauaggccgcaaccacaacaaggagggcgaccaguacaucuauauggggcagccccucaacaacgacgaggaucacgcccacuggaccgaggccaagaugcugcuggacaauaucaauacccccgagggcaucauccccgcccucuucgagcccgagcgugagaaguccgcggcgauagacggugaguaucgucugcgcggcgaggcgcggaagacauucgucgagcugaugcgccgcggggaucuccccguuuggcugucauacaagguggccuccgagggcuuccaguacagcgaccgccgguggugcuucgacggagagcgcaauaaccagguccuggaggagaacauggaugucgaaaucuggacgaaggaaggggagaggaagaagcuccgcccccgcuggcuggacgcccgcacauacucagauccccuggcccuccgggaguucaaggaguucgcggccggucgccggucugugucuggugaccucauacuggagaucggcaagcucccccagcaccuaacccagcgcgcgcagaacgcgcuugacaaccucgucaugcuccacaacagcgagcagggcggcagagcguaccggcacgccauggaggagcugccugacaccaucgagacccucaugcuacuggcacucaucgcggugcucaccggcgggguaacccuauucuuccucucuggaagagggcucggcaagaccucaaucggccuacucugcgugauggccuccagcgugcuguuguggauggcguccguggagccacacuggaucgcggccagcaucauccuagaguuuuuccugaugguccugcucauccccgagcccgaccgccagcggacuccgcaggacaaccaguuggccuacguaguaaucgggcuacucuucaugaucuuaacgguagccgcgaacgagaugggccuccucgagaccaccaagaaggaucuugggaucggacacguggccguggaaaaccaccaucacgccgccauguuggaugucgacuugcaucccgccuccgcguggacccuguacgccguagccacaaccaucaucacccccaugaugcgccacacuaucgagaauacgaccgccaacaucagccugaccgccauagcaaaccaggccgccauccucaugggccuggacaagggguggccgaucuccaagauggacaucggcguaccucuguuggcccuagggugcuacagccagguuaacccccugaccuuaacggcggcggugcugaugcugguggcccacuacgccaucaucggcccuggguuacaggccaaggcaaccagggaagcccagaagcgcacugccgccggcaucaugaagaauccgacagucgaugggaucguggccaucgaccuggaccccguggucuacgacgcaaaguuugagaagcagcugggccagaucaugcuccugauucugugcacgucccagauacuccuaaugcgaacaaccugggcccugugcgaaucuaucaccuuagcaacggguccccugaccacccugugggaggggucucccggcaaauucuggaauacuacgaucgccguaagcauggccaacaucuuccggggguccuaccucgccggcgccggucuggccuucucucucaugaagagucucgggggcgggcgucggggcaccggggcacagggcgagacccugggagagaaguggaagcgccagcugaaccagcucaguaagagcgaguucaacaccuacaagcgguccgggauuauggagguggaccgcuccgaggcgaaagaaggccugaagcguggagagacgaccaagcacgccgugucccgcggcaccgcgaagcuccggugguucguggaacgaaaccuaguuaagccggaggguaaggucaucgaccugggcugugggcgcgggggcuggagcuacuacugcgccggccugaagaagguaaccgaggugaagggguacacaaagggugggcccggacaugaggagcccauccccauggccaccuacggguggaaucuagucaagcuucacuccgguaaggacguguucuucaucccgcccgagaaaugcgauacccuucugugcgacaucggugagagcucccccaaccccaccaucgaggagggccgcacgcuccgggugcugaagauggucgaaccguggcugagggggaaccaauucugcaucaaaauccucaaccccuacaugcccagcgucguugaaacccuagagcagaugcagcgcaagcacggggguauguuaguucgcaacccccucucgcguaacaguacccacgaaauguacuggguguccugugggacugguaacauugugagcgcgguaaacaugaccucuaggaugcuguuaaaucgguucacgauggcccaccgcaaaccgacguaugagcgcgacguggacuuaggggccggcacgcggcacgucgcagucgagcccgagguccccaaccuggauaucaucggacagcgcauagagaacaucaagcacgagcacaagagcaccuggcacuacgacgaagacaaccccuacaaaacgugggcguaucacgggagcuaugaggugaagccuagcggcagcgcguccagcaugguaaacggggugguuaagcugcucaccaagcccugggacgugauccccauggugacccagaucgccaugaccgauacgaccccauucgggcagcagagggucuucaaggaaaagguggauacccgcacaccaaaggccaaacgggggacggcucaaaucauggaggugaccgccaaauggcuauggggauuccuguccagaaacaaaaagccccggaucugcacccgcgaagaauucacccggaaaguacgaucuaacgcggccaucggagcuguuuucguugacgagaaccaauggaauucagcgaaggaagcggucgaagaugaacgguucugggaccucgugcaccgcgaacgggaacugcacaagcaagggaaaugcgcaacgugcguguacaacaugaugggcaagagggagaagaagcugggggaguucggcaaagccaagggcagccgggccaucugguauauguggcuuggugcgcgcuucuuagaguucgaggcgcugggcuucaugaacgaagaccacugguuuucccgggagaacagccucucaggggucgagggcgaggguuugcacaaguuaggauacauucuccgggauaucagcaagaucccugggggcaacauguacgccgacgacaccgccgguugggacacccggaucaccgaggacgaccugcagaaugaggccaagaucacggacauaauggagccggagcaugcucugcucgcaaaauccauauucaaguugaccuaccagaacaagguggugcgcguccaacggcccgccaagaacgggaccgugauggacguuaucagcaggcgcgaccagcggggauccgggcaggucggcaccuacggccugaacacauucaccaacauggaagcccagcuaauccgccagauggagagcgaggggauuuuuagccccagcgaauuagagacgcccaaccuggccggccgggugcucgacugguuagagaagcacggggucgagcgacugaagaggauggccauaaguggcgacgacugcgucgugaagccgaucgacgaccgcuucgcgaccgcuuugacggcgcugaacgacauggggaaggugcggaaggacgugccccaaugggagcccucuaagggauggaacgauuggcagcagguccccuucugcagccaccacuuccaccagcugaucaugaaggauggccgugagaucguggucccgugccguaaccaggacgaguuagucgggagagcccgggugucccagggcgccggguggucucugcgcgagaccgcgugccugggcaaguccuacgcccagauguggcaauugauguacuuucaucggcgagaucugcggcuugccgccaacgccaucugcagcgccguaccgguggauugggugcccaccucccgcacaacguggagcauccacgcccaccaucaguggaugaccaccgaggacaugcucuccgucuggaaccggguguggaucgaagagaaccccuggauggaggacaaaacccacaucucguccuggggcgacgugccguaucugggcaagcgcgaggaccaguggugcggcagcuuaauugggcuuacggccagagccacuugggcaaccaacauccagguagccaucaaccaagugcgccgccugaucggcaaugagaacuaccuggacuacaugaccuccaugaagcgguucaagaacgagagcgaccccgaaggggcccucugguag

SEQ ID NO: 24219 - RNA, 9879 nt, Artificial Sequence
  derived and/or modified CDS sequence (opt11) from DENV-1__FJ410245__SS-prME
agcgucacgaugcugcucaugcugaugcccaccgcccuggcauuccaucucaccacccgcggcggcgagccccacaugaucgugagcaagcaagagcggggcaagagccuucuguuuaagacuucagccggggugaacaugugcaccuuaauugccauggaccugggcgaacugugugaggacaccaugaccuauaaguguccccguaucacggagaccgagccagaugacguugacugcuggugcaacgccaccgauaccugggugaccuacgggaccugcucucagacgggcgagcaccggcgcgacaagcgguccguggcccuugcaccacacguaggccuggggcuggagaccaggaccgagaccuggaugagcuccgagggggcauggaagcagauccaacgggucgagacgugggcccuccgccaccccggguucaccgugauugcguuauucuuggcccacgcgauuggcaccagcaucacccaaaaggggaucaucuucauccuccugaugcuggugacccccuccauggccaugcguugugucggcaucggaagccgcgacuucguggaagggcucuccggcgccaccuggguggacguaguauuggagcacgggagcugcgugaccaccauggccaaggacaagccuacgcuggacaucgagcuacugaagaccgaggucaccaaccccgccgugcugcggaagcucuguauagaggcgaaaaucuccaacaccacaaccgacucccgcugcccgacucagggggaagccacccugguggaggaacaggaugccaacuucgucugccggcgcacguuuguggaccgagguuggggaaacggcugcgggcuguuugggaaagggucccucaucacgugcgcuaaguucaagugcgugaccaagcuggagggcaaaaucguccaguaugagaaucugaaauacagcgugauugugacuguccacacgggcgaccagcaccagguggggaacgaguccaccgagcacggcaccaccgccaccauuacgccccaggcgcccaccacggaaauccagcucaccgacuacggcgcccugacgcuggacugcucaccccgcacaggccucgacuucaacgagaugguccuguuaaccaugaaggagaaaucgugguuagugcacaagcagugguuccuggaccugccccuccccuggaccagcggggccagcacgucccaggagaccuggaaccggcaggaccugcuggugaccuucaagaccgcccacgccaagaaacaggagguuguggugcucggcagccaggagggcgccaugcacacggccuugaccggggcaaccgagauccagaccuccggcacgacaaccaucuucgccggucaccugaagugccggcucaaaauggacaaacugacccugaagggcaugagcuacgucaugugcacgggauccuuuaaacucgagaaggaaguggcagagacccagcacggcaccgugcugguccaaauuaaguacgagggcaccgacgcaccuugcaagauccccuucagcacgcaagaugagaagggggugacccagaacgggcguuuaaucaccgccaacccgauugugaccgauaaagagaaacccgucaacauugaggccgagccacccuucggugaguccuacaucgugauaggcgcuggcgagaaggcgcugaagcucagcugguucaagaagggguccagcaucggaaagauguucgaagccacugcccgcggcgcccggcgcauggccauccugggagauacggcgugggacuucgggagcaucggcggcguauucaccucagucgggaagcuggugcaucagaucuucggcaccgccuacgggguacuguucucggguguuagcuggacgaugaagaucgggaucggcgugcugcucaccuggcucggccugaacagccgaagcacaucgcugagcaugaccugcauagccguggggcuggucacucuguaccugggcgugaugguccaggccgacuccgggugcguuaucaacuggaagggccgagagcucaagugcgggagcggaaucuucgugacaaacgaggugcauacauggaccgagcaguacaaguuucaagccgauaguccgaagcgcuuauccgcggcaauaggcaaggcuugggaggagggggucugcggcauccggagcgccacccgccuggagaacauuauguggaagcagaucuccaacgagcucaaccacauccugcuggagaaugacaugaaauuuacggugguagucggggacguggccggcauacucgcgcaggggaagaagaugauucggccccagcccauggaguauaaguacagcuggaagagcugggggaaggcuaagaucaucggagcggacgugcagaacaccacguucaucaucgacgggccaaacacgccggagugccccgacgaccagcgggccuggaacaucugggagguugaggacuacggcuucgggaucuucaccaccaacauauggcugaaguugcgggacagcuacacccaaguaugcgaccaccgccucauguccgcggccaucaaagauagcaaggccgugcacgccgacaugggcuacuggaucgaauccgagaagaacgagaccuggaagcuggcacgggcgagcuucaucgaggucaagacgugcaucuggcccaagucccacacgcuguggagcaacggcgugcucgaguccgagaugaucauccccaagauuuacgguggcccgauuucgcagcauaauuaucgacccggcuacuucacccaggccgccggccccuggcaccuggggaagcucgagcuagacuucgaccugugcgagggcacaacgguagugguggacgagcacugcggcaaccgggggcccagucuuagaacaaccacagugacgggcaaaaucauccacgaguggugcugccgaagcugcacgcuaccaccccuucguuucaaaggagaggacggcugcugguacgggauggagauccggccugucaaggagaaggaggagaaccuagugaaguccauggugucagccggcagcggcgaggucgauuccuucagccucggucuguuaugcaucuccauuaugaucgaggaggugaugcgcagucgguggagccgccggaugcucaugacgggcacccuagccguguucuuccuuuugaucauggggcaacugacguggaacgacuuaauccgccucugcaucaugguuggagcuaacgccuccgaccgcauggggaugggcaccaccuacuuggcacuuauggccaccuucaagaugcgcccgauguucgccgugggccuccuguuucgccguuugacgucccgcgaaguguuacugcugaccaucgggcucagccuagucgcguccguggagcugccuaacucgcuagaggagcugggcgacgggcuggccaugggcaucaugauccuuaaguuacugaccgacuuccagagccaccaguugugggcuacccugcugagccucacguucaucaagaccaccuucucccugcauuacgccuggaagaccauggcgaugguccugagcaucgugucccucuucccccugugccugagcacgacuucccagaagaccaccuggcuccccgugcugcugggcagccuugggugcaagccguuaaccauguuccugaucgccgaaaacaaaaucuggggccguagguccuggccccuuaacgaggggaucauggccgucggcaucgugagcauccugcugagcucccugcugaagaacgaugugccccuggccgggccguugauugcgggcggcaugcugaucgcgugcuaugucaucagcggcuccagcgccgaccugucucucgaaaaagccgccgaggugagcugggaggaggaggccgagcacuccggggcgagccacaacauccugguugaaguccaggaugacgggacuaugaagauuaaggacgaggagcgagacgacaccuugacaauccuguugaaggccacccugcucgccguguccggcguguauccgcugagcauccccgccacgcuguuugucugguacuucuggcagaagaaaaagcagcgcucgggggugcucugggacacccccuccccgcccgagguggagcgcgccgugcuggacgacggcaucuaccgcauuaugcaacggggccuucuggggcgcagccaggugggcgugggggucuuccaggagaacguguuccauaccauguggcacgugacccggggcgcggucuugauguaccaggguaagcgccuggagccuagcugggccuccgugaagaaggaucugaucucauacggaggcggguggcggcuucagggcuccuggaacaucggggaggaagugcaggucauugccguggagcccggcaagaaucccaagaauguucaaacggcccccggaaccuucaagacccccgagggcgaggucggcgccaucgcgcuggacuucaagcccgggaccagcggcucucccaucgugaaccgcgaggggaagaucguaggccuguacggcaacggagucgugacgaccagcggcaccuacgugagcgccaucgcucaggccaaggcgucacaggaggggccgcuccccgagaucgaggacgaggucuuucggaagcgcaaccugaccauaauggaccugcaccccggcagugguaagacgcguagauaccucccggcgaucguucgggaggcuaucaaaaagaaacugcgcacccugaucuuggcacccacccgcguggucgcguccgagauggcggaggcccuuaaaggcaugcccauccgguaccaaaccacggccgucaagagcgagcacacaggcaaggagaucguugaucugaugugccacgccacuuucacuaugcgccucuuaucccccguucgggugccaaauuacaacaugauuaucauggacgaagcccacuucacggacccuagcuccauagcggcccgcggcuacaucagcacccgggugggcaugggggaggccgccgccauuuucaugacagcgaccccgcccggcuccgucgaggccuucccucagagcaacgcagugauccaggacgaggagcgugacauacccgagaggucuuggaacagcggcuaugaguggaucacugacuuucccgggaagaccgucugguucgucccuucgaucaagagcggcaacgacaucgccaacugucugcgcaagaacgggaagcgggucauccagcucaguagaaagaccuucgacaccgaguaccagaaaacgaagaacaacgacugggacuacguggugaccaccgauauuucggagaugggcgcuaacuuccgugccgaucgcgucaucgacccucggcgcugccugaaaccggugauccugaaggacgggcccgagcgggucauucucgcaggccccaugccggugaccguggccagcgccgcgcaacgucgggguagaaucggccggaaccauaacaaagagggcgaucaguacaucuacauggggcagccccugaacaacgacgaagaccacgcccacuggacggaggccaagaugcugcucgacaacauuaacacucccgaggggaucaucccugcacuguucgaaccggagcgcgagaagagcgcggcgaucgacggggaguaucgccugcgaggcgaggcccgcaagacauuuguggagcucaugcggcgaggggaccuccccguguggcuguccuacaaggucgccagcgagggcuuccaguacagcgaucgucgcuggugcuucgacggcgagcggaacaaucagguguuggaagagaacauggacguggagaucuggacuaaggagggggagcgcaagaagcugcggccccgguggcuagaugcccggacguacuccgauccccucgcucugcgcgaguuuaaggaguucgcggccgggaggcgcagcgucucaggggaccugauccucgagaucggaaagcugccgcagcacuugacccagcgcgcccagaacgcccuugacaaucuggugaugcugcauaacagcgagcagggagggcgcgcguaccggcaugccauggaggagcuccccgacaccaucgagacccugaugcugcucgcucugaucgccguucugacgggcggggucaccuuauucuuccuguccggucgcgggcuggggaagaccagcaucggccuccuuugcgugauggccuccagcguccugcucuggauggcgucggucgaaccacacuggaucgccgccagcaucauccuggaguucuuccugauggugcucuugaucccugagccagaccggcagaggaccccgcaggacaaucaguuagcguaugucgucaucgggcuccuguucaugaucuugaccguugccgcgaacgagaugggccuucuggagacgaccaagaaggaccuggggauaggccacguggccgucgagaaccaccaccacgccgccaugcucgacguggaccuccaccccgcguccgcuuggacccuguacgccgucgccaccacaauuaucaccccgaugaugaggcacaccaucgagaacacgacggcaaacaucucccuaaccgccaucgcaaaccaggccgccauccuaauggggcuggacaagggcuggcccaucuccaaaauggacaucggugucccccuccuggcccugggcugcuacagccagguuaauccccucacccugaccgcagccguacugaugcucguggcccacuacgccaucaucggcccggggcugcaggccaaggcgacgcgcgaggcccaaaagaggaccgccgcuggcaucaugaagaacccuacgguagacggaaucguggccauugaucuggaccccgucguguacgacgcgaaguucgagaagcaauugggccagaucaugcugcugauccucugcacaucccagauccugcuuaugcggacgaccugggcccucugcgagagcaucacccuggcgaccgggccacugacgacacugugggagggcuccccgggaaaguucuggaauaccaccaucgccgugucuauggccaauauuuuucgcggaaguuaccuggcgggcgccggccuggccuucucacucaugaagucccucgggggcgggcggcgaggaaccggggcccagggcgagacgcugggcgagaaguggaagcggcagcucaaccaguuauccaagagcgaauucaacacauacaaacgcuccgguaucauggaagucgaccguagcgaggcgaaggagggacuuaagcgcggggagaccacgaaacacgccguauccagaggcaccgccaagcuccgcugguucguggagcggaaccuggucaagcccgaggggaaggugaucgaccugggcuguggccgcgggggcuggagcuauuacugcgccgggcugaagaaagugacugaggucaagggcuauaccaagggcgggcccggccacgaggagcccaucccgauggccacguacggcuggaaucucguuaagcugcacucgggcaaggacguguucuucaucccgcccgagaagugcgacacccugcucugugauaucggggagucaucccccaacccgacuaucgaagaaggccggacucugcgcguguuaaagaugguggagcccuggcuccggggcaaccaguucugcaucaagauccugaaccccuacaugcccaguguuguggaaacgcuggagcaaaugcagcgcaagcacggcggcaugcucgugcggaacccgcucuccaggaacucuacacacgagauguacuggguguccugugggaccggcaacaucgucagcgccguaaacaugaccucgcggaugcugcucaaccguuucaccauggcgcaccgcaagcccacguacgaacgggacguugaucuuggggccgggacccgccacgucgccguggagccagagguggccaaccuggauaucaucggccaaagaaucgaaaacaucaagcacgagcauaagaguaccuggcauuacgacgaggauaauccuuacaagacaugggcguaccacggguccuacgaggucaagccuagcggauccgccagcagcauggugaacgggguagugaagcucuuaacgaagcccugggaugugauccccauggucacccagaucgcuaugaccgauaccacgcccuucggccagcaacgcgucuucaaagagaagguggacacacgaaccccaaaggccaaacgcgggaccgcacagaucauggaagucacggcgaaguggcuguggggcuuccucucccggaacaagaagccccgcaucugcacccgggaagaguucaccagaaaggugcggucgaaugccgccaucggcgccguauucgucgacgagaaccaguggaacuccgcgaaggaggccguggaggacgaacgcuucugggaccuggugcaccgugagcgugagcugcacaaacaggggaagugcgcgaccugcgucuacaacaugaugggcaaaagagagaagaagcucggggaguucggcaaggccaaggggagccgcgccaucugguauauguggcucggggcgagauuccuagaguucgaggcgcucggcuucaugaaugaggaucacugguucucccgcgagaacagccuguccggcguggagggcgaagggcuacacaagcucggcuacauccuucgggacaucagcaaaauaccggggggcaacauguacgccgacgacacggcaggcugggauacccgcaucaccgaggaugacuugcagaacgaggcccggauaaccgacauuauggaacccgaacacgcgcuccuggcgaaguccauauucaagcugacguaucaaaacaaaguugugcgcgugcaacgccccgccaagaacgggaccgugauggaugucaucagccgucgcgaccagcggggcuccggccaggugggcaccuauggccucaacaccuuuacgaacauggaggcccagcugauccgccaaauggaaagcgaagggaucuucuccccaagcgagcuggagacccccaaccucgcagagcgggugcuggacuggcuggaaaaguacggcgucgagcgccuaaagcggauggcgaucaguggugacgacugcgucgugaagccaaucgacgaccgcuucgccaccgcccugacugcgcugaacgacauggguaagguccggaaggacauuccccagugggagcccagcaagggauggaacgacuggcaacagguccccuucugcucacaccacuuccaccaguugaucaugaaggauggccgcgagauuguggucccgugccggaaccaggacgaguuagugggccgcgcccgggugagccaaggggcuggcuggagcuugcgcgagacugcgugccucgguaaauccuacgcccagauguggcagcugauguacuuccacaggcgcgaccugcggcucgccgcgaacgcgaucugcagcgccgugcccguagacuggauccccaccucccgcaccaccugguccauccacgcccaucaccaauggaugacgaccgaggacaugcuauccguguggaaccgggucuggaucgaggaaaaucccuggauggaggacaaaacccacauuagcuccuggggcgacgugccuuaccugggcaagcgcgaggaccaguggugcggcucccucaucggccugaccgcccgcgcgaccugggccaccaacauacagguggcaaucaaccagguccggcggcugauagggaacgagaacuacuuggacuacaugaccagcaugaagcgguucaagaacgagagugacccggagggcgcacugugguga

SEQ ID NO: 24220 - RNA, 9879 nt, Artificial Sequence
  derived and/or modified CDS sequence (opt11) from DENV-1__FJ410246__SS-prME
ucuguuacgaugcuacucaugcucaugcccacagccuuggcguuucaccuaacuacucgaggaggggaaccccacaugauagugagcaagcaagagcgagggaaaaguuuacuguucaaaacaagcgcgggggucaacaugugcacacucaucgcaauggacuugggcgaguucugcgaggacaccaugacguacaagugcccucgaaucacagaagccgaaccugacgauguagauugcuggugcaaugcaacagacacuugggucaccuauggcacgugcagucagacaggugaacaucggcgcgacaagcgcagugucgcccuggccccgcauguugggcugggacucgaaaccagaacagaaaccuggaugucaagcgaaggagcauggaagcaaauacagcggguugaaaccugggcgcuucgacauccgggguucaccguaauagcccucuuccuugcgcacgcaauaggaacgucaauuacgcaaaaaggcauuaucuucauccuccugaugcugguaaccccgagcauggcgaugagguguguaggaaucggcucacgagacuucguagagggccucucgggcgccaccugggucgacguaguacuggaacauggaaguugcgugaccacaauggcgaaagacaagccuacacucgacauagagcuccucaaaacggaggugacaaauccagcagugcugaggaagcuguguauagaggcgaaaauaagcaacaccaccaccgacagccggugcccgacgcagggggaagccacacucguagaggagcaagaugccaacuucguaugcaggagaacguucguagaccgaggcuggggaaacggcugcggccucuucggaaaagguucccuaauuacaugugcuaaauuuaaaugugugacaaagcuagaggggaaaauaguccaguaugaaaaccugaaauauucagucauagucaccgugcacacgggcgaucagcaucaaguuggaaacgagagcaccgagcacggcacgacagccacuaucacgccccaagccccauccacggagauacaacuaacugauuacggggcgcuaaccuuagauuguucaccccgcacaggcuuggauuucaaugagaugguccuuuugacgaugaaagagaaaaguugguuaguacacaaacaaugguuccuggaccugccacucccguggacuagcggggcuucgaccucacaggaaaccuggaaccgccaggauuuacucguaaccuuuaagaccgcacaugcgaagaaacaagaagucgucgugcuaggaagccaggaaggagcuaugcauaccgcucucacuggcgccaccgagauacaaacgagcgggaccaccacgauauucgcggggcaucugaagugcagacugaagauggacaaacucacauugaaaggaauguccuacgucaugugcacagggagcuuuaaacuagaaaaggagguagcagaaacgcagcacggcaccguccucguacaaaucaaauaugaggggacagacgcgccgugcaaaauaccguucagcacccaagacgagaagggagugacccagaacggacgccugauaaccgccaauccuauagugacagacaaggacaaaccgguaaacaucgaagcagagccacccuucggagaguccuacaucguaauaggggccggcgaaaaagcccugaaacuaagcugguucaagaaggggaguucgaucggaaagauguucgaggcgacggcgagaggcgcgagaaggauggccauccucggcgacacagccugggacuucggcagcaucgguggugucuuuaccuccgugggaaagcuagugcaccaaauauucggaaccgccuacgggguacucuucagcggugucuccuggaccaugaaaaucggcaucggggugcuacuaaccuggcuggggcugaacagccggucaacuagccugagcaugaccugcauagcaguaggccuagucacacucuaccucgggguaaugguccaagcugauucgggcugcguaaucaauuggaaggggcgcgaacugaaauguggaagcggaauauuugucacaaacgagguccacacauggacagaacaauacaaauuccaagccgauucgccaaaaagacucucagcagccaucggcaaggcuugggaggagggagugugcggcauccggucugccaccagguuagaaaacauaauguggaagcaaaucucaaacgaacucaaccauauacucuuagagaacgauaugaaguuuacagugguggucggagacgucgcgggaauccucgcgcagggaaagaaaaugauaagaccgcagccaauggaauacaaguacuccuggaaaagcuggggaaaagcgaagauaauaggggcagauguucaaaacaccacuuucauaaucgacggccccaauacccccgaaugcccggaugaucaacgggcguggaauauaugggaagucgaagauuacggauuuggaaucuucaccacgaacauauggcucaagcugagagauucuuacacucaaguaugcgaccaucgccucaugagcgccgcgaucaaagacucgaaagccguacaugcagauaugggcuacuggaucgagagugagaaaaacgagaccuggaaacuggcucgagcuucguucauagagguaaaaaccugcauauggccaaagucccacacgcuauggagcaacggcguccuagagucagagaugaucauuccgaagauauacggcggacccaucagccaacauaacuauaggccgggcuacuucacccagaccgccggcccauggcaucugggaaaacuugaauuagauuucgaccucugugaggggacaaccgucguaguagacgaacacugcgggaacaggggucccagccugcgcacaaccaccgucaccggaaagauaauucaugaguggugcugucggagcugcacgcuacccccauugcgauucaaaggagaggacggauguugguauggcauggagauccgaccaguaaaagaaaaggaagaaaaccuaguuaaaagcaugguaucugcgggaaguggagaaguagauagcuuuucguuaggacuacuguguaucucaaucaugacagaagaggugaugcggaguagauggucucguaaaaugcugaugacaggaacgcuagcaguguucuuccucuugauaaugggacagcugacguggaaugaucuuauacggcucugcauaauggugggugcuaacgcgagcgaccgaaugggaaugggcaccaccuacuuagcguugauggcaacauucaagaugagaccgauguuugcaguaggccuucucuuccggcgucucacaucaagggagguguuacuacugacgauaggccugagccucguagcaucagucgaguugccaaacucacuagaagaacuaggggacggacucgccaugggaauaaugauccugaaacuacuaacagacuuccaaucacaccagcugugggcgacucuacugagccugacguuuaucaaaacgaccuuuucccuccacuaugcguggaaaacaauggcaaugguccuaaguaucgucucccuauuuccacuaugccuuucaaccacgucgcaaaagacaaccuggcuaccaguccuacuagggucgcuaggaugcaaaccacugaccauguuccuuaucgccgagaauaaaaucuggggcagaaaaagcuggccauuaaacgaaggaauaauggcagucggcaucgugagcauucuacugagcagccuacucaaaaacgacgugccacuagcggggccccugauagcgggaggaaugcugaucgcauguuacguaauuucagggucauccgcggaucucucucuggagaaagcagccgaagucagcugggaggaagaagcggaacacucuggcgcuucucacaauauacucgucgaaguucaagaugauggcacuaugaaaauuaaggacgaagaacgugacgacacucugacaauacugcugaaagccacacuucucgcgguuucaggcguauacccauuaagcaucccggcaacacuuuuugucugguacuucuggcaaaagaagaaacaacgaagcggggugcuaugggacaccccaagcccaccagaagucgaaagagcaguucuggacgacgggauauaccgcauuaugcaacgaggccuacuaggucggucgcagguugguguaggaguuuuccaggaaaacguuuuccacaccauguggcacgucacucggggcgcaguccuaauguaucaaggcaaaaggcuggaaccaucaugggccuccguaaagaaagaccuuaucuccuauggaggaggguggaggcugcaagguagcuggaacacaggagaagaagugcagguaaucgccguagaacccgggaaaaacccaaagaacguacagacagcgcccggaacauucaagacauccgagggggagguuggggcaaucgcucuagacuucaagccugggacaagcgggucgccaauugucaaucgcgaagggaagauuguuggacuauaugguaaugguguaguaaccacaucugggacguauguaagcgcgaucgcacaagcgaaagcgucgcaagaaggaccgcuaccggaaaucgaagacgaggucuucagaaaaaggaaccugacaaucauggaccugcauccgggcuccggaaagacgcgacgguaccuaccugcuauuguccaugaagcgauuaaacguaagcuccgcacguuaauccuagccccuacgcgagucguagccucagaaauggcggaggcccucaaaggcaugcccauccgauaccagacgacggccguuaaaagugaacauaccggaaaggaaauuguggaccugaugugccacgcgacuuucaccaugaggcuauuaagcccggugagagugccaaauuauaacaugaucauaauggacgaagcgcacuucacggacccguccagcauagcggcacgaggguacauaucgacgagaguaggcaugggagaagccgccgcaauauucaugacagcaacgccuccuggaucaguggaagcauuuccacagucaaacgccguaauucaggacgaggaacgugacaucccagaacgcagcuggaacuccggauacgaguggaucaccgacuucccaggcaaaacagucugguuuguaccaaguaucaagagcggaaacgacauagccaauugccugaggaaaaacggcaagagggugauacagcugucgaggaagacguuugacacagaauaccaaaagaccaaaaacaaugacugggacuacgugguaaccaccgacauaagugagaugggcgccaacuuccgggcggaccgcgucauugacccaaggagaugccugaagccggucauccucaaggauggacccgagcgggugauccuagcugggccgaugcccgugaccgucgcuucggcagcgcagcgccggggccgaauaggaagaaaucauaacaaggagggcgaccaguauguuuacaugggucaaccauugaacaacgacgaggaccacgcacacuggaccgaagcuaagaugcuccucgacaauaucaacacccccgaagggaucauaccagcucuauucgaaccagaacgagaaaagagugccgccaucgauggggaauaucgccuccgcggcgaggccagaaaaacauuuguugaauugaugcggcgcggcgaucucccgguauggcucagcuacaagguagcaagcgagggcuuucaauauucggaccgcagaugguguuuugacggggagagaaacaaccaaguacucgaagagaacauggacguagaaauauggacgaaagagggcgagagaaagaaacuccggccgagauggcuggaugcccggacguacagcgacccacuagcacugagagaguucaaggaguucgcagcaggcaggagaucagucuccggagaucuaauacuugaaaucggaaaacuaccccaacacuugacgcagagagcgcaaaacgcacucgauaaccuuguaauguuacauaacagcgagcaagggggacgggcauaccgacaugcaauggaagaacuuccggauacuaucgagacauuaauguugcucgcccuuauugcggucuuaacuggaggggucacucuauucuucuugucgggucgaggauuagguaaaacaagcaucggucuuuuauguguaauggccagcucugugcugcucuggauggccucgguggaaccucacuggauugcggcgucaauuauacuagaguucuuccuaauggugcuacuuauaccggagccugauagacaaaggacgccccaggauaaccaacuugcauauguuguaaucggacuucuauucaugauacucaccgucgcggccaacgagaugggccuccucgagacgacaaagaaagaccugggcaucggacauguagcagucgaaaaccaucaucacgcggcuauguuagauguugaccuccacccagccagcgcauggacgcucuaugccguagcaacaacgauuauuaccccgaugaugcggcacacgaucgaaaauacaacagcaaacaucagccucacugccauugcaaaccaggcagcgauacucaugggacuggauaaagguuggccgaucuccaaaauggacaucggcgucccccuccuggcauuggggugcuacagccagguuaacccccuaacgcugacagccgcaguacucaugcuagucgcacacuacgccaucaucgguccagggcugcaagccaaagccacacgggaggcccagaaacgcacugcagccggaauuaugaagaaccccaccguagaugggauugucgcaauagacuuagauccgguagucuaugacgcgaaguucgaaaaacaacuaggccaaaucaugcuccucauccuauguacgagucagauauuacugaugcgaacgacaugggcccucugcgaguccauuacucuugcgacgggaccccugacgacgcuaugggaaggaucgcccggcaaauuuuggaauacaacuaucgcgguaaguauggcgaauaucuuuaggggcagcuaucuugccggugcuggcuuagcauuuagucuaaugaaaagccuugggggcggcagacgaggcacgggcgcacaaggcgaaacccucggugaaaaauggaagagacaacugaaccaacucaguaaaucggaguucaacaccuacaaacguuccggcauuauggaaguggacagauccgaagcgaaggaaggauuaaaacgaggggagaccacgaaacaugcagucagcaggggaacagcgaaacucagaugguucguagaaaggaaccuagugaaaccggaaggaaaaguaaucgaccuggggugcggcaggggaggcuggagcuacuacugcgcaggucugaagaaaguaacagagguaaagggcuacacuaagggagggccagggcacgaagaaccaauccccauggccaccuauggcuggaaccuugugaaacugcacucugguaaagacgucuucuucauucccccagaaaaaugcgacacacuucugugcgauauuggugaauccucuccaaacccaacaauagaagagggccguacacugagaguacucaagaugguggaaccguggcugcgcggcaaucaauucugcaucaagauccucaacccauacaugccgucaguaguggaaacauuggaacaaaugcagcggaaacacgggggaaugcuagugcgcaacccacuaucacgcaauaguacccaugagauguacuggguauccugcggaacaggaaacaucguaagcgccguaaacaugacgucccggaugcugcucaaccgguucacaauggcgcauagaaagccgacauacgagcgcgacguggaucuuggagcaggcacccggcauguggccguggagcccgaggucgcgaaccucgacaucauuggacaaagaauagaaaacaucaaacacgaacacaagagcacauggcauuacgacgaggacaacccguauaaaacaugggcguaccauggcuccuacgagguuaaacccuccggcuccgcgucuucaauggugaacgggguagugaaacuccugacaaagccgugggauguuaucccgauggugacacaaauagccaugacggauacuacgcccuucggucaacaaagaguguucaaggagaaaguagacacaagaacaccaaaagcaaaacgggggacagcacaaauaauggaagucaccgcuaaguggcucuggggguuccuaagccgaaacaagaaaccucgcauaugcacacgggaagaguucacgcggaaagugcgaagcaaugcggccauaggcgccguguucgucgaugaaaaccaauggaacucggccaaggaggcaguggaggacgagcgcuuuugggaucuaguccaccgcgaaagagaacugcauaagcaagggaagugcgccacaugcguauacaauaugauggggaaacgcgagaagaaacucggagaguucggcaaagcaaaaggcucaagagccauaugguacauguggcucggggcccgguuccuggaauuugaggcacuaggauucaugaacgaagaccacugguucagucgcgaaaacucacuaucggggguagaaggcgaagggcuucauaaacuaggcuacauauuacgcgacauaucaaaaauacccggaggcaauauguacgcagaugauacagcggggugggacacacgcauaacagaagacgauuuacagaacgaagccaaaauaacagauaucauggaaccggagcacgcgcucuuggccaaaaguaucuuuaaacuuacauaccaaaacaaggucguaagaguccaacgcccggcaaagaacgggacugucauggauguaauaucgcgcagagaucagagaggaucaggacaggucggaacguacggacuuaacacuuucaccaacauggaagcccaacucauaagacagauggaauccgaaggcauuuucuccccgagcgaguuagaaaccccuaaccuugcagggcgcguauuggacuggcucgaaagacacggcguagaaaggcuaaaaaggauggcaauuucgggagaugauugcguaguuaaaccaaucgacgauagauucgcgaccgcacugacugcccuuaacgacaugggcaagguacgaaaagacaucccgcaaugggaaccgagcaaaggauggaaugacuggcaacaagugcccuucuguagccaccacuuccaccaauuaauuaugaaggacgggagagaaauaguggugccgugcaggaaucaagacgagcuggucggacgagcacggguaagccaaggcgcaggguggucguuaagagagacggcaugccugggaaagagcuaugcucagauguggcaauuaauguacuuccaccggagggacuuaagacucgcagccaaugcgauuugcagugccguucccguagacuggguaccgacaucaaggaccacauggaguauccacgcccaccaccaauggaugacuacagaggacaugcuuucuguuuggaacagagucuggauagaagaaaacccauggauggaagacaaaacacauauuucaucguggggagaugucccauaccuagguaaaagagaggaccaaugguguggaucacucaucggucuaaccgcgagagcaaccugggccacgaacauacaaguggcaauaaaccaaguacggaggcucauagggaacgaaaacuacuuagacuauaugacauccaugaaacgcuucaaaaacgagagcgaccccgaaggcgcgcugugguga

SEQ ID NO: 24221 - RNA, 9879 nt, Artificial Sequence
  derived and/or modified CDS sequence (opt11) from DENV-1__FJ410247__SS-prME
uccguaacuaugcugcucaugcugaugcccacugcccuggccuuccacuugacgacacggggcggggaaccgcacaugaucgugagcaagcaggagcggggcaagagccuacucuucaagaccagcgcaggggugaauaugugcacacucaucgccauggaccugggcgagcugugcgaagacacaaugacauacaaaugcccccgcaucaccgagaccgagcccgacgacgucgacuguuggugcaacgcaacggacaccugggugaccuacgggaccuguagccagacaggggagcaucggagggacaagcgguccguggcccucgcgccccacgugggccuggggcuggaaacccgcacagagaccuggaugagcuccgaaggcgcguggaagcaaauacaacguguugagaccugggcccugcgccacccuggguucaccgugaucgcccuguuccuggcccacgcgaucgguaccucuaucacccagaaggggauaaucuucauccuguuaaugcugguaacgccuuccauggccaugcgaugcgucggcaucggcagccgcgacuucguggaggggcuaagcggcgcgaccuggguggacguaguccuggagcaugggagcugcgugaccaccauggccaaggacaagccgacgcuugacaucgagcuacugaagacugaagucacuaaccccgccauccugcguaagcucugcaucgaggcgaagaucuccaacaccacgacagacaguagguguccgacccagggcgaggccacccugguggaagaacaggaugccaacuucguuugucggcgcacguucgucgaccggggcugggggaauggcugcggucuguucggaaaggggucccugaucacgugcgccaaauuuaagugugugaccaagcucgaaggcaagaucgugcaauacgagaaccugaaauacagcgucaucgucaccgugcacacgggcgaccaacaccaggucggcaacgaguccacugagcauggcacuaccgcuacaaucacuccccaggcgccgaccacggaaauccagcucaccgacuacggggcuuugacacuggauugcucuccgcgcaccggccucgauuuuaaugagauggugcugcuuacgaugaaggagaagucguggcucguccacaaacagugguuccuggaccuaccgcuccccuggaccaguggagcaagcacgucgcaagagaccuggaaucggcaggaccuacuggugaccuucaagaccgcucacgccaagaagcaggaaguuguugugcucggcucucaagagggugcaaugcacacggcacugacuggagccacugagauacagaccuccggcacaaccaccaucuucgccgggcaucugaagugccgccucaagauggacaaguugacgcugaagggcauguccuacguaauguguacgggguccuucaaacucgaaaaggaggucgccgagacccagcacggcacugugcuggugcagaucaaguacgaggggacggaugcgccgugcaagauccccuucucuacucaagacgaaaaggggguaacccagaacggucgucugaucaccgcuaacccgauagugacugacaaagagaaacccgugaacaucgaggccgagccucccuucggagaauccuauaucgucaucggcgccggcgagaaggcucucaaacuuaguugguuuaagaaaggcuccagcaucggcaagauguucgaggcgacggcccgcggggcaagacgcauggcgauacugggugacacagcaugggauuucgggucuaucggcggcguguucaccagcguugguaaguugguccaucagaucuuugggaccgccuacgggguccuguucaguggagugagcuggacgaugaagauugguauuggcguacugcugaccuggcucggacugaacuccagaucaacgucgcugaguaugacuugcauagccguugggcucgugacacuguaccugggcgucauggugcaggcagacuccgggugugugaucaacuggaagggccgggaacucaaaugugggucaggcaucuucgucaccaaugaggugcacaccuggaccgagcaguacaaguuucaagcugacuccccgaagcgccuguccgcagccaucggcaaggcuugggaggaaggugugugcggcaucagaagcgccacucgcuuggagaacauaauguggaagcagaucuccaacgagcucaaucacauucuacuggagaaugauaugaaguucacuguuguggugggcgacguugcagguauccucgcacagggaaagaagaugauacggccucagcccauggaauacaaguacucauggaaguccugggggaaagccaagauuauuggcgccgacgugcagaauacuacguucauuaucgacgggcccaacaccccagaaugcccugaugaccagcgugccuggaacaucugggagguggaagacuacggcuuugggaucuucacgacaaauaucuggcuuaaacuuagagacagcuacacccagguaugugaucaccgccucauguccgcggccaucaaagacagcaaagcugugcacgcggacaugggcuauuggaucgaguccgagaagaaugagacguggaaacuugcccgcgcgucuuucaucgagguuaagacgugcauuuggcccaaaucacacacccuuuggagcaacggcguccucgagagugagaugaucauccccaagauuuacggcgguccgaucagccagcacaauuacagacccggguacuucacgcaaaccgcuggcccauggcaucuaggaaagcuggagcucgauuucgacuuaugcgaggggacgacugugguugucgaugagcauuguggaaaccgggguccgucucugcgcacaacaacggugacgggcaagauuauccacgagugguguugcagaagcuguacccugccaccccugagguuccgcggagaggauggcugcugguacggcauggaaauccgucccgugaaggagaaagaagagaaccuggucaaguccauggucucugcuggcagcggugagguggacagcuuuagucuuggcuuacucuguauauccauaaugaucgaggaggucaugcggagucgcuggucccgaaagaugcucaugaccggaacccuggcuguauucuuacuccuuaucaugggacagcugaccuggaacgaccucauccgccugugcauuauggugggcgcaaacgcgagugauaggauggguaugggcaccacauaucuggccuugauggcaacguuuaagaugcggccgauguucgccgucggccuguuauuccgccggcuaaccucccgcgaaguucuguuguugacaauugggcugucauuaguggcgagugucgaauugccaaauucacuggaagaacugggugacggccucgcgaugggcauaaugauccucaagcuguuaaccgauuuucagucucaccagcugugggcaacgcugcucuccuugacauucauaaagacuaccuucucgcugcacuaugccuggaagacgauggccaugguccucucgauugucaguuuauucccucuuugccucagcaccacaucccaaaagaccacguggcuucccguucuucucggcagcuugggguguaagccguuaaccauguucuugauagcggagaaccggaucuggggccggagaucauggcccuuaaaugaggggaucauggcuguggguaucgucagcauuuugcucagcucacugcugaaaaacgacgugccauuagcgggacccuugaucgccgguggcaugcugaucgccuguuacgugaucaguggguccucagcggacuugucccucgagaaagccgccgaggugagcugggaggaggaggccgagcacucgggcgccucacauaauauccuaguagagguucaagacgacgguaccaugaaaaucaaggaugaagaacgcgacgauacccuuaccauuuuauugaaagcuacguuauuggccguauccggcguauacccgcugagcauuccggcaacguuauuugucugguacuucuggcagaagaaaaagcagcgguccggaguucugugggacacucccagcccgccagaaguggaaagagccguguuagacgacgguaucuaccggauaaugcagcgcggccugcuggggcggucccaggucggcguggggguguuccaagagaacguauuccacaccauguggcacgucacgaggggcgcugugcugauguaccaggggaagcggcucgagccuucuugggcguccgucaagaaagacuuaaucagcuacggcgguggguggaggcuccagggcuccuggaacaccggggaagagguccaagucaucgcaguagagcccggcaagaaucccaagaacgugcagaccaccccgggcacguucaagacccccgagggcgagguaggcgcaaucgcccucgacuucaagccaggcacaagcggcucgcccaucguuaaccgggaaggcaagauagugggccucuacggcaacggugucguuaccacgagcgggacauacgugagcgccaucgcccaggccaaggccucgcaggaaggaccgcuaccugaaauagaggacgagguguuccgcaaacggaaucugacaaucauggaucuacaccccggcucagguaaaacucgucgguacuuaccagccaucguccgcgaagcgaucaagcggaagcugcggacucucauccuggccccaaccaggguggucgcgagugagauggccgaggcucugaagggcaugcccauacgguaccagaccaccgcggucaagagcgaacauacgggcaaggagauaguggaccucaugugucacgccaccuucaccaugcgccugcugucccccgugcgugucccuaacuauaacaugauaaucauggacgaggcacacuucacggaccccagcuccaucgcggccagaggguacaucagcacucgggugggcaugggggaggccgccgccaucuucaugaccgccacgccgccgggcuccguagaggcauuuccgcagagcaacgcggucauccaggacgaggagagagauaucccagaacgguccuggaacaguggguaugaauggaucaccgacuuccccggcaagacagugugguuugugcccuccauaaagagcggcaaugacauagccaacugccugcgcaagaacgggaagcgggucauucagcugucacggaagacuuucgacacagaguaccagaagaccaagaauaacgacugggacuacguggugacgacugacaucucugagaugggcgccaauuuccgggcugaucgcguaauagacccgagacgcugccuuaagccagugauccucaaagacggccccgagcggguaauccuagcggguccaaugccggucacagucgccuccgccgcacagagacgggggcgcauaggccgcaaccauaacaaggaaggcgaccaguacaucuacaugggucagccgcugaacaacgacgaggaccacgcccacuggaccgaggccaagaugcucuuagacaacaucaacacgcccgaaggaaucauccccgcgcuguucgagcccgagcgagagaagucggcggcuaucgacggggaguaccgccucagaggggaggcccgcaagaccuuuguggaacugaugcggcggggugacuugccgguguggcucuccuacaagguggcgagcgagggcuuccaguacagugaucggcgcugguguuucgacggcgagcggaauaaccaggugcuugaagagaacauggauguggagauauggaccaaggagggcgagagaaagaaauugagaccccguuggcuagacgcccgcacauacuccgacccacuggcccugcgcgaguuuaaagaguuugcagcaggccggagaucgguguccggggaccucauccuggagauaggcaaacugccgcagcaccucacgcagagggcacagaacgcccuggacaauuuggucaugcuacauaacagcgagcaagguggucgagccuaccggcaugccauggaagaguugcccgacaccaucgagacacucaugcuccuagcgcugaucgcggugcucaccggcggggugaccuuguucuuucucucgggccgggggcuuggaaagacaagcaucggccugcugugcgucauggccaguaguguucuacuguggauggccuccguggaaccacacuggauagccgcaucuaucauccucgaguucuuucuaaugguccuccugauccccgaaccggaccgccagcgcaccccgcaggacaaccagcucgccuacgugguaaucgggcugcuguucaugauccucacaguugccgccaaugagaugggccugcuggagacgacuaaaaaggaccucggaauuggccacguugccguggggaaccaucaccaugcugcgaugcuggacgucgaccuacaccccgccuccgcuuggacacucuacgccguggccacuacaaucauaacgccgaugaugcggcacacaaucgagaacaccaccgccaauauaagccuaacggcgaucgccaaccaggccgcaauccuuaugggccucgacaagggcuggcccaucuccaagauggacaucggggucccccugcuggcacugggaugcuacagccaggucaacccccucaccuuaaccgcugcgguccucaugcugguggcgcauuacgccaucaucgggccagggcugcaggccaaagcgaccagagaagcgcaaaagagaacagcggccggcaucaugaagaaccccacugucgacgggaucguggccaucgaccuggacccggugguauacgacgccaaguucgagaaacaacuggggcagauaaugcuccucauauugugcacaagccagauucugcucaugcggaccaccugggcccugugcgaaagcauaacauuagcgaccgggccccucacgacgcugugggaaggaucccccgggaaguucuggaacacgaccauagcggugucuauggccaacaucuuccgcggguccuaccuugccggggcaggguuggcuuucagccugaugaaaucccugggcggagggcggcgcggaaccggagcccagggcgagacgcucggagagaaguggaagcgucagcuuaaccaacuauccaagagcgaguucaauaccuauaagcgcagcggaauuauggaaguagaucgguccgaggcaaaagagggucucaagcgcggggaaaccaccaagcacgccguaucccggggcacugcgaagcugcgcugguucguugagaggaacuuagugaagccagaggggaaggugaucgaccugggcuguggccgcggcggguggaguuacuacugcgccggccugaagaagguuaccgaggucaagggguacaccaagggcggccccgggcacgaggaaccgaucccgauggccacauacggcuggaaucuaguuaaacugcauuccgggaaggacguauuuuucaucccgccugagaaaugcgacacccugcuuugcgauaucggcgagagcucccccaauccgacgauagaagagggcaggacccuucgcgugcucaagauggucgagcccuggcuccgaggcaaccaguucugcaucaagauacugaacccauacaugcccagcgugguggagacgcucgagcagaugcagcgcaaacacggcgggaugcugguucggaacccucuuucucgcaauagcacgcacgagauguacuggguguccugcggcacaggaaauaucgugagcgcugucaacaugaccucccgcauguugcuaaacagguucaccauggcgcaccgcaagcccacuuaugagcgggacguggaccucggagcgggcacacgacacguggcggucgagccggagguggcgaaccucgacauuaucgggcagcguaucgagaacaucaaacacgagcauaagucgaccuggcacuacgaugaggacaaccccuacaagacaugggccuaucacggcuccuaugaaguuaagcccucagguuccgcauccagcauggucaauggugucgucaaguuguugaccaagccaugggacgugauccccaugguaacgcagaucgcgaugaccgacacuacucccuucgggcaacagcgcgucuucaaggagaagguagacacucggaccccgaaggccaaacaggggaccgcccagaucauggagguuaccgcgaaguggcucuggggcuuccugagccgcaacaagaagccccggaucugcacgagggaggaguucacgcgaaagguccgcagcaacgcagcaaucggggccguuuucguggacgagaaucaguggaacucggccaaggaggccgucgaggacgaacgcuucugggaccuggugcaccgagagcgggagcuacacaagcagggaaaaugugcgaccugcguauacaacaugauggggaagagggagaaaaagcugggagaguucgggaaagcuaaagguucccgggccaucugguauauguggcugggcgcccgcuuucucgaguuugaggcccugggcuucaugaacgaggaccauugguucucccgggaaaauagucuguccggagucgaaggugagggacuccacaagcuggguuauauccugcgagacaucagcaagauccccggcggaaacauguacgcagaugacaccgccggcugggauacgcggaucacagaagacgaccuccagaacgaggcgcgcaucaccgacaucauggaaccggagcaugcucuguuagccaaguccaucuuuaagcucaccuaccaaaacaagguggugcgaguacagcggcccgcgaaaaacggcaccgugauggacguaaucagccgccgcgaccaacgcggcuccggccaggucggcacauaugggcugaacaccuucacgaacauggaagcccagcugaucagacaaauggaaagcgagggaaucuucuccccgagcgagcuugagacacccaaccuagccgagcgcgugcuggacuggcuagagaaguaugggguggagcggcugaagcgaauggccauaucgggcgacgacugugucguuaaaccgaucgaugaccgguucgcaaccgcgcuuaccgcguuaaaugauaugggcaagguucgcaaggacauuccccagugggaaccuagcaagggcuggaacgacuggcagcagguccccuuuugcucacaccauuuucaccaacugaucaugaaggacggccgggagaucgugguccccugccgcaaccaagacgagcugguagggagggccagagugagucagggcgcuggauggucucuccgcgaaaccgcgugucugggcaaaaguuaugcacagauguggcagcuuauguacuuccacaggagagaccuucgccuggccgcuaaugcuaucugcucggcugugccggucgacuggauuccgacgagccggacuaccuggagcauucaugcacaucaccaguggaugacaacugaggacaugcuauccguguggaacaggguguggaucgaagagaacccauggauggaggacaaaacccacaucagcuccuggggcgaugugccauaccucggaaagcgcgaggaccaguggugcgggagcuugauuggccuuacugcccgcgcaaccugggccacuaacauccaaguggcuaucaaucaggugcgccgccucauaggcaacgaaaacuaccuggacuauaugacgucuaugaagcgauucaagaacgaauccgaccccgagggugcguuaugguga

SEQ ID NO: 24222 - RNA, 9879 nt, Artificial Sequence
  derived and/or modified CDS sequence (opt11) from DENV-1__FJ410248__SS-prME
agcgugaccaugcuucugaugcugaugcccaccgccuuagccuuccaccucacuacacgggguggggagccgcacaugauagugucaaagcaggagcggggcaagagccuccuguuuaagacgagcgccggggugaauaugugcacucucaucgcaauggaccugggcgaacugugugaggauaccaugaccuacaagugcccucgaaucaccgaggccgagcccgacgacguagacugcuggugcaacgccaccgacacgugggugacguacgggaccugcagccagaccggggagcaccggcgggacaagagauccguagcgcucgcaccccacgucggccuggggcuggagacuagaacggaaaccuggaugagcagcgaaggcgccuggaaacagauacagcgggucgaaaccugggcccuucgucaccccgguuucacuguaauugcccuuuuccuggcgcacgccaucgguacaagcaucacacagaaggggauaauauucauccuccuaaugcuggugacccccuccauggccaugcggugcgucggcauuggcagccgagacuucguggaggggcucuccggggccacguggguggacgucguguuagaacacgggagcugcguuaccaccauggccaaagacaagcccacccuugacaucgagcuccugaaaacggaagucaccaaccccgcggugcugaggaaacucugcauagaggccaagaucuccaacaccaccacggacagccgcuguccgacccagggcgaagcaacacugguugaggagcaggacgcaaacuucguuugccgucgcaccuucguggaucgggggugggggaacgggugcgggcuguucgggaaagggucccucaucacgugcgccaaguucaagugcgugaccaagcuggaagggaagaucguacaauaugagaaccugaaauacagcgugaucgugacgguccacaccggcgaccagcaccagguggggaaugaguccacagagcacggcaccaccgcgaccaucacgccccaagcccccagcacggagauccagcucacagauuacggggcccugacccuagacugcagcccccggaccggcuuagacuucaacgagaugguccugcugacgaugaaggagaaaagcuggcucguccacaagcagugguuucuggaccugccacuccccuggaccagcggggccuccacaagccaagagaccuggaaccggcaagauuugcucgugacguucaaaaccgcccacgcgaagaagcaggaggucguggugcucggcucccaggaaggggccaugcacaccgcgcugaccggagccacggagauccagaccagcggcacgacaacgaucuucgccgggcaccugaaaugccgcuugaagauggacaagcugacccugaagggcauguccuacgucaugugcacugggagcuucaaguuggagaaggagguggcggagacccagcacggcacggugcuuguacaaauaaaauacgagggcacggacgcgccauguaagauccccuucuccacccaggaugaaaaaggagugacacagaacggccggcugaucacugccaacccuaucgugacagacaaagagaagcccgucaacauugaggccgagccgcccuuuggggagucuuacaucguuauuggcgcgggggagaaggccuuaaagcucuccugguucaagaaggggucauccaucggcaaaauguucguggccaccgcaagaggggcccggcgcauggcgauccuaggcgacacagccugggacuucgggagcaucggcggcgucuucaccuccguggggaaguuagugcaccagaucuucggcaccgccuacgggguccucuucaguggcguguccuggaccaugaagaucgguaucggcgugcugcugacauggcucggccugaacagccgauccacgucguuguccaugaccugcauugccgucggacucgugacccuguacuuaggcgugaugguccaagccgacagcgggugcgugaucaacuggaagggccgggagcuuaagugcgggucaggcaucuucgugaccaacgagguccacacguggaccgagcaguacaaguuccaagcggauuccccgaaaagacucucugccgcgauaggcaaggccugggaggaaggaguaugcggcauccgguccgcgaccaggcuggagaacaucauguggaagcagaucagcaacgaacucaaccauauccugcuggagaacgacaugaaauucaccguggucgugggggacguggcuggcauccucgcccaggggaagaagaugauccggccccagcccauggaauacaaguacucguggaagaguuggggaaaggcaaaaauuaucggcgccgauguccagaacaccacguuuaucauugacgggcccaauaccccggagugccccgacgaucaacgagcguggaauaucugggagguggaagacuacggcuucgggaucuucaccaccaacaucuggcuaaagcugcgugacuccuacacccaggucugcgaccacagguuaaugagcgcggccaucaaggacuccaaggccgugcacgccgauaugggcuacuggaucgagagugaaaagaacgaaacauggaagcuggcucgggccuccuucaucgaggugaagaccugcauuuggcccaagagccacacccugugguccaacggcguauuggagagcgaaaugauaauccccaaaauuuauggcggcccuaucucccagcacaacuaccgccccggguacuuuacacaaaccgccggaccguggcaccuggggaagcuggagcucgacuucaaccugugcgaagguaccaccguggucguggaugagcacuguggcaaccgggggccgagcuugcgcacgacgacggucaccggcaagaucauccacgaguggugcugccggagcuguacgcugccgccacugcgcuucaagggggaggauggcugcugguacgggauggagauccggcccguaaaggaaaaggaggagaaccugguaaagagcauggucucggcaggcuccggcgagguggacagcuucucccucggguugcugugcauuagcaucaugaucgaggaagugaugaggagccgguggucucgcaaaaugcucaugacaggcacccuggcugucuucuuuuuacucaucauggggcagcugacuuggaacgaccugauccggcucugcauaauggugggcgcgaacgcauccgacagaaugggaaugggcacgaccuaccuggcgcugauggccacuuucaagaugaggccgaugcucgccguggggcuguuauuccgucgcuugacaagccgggagguacugcugcucacgaucggacugucccugguggcgagcgucgaacuccccaacucccuggaagaguugggcgacggucuggccaugggcaucaugauccugaaauuacucaccgauuuccagagccaccagcugugggcaacccugcucucgcugaccuucaucaagacgaccuauagcuugcacuacgccuggaagacaauggcgauggugcucucaaucgugucgcuguuucccuugugccucuccaccaccagccagaagacgaccuggcuucccguccugcuaggaucccuggggugcaagccucucacaauguuccucauagccgaaaacaaaaucuggggccgcaagagcuggccacugaacgaggguaucauggccgucggcaucguguccauccuacucuccagccugcugaagaaugacgucccucucgccgggccucuuauagccggcggcaugcugaucgccugcuacgugaucuccgggagcuccgccgacuuaagccuagaaaaagccgccgaagugucgugggaggaggaggcagagcacagcggcgcgucccacaacauacuuguagaggugcaagacgacgggacaaugaagaucaaagacgaggagcgagacgacacccugaccauccugcuaaaggcgaccuuacuggccgugagcggcgucuacccccugucaauacccgcaaccuuauucgugugguacuuuuggcaaaagaagaagcagcgcagcggcgugcugugggacacgcccucuccgccugaggucgaacgugccgugcuggacgacgggaucuaccggaucaugcagaggggauugcucgggcgcagccaagugggcguggggguguuccaggagaacguuuuucacaccauguggcaugucacccggggcgcagugcugauguaccaggggaagcgccuagagcccaguugggccagcgugaagaaggaccucaucaguuauggcggcggguggcggcugcagggcaguuggaacacuggagaggagguacaggugaucgccguggagccaggcaagaaccccaagaauguccagacagcccccgggaccuucaaaacuucggagggcgagguuggcgccauagcguuggacuuuaagcccggaacaaguggcagccccaucguuaaccgcgaagggaagaucguggggcucuacggcaacgggguggugacgacauccggcacguacgucucugcuaucgcgcaggccaaggcuucccaggaggggccccugccggaaauugaaaacgagguguuccggaagcgcaauuuaaccaucauggaccuccacccuggcagcggaaaaacgcgaagguaccugcccgccauuguccgagaagccaucaagcgaaagcuccggacgcucauacucgccccgacucguguaguggccucugagauggcugaggcccucaagggcaugcccauccgcuaucagaccaccgcugucaagagcgagcauacuggcaaggagaucguugaccucaugugccacgccacauucaccaugcgguuacugucccccguccgcgugcccaacuacaacaugaucaucauggacgaggcacacuucacugacccguccuccauagcggcccggggguauaucagcacccgggucggcaugggggaggccgcggcaaucuuuaugaccgcgacgccacccggcucgguugaggccuuuccccagucuaaugccguaauccaggacgaggagcgggauauaccagaaaggaguuggaacagcggguacgaguggaucacggacuuccccgggaagaccgucugguucgugcccuccauaaagagcggcaacgacaucgccaacugccuccggaagaacgggaagcguguuauacagcuuucccgaaaaaccuuugauaccgaguaccagaagacgaagaacaacgacugggacuacguggugaccacugacaucucggaaaugggcgccaacuuccgcgcugaucgggugaucgacccccgacggugccugaagccugucauccuaaaggacgggccugaacgcgugauccuagccggccccaugccuguuaccguugccucugccgcgcagcggcgcgggcggaucggccgcaaccacaacaaggagggcgaucaauacaucuacauggggcagccgcuaaacaacgacgaggaucacgcccacuggacugaggccaagaugcuacuggacaauaucaacacgccagagggcauuauuccggcguuauucgagcccgagcgggagaaguccgccgccauagacggggaguaccgccuccgcggggaggcccggaagaccuucgucgagcugaugcgccgcggcgaucucccggucuggcucucuuacaagguggccuccgaaggcuuccaauacagcgaccgucgguggugcuucgacggagagcgcaacaaccaggugcuggaggagaacauggacgucgagauuuggacaaaggagggggaacggaagaagcugcgcccccguugguuggacgcccguacguacuccgacccauuggcccugcgggaguucaaagaguucgcggcuggccgccgguccguguccggggaccucauccuggagaucggcaagcucccccaacaccucacccagcgcgcccagaacgcgcucgacaaccuggugaugcuccauaacuccgagcagggugggcgggcguaccgacaugcuauggaagaacugccggacaccaucgaaacccugaugcuccuggcccuaaucgccgucuuaacgggaggggugacccuguucuuucugucuggccggggucucggcaagaccagcauuggccuacugugcguuauggcguccagcguccuccuauggauggcgaguguggagccccacuggaucgccgccucgaucauccuggaguucuuccucauggugcuacugauccccgagccggaccgccagcggaccccgcaggacaaccagcucgccuacgucgugaucgggcugcucuuuaugauacucacaguggccgcgaacgagaugggcuuacuugagaccaccaagaaggacuuagggaucggccacguggccguagagaaccaccaccacgcagccaugcuggacguggaccugcaccccgccuccgcguggacccuuuacgccgucgccacgacaaucaucacccccaugaugaggcauacgaucgagaacacaacggccaacaucagccugacugcgaucgcgaaccaggcagcgauucuuauggggcuugacaagggguggccgaucuccaagauggauauaggcgucccccugcuggccuuagguugcuacagccaggugaacccccugacccugaccgcugccguacucauguugguugcccacuacgcuaucaucgggcccggcuugcaggccaaggcgacgcgggaagcccaaaagcgcaccgccgccggcaucaugaaaaauccgaccguggacgggaucguggccaucgaccucgacccgguuguguacgacgcuaaguucgagaagcagcugggccagauaaugcuucucauccugugcaccucccaaauucugcugaugcgcacgaccugggcccugugcgagaguaucacccuggccacaggcccccuaacgacccugugggaggggucccccggcaaguucuggaacaccaccaucgcagucagcauggccaacaucuucaggggcagcuaucuggccggcgccggccucgccuucucccugaugaagucacucggaggagggagacgggggacgggugcccagggcgagacccucggcgagaaauggaagagacagcugaaccaacuguccaagagcgaguucaauaccuacaagcgguccggcauuauggagguggaccgauccgaggcuaaggaggggcucaagcgcggggaaaccacgaaacacgccguaucccgcggcaccgccaagcugcgaugguucguggagcgcaaccugguuaagccggaggggaaggugaucgaccuuggcugcggccgcggaggguggaguuacuauugcgccgggcuuaagaagguaacugaggucaagggguauaccaagggcgggcccggccacgaggaacccauacccauggccacguacggauggaaucugguaaagcuccacucggggaaggacgucuuuuucaucccgcccgagaagugcgacacgcuucugugcgacauuggcgagagcucccccaacccuaccaucgaggagggacggacccugcgggugcucaaaaugguugagccguggcuccgcgggaaccaguuuugcauaaagauccugaaccccuacaugcccagcguuguggagacgcucgagcagaugcagcggaagcauggcggcaugcuggugcggaacccccugucucgcaacucuacccacgagauguacuggguaucuugcgggaccgguaacauugugagcgcgguuaacaugaccagucguaugcuccugaauagauucacaauggcacaccgcaagccgacguacgagaaggauguggaccugggugcaggcacccgccacguggcaguggagcccgaggucgccaacuuggacaucaucggccagcgaauagagaacauaaagcacgagcacaaauccaccuggcacuacgacgaggacaaccccuacaaaaccugggccuaccacgggagcuacgaaguuaagcccagcggaagcgccuccagcaugguaaacggggucgugaagcugcugacuaagccgugggaugucauucccauggugacccaaauagccaugaccgacacaacccccuucggccagcagcgcguauucaaggagaaggucgacacccggaccccuaaagcuaagcgugggaccgcccagaucauggaagugacggcgaaguggcucuggggcuuucugucccggaauaagaagccgcgcaucugcacacgggaggaguucacgcgcaaaguacggagcaacgccgccaucggcgcggucuucgucgacgaaaaucaauggaacucggccaaggaagcaguggaagacgagcgcuucugggacuuaguucaccgggagcgcgagcuccauaaacaagguaagugugcgacgugcguguacaacaugauggguaagcgagagaaaaagcugggugaguucggcaaggccaagggcucccgcgccaucugguacaugugguuaggcgcgcgcuuucuggaguucgaggcccuggguuucaugaacgaggaccacugguucucccgcgaaaacagccuuucggggguggagggcgagggucuccauaaauuaggcuacauccugcgugacaucagcaagauccccggagggaacauguacgccgacgacacugccggcugggacacgcgcauaacagaggacgaccuccagaacgaagcgaagaucaccgacaucauggagcccgaacacgcccugcuggccaaaucaaucuucaaacucacguaccaaaauaaaguagugaggguucagcgcccugccaagaacgggaccgucauggacgugaucucacgccgcgaccagcgcggcuccggccaggugggaaccuacggccugaauaccuucacgaacauggaggcccagcuuauccggcagauggagucugagggcaucuucucccccagcgagcucgagaccccgaaccuggccggccgaguccuggacuggcucgagaagcauggggucgagcggcuuaaacggauggccaucucuggcgacgauugugugguaaaacccauugaugaccgguucgcgaccgcccugaccgcacucaacgacauggggaaggugcgcaaggacaucccgcagugggaacccagcaagggcuggaacgacuggcagcagguccccuuuugcagccaucauuuccaccagcugaucaugaaggacggccgggagauagucguaccgugccggaaccaagacgagcugguagggcgugccagagucucccagggcgcaggcuggaguuuacgggagacggccugccugggcaaguccuacgcccagauguggcagcugauguauuuccaccgccgggaccuccgccuggccgcgaacgccaucuguagcgcgguaccgguagauuggguccccaccucccggacgacauggagcauccaugcacaccaccaguggaugacgaccgaggacauguuguccguguggaaucgcguguggaucgaggagaaccccuggauggaagacaagacccacaucagcucuuggggcgauguccccuaucugggcaagcgggaagaccagugguguggcagccugaucggguuaaccgcccgcgcgacgugggccaccaacauccagguggccauaaaccaagugcggcgcuuaaucggcaacgagaauuaucuggacuacaugacaucaaugaagcgauucaagaaugagucggacccggagggggcucuaugguga

SEQ ID NO: 24223 - RNA, 9879 nt, Artificial Sequence
  derived and/or modified CDS sequence (opt11) from DENV-1__FJ410249__SS-prME
ucgguuacgaugcugcuuaugcugaugccuaccgcccuagccuuccaccucacgacccgagggggagagccccacaugaucguaagcaagcaggagcggggcaagagccuguuguucaagaccagcgcugggguuaacaugugcacccucaucgccauggaucugggugaguucugugaggacacgaugaccuacaagugcccccggaucacugaggccgagccugacgacguggacugcuggugcaacgccaccgacacgugggugacauacgggaccuguagccagaccggugagagacggcgggacaagcgcuccguggcccuggcgccccacgugggccuagggcuggagacgcggaccgaaaccuggaugagcuccgagggcgccuggaagcagauccagagggucgagacgugggcccugcggcaucccggauucacgguaauagcacucuuccuggcgcaugccaucggcaccucaaucacccagaaagggaucauuuucauccugcucaugcuugugacccccuccauggccaugaggugcgucggcgucggaagccgggacuucguggaggggcuguccggggccacgugggucgacguagugcucgaacacggaagcugugucaccaccauggcaaaagacaagccgacccuggacaucgagcugcucaagacggaagugaccaaccccgcgguucugcgcaaguuaugcaucgaggccaagauauccaacaccacaacggauaguaggugcccgacucagggcgaggccacccucgucgaggagcaggacgccaacuucgugugccgcagaaccuuuguggacagaggcugggggaacggcugcgggcuguucgggaaggguuccuuaaucacaugcgccaaguucaaaugcgucaccaagcucgaaggcaagacagugcaguacgagaaucugaaguacagcgugaucgucaccgugcacacgggcgaccagcaccagguggggaacgagucaacugaacacggcacuaccgcgaccaucacgccccaggcccccagcaccgagauccagcugaccgacuacggcgccuugacccuggauugcagcccucggacgggcuuggauuucaaugagaugguuuugcugacaaugaaggagaaguccuggcuggugcauaagcagugguuucucgacuugccgcuacccuggaccucgggggccagcaccagccaagaaacguggaaccgcaaggaccuccugguaacguucaagaccgcccacgcgaagaagcaagaagugguggucuuaggcucccaggagggcgccaugcacacagcccucacgggggccaccgagauccagacguccggcacgaccaccaucuucgccgggcaccugaaaugccggcugaagauggauaagcuaacccugaaggggaugagcuacguuaugugcaccggcagcuuuaagcuggagaaagaaguggcggaaacgcagcacggaaccgugcuugugcagauaaaguaugagggcaccgacgccccgugcaaaauccccuucuccacccaggaugagaaggguguuacccagaacggccgccuaaucaccgcgaacccgaucgucaccgauaaagagaagcccgugaacauagaggccgagccgcccuucggggagagcuacaucgucauuggcgcgggagagaaagcacugaagcuguccugguucaagaaaggaucauccauaggcaagauguucgaggccaccgcacgcggugcccgccgcauggcgauccucggagacacggccugggacuucgggagcaucggcgguguguucaccuccguggggaagcuggugcaccagaucuucggcgccgcguacgggguccuguucagcgguguguccuggacuaugaagauugggauuggcguucuccugaccuggcugggucuaaacagccgguccacaagccuguccaugaccuguaucgccgucgggcuggugacguuauaccuuggcgucaugguucaggcggacucggguugugucaucaacuggaagggccgcgagcugaagugcgggagcggcaucuuugugacuaacgagguccacacguggaccgagcaauauaaguuucaggcagacuccccuaagcggcucagcgccgcgaucggcaaggccugggaagagggggugugcggcauucgcucugcgacccggcuggagaacaucauguggaagcagaucagcaacgagcucaaccacauccuccuggagaacgacaugaaguucaccguuguagucggggacguggccggaauccuggcacaggggaagaagaugauccgcccccagcccauggaguacaaguacagcuggaaguccugggggaaggccaagaucaucggcgcggacguccagaacaccacguucaucaucgaugggcccaacaccccugagugcccugacgaccagagggccuggaacauaugggaagucgaggacuacggcuucgggaucuucacgaccaacaucuggcucaagcugagggacuccuacacccaggugugcgaccaccgucuuaugagcgccgccaucaaggacuccaaggccguucaugcagauaugggauacuggaucgagagcgagaagaacgagacguggaagcuagcccgcgccuccuucaucgaggugaaaaccugcaucuggcccaaaagucacacccugugguccaacggcguccuggagucggagaugaucauccccaagaucuaugggggcccgaucucgcagcacaacuaccgacccggguacuucacgcagaccgcaggccccuggcaccucgggaagcuggagcuggacuucgaucucugcgaaggcaccaccgucgugguggacgagcacugcggcaaccgcgggccgagccugcggacgaccacugucaccgggaagaucauccaugaauggugcugccguuccuguacgcugccgccccugcgguucaaaggugaggauggcugcugguacgggauggagauccgccccgugaaggagaaggaggagaaccuagucaagucuaugguaagcgccggcuccggcgagguggacagcuucagccugggucuccugugcaucagcaucaugaucgaggaggugaugcggucccgcuggagccggaagaugcugaugaccggcacccuagcggucuucuucuuucuaaucauggggcagcugaccuggaacgaucucauccgccugugcaucauggugggcgcgaacgccuccgaccgcauggggaugggcacgaccuaucuggcccucauggccacguuuaagaugcggccgauguucgcgguagggcugcuguuccgccggcucaccagccgcgaaguacuacuguugacgaccgggcugucccugguggccagcgucgagcuccccaacucccuggaagaacugggcgaugggcucgccaugggcaucaugauccugaagcugcuuaccgacuuucagagccaccagcugugggcgacccugcucucccugacguucauuaagaccaccuucagccugcacuacgcguggaagacgauggccauggugcucuccaucguaucacuguucccccuaugccucucaacgaccucgcagaagaccaccuggcugcccguccugcucggcucccugggguguaagccgcucacaauguucuugauugcggagaacaaaaucuggggccgcaaaagcuggccccugaacgaagggaucauggccguggguaucgugagcauccugcucuccagccugcugaagaacgacgucccccucgccgggccacuaaucgcaggcggcauguugaucgcuuguuaugugaucuccgggagcucggcugaccucucacuggaaaaggccgccgagguguccugggaggaggaggcggaacacagcggcgcgucccauaacauuuuaguugaggugcaagacgacgggaccaugaagauaaaggacgaagaacgcgacgacacccuaaccauccugcuaaaggccacccuccuggccgugagcggagucuauccgcuguccauccccgcaacccucuucgugugguacuucuggcagaagaagaagcagcggucaggggugcucugggacacccccagcccgcccgaaguagagcgagcaguucuggacgacggcauuuaccggaucaugcaacgcggucuccucgggcggagccaggugggcguugggguguuccaggagaacguauuccacaccauguggcaugucacccgcggcgcuguguuaauguaccaggggaaacgacuggaacccuccugggcuucggugaaaaaggaccucaucagcuacggcggcggguggaggcugcagggcaguuggaacacgggggaggagguccaggugaucgcuguggagcccggcaagaaccccaaaaacguucagaccgcccccgggaccuucaaaaccuccgagggcgaggugggcgcgaucgcccucgacuucaagcccgggacgagcggcagucccauagugaaccgcgaggggaagaucgucggccucuacggcaacgggguugugaccacaucgggcacuuacgucagcgccauugcccaggcgaaggccucccaggaggggccccugcccgagaucgaggacgagguguuccgcaagcggaaucucacaaucauggacuuacacccgggcagcgggaagacccgccguuaccugccagccaucgugcgcgaggccaucaagcggaaacugcggacccucauccuggcucccacucgcgugguggcgucagagauggccgaagcacugaaggguaugcccauucgguaccagacgaccgcggucaaaagcgagcacaccggcaaggagaucgucgaccucaugugccacgccacguucacgaugcgccuccugucccccgugcggguacccaacuacaacaugaucaucauggaugaagcgcauuucaccgacccgagcucuaucgccgcccgcgguuacauaagcacacgggucggcaugggggaggcggccgcgaucuuuaugaccgccacgccgcccggcuccguggaagccuucccccagagcaacgccgugauccaagacgaggagcgagacaucccggaaagauccuggaacagcggguaugaguggaucacugacuuccccggcaagaccgucugguuugugccguccauuaagagcggcaacgacauugcgaacugccucagaaagaacgggaagcgcgugauccagcugucccgcaagaccuucgauacagaguaccagaagaccaagaacaacgacugggauuacgucgugacaacggacaucagcgagaugggcgccaacuuccgggccgaccgcgugauugauccccggcgcugccugaagccggucauccucaaggacgggcccgagcgggugauccuagccggucccaugcccgucacuguagccuccgccgcccagcgccggggucguauaggccggaaccauaacaaagaaggcgaccaguacaucuacaugggccagccacugaacaaugacgaggaccacgcgcacuggaccgaggccaagauguugcuggacaauaucaacacccccgagggcauuaucccugcccuauucgagccggagcgcgagaagucagcggccauugauggggaguaccgcuuacggggcgaggccagaaagaccuucguggagcugaugcggcgcggggacuugccagucuggcuuucuuacaagguggccuccgagggcuuccaguauagcgacagacgcuggugcuucgacggcgagcggaacaaccagguacuggaggagaacauggacgucgagaucuggacgaaggagggagagcguaagaagcuacggccccgcuggcucgacgcgcggacauacuccgaccccuuggcccugagagaguucaaagaguucgccgccggcagacgcagcguguccggugaucucauccuggagaucggcaagcugccccagcaccucacccagcgggcccaaaacgcgcuugacaaccuggugaugcuccacaacagcgagcagggcgggcgcgcauaccggcaugccauggaggaguugccggacaccaucgagacgcugaugcuccuggcccugaucgccguccucacgggcggggugacgcuguuuuuccucuccggacgcgggcucgguaagaccagcaucggccuccugugcguuauggcguccucuguccuccuguggauggccucaguugagccgcauuggaucgccgcauccaucauccuggaguucuuucucauggugcugcugauccccgagcccgaccggcagaggaccccgcaagacaaccagcucgcuuacgucgugaucggucugcuguucaugauccucacgguggcggccaacgagaugggccuacuggagaccacuaagaaggaccuagggauuggccacgucgccguagagaaccaccaccacgccgccaugcuggacguagaccugcaccccgcguccgccuggacccucuacgccguggccacgacaaucauuacccccaugaugcggcacaccaucgagaacacgacugccaacaucagucuuacagcgauugccaaccaggccgccauccugaugggucuggacaagggcuggccgaucucuaagauggacaucggcgugccccugcuggcguuagggugcuacagccaaguuaauccccugacccugacggcagcaguccucaugcugguggcccacuacgccauaaucggccccgggcugcaggcgaaggccacccgcgaggcccagaagcguaccgccgccggcaucaugaagaauccgaccguggacggaauugucgcgauugaccucgauccugugguguacgacgccaaguucgaaaaacagcugggccaaaucauguuacucaucuuaugcacgucccagauccugcucaugcggacaaccugggcccuaugcgagagcauaacccuggccacaggcccccucaccacccuaugggaggggucccccggcaaguucuggaacacgacgauugccguuagcauggcgaacaucuuccgcgggucauaccuugccggagccggccucgccuucucccugaugaaguccuuagggggagggcggaggggcaccggggcgcagggcgaaacucucggcgaaaaguggaagcggcagcucaaccagcuguccaagagcgaguucaacaccuacaagcgcuccgggaucauggagguggaccggagcgaggccaaggagggccucaagcgcggggagacuaccaaacacgccgugagucggggcaccgcaaaacuucgaugguucguagagcggaaucuggugaagccggagggcaaggugaucgaccuuggcugcggccgaggcggcuggagcuacuacugcgccgggcugaagaaggucacggaggugaaaggcuacacgaaaggcggccccgggcacgaggaaccaauccccauggcaaccuacggguggaaccugguaaagcugcacucggggaaggacgucuucuucaucccgccugagaagugcgacacgcuccugugcgacaucggggagagcucucccaaucccaccauugaggagggccggacgcugcgcguacucaagauggucgagccuuggcuccgcggaaaucaguucugcaucaaaauccugaauccguacaugcccucugucguggagaccuuagagcagaugcagcgcaagcacggcgggaugcucgugcggaacccccugagccgcaauagcacccacgagauguacugggucuccugcgggaccggcaacaucguguccgcugugaacaugaccucccggaugcuccugaaccgcuucacgauggcccaccgcaagccgaccuacgagcgagacgucgaucugggggccggcacccgccacguggccguagagccggaagucgcgaaccucgacauaaucggccagcggaucgagaacaucaagcacgaacacaagagcaccuggcacuacgacgaggacaaccccuacaaaacgugggccuaccacggaaguuacgaagugaaacccucgggcagcgcauccagcauggucaacgggguggugaagcugcugaccaagccgugggacguaauccccauggugacucagauugccaugacagacacgacccccuucggucagcagcguguauucaaggagaaggucgacacccggaccccgaaggccaagcgcgggacggcgcagaucauggaggugacggccaaguggcuauggggcuuccuaucuagaaacaagaaaccgcgcaucugcacgcgagaagaguuuacccguaaggugcggagcaacgccgcaaucggcgcggucuucguggaugagaaccaguggaacucugcgaaggaggccguggaggacgagcgcuucugggaccugguccaccgggagcgcgagcuccacaagcaggggaagugcgccacgugcguguacaacaugaugggcaagcgugaaaagaaacuuggggaguucggcaaggcgaaggggagccgugcgaucugguacauguggcugggcgcacgguuccuagaguucgaggcccuaggcuucaugaacgaagaccauugguucucccgcgagaacucccuguccgggguggagggugaggggcuacacaaguugggcuacauccugcgggauaucagcaagauccccgggggcaacauguacgccgacgacaccgccgggugggauacccgcaucaccgaagaugacuugcaaaacgaggcgaagaucacggauaucauggaaccugagcacgcccugcuggccaaguccaucuucaagcucaccuaccagaacaaggucgugagggugcagcgcccggccaagaacggaaccgucauggacgugaucagcagacgagaccagcgcggguccggccagguuggcaccuacggccuaaauaccuucaccaauauggaagcccagcugauccgacagauggagagugaggggaucuucucccccagcgaacucgagaccccgaaucuugccggacgcguccuggacuggcucgagaaacacgggguggagcggcuuaaacgcauggccaucuccggcgacgacugcguggugaaaccgaucgacgaccgguucgccacugccuugacggcccucaaugacauggggaaggugcgcaaggacgugccgcagugggagcccagcaagggcuggaaugacuggcaacaggugcccuucugcagccaucacuuccaucagcugaucaugaaggacggccgggagaucguggugccuugccgcaaucaggacgagcugguaggucgggcgagagugucacagggcgcgggguggagccucagagagaccgcgugccuggggaaguccuacgcccagauguggcagcugauguacuuccaucgacgggaccuccgccuggcggccaacgccaucugcagcgccguaccggucgacugggucccaaccucccggaccacguggagcauccacgcccaccaucaguggaugaccacggaggacaugcuguccgucuggaaucgcgucuggaucgaggaaaacccguggauggaggacaagacccacauaagcucuuggggcgauguacccuaccucggcaagcgggaggaccaguggugcggcagccugauaggacugacggcgcgcgcgacgugggccaccaacauccaaguggccaucaaccagguucgccggcucauuggcaacgagaauuaccuagacuacaugaccagcaugaagcgcuucaagaacgagagcgacccggaaggcgcccugugguga

SEQ ID NO: 24224 - RNA, 9879 nt, Artificial Sequence
  derived and/or modified CDS sequence (opt11) from DENV-1__FJ410251__SS-prME
ucggugaccaugcuucugaugcuaaugccuacugcgcuggcuuuccaucuuaccaccaggggcggggagccccacaugaucgugaccaaacaggagcggggcaagagccuccuguucaagaccagcgccggggugaacaugugcacccucauugccauggauuugggugagcucugcgaggacaccaugaccuacaaguguccccggaucaccgaggccgagcccgaugacguggacugcuggugcaacgccacugacaccugggugaccuacgguaccugcagccagacgggcgagcaccggcgcgauaagcggagcguggcccucgcaccccacguggggcuggggcuggagaccagaaccgagaccuggauguccagcgagggugcuuggaaacagauacagcgcgucgagaccugggcccuccgccaccccggguucaccguuaucgcccuguuuuuggcucacgccauugguacguccaucacccagaagggaauaaucuucauccuucugaugcugguaacgcccagcauggcuaugcgaugugucggcaucgguucccgugacuucgucgaggggcucagcggcgcaaccuggguggaugucguucuggagcacggguccugcgugaccaccauggccaaggauaagccuacgcuggauaucgaguuauugaagacggaggucacuaacccggcgguguugcggaagcucuguaucgaggcuaaaaucaguaacacaacgaccgacucccggugccccacccagggcgaggcgaccuugauggaggagcaagacgccaacuucgugugccggcgcacguucgucgaccgaggcuggggaaacggcugugggcuguucggcaaagggagccucauuaccugugcuaaguucaagugcgugaccaagcuggaggggaagauugugcaguacgagaaccugaaauacuccgugaucgugacgguacacaccggcgaccagcaccaagucgggaacgagagcaccgagcacggcacuacugcgacaaucacgccccaggcucccacuuccgagauccagcugaccgacuauggggcccucaccuuagacugcagcccccgaacgggccuggacuucaacgagaugguccuacugacuaugaaggagaaguccuggcucguccauaagcagugguuccuggaccugccccugccuuggacgagcggggccagcacgucccaggagacguggaaucggcaggaccuguugguuaccuucaagaccgcccacgcgaagaaacaggagguggucguccucggcagccaggaaggcgccaugcacaccgcccugacgggggccacagagauacagaccuccggcacgacgaccauuuucgcuggccacuuaaagugucgccucaagauggacaagcugacccugaaaggcaugagcuacgugaugugcaccgggucauucaagcucgaaaaggaaguagcggagacgcagcacggcaccguccuggugcaaaucaaguacgagggcaccgacgcccccugcaagauucccuucucgacccaggacgagaagggggucacgcagaaugggagacugaucacugcaaauccgaucgucaccgacaaggagaagcccguaaacauagaagccgagccgcccuucggggaguccuacaucgucaucggcgcgggugggaaagcccugaagcucagcugguucaagaaaggguccagcaucgggaaaauguucgaggcgaccgcgcggggcgcccggagaauggcaauccugggggauacggccugggacuuuggcuccgugggcgggguauucacaucgguuggcaagcuggugcaccagaucuuugggaccgccuauggcguccuguucuccggcgugucuuggaccaugaagaucggcauuggcguucugcugacguggcucgggcugaacucccgcagcaccucccugagcaugaccugcaucgccgugggacucgucacccuguaccugggcgugaugguucaggcugauuccggcugcguaaucaacuggaaggggcgggaacuuaaaugcggauccggcaucuucgugacaaaugaagugcauaccuggaccgaacaguauaaauuccaggcggauucuccaaagcggcuguccgccgcaaucgggaaagcaugggaggagggcguaugcgggauccggagcgcgacccgucuggagaauauaauguggaaacagaucuccaacgaacuaaaccauauccuucuggagaacgacaugaaguucaccguggucgucggcgacgucguggggauccucgcucaaggcaagaagaugauacggccgcaaccuauggagcacaaauacagcuggaaguccuggggcaaggccaagauuaucggggccgaugugcagaacacgaccuucaucaucgacggccccaauacaccggagugucccgacgaccagcgugccuggaacaucugggagguggaagacuacggauucgguauuuucaccacgaacaucuggcugaagcugagggauucuuacacccagguuugcgaccaccgucucauguccgcggccaucaaagacagcaaggcuguccacgccgauaugggauauuggaucgaauccgaaaagaacgagacuuggaaacuugccagagcgagcuuuauagaggugaagaccugcaucuggcccaagucccacacgcuguggucaaacggcguacucgagucggagaugaucauccccaagauauauggcgggccgaucagccagcacaacuaucgccccggauacuucacgcagaccgccgggcccuggcaccugggcaaguuagagcuugacuuugaccuuugcgaggguaccacggucguuguggacgagcacugcgggaaccguggcccuucgcugaggaccaccaccgucaccgggaagaucauccacgaguggugcugucggagcugcacauuaccgccucuccgcuucaaaggcgaagacggguguugguauggcauggagauccggccggugaaggagaaggaggagaaccuugugaaguccauggucagcgccggcucgggggagguggacuccuuuucucuugggcugcuguguauuuccauaaugaucgaggaggugaugcgcagccgguggucccgcaagaugcucaugaccggaacccuagccgucuuccugcuccugaucaugggccaacugaccuggaacgaccucauucgucucugcaucauggugggggcaaacgcuucggaccgcaugggcaugggaaccaccuaccuggcccucauggccaccuuuaagaugcgcccgauguucgccgugggucuccuguuccggagacugacgagucgggagguuuugcuacuaaccaucgggcucagucugguggccuccgucgaacucccuaacucgcuggaggagcugggggaugggcuggcgauggguaucaugauccugaagcuccucaccgacuuccagagucaccaguuaugggccacccugcucagccugacguucaucaaaaccacucuuucccuucacuacgccuggaagaccauggcaauggugcugagcaucgugagccucuucccgcucugucucagcaccaccagucagaagaccacguggcugccgguccucuuggggucccugggcuguaagccucucacgauguuccuaaucacagagaacaagaucuggggacguaaguccuggccucugaacgagggcauuauggcgguggguguugucucaauucuccugagcucccugcucaagaacgacguaccccuggccggcccacugaucgcgggcggcaugcugaucgccuguuacgugaucagcggcuccucggccgauuugucccuggagaaggcggccgaaguuagcugggaggaagaagccgagcacucaggggccagccauaacauccuugucgaggugcaggaugauggcaccaugaaaaucaaggaugaggagagagaugacacccugaccauacuccucaaggccacguuacuggccgucuccggcgucuacccguuaagcauccccgcaacccuguucgugugguacuucuggcagaagaagaagcaacgcuccggcguccugugggacaccccgaguccacccgagguggaacgagccguacuagacgacggcaucuacaggaucaugcaacgggggcuccucggacggucgcaagucggugugggcguguuccaggaaaacgucuuccacaccauguggcacgugacgcgcggggccgugcugauguaccagggcaagcgccuggagccaucaugggccagcgucaagaaagauuuaaucaguuauggagggggcuggcggcuucaggggucguggaauaccggcgaggagguccaagugauagcgguagagccgggaaagaacccgaagaaugugcagaccgcccccggcaccuucaagacgccugagggcgagguaggggccaucgcccucgacuucaagccuggcaccuccggguccccaauagucaaccgcgaaggaaagaucgugggccuguacggaaacgguguggucacuaccaguggaacauauguuuccgcgaucgcgcaggccaaggccucacaagaaggcccguuaccggagauugaagacgaaguguuccguaagcgcaaccuuacaauuauggaucugcaccccggcucuggcaagacgcgccguuacuugcccgccaucgucagggaagccaucaagcgcaagcuccggacucugaucuuagccccuacccgcguaguggccagcgagauggcggaggcacucaagggcaugcccauucgcuaccaaacuacagcagucaagagcgaacacacugggaaggaaauaguggacuuaaugugccaugccacguuuaccaugcgacugcuuuccccggugcgagucccgaacuacaacaugaucaucauggacgaggcucacuucaccgaucccagcucgaucgccgcccggggcuacaucagcacccgcguuggaaugggugaggcggcagcuaucuucaugacggcaacaccgcccggguccguggaggcuuucccgcaaagcaacgcgguaauccaagacgaggagcgggacauccccgagcguuccuggaacuccgguuacgaguggaucaccgacuuucccggcaagacugucugguucguucccucgaucaaaagcgggaaugacaucgccaacugucugagaaagaauggaaagcgcgucauccagcugucgcggaaaacguucgacacagaguaccaaaagaccaagaacaacgacugggauuacgugguaaccacggauauuagcgagaugggagccaacuuccgcgccgacagaguaaucgauccuaggagaugccucaagccugugauccugaaggacgggccagagagagucauccuagcggggccuaugccggugaccguggccagugccgcccagcggcgcggucggaucggccgcaaccauaacaaagagggcgaccaguacaucuacaugggccagccucugaacaacgacgaggaccacgcccacuggaccgaggcuaaaauguugcuugacaacauuaacacaccagaggguauaaucccugcccucuuugagccggagcgggagaagagugccgcuauagauggcgaguaccgccuacguggagaggcccggaagacguucgucgaguugaugcgccggggagaccucccugucuggcugucguauaaaguggcgagcgaaggcuuccaguacagcgaccggcgguggugcuucgacggcgagcgcaacaaucagguccuggaagagaauauggacguugagaucuggaccaaggagggcgagcguaaaaagcuacguccgcgguggcuggaugcccgcacuuauucggacccacuggccuuacgggaguuuaaggaauuugccgccgggcgccggagcguguccggcgaccuuauccuugagauaggcaagcucccccaacaccugacccagcgcgcacagaaugcccuugacaaccuggugaugcugcauaauuccgagcagggcggacgggcauaccgccaugccauggaggagcugccagacacgaucgaaacccucaugcuguuggcgcuuaucgcugugcuuaccgggggcgugacccuguucuuccuaucagggcggggucugggcaagaccuccaucgggcugcucugcgucauggcuagcucuguccugcuguggauggccuccguggagccucacuggauagccgcgagcaucauccucgaguucuuccugaugguccugcucauaccggagccggaccgccaacguacgccccaagauaaccagcuggccuauguggugaucgggcuccuauucaugaucuuaacagucgccgcgaaugagaugggccugcucgagacgaccaagaaggaccugggcauaggacacguggccguggagaaccaccaucaugcgacgauguuagacguggaccuccaucccgccuccgcguggacccuguaugccguggccaccaccaucauuacgccgaugaugcgccacaccaucgagaauacgacagcgaauauaagccugaccgcuaucgccaaccaggccgccauccucauggggcucgauaagggcuggccgaucuccaaaauggacaucggcgugccccuucucgcacugggcugcuauagccaggucaacccucugacacuuaccgccgccgugcugaugcugguggcccacuaugcgauuaucggaccgggacugcaggcaaaagccacccgcgaggcucagaagcgcacagccgcggguaucaugaagaaccccacagucgacggcaucguggcaauagaccuggaccccguggucuacgacgcuaaguuugagaagcagcugggccaaauuaugcuccucauccuaugcaccagccagaucuuacucaugcgcaccacgugggcccugugcgagucaauuacccuggcaaccggcccccugaccacgcuaugggagggcucgccggggaaguuuuggaacaccaccaucgcggucagcauggccaacaucuuucgaggcuccuaccucgccggcgccggccucgccuuuucccugaugaagagucuaggcgggggccgccguggaacuggggcgcagggggagacacugggugagaaguggaaaagacaacugaaccagcuguccaagagcgaguucaacaucuacaagagauccgguaucauggaaguggaucgauccgaggccaaggagggacucaagagaggggaaacgacccgccaugccgucagccgggggacugccaagcugcgcugguucguagagcggaaccuagucaagcccgaaggaaaggucauagaccuaggcugcgggcgcgggggcuggucguacuacugcgcgggccugaagaaagugacggaaguaaagggguacacgaagggcggacccgggcacgaggagcccaucccgauggccaccuacggcuggaaccuggucaagcugcauuccggaaaagauguguucuucacuccgcccgaaaagugcgacacgcugcucugugauaucggcgagaguucccccaacccgaccaucgaagagggccggacucuccgcgugcucaagaugguggagcccugguugcggggcaaucaguucuguauaaaaaucuugaauccauauaugcccucagucguggagacgcuagagcagaugcagcguaaacauggcgggaugcugguccggaaccccuuaucccgcaacagcacccaugagauguauugggucucaugcggcacggguaacaucgugagcgccgucaacaugaccucacggaugcuccucaaucgcuuuaccauggcccaucgcaagcccaccuaugaacgcgacguagaccuaggcgcuggaacgagacacguggcggucgagcccgaaguggccaaccucgacaucaucgggcagcggaucgagaacauuaaacacgagcauaagagcaccuggcauuacgaugaggacaacccguacaaaacaugggccuaccacggcucguaugaggucaagccaagcgguuccgcaagcaguauggugaacggcgucgucaaguuacuuaccaagcccugggacgugauccccauggugacgcagauugccaugaccgacaccaccccuuucgggcaacagcgcguguucaaagaaaagguggacacacggaccccgaaggcgaagcggggcaccgcucaaaucauggagguaaccgcccgguggcuguggggcuuucugucccgcaauaaaaagccccggaucugcacuagagaagaguucacccggaagguccgcuccaacgccgccaucggggcgguguucguggacgaaaaccaauggaacuccgccaaggaggccgucgaggacgagcgauucugggacuuaguccaaaaagagcgcgaacuucacaaacagggcaagugugcgaccugcguguacaacaugauggggaagcgggagaagaagcugggcgaguucgggaaggccaagggcagcagggcaauaugguacauguggcuaggcgcccgguuccucgaguucgaggcccugggguucaugaacgaggaucacugguucucccgcgagaacucccucucgggcgucgagggcgaaggcuugcauaaacugggguacauccuccgggauauaagcaagauaccgggcggcaacauguacgcggacgauaccgcggggugggacacgcguaucacugaggacgaccugcaaaacgaagccaagauuaccgauauaauggaaccggagcacgcacuucucgccacgucaaucuucaagcugaccuaccaaaacaagguggugcggguccagaggcccgcaaagaacggcaccgugauggacgugaucagccgccgggaccagcggggaagcggccaggucggcaccuacgggcugaacaccuucaccaacauggaggcgcagcucauuaggcagauggagagcgaggguaucuuccuucccuccgaacuggagaccccgaaccucgccgagcgcgugcuggacuggcuggagaaguacgggguggagcgcuuaaagcgcauggccauaagcggcgacgacugcgucgugaagccgaucgacgaucgguucgccacggcacugaccgcgcugaaugauauggggaaggugcguaaggauaucccccagugggagcccuccaagggcuggaacgacuggcagcagguccccuucugcagucaucacuuucaccagcucauuaugaaagacggccgggagaucgucguuccaugccgcaaccaggacgagcuggucgggcgagcgcgcguuucccagggcgcagggugguccuugcgugagacggccugccugggaaaguccuaugcccagauguggcagcugauguacuuccaccgccgggaccuuagacucgcggccaacgccauaugcagugccgugccggucgauugggugccuaccucacgcaccaccugguccauccacgcacaccaccaauggaugacgaccgaagacauguugucaguguggaaccgcgucuggaucgaggaaaaccccuggauggaggacaagacgcauguauccagcuggggcgacgucccguacuuggggaaacgggaggaccaguggugcggcucccugaucgggcugacagcccgcgcgacuugggccucuaacauccagguugccaucaaucaggugcgccgauugaucgguaaugagaacuaccucgacuacaugaccuccaugaagcgcuucaagaacgagggggaccccgagggcgcgcugugguag

SEQ ID NO: 24225 - RNA, 9879 nt, Artificial Sequence
  derived and/or modified CDS sequence (opt11) from DENV-1__FJ410252__SS-prME
ucaguaacaaugcugcugaugcugaugccuaccgcucuggccuuucaccucaccacucggggaggggaaccccacaugauuguguccaagcaggaacggggcaagucucugcuguucaaaaccuccgccgggguuaacaugugcacccuuauagccauggaccucggcgaguucugcgaagacaccaugaccuacaagugcccucgcaucacggaggccgagccugaugacguggacugcugguguaacgccaccgauaccugggucaccuacgggaccuguagccagaccggugagcauaggcgggacaaacggucaguggcucuggcuccccacgugggccuuggguuggagacgcgcacugagacuuggaugucguccgagggggccuggaagcagauccagcgaguggagaccugggcacuucgccacccgggcuucacugugaucgcgcucuuucuggcgcacgccaucgggacaagcaucacccaaaaggggauaaucuucauccuccugaugcugguuacaccuuccauggccaugcgcugcgucggcaucggcagccgcgacuucgucgaggggcuguccggugccacuuggguggacgucgugcucgagcauggaagcugugugaccaccauggccaaggacaagcccacgcucgacaucgaguuacucaagaccgaggucaccaaccccgcggugcugcggaagcugugcaucgaggccaaaaucaguaacaccaccacagacagccgcugcccgacgcagggcgaagcaacccuuguggaggagcaggaugccaauuucgucugccgccguacccuaguugaucgaggcugggggaauggcugcgggcuguucggcaaagggucccuaaucacgugcgcuaaauuuaaaugcguaaccaaguuggagggcaagaucguccaguacgagaaccugaaguacagcgugaucgugaccguccacaccggggaccagcaccaaguggguaacgaguccacggagcauggcacuaccgcgacuaucacgccacaggcccccagcaccgagauccagcucaccgacuacggggcccugacgcuagacugcagcccccggaccggccucgacuucaaugagaugguccugcucacgaugaaggagaaauccugguuagugcacaagcagugguuccucgaccugccgcuccccuggacuagcggggccuccacaucgcaggagaccuggaaccgccaagaccugcugguuacauucaaaacagcgcacgcaaagaagcaggaggucgugguucucggcucccaggagggcgcaaugcacacugcuuuaaccggggccacggagauccaaacuucugguaccaccacgaucuucgccgggcaccuaaagugucgccuuaagauggauaaguugacauugaagggcauguccuacguuaugugcaccgggagcuucaagcucgaaaaggaaguggccgagacucagcacggcacuguucuaguccaaaucaaauaugaggguaccgaugccccuugcaagauucccuuccugacccaggacgagaaaggcguuacucagaacggacggcugaucacggccaauccgaucgugaccgacaaggagaagcccgucaacauugaggccgagccgcccuucggcgaaucguacaucgugauuggcgcgggcgagaaggcccucaagcugagcugguucaaaaaggguucaagcaucggcaagauguuugaggccaccgcucgcggagcucgaaggauggcgauccugggggacaccgccugggacuucggguccaucggcgggguguuuacgagcgucgggaagcucguccaucagaucuucggaaccgccuacgggguauuguucuccggcguuagcuggaccaugaaaaucgggaucggcgugcuucucaccuggcuggggcugaacucccgcucgaccucgcucagcaugaccugcauagcgguagggcuggucaccuuguaccucggcgugauggugcaggccgacucagggugcguaaucaacuggaaaggccgggagcugaagugcgggagcggcauauucguaaccaacgaaguccacacguggaccgaacaauacaaguuccaggcggacuccccgaaacgccuguccgccgccaucgggaaagccugggaggaaggugucugcgggauacguagcgcaacccgacuugagaauaucauguggaaacagaucuccaacgaacugaaccacauccugcuagagaaugacaugaaguucacgguggucgucggugacguggcuggcauccuggcccaggggaagaagaugauccggccccagccaauggaguacaaauacagcuggaaauccuggggaaaagccaagaucaucggcgccgacgugcagaauaccacguucaucauagauggucccaacaccccagagugccccgacgaccagcgagcguggaacauaugggaggucgaggacuacggcuucgggaucuucaccaccaauauauggcuaaaacuccgggacagcuacacccaagugugcgacuaccgccuuauguccgccgccaucaaggacagcaaggcggugcacgccgacaugggcuacuggaucgaaagugaaaagaacgagaccuggaaguuagcuagggcgagcuucauagaaguuaaaaccugcaucuggcccaagucccacacccuguggagcaacggcgugcuagagucagagaugaucauuccaaagaucuacgggggcccgaucagccaacacaacuaccgccccggguacuucacgcagaccgcuggccccuggcaucuggggaagcucgaguuagacuucgaccugugcgagggcacaaccguggucguagacgagcauugcggaaaccgaggcccgucgcuccgcacgaccaccgugacggguaaaauuauccacgaguggugcugccguagcuguacuuugccgccgcugcgcuucaagggggaggacggcugcugguacgggauggagauacgucccgucaaggaaaaggaagagaaccucgugaaaucgauggugagcgcgggcaguggcgagguggacuccuucagucugggccugcucugcaucuccaucaugaucgaggagguaaugaggagccgguggucuagaaagaugcuaaugaccggcaccuuggccguguucuuccucuugaucaugggccaguuaacuuggaaugaccugaucagacugugcauaauggucggcgccaaugccuccgauagaauggggaugggcacgaccuaucuggcccucauggccaccuuuaagaugagaccgauguucgcugugggacuucuuuuccggcgccucaccucccgggaggugcugcuguugacuaucgggcuuagccugguggcguccguggagcuccccaauagucuggaggagcugggcgacgggcuagccaugggcaucaugauccugaagcugcucaccgacuuccagucucaucagcugugggccacucugcucucccucaccuucaucaagacgacauucuccuuacacuacgcuuggaagacgauggcgauggucuuaucgaucguuucccuguucccacuaugccucagcaccacuucccagaagaccaccugguuacccgugcuucucggaucacuggggugcaagccgcuuaccauguuuuugauagcggagaacaagaucuggggccggaaaucguggccccugaacgaggguauuauggcggucggcaucguaagcauccugcucagcucccuucugaagaaugaugugccccucgcagggccccugauugccggcggcauguugauugcgugcuauguuauaagcgggucuagcgcggaccucucccuggaaaaggcggccgaggugucaugggaggaggaggcagaacacuccggcgccucccacaacauccugguagaaguccaggacgacgggacuaugaagaucaaggaugaggaaagagacgauacccucacuauccugcuuaaggccacccuccuggccguuucuggaguguauccucucagcauccccgccacccucuuugucugguacuucuggcaaaagaagaagcagagauccggggugcucugggacacgcccucgccgcccgagguggagcgggccguuuuagaugaugggauuuaccgcauaaugcagcgggguuuauuggggcgcucccaggugggugugggagucuuccaagagaacguguuccacacaauguggcacgucacgcggggcgcggucuugauguaccaaggcaagcgucuggagcccagcugggcguccguuaagaaggaccucaucaguuacggcggcggguggcggcugcagggguccuggaacacuggggaagaggugcaggucaucgccguggagcccggcaaaaaucccaagaacgugcagacggcaccagggacguucaaaaccucggagggcgaggucggcgccaucgcacuggauuucaagccagggaccuccggcagccccauagugaaucgcgagggaaagauugugggccucuacggcaacggggucgugaccacaagcggcaccuacguguccgccauagcccaagccaaagcgagccaggagggaccccugccugagauugaggacgagguuuuccggaagcgcaaccugaccaucauggacuugcaccccggcuccgggaagacacggcgcuaccugcccgccauagugcgugaagccaucaagcgcaagcuccggacccucauccucgccccgacccgcgugguggccucagaaauggcggaggccuugaagggcaugcccauccgcuaccagacuacggccgugaaguccgaacacacuggcaaagagaucguggaccuaaugugccaugccaccuuuaccaugcgccugcugagccccgucagagugcccaacuauaauaugaucauaauggacgaagcccauuucacggacccgucaaguaucgcggcuagaggguacaucuccacccgugugggcaugggggaggccgccgccaucuuuaugaccgcgacgccacccgggagcgucgaggccuuuccccaguccaacgccgugauccaggacgaggagcgggacaucccggagcgcucauggaacuccggguacgaguggaucacugacuuucccgguaagaccgucugguucguuccgucgaucaaguccggcaacgacaucgccaauugccuucggaagaaugggaagcgcgugauccaacugucaaggaagaccuucgacacggaguaucagaagaccaagaauaacgacugggacuacgugguuaccaccgacaucucugagaugggggccaacuuccgcgcugaccgggugaucgacccgagaaggugucuuaagccggucauacucaaagacgggcccgagcgcgucauccuggccggcccuaugccaguaacgguagccagcgccgcccagcggcgcgggcggaucggccguaaccacaacaaagagggcgaucaguacaucuacauggggcagccuuugaacaacgacgaagaccaugcccacuggacggaggccaagaugcuccuggacaauaucaacacgcccgagggcauuaucccagcccuguuugaacccgagcgggaaaaguccgccgcgaucgacggugaguaccgauugaggggcgaggcccggaagaccuucguggaacugaugagaaggggagaccugccagucuggcucagcuacaaggucgccagcgagggcuuccaguacuccgaccgccgaugguguuucgacggcgaacgcaacaaccaggugcucgaggagaacauggacguagagauuuggaccaaggagggugagcggaagaagcugcggccacgguggcucgacgcgcgcacguacagcgauccucuggcccugcgagaguuuaaggaguucgcugccgguagacggucugucagcggcgaucucauccucgaaauugguaagcugccccagcaccucacacaacgcgcacagaaugcccuggauaaucuggugauguuacacaacucggagcagggugggcgugcguaucgccacgccauggaggaguuaccggacacaauagaaacacugaugcuacuugcccuaauugcgguucucacggguggggucacacucuucuuucuuagcggacgggggcucggcaaaaccuccaucggcuuacucugcguaauggcaucauccgucuuacuguggauggcaagcgucgagccucauuggaucgccgccucuaucauccuggaguucuucuuaauggucuuacucauccccgagccagaccgccagaggaccccgcaggauaaccagcucgcauacgugguuaucgggcuguuguucaugauucuuaccguggcggccaacgagaugggccugcuggagaccaccaagaaggaccucggaauaggccacgucgccgucgaaaaccaccaccaugccgccaugcuggauguggaucuucaucccgcgucagcguggacacucuacgcuguggcuacgacuauaaucaccccuaugaugaggcacaccaucgagaauaccacggccaacaucuccuuaaccgcgaucgcgaaccaggcggccauccugauggggcuggacaagggcuggcccaucagcaagauggacaucggcgucccccugcuggcccucgggugcuacucccaggugaaccccuugacccugacagcggccgugcuaauguuagucgcccacuacgccaucaucggacccgggcugcaagccaaggcaacgcgcgaggcccagaagcgcacagcugcuggcauuaugaagaaccccaccguggacgggaucguggccaucgacuuggauccagucguguaugacgcgaaguucgaaaagcaguuaggccagaucaugcuacuuauucugugcaccucccagauucugcucaugcgaacgaccugggcccugugcgagaguaucaccuuagcuacggggccccucacgacccucugggaggggagccccggcaaguucuggaacaccaccauagccgugaguauggcaaacaucuucagagggucuuaccucgcgggugccggccucgcguucucccugaugaagucccucgggggcgggcgacgggggacgggagcccaaggggagacccucggcgagaaguggaaaagacaacugaaucagcugucuaagagugaguucaacaccuauaaacgaagcggaaucauggaggucgacagauccgaggcgaaggaaggcuuaaagcgcggcgagaccacgaagcacgcagugagccgcggcacggcaaaguugcggugguuuguggagcgcaaucuggugaagccggaggggaagguaaucgaccuaggcugcggccgcggcggguggucauauuacugcgcggggcucaagaaagugacggaagucaaaggguacaccaagggugggccuggacacgaagaaccgauccccauggccacguacggcuggaaccuggugaagcuccacagcggaaaggacguguuuuucaucccacccgagaagugcgauacccuccugugcgacaucggggagagcagccccaaccccacaaucgaggaagggcgcacacugcggguccucaaaaugguggagccauggcugagggggaaucaguucugcaucaaaauccucaaccccuacaugcccuccgucgucgaaacguuagagcagaugcagcggaagcaugguggcaugcuagugcguaauccccugagccggaacuccacccacgagauguacugggugagcugugggacugggaacauagucuccgcggugaacaugaccagccgcaugcuacuaaauagauucacaauggcccaucgcaagccaacguacgagcgcgauguggaccugggagccggcacacggcacguggccguugagcccgagguugcgaaccuggacaucaucggccaacgcaucgagaacaucaagcacgaacacaaaucuaccuggcacuaugacgaggacaaccccuacaagaccugggcguaccacgggagcuacgagguuaaacccuccgguucagccuccuccauggugaauggggucgugaagcugcuuacgaagccgugggacgugauuccuauggucacucaaauagccaugacggacacuacgccguucggccagcagcgaguguucaaggagaaagucgacacucgcacccccaaggccaaacgggggaccgcccagaucauggaggucacggcgaaguggcucuggggcuuucuuagucgaaauaagaagccgcggaucuguacacgagaggaguucacacggaagguacgcuccaacgccgccaucggggccgucuucgucgacgagaaccaguggaacagcgcgaaggaggccguggaagacgagcgguucugggaucugguucacagggaacgggaacuccauaaacaggggaagugcgcgaccugcgucuacaacaugauggggaagcgggaaaagaagcugggggaguucggcaaggcuaagggaucccgggccaucugguacaugugguugggcgcgagguuccuagaguuugaggcccugggcuucaugaacgaggaccauugguucucgcgggagaacucccucucugggguggagggcgagggacuccacaagcugggcuacaucuuacgggacaucuccaagauccccgggggcaauauguacgccgacgacacggcgggcugggacacccgaaucaccgaggacgaucuucagaacgaagccaagaucaccgacauuauggaaccagagcaugcgcugcuggccaagagcaucuucaagcucacguaccagaacaaggugguccgcgugcagcgcccggccaagaaugggaccguuauggacguaaucagucgccgagaccaacggggcucgggccaggugggcaccuacgggcugaacaccuucacgaacauggaggcacagcugauccgccagauggaguccgaggggauauucaguccgagugagcucgagaccccaaaccuugcgggccgggugcuggacuggcucgagaagcacgggguugagaggcugaagcggauggccaucucuggugacgacugugucgucaagcccaucgaugaccgcuucgcaaccgccuugaccgcauugaacgacauggguaagguccggaaggauaucccacagugggagcccuccaaaggcuggaacgacuggcagcagguacccuuuugcagccaccauuuccaccagcugaucaugaaggacggucgggagaucguggucccuugcagaaaccaggacgagcugguagggagggcgcgggucucucaaggcgcaggcuggucccuccgcgagaccgccugccuuggcaaguccuacgcgcaaauguggcagcugauguacuuccaccggagggaccuccgccucgccgcgaacgccaucuguuccgccguuccgguggacugggugcccaccagcaggaccaccuggucgauccacgcacaccaccaauggaugacuacggaggauauguuaagcgucuggaaccggguguggauagaagagaaucccuggauggaagacaaaacccacaucucuagcuggggagacgugcccuaccucgggaaacgggaagaccaguggugcgguucucugauaggucuuacugcacgcgcaacgugggccaccaacauucaagucgcuauaaaccaaguacgccgccucaucgguaaugagaacuaucuggacuacaugacgagcaugaagcgguuuaagaacgaauccgacccggaaggagcacugugguga

SEQ ID NO: 24226 - RNA, 9879 nt, Artificial Sequence
  derived and/or modified CDS sequence (opt11) from DENV-1__FJ461331__SS-prME
ucugucaccaugcugcucaugcugaugccuacugcccuggcauuccaccucaccaccagggggggggagccccauaugauugugagcaagcaagagcgggguaagucucugcuguuuaagacuagcgccggggugaacaugugcacucuaaucgcgauggacuugggggaguuaugugaggacacgaugacauacaaguguccgcguauuacugaggcggagcccgacgacguggacugcuggugcaacgccaccgauacgugggugaccuaugggaccugcucccaaaccggcgaacaucggcgcgacaaacgguccguggcccucgcuccccacgugggacuggggcuggagacgcguaccgaaacauggaugucaagcgaaggcgccuggaaacagauccagcgagucgagaccugggcguuacggcacccuggguuuacggucaucgcccuauuucuggcgcacgcaauaggcacaaguaucacccagaaggggauaauauucauucuccugaugcuggugacacccucaauggcgaugagaugcgucgguaucggcuccagggauuuuguugaggggcucucaggugccacguggguggaugucgugcuggaacaugggagcugugugacgacuauggccaaagauaaacccacccuggacaucgagcuccugaagacggaggugacaaacccagcggugcugcggaaacuguguaucgaagccaagauaucaaauacaacaacggauagccguugcccgacacagggugaggccacccuuguggaggagcaggacgcaaacuucgucugccgucgcaccuuuguggaccgggguugggggaacggcugcggucuguucggcaaggggucgcuuaucacgugcgccaaguuuaagugcguuaccaagcuggaggggaaaauugugcaguacgagaaccugaaauacagcguaauagugaccguucacaccggcgaccagcaucagguggggaacgagucgacggagcaugggaccacggcgaccaucaccccgcaggcaccaacgacggagauacaacucacugacuauggggcccugacccuggacugcagcccccgaacgggucucgacuucaaugagaugguccuguuaaccaugaaagagaaguccuggcuugugcacaagcagugguuccucgaccugccccugcccuggacgagcggggccucaacgucccaggagacauggaaucggcaagaccucuugguuacauucaagaccgcgcaugcgaagaagcaagaggucguugugcuggguagccaggagggcgcaaugcauacugcucucacgggggccaccgaaauccagaccuccggaaccacgacgaucuucgccgggcaccuuaagugccgccugaagauggauaaguugacccugaagggcaugucguacgucaugugcaccggguccuuuaagcuagagaaggagguggcagagacgcagcacggcaccgugcugguccaaaucaaguacgaggguaccgaugcccccugcaagauccccuucucgacacaggacgagaagggggugacccaaaauggccggcucaucaccgccaacccgauuguuaccgacaaggaaaagcccgugaauauagaggcugaaccccccuucggggagaguuacaucgugauuggagcgggagagaaggcacuuaaacucagcugguucaagaaaggcagcagcaucgggaaaauguucgaggcuaccgcccggggugcccggcggauggcgauuuugggcgacaccgcuugggacuucggguccaucggcgguguguucacgagcgucgggaagcuaauccaccagaucuuuggcaccgccuacgggguucucuucuccggggugaguuggaccaugaaaaucgguaucggcguccuguugacaugguuaggccugaacucccgcagcacguccuugagcaugacaugcauagccguaggacuuguuaccuuguaccucggagucaugguccaggcugacuccgggugcgugauaaacuggaaggggcgggagcucaagugcgggagcggcauuuucgugacuaacgaggugcauaccuggacugagcaguauaaguuccaggcggacagcccgaagcgucugucggcugcgaucgggaaggcgugggaggaaggggugugcggcaucaggagugccaccaggcucgagaauauuauguggaagcagaucucgaacgaacugaaccauauccuccuggaaaacgacaugaagcucacuguggugguuggcgacgucgccggcauccugggucaaggcaaaaagaugauacguccccagcccauggaguacaaguacagcuggaaguccuggggcaaggccaagaucaucggagccgaugcccagaauaccacauuuaucaucgacggccccaacaccccggagugccccgaugaccagcgcgcguggaacauaugggagguggaggacuacggguucgguauuuucacaacuaacauauggcugaaguuacgggacagcuacacgcaggugugcgaccacaggcuuauguccgcagccauaaaggauagcaaggcaguacacgcggacaugggcuacuggaucgaguccgagaagaacgagaccuggaaauuggcgcgcgccuccuucauagaggugaagaccugcaucuggccgaagucccauacgcucuggagcaauggggugcuggaguccgagaugaucauccccaagaucuacggaggucccaucagccagcauaacuaccgccccggcuacuuuacccaaaccgccggccccuggcaccugggcaaguuagagcuggacuucgaccugugcgagggaacgaccguaguaguggacgagcacugcggaaaccgcggcccgucccuccgcacaaccaccgucacggggaagaucauucacgagugguguugccggaguugcacgcugccgcccuuacgcuuccgcggugaggacggaugcugguacgguauggagauacgacccgugaaggagaaggaggagaaccucgugaaaucuauggugagcgcgggcucuggagagguggacaguuucucgcucggccuccucugcaucucgaucaugaucgaggaggucaugcgcagccgcuggucacgaaagaugcugaugacggggacccuggcagucuuuuuccuccuaaucaugggucagcugacguggaacgaccucauacgccuguguaucauggugggggcaaacgcauucgaccgcaugggcaugggcacaacuuaccuggcccuuauggcaacauucaagaugaggccgauguucgcaguuggguugcuguuccgcagacuaacgagcagagagguucuguugcucacuauuggccugucccugguggcuagcguggaacucccaaacuccuuagaggagcugggggacggucucgccaugggcauuaugauccucaagcugcucacggacuuccagucgcaccaauuaugggccacgcugcucuccuuaacguucaucaagaccaccuucagccuacacuacgcguggaagacuauggcuaugguccuguccauuguauccuuauucccccugugccucucaacgaccagccagaagaccaccuggcugccgguccugcucggguccuuaggcugcaaaccgcuuacgauguuccugauugcagagaacaaaaucuggggucggaaauccuggccccugaacgagggcaucauggcggugggaaucguguccauccugcucagcagccuuuugaaaaacgacgucccguuagccgggcccuuaaucgccggcgggaugcucaucgcaugcuacgugaucucuggcaguucugcggaccugagccuggagaaagccgcggaaguguccugggaagaggaggccgaacacagcggggcgucucacaacauacugguugagguucaggacgacggcacuaugaagauuaaggaugaagagagggaugacacccucacgauacugcugaaggccacucugcuggccguaagcggggucuacccgcugucaauccccgccacccucuucgugugguacuucuggcagaaaaagaagcaacggucgggcguacuuugggacacgccaucgccccccgucguggaaagggccgugcuggacgacgggauauaccguaucaugcagcgcgggcuccucggccguagucaggucgggguggggguguuccaggagaacgucuuccacaccauguggcacguuacacggggagcaguccugauguaccagggcaagcggcuggagcccaguugggccagcgucaagaaggaccucaucuccuacgguggcggcuggcgccugcggggcagcuggaacacuggagaagaaguacaggugaucgccgucgagccggguaaaaaucccaaaaacgugcagaccgccccagguaccuuuaaaacgcccgagggcgaggugggggccaucgcgcuagacuucaagcccgggacaagcgggucccccaucgucaaucgagaggggaaaauuguuggccucuacgggaacgggguggucaccacguccgggaccuacguaagcgcaaucgcccaggccaaggcgagucaggaaggcccgcuacccgagaucgaagacgagguauuucggaaacguaaccugacuaucauggaccuacaccccggguccggcaagacgagacgcuaccugcccgcuauuguccgggaagcgaucaagcgcaagcugcgcacgcuaauacuggcuccgacccgggugguggccagcgagauggcggaggcuuuaaagggcaugccuauccgauaccaaacgaccgccgucaagucugagcacacugguaaggagaucguggaccucaugugccacgcuacauucacgaugcgccuacugagccccgugcgagucccaaacuacaacaugaucaucauggaugaggcccacuucacagacccauccucuaucgcggcgcggggguacaucuccacccgcguggggaugggugaagccgcggccaucuucaugaccgcgacgccgcccgguagcguggaagcuuuuccgcaauccaacgccgucauccaagacgaagagcgggauaucccggagcgcucguggaacuccggacacgaauggaucaccgauuuccccggcaaaaccgugugguucgugcccagcauuaaauccgggaacgauaucgccaacuguuugcggaaaaacggcaaacgcgucauacaguuaucaagaaagaccuucgauacggaguaucagaagaccaagaauaacgacugggauuacgugguuaccaccgacaucagcgagaugggggcgaauuuccgugcggacagggucauagacccgcggcguugccucaaacccgucauacucaaggacggcccggagcgugugauacuggccgggccaaugcccgucacuguggccagcgccgcacagaggcggggcaggaucgggagaaaccacaauaaagagggggaccaguacaucuacaugggccagccccuaaacaacgaugaggaccacgcgcacuggaccgaggccaagauguuacuggacaacauaaauacccccgaggggauaaucccagcacuuuucgaaccggagcgcgagaaaagugccgcgguggacggugaguaccgacuccgcggggaggcucgcaagacguuuguggagcucaugcggcguggagaccugcccguguggcucaguuacaagguagcuucagagggauuccaguacagcgaucgccgguggugcuucgacggggagcgcaacaaucaggugcucgaagaaaacauggacguggaaaucuggacgaaagagggcgagcggaagaagcugcgcccccgguggcucgacgcccgaacguacucugacccccuggcccugcgggaguuuaaggaguucgcggccggucgccgguccguuagcggagaccucauucuggagauagguaagcuuccgcagcaccuuacccaacgagcccagaaugcccuggacaacuuggugaugcuucacaacucagagcagggcgggcgugccuaucgccacgccauggaagagcuuccagacaccaucgaaacgcugaugcuacuggcccuaauagccguguuaacugggggaguuacccuguucuuccucagcggucgaggacugggcaagaccucuaucggucugcucugcguaauggcuagcuccgugcugcuguggauggcgagcgucgagccgcacuggaucgccgccuccaucauccuggaauucuuucucaugguauugcugauacccgagccggaccgccagcggacgccccaagacaaccagcuggccuauguggugaucgggcugcucuuuaugauccucacuguugcagccaacgaaaugggucuguuggagacaaccaagaaggaccucggcauaggacacguggcggucgagaaccaccaccaugcggccaugcuggacguugaccugcacccugccagcgcguggacccucuaugcgguggcaaccacaaucaucacuccgaugaugcgccauaccaucgagaacacgacggccaacaucucccucaccgccauagcgaaccaggccgccaucuuaaugggccucgacaagggcuggcccauaaguaaaauggauauagggguaccccuccuagcccucggcugcuauagucaggugaacccccugacccugacggcggcuguucuuaugcuggucgcccauuaugcuaucauagggccgggcuuacaagcgaaggcgacgcgcgaggcccagaagcggaccgccgccgggaucaugaaaaacccaaccguugaugggaucguggccaucgaccucgacccgguuguguacgacgcgaaguucgaaaagcagcugggccagauaaugcugcugauucugugcacgagccagauccuguuaaugcgcacaaccugggcccuuugugagaguaucacuuuagcaacggguccgcucacuaccuugugggagggguccccggggaaauucuggaacaccacgaucgcuguguccauggccaacaucuuccguggcucguaucuggcgggugccggccucgcauucucccugaugaaaucacugggagggggaagacgggggacaggagcccagggcgaaacuuuaggggagaaguggaagcgccagcugaaccagcucucaaagagcgaguuuaacacauauaaaagaucgggaaucauggaagucgacaggagcgaggcgaaggaggggcucaagcggggagagacgacaaagcacgcagugagccgcggcaccgcaaagcuucguugguucguugagcgcaaccugguaaagcccgaaggcaaaguuauagauuuaggcugcgggcgaggcgguuggagcuacuacugugccggcuugaagaaggugacagagguaaaaggcuacacgaagggggggcccggucacgaggagcccaucccgauggcuaccuacggcuggaaccuuguuaagcugcacagcgggaaagacguauuuuucaucccgcccgaaaagugcgacacuuugcugugcgacauaggugaguccaguccuaacccgacuaucgaagaaggacgcacacugcggguacucaaaaugguugagccguggcugcgcggcaaucaauucugcaucaagauccugaaccccuauaugccuuccgucguugagacccucgagcagaugcagcggaagcacggggggaugcugguucggaacccguuaagccgcaacagcacgcacgagauguacugggugagcugcgguacggggaacaucgucucugcggugaauaugaccucacgcaugcuucuuaaccgcuuuaccauggcacaucgaaagcccaccuaugaacgcgacguggaccugggcacaggaacgcggcacguugccguggaaccggaggucgccaaccuagacauaaucggccagagaaucgagaacaucaagcacgagcacaagaguacauggcacuaugacgaagacaacccguacaagacuugggccuaucacgggagcuacgaagucaagcccuccggaagugcgaguuccauggucaacggcgucgucaaauugcucacuaaacccugggacgugauccccaugguuacccagaucgccaugacggacacaacccccuucgggcagcaacgggucuuuaaggaaaaggucgacaccaggacgccgaaggccaagaggggcacagcccaaaucauggaggucacugcccgcuggcuguggggcuuccugagccggaacaagaaaccccgcaucuguacccgggaggaguucacaagaaaggugcgguccaacgcugccaucggcgccguguucgucgaugaaaaccaguggaacagcgccaaagaggcgguggaagaugagcgauucugggaucuggugcaccgggagcgcgagcuacacaaacagggaaaaugcgcgaccugcguauacaacaugauggguaaacgugagaagaaacugggugaauucgggaaggccaagggcuccagagcgaucugguauauguggcugggcgcgcgguuccuugaguucgaggcguuaggguucaugaaugaagaucacugguuuagccgcgaaaacucuuuaagcggcguugaaggggagggacuccacaagcuggguuacaucuugagggacaucucgaagauccccgggggcaauauguacgccgacgauaccgccgggugggacaccaggaucacagaggacgaucuccagaacgaggccaagauaaccgacaucauggagcccgagcaugcauuacuggcuaaggccaucuucaagcucacuuaccagaacaagguggugcgcgugcaacguccggccaagaacggcaccgugauggauguuaucagcagacgggaucaacgcgggucgggccagguaggcacauacggguuaaacaccuucaccaauauggaggcccagcugauucggcagauggagagugaaggaauuuucucacccagcgaguuagagacucccaaucuggccgaacgagcauuagacuggcucgaaaaguacgggguagagaggcugaagaggauggccauuuccggcgacgauugcgucgugaaacccaucgacgaucgcuucgccacagcccuaaccgccuugaacgacaugggaaagguccgcaaggauaucccccagugggagccaagcaagggcuggaacgacuggcagcagguaccauuuugcucccaucauuuccaucagcugauaaugaaggacggccgcgagaucguggugccgugccgcaaccaagacgagcuaguugggcgugcgcgagugucucagggcgcgggguggucccuccgcgagacugccugucuggggaagagcuacgcccagauguggcagcugauguacuuccaccgcagggaccuaagacuagcagccaacgccaucuguagcgccguucccguagauugggugcccaccuccaggacgaccuggucuauucaugcucaccaccaguggaugaccaccgaggacaugcuguccgucuggaaccgugucuggaucgaggagaaucccuggauggaggacaagacgcacauaagcuccugggaggacgugccguaccuagguaagcgcgaggaucaauggugcggcagcuuaaucggucuaaccgcgcgggcaaccugggccaccaauauacaaguggccaucaaccaagucaggcggcucaucgggaacgagaacuaccuggacuacaugacguccaugaaacgcuuuaagaaugagagcgaucccgagggcgcccugugguag

SEQ ID NO: 24227 - RNA, 9879 nt, Artificial Sequence
  derived and/or modified CDS sequence (opt11) from DENV-1__FJ410256__SS-prME
ucugugaccaugcugcucaugcugaugcccaccgcccuggccuuccaccucaccacgcggggcggggagccccacaugaucgugagcaagcaggagcggggcaaaagccuacuguucaagacuagcgcgggggugaacauguguacccuaaucgccauggaccugggagaguuuugcgaggacaccaugaccuacaaaugcccccggaucaccgaagcggaacccgaugacguggacugcuggugcaacgccaccgacacaugggugacauacggcacauguucgcagaccggggagcaccgccgcgauaagcggagcguugcccuggcgccccacgugggccugggacuggagacgcgcaccgagaccuggaugagcuccgagggcgccuggaaacagauucagaaggucgagacgugggcacugagacaccccggguucacggugauagcccucuucuuggcacaugcuauagguaccucaaucacacagaaagggauuauuuucauccugcucauguuggugacucccuccauggcgaugcgcugcgucggcaucgguucccgggacuucguggaagggcuguccggcgccacguggguagacgucguucucgagcacgggucgugcgugacgacuauggccaaggacaagcccacgcucgacaucgagcugcucaaaacugaaguuaccaaccccgcgguacugcgcaagcugugcaucgaggccaaaaucucaaauaccaccacugacagccggugucccacccaaggcgaggccacacucguggaagagcaggacaccaacuucgucugccgccggacguucguugaucgcggcugggguaacggcugcggguuauuuggcaaggggucccugaucacgugcgccaaguucaagugcgugaccaagcucgaaggcaagaucguccaauacgagaaccugaaguauagcguuaucgugacuguccacacgggcgaccagcaccagguggguaacgagucgacggaacaugggaccaccgccaccauuacuccgcaggcacccucuaccgagauccaguugaccgacuacggggcccucacccuggacugcagcccccggaccggccuggauuucaacgagaugguacuccugaccaugaaggagaaguccuggcucguccacaagcaaugguuccucgaucuuccgcuacccuggaccagcggcgcguccacuagccaggagacguggaaccgcaaggaccuccuggugacauucaaaaccgcccaugcgaagaagcaggaagucguggugcucggcucccaggaaggcgcgaugcacacugcguugacgggcgccacugagauccagaccagcgguacaacuacgaucuucgccgggcacuuaaagugccggcugaagauggacaagcucacgcugaaggggauguccuacgucaugugcaccggaagcuucaagcuggagaaggagguggccgaaacgcagcauggcaccguucucguucagaucaaauacgagggcaccgacgcgcccugcaaaaucccauucuccacacaggaugagaaaggcgugacgcagaacggcaggcugaucacggcuaacccgauugucacagauaaagagaagcccgugaauaucgaggcugagccccccuucggggagagcuacaucgugaucggcgcaggcgagaaggcgcugaagcuguccugguucaagaaggguagcuccaucggcaagauguucgaggccaccgcgcgcggagcccgccggauggccauccucggcgacacggcgugggacuucgggagcaucggcggcguguucaccucggucgggaagcuggugcaccagaucuucggcacagccuacggggugcuguucuccggaguguccuggaccaugaagaucgggaucggcguacuccugacguggcugggucucaacucccgcuccacaagccuguccaugaccugcaucgccguggggcuggucacccucuaccugggaguaauggugcaggccgacagcgggugugucauuaacuggaagggacgagagcugaagugcgggagcggcaucuucgucacgaacgaggugcacaccuggaccgagcaguacaaguuccaggcagacagcccgaagcggcuaagcgcugccauaggaaaggccugggaagagggagucugcggaauuaggagcaccacgcgucuggagaacaucauguggaaacagaucagcaacgagcugaaccacauccuccucgagaacgauaugaaguucacggugguggucggagauguagcuggcauccuggcccaggggaagaaaaugauccgaccccagcccauggaauacaaguauuccuggaagucguggggcaaagcgaagaucaucggcgccgacgugcagaauacaaccuucauaauugacgggccuaauaccccggagugucccgacgaccagcgggccuggaacauaugggagguggaggacuacggcuuuggaaucuucacaacgaacaucuggcuuaaacugcgcgacuccuacacccaagugugugaccaccgacuuaugagcgccgcgaucaaggacagcaaggcugugcacgccgacaugggcuacuggauugagagcgagaagaacgagaccuggaagcucgcucgcgccuccuucaucgaggucaagacauguaucuggcccaagagccacaccuuaugguccaacggcgugcuggagagcgagaugaucauccccaagaucuacggaggaccgaucucccagcauaacuaccgacccggguauuucacccagaccgccggccccuggcacuuggggaagcuggagcuagacuucgacuugugcgagggcacuaccguggucguggacgagcacugcggaaaccgcgggccgagcuugcggaccaccaccgugaccggcaagaucauccaugaauggugcuguagauccugcaccuuaccgccccuccgguucaagggugaggacggcugcugguaugggauggagauacgccccgucaaggagaaggaggagaaucuggucaagucaauggugagugccggcuccggugagguagacaguuucucccuagguuuguuaugcaucucaauaaugauugaggaggugaugagaucccgcuggagccgcaagauguuaaugaccggcacgcuggcgguguuuuuccuguugaucaugggucagcucacuuggaaugaucucauucgccuguguaucauggucggcgcgaacgccucggaccgcauggggaugggcaccaccuaccucgcgcuaauggccacguucaagaugcgccccauguucgccgugggacuacuguucagacgccugaccagccgcgaggugcugcuccugacuauuggacugucccucgucgccaguguggagcugcccaacucgcucgaggagcucggcgacggacuggccaugggaaucaugauacugaagcuccugacggacuuccagucgcaccaguugugggcgacgcucuugagucugaccuucaucaagaccaccuucagccugcacuacgccuggaagacgauggccaugguccuguccaucgugucgcuguuccccuugugccuguccaccaccagccagaagaccacguggcuacccgugcuccuaggcucccugggauguaagccgcuaacaauguuccugaucgccgagaacaaaauauggggccgcaagagcuggccccugaacgaagggaucauggcaguuggcaucgugagcauccuccuguccucgcugcucaagaacgacgugccuuuagccgggcccuuaaucgccggcgguaugcugauugccuguuaugucaucuccgguagcagugcugaucucagccuggagaaggcggcugaagucuccugggaggaagaggccgagcacagcggcgccucccacaacauccucguggagguccaggaugacgggaccaugaagauaaaggaugaagagcgagacgacacccugaccauccuucucaaggcgacgcugcuggcggugaguggaguguacccguuaucgauucccgccacuuuauuugucugguauuucuggcaaaagaagaagcagcggagcgguguccucugggacacccccaguccacccgagguggagcgcgcaguccucgacgacggcaucuaccggaucaugcaacgcggccuacuggggcgaagccaggugggcgugggggucuuccaggagaacguauuccacaccauguggcacgugacgaggggcgccguccugauguaccaagguaagcggcucgagccguccugggccagcguaaagaaagaucugaucuccuacggcgguggguggcgccugcagggaagcuggaacaccggcgaggaggugcaggucaucgcgguggagccaggcaagaaccccaagaaugugcagaccgccccugggacguucaagacgucugagggcgaggucggugccaucgcacucgacuucaagcccgguaccagcggcagccccaucgugaaccgggaggggaagaucgugggccuuuauggaaacggggucguaacgaccaguggcaccuacguuagcgccaucgcgcaagccaaagccucccaggaagggccccugccagagauagaagacgaggucuuucggaaaagaaaccucaccauuauggaccuccaccccggcagcgggaagaccaggcgguaccuaccugccaucguucgcgaggcgauuaagcggaaacuccgcacucugauccuggcgccgacucggguggucgccuccgagauggccgaggcccucaaaggcaugcccaucagguaccagaccaccgcggucaaaagcgagcacaccggcaaggagaucguggaccugaugugccacgcaacuuucaccaugcgacugcuaucccccguccgugugcccaacuacaacaugaucaucauggaugaggcccauuucaccgacccgucguccauagccgccagaggcuacauaagcacccgggucggcaugggggaggcggccgcuaucuuuaugacggccacgccgcccggcuccgucgaggccuuuccccagucaaacgcgguuauccaggacgaagagcgcgacaucccggagcgguccuggaacaguggguacgaguggaucaccgacuuccccgguaagaccgugugguucguccccucuaucaagucugguaacgacaucgccaauugccugaggaagaacgggaagcgggugauacaacuaucgcgaaagacguucgacacggaguaccagaagacaaagaacaacgacugggacuacguggucaccacggacaucucugagaugggggccaauuuccgggccgaccgggugaucgauccccggcgcugucucaagccggugauucugaaagacgggcccgagcgugucauucuggcggggccuaugcccgugacugucgcuuccgcagcgcagcgucgggggcgcauaggacggaaucacaacaaagagggggaccaguacauuuacauggggcaaccgcucaacaacgacgaggaccaugcccauuggacggaggcgaagaugcugcuugacaauauaaacacccccgaggguaucauccccgcccucuucgagccagagcgcgagaagucggcagcgaucgacggggaauaccggcugcgcggcgaagcccguaagacguucguggaacuuaugcgucggggagaccucccgguuuggcucagcuacaagguugcgucggaaggcuuccaguacagcgaucggcgcuggugcuucgacggcgagcggaauaaccaggugcuggaggagaacauggacguugagaucuggaccaaggagggugaacgcaagaaguugcggccucgaugguuagaugcccggaccuacuccgacccauuggcgcuccgcgaguucaaggaguucgccgcgggcagaaggucggucuccggggaccugauccuggagaucggcaagcuaccccagcaccugacucagcgggcgcagaacgcguuggacaacuuggugaugcuacacaauucggagcagggcgggagagccuaccggcaugcaauggaggaauuaccagacacgauagagacccucaugcugcuugcgcucauagccguacugacaggcggggugacgcuguucuuccucuccggccgcggacugggcaagaccagcaucggcuugcucugcgugguggcuagcaguguccugcuguggauggcguccguggaaccccacuggauugccgccagcaucauccucgaguuuuuccugauggugcuccucauccccgagcccgauaggcagcgcacgccacaagauaaccagcuggcguacgucgugaucgggcugcucuucaugauccugaccguggccgccaacgagauggggcuccucgaaacuacaaagaaggaccuagggaucggccacgucgccgcggagaaccaccaccacgccgccaugcuggauguggaucuccaccccgcuuccgccuggacguuguaugcuguggccaccacgaucaucaccccgaugaugcgucacacgaucgagaacaccaccgccaacauuagccugaccgccaucgccaaucaggcggccauccucaugggucuggacaagggcuggccgaucucaaagauggacaucggcgugcccuuacuagcacuggggugcuauucucaggugaauccccugacgcugacugccgcgguguugaugcuggucgcccauuacgcaaucaucggccccgggcugcaggccaaggccacucgcgaggcgcaaaagcggaccgccgccgguaucaugaagaacccaaccguggacgggaucguggcgauagaccuggaccccgucguguacgacgccaaauucgagaagcagcugggccagaucaugcuccugauccuauguacuucccaaauccuccugaugcgaaccaccugggcguugugcgagagcaucacgcuggcaaccggcccccugaccacccugugggagggguccccugguaaguucuggaacacgaccauagccguaagcauggccaauaucuuccgcgggagcuacuuggccggcgcgggccuggcauuuuccuuaaugaagucccucgggggcggaaggcgcggcaccggggcccagggcgaaacccuuggcgagaaguggaagaggcagcugaaccagcucagcaaguccgaauuuaacacguauaagcgcucaggaauuauggaagucgaccggagcgaggccaaggagggccugaagcgcggugagaccacgaagcacgcggugucccggggcaccgccaaacuucgaugguuuguggaaagaaaccucgucaagccggaggggaaggugaucgaucugggcuguggacgcgggggcuggagcuacuacugcgccgggcugaagaaggugacggagguuaagggguacaccaagggcgggccgggccacgaggagccgauccccauggccacguauggguggaaccuggugaagcuccacuccggcaaggacguguucuucaucccgccagaaaaaugugacacccugcucugugauaucggggagagcucccccaaccccacgaucgaggaggggcggacccuccggguccugaagaugguggaaccguggcuacgugggaaccaguucuguaucaagauccucaacccauacaugcccucaguaguggagacccuggagcagaugcagcggaagcacggcggcaugcuggugcggaacccccucagccgaaacagcacccacgagauguacugggucucuugcgggaccgggaacaucgucagcgcggugaacaugacgucccggaugcugcuaaaccgcuucaccauggcgcaccggaagccgaccuacgagcgcgacgucgaccuuggggccggcacccgccacgucgccgucgagcccgagguagccaaucuagacaucaucggucagcggauugagaauauuaaacacgaacauaaaagcacguggcauuacgacgaggacaaccccuacaaaacuugggccuaccacggcuccuacgaaguaaagccgagcggaagcgcgucauccauggugaacggggucgugaaacuucucacaaagccgugggaugugauaccaauggucacacagaucgccaugacggacaccaccccguucgggcagcaacgcguauucaaggagaagguggacacccggacgccaaaggccaagcgagggaccgcgcagaucauggaggucacggccaaguggcuuugggguuuccugagcaggaauaaaaaaccgcgcauuuguacccgcgaggaguucacgaggaaggugcggucuaacgcagccaucggggcgguguucgucgacgagaaccaauggaacagugcaaaggaggcgguugaagacgaacgcuucugggacuugguacaucgugagcgagaacugcacaaacaggggaagugcgcgaccugcguguacaacaugauggggaaacgugaaaagaaacugggggaguucggcaaggccaaggggagccgagccaucugguacauguggcucggcgcacgguuccuggaauucgaggcacugggcuucaugaacgaggaccacugguuuucccgcgagaacagccucuccgggguagagggcgaggggcugcacaaacugggcuacauccuccgcgacaucucgaagauccccgggggcaacauguacgccgacgauaccgccggcugggauacccgcauaacggaggacgaccuucagaacgaggccaagauuacagacauaauggagcccgaacaugcccugcucgcuaagaguauauuuaagcugaccuaccagaacaagguuguccgggugcagagaccggccaagaacgguaccgugauggauguaaucagccggcgcgaccagcgcgguaguggccaggugggcacguacggccugaacaccuucacuaacauggaggcacagcucauccgucagauggagagcgaggggauauucucuccauccgagcuggagacccccaaccuggcaggccggguguuggacuggcuggagaagcacggugccgagcggcugaagcgcauggcuaucuccggcgacgacugcgucgugaaacccaucgacgaccgguucgccacggcccucaccgcccugaacgacauggggaaggugcgcaaggacaucccgcaaugggaacccagcaagggguggaaugacuggcaacagguccccuuuuguucgcaccauuuucaucaguuaauuaugaaggacgggcgggagaucguggugcccugccgcaaccaagaugagcucgucgggagggcucgcgucucccagggcgccggguggagccuccgggagaccgccugccugggcaagucauacgcccaaauguggcagcucauguacuuccaccgccgggaccuccgccucgccgcaaacgccaucugcagcgccgucccgguugauuggguccccaccucccgcaccacuuggagcauccacgcccaccaccaauggaugacgacggaggacaugcuguccguuuggaaccgugucuggaucgaggaaaaccccuggauggaggacaagacgcacaucagcuccuggggcgacgugcccuaccuggguaagcgggaggaucaguggugcggcagccugauugggcucaccgcucgcgccacuugggccacaaacauccagguggcaaucaaccagguccggcgcuugaucggcaacgagaacuaccuggacuacaugacuuccaugaaacguuuuaagaacgaaagcgacccggagggggcccucugguga

SEQ ID NO: 24228 - RNA, 9879 nt, Artificial Sequence
  derived and/or modified CDS sequence (opt11) from DENV-1__FJ410257__SS-prME
agcgugacgaugcugcucaugcugaugcccacggcccuggccuuccaccucacaaccaggggcggggagccccauaugauuguuagcaagcaggagcggggcaagagccuguuauucaagacaagcgcgggcgugaacaugugcacccuuaucgccauggaccucggcgagcugugcgaggauacaaugaccuacaaaugcccccguauaaccgaggccgagccugacgacguggacugcuggugcaacgccacggacaccugggugaccuacgggacuugcagccagacuggcgagcacagacgcgacaagcgguccguggcccucgcgccccacguaggccuugggcucgagacgcgcacagagacauggaugagcucugagggcgccuggaagcagauccagcgugucgagaccugggcccuccgccaccccggguuuacgguuaucgcccuguuucuggcgcacgccaucgggacgagcauaacccagaaggggauuaucuucauccuccugauguuagugacccccuccauggccaugcggugcguugguaucggcagccgcgacuucgucgaggggcuuuccggcgcgacguggguggacgucgugcucgagcaugggagcugugugaccaccauggccaaagacaagcccacccuggacaucgaguuauuaaagacggaggucacaaauccggcagugcuacguaagcucugcauugaggcuaaaauauccaacaccaccaccgacagccgcugcccgacccaaggcgaggcaacauuaguggaagaacaggacgcaaauuucgucugccggcgcaccuucguagaccggggcugggguaacgggugcggucuguucggcaaggggucccucauuaccugcgcuaaguucaagugcgugaccaagcuggaggggaagauuguccaguaugagaaccugaaauauagcgugaucgucaccguucacaccggcgaccaacaccaagugggaaaugaauccacggagcaugggaccaccgcgacuaucacuccccaggcacccacuaccgagauccagcucaccgacuacggggcguuaacacuggacugcucgccucgcacgggacuggacuucaacgaaauggucuuacugaccaugaaggaaaaguccuggcucgugcacaaacagugguuucuggaucugccgcuuccguggaccucgggggccaguaccucacaggagacauggaacaggcaggaccugcuggugacguucaagaccgcccacgcgaagaagcaagaggucguggugcucgguagccaggagggcgcaaugcacaccgcccugaccggcgccacugagauccagaccuccggcacaacuaccaucuucgccggccaccugaagugccgccucaaaauggauaagcugacccugaaaggcaugagcuacgucauguguaccggguccuucaagcucgagaaggagguggcggagacucagcacggcaccgugcugguccagaucaaauacgagggcaccgacgccccuugcaagaucccguucaccacgcaggacgaaaagggcguaacucagaacggccggcugaucaccgccaacccgaucgugaccgacaaggagaaacccgugaacaucgaggcagagccucccuucggggagagcuacaucgugaucggcgcgggcgagaaggcccugaaacuguccugguucaagaagggaagcuccaucggcaagauguucgaggccacggcccgcggagcucggcgcauggcaaucuugggcgacacagcuugggacuucgggagcaucggcggcgucuucaccuccgucgggaagcuggugcaccagaucuucggcaccgcuuauggcgugcuguuuagcggcgucuccuggacuaugaagauugggaucggcgugcugcugaccuggcuaggguuaaacagcaggucaaccagcuugaguaugaccuguaucgcuguggggcuugucacgcuguaccuaggcguuaugguccaggccgacucugggugcgucaucaacuggaagggacgcgagcucaagugcggguccggcauuuucgugaccaacgagguucacacguggaccgagcaauacaaauuccaagcggacuccccgaagcgccugucggcugccaucggcaaagccugggaggaaggagucugcgggauucgcuccgccacucgccuggagaacaucauguggaagcagauuucgaacgagcucaaccacauccugcuggagaacgacaugaagcucacugugguggucggggacguggcgggcauccuggggcaaggcaagaagaugauuaggccucagcccauggaguauaaguacuccuggaaguccuggggcaaagcaaagaucaucggggccgacgcgcagaacaccaccuuuaucauugacggccccaacaccccggagugccccgacgaccagcgagcguggaauaucugggagguggaggauuauggguucggaaucuucacgacaaacaucuggcuaaaacuucgggacagcuauacacaggucugcgaucaccgccugaugagcgccgccauaaaggacucaaaggccgugcacgcggauaugggguacuggaucgaaagcgagaagaacgagaccuggaagcucgcgcgggcguccuuuauagaagugaagacguguaucuggccaaagagccacacccucuggucuaacgggguacuggagagugagaugaucauacccaagaucuacggcggaccuaucagucagcacaacuaccgcccgggcuacuuuacacagaccgccgggcccuggcaccugggcaaguuggaacuagacuuugacuuaugcgagggcacuaccgugguggucgaugagcacugcgggaacagaggaccgucguugcgcaccaccaccgugacugggaagaucauccacgagugguguugccgcuccugcacucugccaccccugcgcuuuaggggcgaggacggguguugguacggcauggagauccggcccguaaaagagaaggaggagaaucucgucaagagcaugguguccgccgggucgggagagguggacagcuucucgcugggucugcucugcaucagcaucaugaucgaggaggucaugcggucacgcuggucucggaagaugcugaugaccgggacguuagccguguucuuccuguugaucaugggccagcugacguggaacgaccucauacgccugugcauuauggugggcgcgaaugccuccgaccgaaugggcaugggcaccaccuaccuggcccucauggccacguucaagaugaggccgauguucgccgucgggcugcuguuccgccggcucaccagccgcgaggugcuacugcugaccaucggacugucccugguggcaagcguagagcuccccaacucgcuggaggagcuuggugacggccucgccaugggcaucaugaucuuaaagcugcucaccgacuuccagagccaucaguugugggcuacacugcucucccugacguuuaucaagaccaccuucagccugcacuacgcauggaagacgauggcaaugguguugucgaucgucucccuguuuccucugugucucuccaccaccucacagaagaccacguggcugccagugcuucucgggucccugggcugcaagccgcuuacaauguuccucaucgccgaaaacaagaucugggggcgcaagagcuggccccugaacgagggcaucauggcgguggggauagucuccauacugcucagcagucuccucaagaaugacgugccccuagccggcccccugaucgcgggcgggaugcugaucgcgugcuacgugaucucugguaguuccgccgaccucucucuggagaaggcugccgaggucuccugggaagaggaagccgagcacagcggggcuucacauaacauucugguggagguccaagaugacggcaccaugaagaucaaagaugaagaacgcgacgacaccuuaaccaucuuguuaaaggccacgcuccuggcggucagcgggguguacccgcuuucaauaccugccacccucuuugugugguacuucuggcagaagaaaaagcagcgcucaggcguacugugggauaccccuucgccuccugagguagagcgugccguucuggacgacgguaucuacagaaucaugcagcgugggcugcucggccggagccaggucggggugggcguguuucaggagaacgucuuccacacaauguggcaugugacuagaggggcggugcugauguaccaggguaaacggcuggagcccuccugggcgucugucaagaaagaccugaucuccuacggcggggguuggcgccugagggggagcuggaacaccggugaggagguccaagugaucgccgucgagccugggaaaaaccccaagaacgugcagaccgcuccuggcacuuuuaagacucccgaaggcgaggugggggccauugcucuggauuucaagccuggaaccuccgggucucccaucgucaaccgcgagggcaagaucguggggcucuacgggaacggaguggucaccaccagugguacguacgugagcgccaucgcacaggcuaaggcgucucaggagggcccccugcccgagauagaggaugagguguuucguaagcgcaaucugaccauuauggaccuccaccccggguccgguaagacccgccgcuaccugccggcuaucguacgggaggcuauuaagcgcaagcugcgaacccugauccuggcccccacccgggugguggcuagcgaaauggcggaggcucugaagggcaugccaauccguuaccagaccaccgcggugaaguccgagcacacugggaaggagauaguggaccucaugugccacgcuacguuuaccaugcgguuacugucgcccgugcgcgugccuaacuacaacaugauuauuauggacgaggcccacuucaccgaucccuccuccauugcggcucggggcuacauauccacacgcgugggaaugggcgaggccgccgcaauuuuuaugacggcgacuccacccggaagcguugaggccuucccgcaauccaacgcagucauccaggaugaggagcgggacauccccgagcgcagcuggaacaguggcuaugaauggauaaccgauuucagcggcaagaccgucugguucguucccuccaucaagagcggcaacgacaucgcgaacugccuccggaagaauggcaagcgcgugauucagcucucacggaagacguucgauaccgaguaccagaagaccaaaaacaaugacugggauuacguggugaccacagauaucagcgagaugggggcaaacuuccgagcugaucgugucaucgacccucgacguugccuuaagccgguuauucuuaaggauggucccgagcgggugauccuggccgggcccaugcccgugaccguugccuccgccgcgcagcgcaggggacggaucggccgcaacuauaacaaggaaggggaccaguacaucuauaugggccagccgcugaacaacgacgaggaccacgcccacuggaccgaggcgaaaauguuacuugacaacaucaacacccccgaagggauaauccccgcgcuguucgagcccgagcgcgagaaguccgccgcggucgacggagaguaucggcuccgcggcgaggcacggaagacauuuguagaacugaugcgccggggugaucugccgguuuggcuguccuauaaagucgccucagaggguuuccaguacagcgaccgccgguggugcuucgacggggagcgcaacaaccaggugcuggaagagaacauggacguggagaucuggaccaaggagggcgaccggaagaagcugcgcccgagguggcuugacgcccgcaccuacagcgacccccuggccuugcgagagcucaaggaguucgcggccgggcgccggagcguauccggcgauuuaauccuagagaucggcaaacucccccagcaccugacccagcgcgcccagaacgcacuggauaaccucgugaugcugcacaacagcgagcagggcgggcgggcguaucgccacgccauggaggaacugccagauacgauugagacacuaaugcugcuggcacucauugccgugcuuaccgggggcgucacucuguucuuucuuuccgggcggggccugggaaagacgagcaucggucugcuaugcgugauggccucuuccgugcuguuauggauggcguccgucgagccucacuggaucgcggccagcaucauacuggaguucuuccugauggugcugcucauucccgagcccgaucgccagcggacuccgcaggacaaccaauuggccuauguugucaucggucuccucuuuaugauccugaccguggccgcaaacgaaaugggacuucucgagacuaccaagaaggaccugggaaucggucacguggccgucgagaaccaccaccacgcugccaugcuggacguggaccuccaccccgccuccgcguggacccuguacgccgucgccaccaccauuauuacacccaugaugcggcacacgauagagaacaccacggccaacaucagccugacagccaucgcaaaccaggccgccaucuugaugggucuggacaagggcuggcccauauccaagauggacauaggggucccucugcuagcccugggcugcuauagccaggugaacccccugacgcuaaccgccgccgugcugaugcugguugcccauuacgcaaucaucggacccggcuugcaagccaaggcgacccgcgaggcccaaaagcggaccgcggcagggaucaugaagaauccgacgguggacggcauaguggcuauugacuuggaccccgucguguacgacgcgaaguucgaaaaacagcugggucaaaucaugcuccugauccugugcaccagucagauccuccuuaugcgcacuaccugggccuugugcgagagcaucacacuagccaccggaccacuuacgacccucugggagggcucucccgggaaauucuggaauacgacaaucgccgugagcauggcgaauaucuuccgaggcuccuaccucgcgggcgcugggcuggccuuuagccugaugaagucucugggcgggggacgccgggggacuggugcccagggagagacucugggcgagaaguggaaacgccagcugaaccagcucuccaagagcgaguucaauaccuacaaaagauccggcaucauggaggucgaccgcagcgaggcgaaggaaggccugaagcggggagagaccacaaagcacgcagugucacgugggaccgccaagcuacggugguucguugagcgcaauuugguuaagccggaagggaaggucaucgacuugggcuguggacggggcggcuggucuuacuacugcgcaggccugaaaaaggugacggaagucaaaggauacacaaagggaggcccugggcacgaggagcccaucccuauggccaccuacggcuggaaccuagugaagcugcacucugggaaggacguguuuuucaucccgcccgagaaaugcgacacuuugcugugcgauaucggcgaaagcucccccaaccccacgaucgaggagggucgcacacugcggguccugaagaugguggagccauggcugcgcggcaaccaguucugcaucaagauucucaacccuuauaugccaagugugguggaaacccuggagcagaugcagagaaaacacggagggaugcuggugcgcaacccccucuccagaaacagcacucacgaaauguacuggguguccuguggcaccgggaauauugucagugcggugaauaugacgagccgcaugcugcucaaccgcuucaccauggcucacaggaagccgaccuacgagcgcgacguggaucugggcaccggcacgcggcacgucgcgguggaacccgaaguggccaaccuggacauaaucgggcagcgcaucgagaacaucaagcacgagcacaagagcaccuggcauuacgaugaggacaaucccuacaagacgugggccuaccacggcaguuacgagguaaagcccuccggguccgcguccagcauggugaauggcguggugaagcugcucacaaagccgugggauguuaucccuauggucacgcagaucgccaugacggacacuacccccuucgggcagcaacggguauucaaggagaagguugacacgcgcacccccaaggccaagcgaggcacagcccagauuauggaggucacggcccgcuggcuauggggcuuccugucccguaacaagaagccgcggaucuguacucgggaggaguucacccgcaaggugcggagcaacgcggccauuggggcaguguuuguagacgagaaccaguggaacagugccaaggaggcgguggaagacgagcgcuucugggaccucgugcaccgggagcgagagcugcauaagcagggaaagugugcgacuugcgucuacaacaugauggggaagcgggagaagaagcugggcgaguucggaaaggcuaagggcucccgagccauuugguacauguggcucggagcgcgguuccuggaguucgaggcgcuggguuuuaugaacgaggaccacugguucucccgggagaacucccucuccggaguggagggggagggccugcauaaguuagguuacaucuugcgggacauaagcaaaauaccaggcggcaauauguacgccgaugacaccgccgggugggacacccgcauuaccgaagaugaucugcaaaacgaggccaagaucacggacaucauggaacccgagcacgcgcugcucgcgaaagccaucuucaagcugaccuaccagaacaaagugguccgaguacagcgcccggccaagaacggaacagugauggaugugaucucccgccgggaucagcgcgggagcggccagguuggcaccuacgggcugaacaccuucacuaacauggaggcccagcucauacgacaaauggagucugagggcaucuucagcccguccgagcuggagacgcccaaccuggcagagcgcgcgcucgacuggcuagagaaguacgggguggagcgacugaagcgaauggccauaagcggcgacgacugcgucgugaagccaaucgacgaucgcuucgcaacagccuuaacagcccugaacgacauggggaaggugcgcaaggacaucccgcagugggagcccuccaaaggcuggaacgacuggcagcagguccccuucugcucgcaccacuuccaucagcugaucaugaaggauggccgggagaucgucgugcccugucgcaaccaggacgaacucgucgggcgggcgcgcgugucccagggcgccgguuggucacugcgggagaccgccugucuuggaaagagcuacgcccagauguggcagcugauguacuuccaccggagagaccugcgccuagcggcgaacgccaucugcuccgccgugccaguagacugggugccaacgagccggacaaccugguccauucacgcccaccaucaguggaugaccacggaggacaugcucagcguguggaauagggucuggaucgaggagaaccccuggauggaggacaagacccauaucuccagcugggaggacgugcccuaccuggguaagcgcgaggaccaauggugcggcucacugaucggucuuaccgcgcgggccaccugggcuaccaauauccaaguggccauaaaucagguccgccggcuaauugggaacgaaaacuaccuggacuauaugaccaguaugaagcgcuucaagaacgagagugacccggagggcgcccucugguga

SEQ ID NO: 24229 - RNA, 9879 nt, Artificial Sequence
  derived and/or modified CDS sequence (opt11) from DENV-1__FJ461332__SS-prME
uccguaacgauguuacuaaugcuaaugccaaccgcacuagcuuuccaccucaccacucgaggaggagaaccacacaugauagucucaaagcaagagcgaggaaagucgcugcuauuuaaaacaucugcgggaguaaacauguguacccucaucgccauggaucugggggaacucugcgaggacacgaugaccuauaaguguccgcgcauaacggaggcugagccagaugacguagauuguugguguaacgcgacggacacaugggucacauacggaacuuguucucaaaccggcgagcaccgacgggacaagcgcagcguugcgcucgcaccacacgucggacucggacuagagacacgaacugagacguggaugucaagcgaaggcgccuggaagcaaauacaaaggguggagaccugggcccugcgacauccgggcuuuacagucauugcacuauuucuggcucacgccauaggaaccagcaucacccaaaaagggauaauauucauucuacugauguuagugaccccaagcauggcuaugagguguguuggcaucggaagcagggacuucgucgaaggucucuccggcgccaccugggucgacguaguguuagagcacgggucguguguuacgacaauggccaaagauaagccgacccuugacauagaacuacucaaaacagagguaacgaaccccgccguauugcggaaacuauguauagaggcgaaaauuuccaacacaacaacggacucacgcugucccacccaaggggaagcaacccucgucgaagaacaagacgcgaacuucgugugccgaaggacauucguggaccgaggauggggaaacggaugcggacuguucggcaagggcagccuuaucacaugcgccaaauucaaaugcguaacgaaacucgaaggaaagauaguacaauaugaaaacuugaaauauagcgugauaguaacaguacacacuggcgaccagcaccaaguaggcaaugaaucaacugaacacggcacgacagccaccaucacuccgcaagcacccacaaccgaaauccaacugacggacuacggcgcacucacgcucgacugcaguccccguacgggacucgacuucaacgaaaugguacugcugacaaugaaagaaaagucauggcucguccacaaacaaugguuucuggaucuaccgcucccuuggaccagcggagcgagcacgagccaagaaaccuggaauaggcaggaccuauuggucacauucaagacagcacacgccaagaaacaagagguagucguacucggaucacaagaaggcgcgaugcacacagcacucaccggugccacggagauacagacaagcggcaccacaacuauauuugccggccaccugaaaugucgucuaaaaauggacaagcucacccuuaagggaaugucguaugugaugugcacaggcagcuucaaacucgagaaggagguggccgaaacccaacacggaaccgugcuaguucaaauaaaauaugagggcacggacgcaccauguaagauaccauucaguacacaggaugagaaaggaguuacucagaacgggcgacuuaucacggccaauccaaucguaacggacaaggaaaaaccugucaacaucgaagcagagccaccguucggagagucauauauagucauaggggcgggugaaaaagcacuuaaacugagcugguucaagaaagguuccucgauaggaaaaauguuugaggcaacggcccggggugcccgccggauggcgauauuaggggacaccgcuugggacuuuggcucaaucggaggcguauucacguccgugggaaaacuaauucaccaaauauucgggacugcauacggcguucuauucucgggagucaguuggacaaugaagauaggcauagggguguuacucaccuggcucggcuuaaacucccggagcacaucccugaguaugacaugcaucgcaguaggccuagucacgcuguaccuuggcgucaugguccaggccgacuccggcugcguaauuaacuggaaaggaagggaacuaaaaugcggaagcggaaucuucguaaccaaugagguccacacauggaccgaacaauacaaauuccaggcagacucaccaaaaaggcucagcgccgcuauaggaaaagcgugggaggaaggcgugugcgguauucgaagcgcaacacgacuagagaauauaauguggaaacaaauaucgaacgaacucaaccacaucuugcuggagaacgacaugaagcugacggucgucguaggagaugucgccgggauccugggucagggcaagaaaaugauacgaccccaaccgauggaauacaaauacagcuggaaaaguugggguaaggccaaaauaauaggagcagacgcccagaauacgacuuucauaauagacggaccuaauaccccggaaugccccgacgaccaaagagcauggaauaucugggaaguugaagauuacggcuuuggcaucuuuacuacaaacaucuggcucaaacucagagauagcuacacgcaagucugcgaccacaggcugaugucggccgcgaucaaggacuccaaggcgguccaugcggacaugggcuacuggauagagagcgagaaaaacgagacauggaaacuggcacgagcaucguucaucgaagucaaaaccuguauuuggccuaagucacauacccuauggaguaacggcguacuagaaagcgaaaugaucaucccuaagaucuacgguggcccuauaagccaacauaauuaucguccaggcuacuucacucaaacggccggaccauggcaccuaggaaagcuagaauuggacuuugaccuaugcgaagggaccaccguugugguugacgaacacugcggaaaucgcggaccaucgcugagaacaaccacugucacgggcaaaauaauccacgaguggugcugccgcagcugcacgcuaccaccacuuagauucagaggcgaagacgguugcugguacggcauggaaauacgacccgucaaggaaaaagaggagaaucuggucaagucaauggugucagcagggucaggggaaguagacagcuucagccucggacugcuguguaucagcaucaugauagaggaggucaugcgcucccgauggucccgcaagaugcuuaugacgggaacguuggcaguguucuuccuacugauaaugggacaacuuacauggaacgaccucauccgacuguguauaauggugggggccaacgcauucgaccggaugggaaugggcaccacuuaucuggcacugauggcgaccuucaaaaugcgaccgauguucgcugucggacuacucuuccgacggcuaacuagccgcgaaguucugcuccucaccauuggccuaucccucgucgcaucggucgaacucccaaacagucuugaggaacuuggagauggauuggcaauggggaucaugauucuuaaauuguugacggauuuccagagccaucaacuaugggccacccuccucucgcuaacguucauaaagacgaccuucucccuccacuacgcuuggaaaacaauggccaugguccucagcaucgugagucuguucccccucugccuaagcacgacgagccagaaaacaacaugguugcccguacuccucgggucacucggguguaagcccuugaccauguuccucauagcggagaacaagaucuggggucgaaaaagcuggccacuaaacgaggggauaauggccgugggaaucguaaguauauugcuauccucccugcuaaagaaugacguaccccucgcggggccccuaaucgccgggggaaugcucaucgcaugcuaugucauaucgggauccagugccgaccuaucgcucgaaaaagccgcggaaguaucgugggaagaggaggccgagcacaguggagccagccacaacauccuaguugaaguucaagacgacgggaccaugaaaauaaaagacgaggaacgagacgacacgcuaacaauacuucuaaaagccacacugcuagcuguuagcgggguauacccguugagcaucccagcgacccuguuugucugguacuucuggcagaaaaagaaacaacggucaggggugcugugggauaccccaaguccucccguagucgaacgugcagugcucgacgauggcauauaccgaauaaugcaaagaggguugcucggaaggucacaggugggagugggcguauuccaagagaacguauuccacaccauguggcacgucacaagaggagcugugcuaauguaccaggggaaacgacuugaacccagcugggcuucggugaagaaagacuuaauaagcuaugguggagguuggagacuccgcggaaguuggaacacgggggaagagguacaagucaucgccgucgagccgggcaaaaacccgaagaauguacaaacugccccggggacauuuaaaacaccagagggagaagucggugccaucgcucuagauuucaaaccaggcaccaguggcucgccgaucguaaaccgugaaggcaaaaucgucggacuuuacgggaacggcguugugacuacgucaggcaccuaugucagcgcaauagcccaggcaaaagcaagccaagaagggccccuccccgaaauugaagacgagguguuuaggaagcgcaaccucaccaucauggaccuacaucccggauccgguaaaacacgccgauaccuacccgccaucguacgcgaagcaauaaagcgaaaacuccgaacuuuaauucuagcacccacgagaguuguggccuccgaaauggccgaggcccugaaaggaaugcccauacgguaccaaaccacagcggugaagucagaacacacgggaaaagaaaucguagacuuaaugugccacgccacguucacaaugcggcuucugucuccagugagagugccaaauuacaacaugauaauaauggaugaagcccacuuuacagacccaucaagcaucgccgcacguggcuauaucucgacaaggguaggaaugggugaggccgcggcaauauuuaugaccgcaacaccaccgggcucagucgaagccuucccacagagcaacgcggugauucaagaugaagaaagggacauccccgaaaggucauggaacucgggccacgaauggauuacugacuuucccgguaaaacaguuugguuugugcccuccaucaagucgggaaacgauaucgcaaauugucuacgcaaaaacgguaaacggguaauacaacuaucaagaaagacauucgacaccgaguaccaaaagaccaaaaacaacgacugggauuauguugugacaacagacauaucagaaaugggcgcgaacuucagagccgaccgggugauagacccucggcggugcuugaagccuguaauacuuaaagacggaccagaacgcgugauacuagcuggaccgaugcccgucaccguggccagcgcagcccagcgucgcgggcgcauagguagaaaccacaacaaagagggcgaucaauacaucuacaugggucagccguuaaacaacgacgaagaccaugcgcacuggacggaagcaaagaugcuguuggacaacauaaacacgccagaaggcaucauuccggcacuuuucgaaccggaacgcgagaagucagccgcagucgacggcgaauaccgauugaggggugaggcccgcaagaccuucguagaguugaugaggagaggggaccugccaguauggcucuccuauaaaguagcuucggaaggauuucaauacucggaccggagauggugcuucgacggggagcgaaauaaucagguccuggaagagaacauggacgucgaaaucuggacuaaggagggcgaacgaaagaagcuacggccgcguuggcuagacgcacgaacguacagcgacccccuagcccucagagaauuuaaggaguucgcggcggggaggagaagcguauccggcgacuuaauccucgaaauaggaaaacuaccacaacauuuaacgcagagagcgcaaaacgcgcucgacaaccucguaaugcugcauaacucagaacaagggggucgcgccuacaggcaugcaauggaggaacuaccagacacaaucgaaacuuuaaugcuguuggcccuaaucgcugugcuaaccggcgguguaacgcuauucuucuugagcggcagaggacucggaaagacaagcauuggucuacugugcguuauggccuccucggugcuacucuggauggcgucaguagaaccccauuggaucgcggcaaguauaauacuggaguucuuccucaugguccuccugaucccagaacccgauaggcaacgaacaccucaagacaaccaacuugccuauguagugauaggccuauuauucaugaucuugacaguugccgcaaaugagaugggccuacucgagaccaccaagaaagaccucggcauuggccacgucgccgucgagaaccaccaucacgcagcaaugcuagacgucgaccuccacccggcaucagcauggacacuuuacgccgucgcuacaacaaucaucacaccgaugaugcgacauacaaucgagaacacgaccgccaacauaagccuaacagcgaucgccaaccaagcggcaauacugaugggguuggacaaaggcuggcccaucucaaagauggauauaggcgugccguuacucgccuugggaugcuauagucaagucaacccccuaacccucacagcugccguauugauguugguagcucacuacgcaauaauagggccaggacuucaggcaaaagccacacgagaagcccagaagcgaaccgcagcaggaauaaugaagaaccccacugucgauggaauaguagcgaucgaccuggacccgguagucuacgacgucaaauucgaaaaacagcucgggcagaucaugcuucugauacucugcacaucccagauacuucuaaugcgcacuacaugggcucuuugcgaaagcaucacacucgccaccggaccacuaaccaccuuaugggaaggaucgcccgggaaauucuggaacacaacgaucgcaguuagcauggcuaacaucuuccgaggcuccuaccuagcgggggcggggcuggccuucagccucaugaaaucacugggaggagggcgccgaggaacaggcgcacaaggggagacauuaggcgaaaaauggaagcggcagcuaaaccaacuaucgaagagugaguuuaacaccuacaaaagaagcggaaucauggaaguagacaggagugaagccaaggaaggacucaaacgcggagaaacaacuaaacacgcgguuaguagaggaacugcaaaacuucgaugguucguagagcgcaauuugguaaagccagagggaaaaguaauagaucugggaugcggcagaggcggguggucauacuacugcgcugggcucaagaaagugacagaaguaaaaggcuacacgaaaggggguccgggccacgaggaaccaaucccuauggcaacuuaugguuggaaccuuguaaaacuccacagcggaaaggauguguucuucauaccacccgaaaaaugcgauacauuauuaugugacauaggagaaagcucgccuaauccgacaaucgaggaaggaaggacccugcgcgugcuuaaaaugguagagccauggcuucgggguaaccaauucuguaucaaaaucuuaaauccguacaugccguccguggucgaaacccuugaacagaugcagaggaagcacggggguaugcucguucguaacccacuaucacggaacucaacgcacgaaauguauugggucuccugcgggacaggaaacaucguaagcgcagucaauaugacaagcaggaugcuccucaaccgcuucacgauggcccauagaaaaccgacguaugagcgcgacgucgaucugggaacugggaccaggcacgucgcaguugaaccggaaguagccaaccucgacaucauuggucagcggaucgaaaacauaaagcaugaacauaaaagcacauggcacuacgaugaagacaauccauacaaaacaugggccuaccauggguccuacgagguaaaaccgagcggaagcgcaucaagcaugguaaaugggguuguaaaacuccucaccaagccaugggaugugauuccaaugguaacacagaucgcuaugacggacacuacgccuuucgggcaacaaaggguauucaaggagaaaguagacacaaggacccccaaggcaaagcgaggaacggcgcaaaucauggaaguaacggcacgaugguuauggggauuccugagccgcaacaagaaaccgaggauauguacacgcgaggaguucacacgaaaagugcgaagcaacgcagcgauaggcgcaguauucguagacgaaaaccaguggaacucggcuaaggaggcgguggaagacgaacgguucugggaccuaguccacagagagagggaacuacacaagcaggguaagugcgcaacaugcguauacaacaugaugggaaagagagagaaaaaguuaggagaauuuggaaaggccaaagggagcagagccauaugguacauguggcucggugcaagauuccuugaguucgaggcgcucggauucaugaacgaagaccacugguuuagucgggagaacucgcucagcgggguugagggggaaggucugcacaaacucggauacauacuacgggacaucuccaagaucccagggggaaacauguaugcggacgacaccgccgguugggacacgagaauaacggaagacgaucuccaaaacgaagcaaagaucacagauaucauggaacccgaacaugcccuacucgccaaagccauauucaaguuaacuuaccaaaacaaaguugucagaguccagagaccugccaaaaaugggacugucauggacguaauuagucgaagagaccaacgaggaucugggcagguuggcacguauggacucaacaccuucacgaacauggaagcacaacucauccgucaaauggaaucggaagggaucuucagcccaagcgagcucgagacgccaaaccucgccgagcgugcgcuggauuggcuggagaaauacgggguagaacgccucaaacgcauggccaucagcggggacgauuguguagugaaacccauagacgaccgcuucgccacggcccugacagcgcugaacgacaugggaaaaguucgaaaggacauaccacagugggaaccauccaaggguuggaacgacuggcagcaagugccauucugcucucaucacuuucaccaacucauaaugaaggauggcagggagauagucguccccugcaggaaccaagacgagcuaguaggucgggcacgaguaucacaaggcgcaggcuggucucucagagagaccgccugucucggaaagucguacgcccaaauguggcagcuaauguacuuccauagaagagaccucagguuggcagccaaugcaauuuguagcgcaguaccaguugacugggugcccaccagccgaacgacauggucaauacacgcgcaucaucaauggaugacaacugaggacaugcuaagcguauggaaccgaguauggauugaggagaauccauggauggaagacaagacccacauaucgucuugggaggauguccccuacuugggaaaaagggaagaccaauggugugggucacuaaucgggcucaccgcgcgagccaccugggccaccaacauacagguggccauaaaccagguccgcaggcuaaucggaaacgaaaacuaccucgauuacaugacaucaaugaagcgcuuuaaaaaugaaucggauccagagggagcucucugguag

SEQ ID NO: 24230 - RNA, 9879 nt, Artificial Sequence
  derived and/or modified CDS sequence (opt11) from DENV-1__FJ461333__SS-prME
agugugacgaugcugcucaugcuaaugcccaccgccuuagccuuccaccucacuacccggggcggggagccccacauggucgugucuaagcaagagcgggggaaaagccugcuguuuaaaaccagcgcgggggugaacaugugcacgcucauugccauggaccugggcgagcucugcgaggacacaaugaccuauaagugcccacggaucaccgaggccgagccugaugacguggacuguuggugcaacgccaccgauaccugggugaccuacgggaccugcagccagacaggcgagcaccggcgggacaagcgaucgguggcccucgcgccucacgucggacucgggcuggagacgcgcacagaaaccuggaugaguuccgagggcgccuggaaacagauccagcggguugagaccugggcccuacgccaccccggguucacaguuauugcccuguuucuggcccacgcgaucgggaccucgaucacccagaaagggaucaucuucauucucuugaugcuggucacccccuccauggccaugaggugcguggggaucgggagcagggacuucguggaggggcucuccggagccaccugggucgacgugguacuggagcauggguccugcgucaccaccauggcgaaagauaagcccaccuuggacauugagcuccugaagacagaggugacaaaccccgcgauccugcggaagcucuguauugaggcaaagaucuccaacaccacuacagauagccgcugcccgacccaaggcgaggccacccugguggaggagcaagacgccaacuucgucugccggcgcaccuucguagaucggggcugggggaacggcugugggcuguucgggaaaggcuccuuaauaaccugcgccaaguucaagugugucaccaaauuagagggcaagaucguucaguaugagaaucugaaguacagcgugaucguuaccguccacacaggggaccaacaccagguggggaaugaguccacggaacauggcaccacggcuacgaucacgccccaagcccccacgacggagauccagcuaaccgacuauggcgcucugacucucgacugcagcccucgcacgggccucgacuucaacgagaugguccugcugaccaugaaagaaaaguccuggcucguacacaagcagugguucuuagaccucccacuccccuggacaagcggggccagcacaagccaggagacguggaaucggcaggaccugcuggugaccuucaagacggcucacgcaaagaagcaggagguggucgugcugggcagccaagaaggcgccaugcacaccgcccugacgggggcuaccgagauucagaccaguggcaccacuaccaucuucgcugggcaccugaagugccgccuuaaaauggacaaacugacccuuaagggcaugagcuaugucaugugcaccgggaguuucaagcucgaaaaagagguggccgagacgcagcauggcaccgugcugguccaaauuaaguacgagggcaccgacgcgcccugcaagauccccuuuucgacgcaagacgaaaagggggugacccaaaacgggcgucugauuacagccaacccgaucgugacagauaaggagaagcccgucaacaucgaggccgaaccgcccuucggggagaguuacauugugaucggggcaggcgagaaggcccugaaguuaaguugguucaagaaggguuccucaauugggaagauguucgaagcaaccgcccgcggggcccggcgcauggcuauccugggggacaccgccugggacuucggguccauuggcggcguguucacguccguggggaaacuuguccaccaaauauucgggaccgccuacgguguccuguucucgggcguaagcuggaccaugaaaauuggacugggcguccugcuuacguggcuaggacugaacucccguuccaccucccucucuaugaccugcauugcuguggggcuggucacccuguaucuaggggucauggugcaagccgacagcgguugcguaaucaacuggaagggccgggaacugaaaugcgggagcggcaucuucguaacgaacgagguccacaccuggaccgagcaguauaaguuccaggcagacagcccgaagcgacuguccgccgccauaggcaaggcuugggaggagggaguuuguggcauacgaagcgcgacccggcucgagaacguuauguggaagcagaucuccaacgagcugaaucacauucuguuggagaacgacaugaaguuuaccgugguggugggggacguggcgggcauccuggcucaggguaagaaaaugauccguccacagccaauggagcacaaauacagcuggaaguccuggggcaaagcgaaaaucaucggcgcagacguucagaauaccaccuucauaauagacgggcccaacaccccggaauguccagacgaccaaagggcguggaauauuugggaagucgaggauuacggauucgguaucuucaccacgaauaucuggcuaaaauuaagggacagcuauacucaaguaugcgaccaccggcugauguccgcggcaaucaaggacagcaaagccguccacgccgacaugggcuacuggaucgaauccgagaaaaacgaaaccuggaaacuggcgcgggccagcuucaucgaaguuaagaccugcaucuggcccaagucccacacguuguggagcaacggagugcuggaauccgagaugaucauucccaagauuuacgggggaccuaucagccagcacaacuaccggcccggguacuucacccagacugccggccccuggcaccuugguaagcucgagcuugacuucgaccuuugugagggcaccaccgucgugguggacgagcacugcggcaaccggggaccgucccugcguaccaccacuguuacgggcaagauaauccacgaguggugcugccggaguugcacccugccaccccugcgcuuccgcggggaggacgguugcugguacgguauggaaauccgccccgugaaagaaaaggaagagaauuuggugaagaguauggucucugccgggagcggggagguggacaguuuuucauugggacugcucugcauuuccaucaugauagaggaggucaugcggagccgauggucccgaaagaugcugaugaccggcacccuugccgucuuccuacuacugaucaugggacagcugacguggaacgaucugauccgucucugcaucauggucggcgcgaacgcgagcgaccgcauggggaugggcaccaccuaccucgccuugauggccacguucaaaaugcggcccauguucgccgugggcuuacuguuccgacgucugacgucucgcgaagucuugcuccugaccaucggccugagccucguagcgucagucgagcugccgaacagcuuggaagaacucggcgacggucuggccaugggcaucaugauacugaagcucuuaacugauuuccagucccaccaacucugggccacucuccugagccucacguucaucaaaaccacuuucucacuucacuacgccuggaagacuauggcgaugguccugagcaucgucucccuuuucccccucugcuuaucgacaaccagccagaaaaccaccugguugcccguccuccuggguagccugggaugcaagccauuaacgauguuucuaaucgccgagaacaagaucuggggaaggcgcuccuggccccugaaugaggggaucauggccguggguaucgucagcauccuccugagcucacuauugaagaacgacguccccuuggccgggccccugaucgcgggaggcaugcucaucgcuugcuacgugauaucgggauccagugccgaccugagccucgagaaggccgccgaggugagcugggaagaggaggccgagcacuccggcgcaagccauaacauccucguagagguccaggacgaugggacaaugaaaaucaaggacgaggagagagacgacacccugacuauccugcucaaggcuacccugcuggccguauccggcgucuacccguuaagcauccccgccacgcuauucgugugguacuucuggcagaagaagaaacagcgcuccggggugcugugggacacccccucgccgcccgaggucgagcgggccgugcuggacgacggcauauaucgcaucaugcagcggggccuucuugggcgcucacaagugggaguagguguguuccaggagaauguguuccacaccauguggcauguuacgcggggcgcggugcugauguaucaagggaagagacuggagccuagcugggccuccgucaaaaaggaccuuaucagcuacggcggagguuggcgccugcagggaucuuggaacacgggcgaggagguacaggugauugccguggagccuggcaagaaccccaagaacguccagacagcccccgggacuuucaagacccccgaaggcgaggugggcgcuaucgcucucgacuucaagcccgggacaaguggcucccccaucgugaaccgcgaggggaagaucguaggcuuguacgguaacggggugguaacuaccagcgggaccuacgucagcgccauagcccaggccaaagccucccaagagggaccgcugcccgagaucgaggacgagguguuccgaaagcgcaaucucaccaucauggaccuccaucccggcucuggaaagaccaggcgcuaccugccggccaucgugcgggaggccaucaagagaaagcuccggacacugauccuggcccccaccaggguuguggccagcgagauggcggaggccuuaaaggguaugccaauucgcuaccagacgaccgcaguaaagagcgagcauacaggaaaggaaaucguagaccugaugugucaugccaccuuuacgaugcggcugcuuucccccguacgcguaccgaacuacaacaugaucaucauggacgaagcccacuucaccgaccccagcucgaucgcggcacggggauacaucuccacccgcguaggaaugggggaggccgccgccaucuuuaugaccgcgacgccgcccggcuccguggaagccuucccgcagagcaacgcagugauccaagacgaggaaagagacauccccgagcgcuccuggaacagcggguacgaguggaucaccgacuuccccgguaaaaccguuugguuugugcccuccaucaagagcggcaacgacaucgccaacugccugaggaagaacgggaagcgcgugauucagcugagucgaaagaccuucgacacggaguaccaaaagaccaagaauaacgacugggauuacguagucaccacugauaucagcgagaugggagcgaacuuccgcgcugacagagugaucgauccgagacguugccucaaaccugucauccugaaagacgggccagaacgggugauccuggccggccccaugccggucacgguagcaagcgccgcgcaacggcgcgggcggauaggccgcaaucauaacaaagagggggaucaguacaucuacaugggucagccacucaacaacgacgaggaccacgcccacuggacugaagccaagaugcuuuuggacaacaucaauacccccgagggcauuauucccgcccuuuucgagccugagcgcgaaaagucugcugcgaucgauggagaguaccggcuucggggcgaggcccggaagaccuucguggaguugaugcgccgcggcgaccugcccgucuggcugucauauaagguggccagugagggcuuccaauauagcgaccggcgguggugcuuugacggugagcgaaacaaccaaguucuggaagaaaauauggacgucgagaucuggaccaaggaaggggagcggaaaaaguuacgcccucgaugguuagaugcccgcaccuacuccgacccccuggcccuccgagaguucaaggaguucgcugcgggccgccguaguguuuccggggaucugaucuuagaaaucggcaagcugccgcagcauuuaacccagagggcucagaacgccuuggacaacuuggucaugcuacacaacagcgagcagggcggccgugcguaccgccaugcaauggaggagcuacccgacacuaucgagacguugaugcuguuagcccucauagccguccugacagguggaguaacccuguucuuuuuguccggucgugggcugggcaaaaccucuaucggccugcucugcgugauggccucgaguguccuguuguggauggcuucgguggagccucauuggaucgcggcauccauaauccucgaguucuuccuaauggugcugcucauccccgagccugaccgccagcggacgccucaggacaaucagcuggccuaugucgugaucgggcuucucuucaugauccuaacugucgccgcgaacgagaugggcuuacucgaaacgaccaagaaagauuuagggaucggccacgcggccgucgggaaccaucaucacgccgccaugcuagaugucgaucuacaccccgcgucagccuggacccuguaugccguggccaccacaauuaucaccccgaugaugcgccacacaaucgagaacacgaccgccaauaucagccuuaccgcgauugccaaccaggcugccauccucaugggccuggacaagggcuggcccaucucuaagauggacaucggcguuccccugcucgcgcugggcuguuauagccaagugaacccgcugacgcugacggcggcagugcugaugcuggucgcccacuacgcgaucaucgggccgggccuccaggcgaaagccacccgcgaagcccagaagcggaccgccgccgggaucaugaaaaaucccaccguggacggcaucgucgcgaucgaucuggacccgguugucuaugacgccaaguucgagaagcaacugggccagaucaugcuccugauccugugcacgucucagauucuccugaugcgcacgaccugggcuuuaugcgagagcauuacccucgcgacggggccccucacaacccuaugggagggauccccgggcaaguucuggaacaccaccauagccgugagcauggcgaauauuuuuaggggcuccuaucucgccggcgccggccuggccuucagccugaugaagucacucggcgggggcaggcgggggacuggcgcgcagggcgagacccugggggagaaguggaagcgccagcugaaccaguuguccaagucggaguucaacacguacaagcgguccggcauuauggaagucgaccgcagcgaggccaaggaggggcugaaacggggcgagacgacaaagcacgccgugagucgcgggaccgcaaagcugcgcugguucguggagcgcaaccuggugaagcccgagggcaagguaaucgaccuaggcugcgguagaggaggguggucguacuacugcgccggcuuaaagaaggugacagagguaaagggguauacaaagggaggcccggggcaugaggagccuauaccgauggcgaccuacggauggaaccuggugaagcuccauuccgguaaggacguauuuuucauaccgcccgagaagugcgauacuuuauugugcgacaucggcgagucuagccccaacccgacuaucgaggaagggcgcacgcuccggguccugaagaugguggaacccuggcugcgcggcaaccaguucugcaucaagauacugaaucccuacaugccgucuguagucgaaacacuugagcagaugcaaaggaagcauggagggaugcucgucagaaaucccuugucaagaaauucaacccaugagauguacuggguguccuguggcaccgggaacauagucagcgcugugaacaugaccucccggauguuacugaacagauucacgauggcccaucggaagccuacuuacgagcgcgaugucgaucucggcgcugguacccgucacgucgccguggaacccgagguggcgaaccuggacaucaucgggcagcggaucgagaacauuaagcacgagcacaagucgaccuggcauuacgacgaagacaaccccuauaagacgugggcguaccacggcuccuacgaggucaagccuucgggguccgccagcaguauggugaacggcgucgugaagcuauugaccaagcccugggacguaauuccgauggucacccagaucgccaugaccgauacaacgcccuucgggcagcagcggguguucaaggaaaaaguagacacccgcacuccgaaggcuaagcgcgguacggcucaaaucauggaggugacagccaaauggcuguggggcuuccugagccgaaacaagaagccgcgaauaugcacccgcgaagaguucaccaggaaggugcggaguaacgccgccaucggggcagucuucgucgacgaaaaccaauggaacucugccaaggaggccguugaggaugagcgguucugggaccucgugcaccgcgagcgcgaguuacacaagcaggggaaaugugcaacuugcguauacaacaugauggggaagcgggagaagaagcugggagaguucgggaaggccaagggcagccgggcaaucugguacauguggcuuggcgcccgcuuccuggaguucgaggcccugggguucaugaacgaagaccacugguuuucccgagagaacagccucuccgggguagagggggagggccugcauaagcugggauacauccuacgagacaucagcaagauccccgguggcaacauguacgccgacgacaccgccgggugggacacccggauaaccgaggacgaucugcagaacgaggcgcguaucacggacauuauggagccggaacacgcgcugcuagccaaguccauauucaagcugaccuaucaaaacaaaguggucagagugcagagacccgccaaaaacggaacugugauggaugucaucagccgacgagaccagcgcggguccggccaagugggcacauacgggcugaauacguucacgaacauggaggcacagcuaauccggcaaauggagagcgaaggcaucuucucgcccagcgagcucgagacccccaaccuggcugagcgcguguuggauuggcuugagaaguacgggguugagcggcugaagcgcauggcaauaucaggcgaugacugcguggucaagccgauagacgaucgguucgccacagccuugacggcccugaaugacauggguaagguucgcaaggacauuccccaaugggagccgaguaagggcuggaacgacuggcagcaggucccuuucugcucccaucacuuccaccagcuaauuaugaaggacggccgggagaucgugguaccgugucgaaaccaggacgaguuagugggccgggcgcgcguaagccagggugccggguggaguuuacgggaaaccgccugccuaggcaaguccuacgcccagauguggcagcucauguacuuccacagaagggaccuucgguuagcggccaaugcuauaugcucggccguacccguggauuggauaccaacuucccggaccacguggagcauccacgcacaccaccaguggaugacaacagaggacaugcuuaguguguggaaccgcgucuggaucgaggagaaccccuggauggaggacaaaacccauaucagcaguuggggcgacgucccguaccuggggaagcgcgaagaucaguggugcggcaguuuaaucggacucacggcgcgcgcuaccugggccacgaauguucagguggcuauuaaccagguccgccggcugaucggcaaugagaacuacuuagauuacaugaccuccaugaaacgauucaagaacgaaucagacccggagggggcccugugguga

SEQ ID NO: 24231 - RNA, 9879 nt, Artificial Sequence
  derived and/or modified CDS sequence (opt11) from DENV-1__FJ410262__SS-prME
ucugugacuaugcuccuaaugcugaugcccaccgccuuagccuuucaccucacgacccgcgggggagagccccacaugaucguuagcaaacaggagcgcggaaaaagccugcuguucaaaacaagcgcgggggugaacaugugcacccucaucgcuauggaucugggugaguucugcgaggauacgaugaccuacaaguguccccgcauuacagaggcggagcccgaugacguggacugcuggugcaacgccacggacaccugggugaccuacgguacuugcagccagaccggcgagcaucggcgagauaagcgguccgucgcccuggcgccccacguugggcucgggcucgaaacgcgcacugagaccuggaugucguccgagggcgcuuggaagcagauccagcguguggaaacuugggcccuccgccauccaggguucacggucaucgcccucuuccuugcgcaugccauaggcaccagcaucacccaaaaggggaucauuuucauacuacucaugcugguuacccccaguauggcgaugcggugcgucggcauuggcagccgcgacuucguugaggggcuauccggggccacuuggguagaugucgucuuggagcacgggagcugcgugaccaccauggcuaaagacaaacccacucuagacaucgagcuacucaagacggaggucaccaacccagcgguguuaaggaaauuaugcaucgaagcuaagaucuccaacacgaccacggacagccgaugcccgacccagggcgaggcaacccuuguggaggagcaggacgccaacuucgucugccgacgcacauucguggaccgggguugggggaacggaugcgggcuguucgggaaggggucccuaauaacgugcgccaaguucaagugcgucacuaaacucgagggcaagaccguccaguacgaaaaccugaaauacagugucaucgugacgguccacacuggggaucagcaccagguggggaacgaguccacugaacacgguacuacggcaaccaucacuccccaggcuccgucaaccgagauacagcuaaccgacuacggggcccucacacuggauugcagccccagaacgggccuggacuuuaaugagauggugcuccugacuaugaaggaaaaauccuggcucguucauaagcagugguuuuuggacuuaccgcugccauggaccuccggcgcaagcaccagucaggagacguggaaccggaaggaucuucugguaacguucaaaacagcucacgcaaagaagcaagaggucgucgugcugggcucccaggagggcgccaugcacacggcucucacgggggccaccgaaauccagaccagcggcaccacgaccaucuucgccggccaucuuaagugucgccugaagauggacaagcucacccugaaaggcauguccuacgucaugugcacugggucauucaagcuugaaaaggagguggcagagacacagcacggcaccgugcuuguccagauaaaguacgaaggaaccgacgcccccugcaagaucccuuucuccacccaagacgagaagggggugacacaaaacgggcgguuaauuaccgccaacccgaucgugacugacaaagagaagcccgugaacauugaggccgagccacccuucggggaguccuacaucgugaucggagcgggugagaaggcguuaaaacugagcugguucaagaaggggagcucuaucggcaagauguuugaggccaccgcacgcggggccaggcgcauggcgauucucggugacacggccugggacuuugggucaauaggcgggguguucaccuccgucgguaagcuggugcaccagauuuucgggacagcauacgggguuuuguucucaggcgucuccuggacgaugaagaucgguaucggcguccuccucacuuggcugggccucaacagccgcuccaccagcuuauccaugaccugcauagcugugggccuugucacccucuaccugggcgugauggugcaagccgauucugggugcguuaucaacuggaaaggccgugagcugaagugcggaagcggcaucuucgugacgaacgaagugcacaccuggaccgagcaguacaaguuccaagcggacucccccaagcgcuuaagcgcagccauuggcaaggccugggaggagggggucugcggcauccggagugcuacccgccuugagaacaucauguggaagcagaucagcaacgagcugaaccacaucuuacuggaaaaugacaugaaguucaccgugguagucggggacgucgccggcauccuugcccaggggaagaagaugauacggccccagcccauggaguacaaguacuccuggaaguccuggggcaaggcgaagaucauuggcgcugacgugcagaauacaacauucauaauagacgggccaaacaccccggagugccccgacgaucagcgcgccuggaacaucugggagguggaggacuacggcuucgggaucuucacaacaaacaucuggcucaaacugcgggacagcuacacacaaguaugcgaccaccgauugaugucugccgccauuaaagacuccaaggccguacacgccgacauggguuauuggaucgagagcgagaagaaugagaccuggaagcucgcacgggccuccuucaucgaggucaagaccugcauauggccuaagucucacacguuaugguccaauggcguucuggagagcgagaugaucaucccgaagauuuacggcggucccauaucccagcacaacuaucgccccggguacuucacccagaccgccggccccuggcaccuugggaagcuggaacuggacuucggccucugcgaaggcacgacgguuguuguggacgagcauugcgggaaccgaggcccgagccugcgcaccaccaccgugacggguaagaucauacacgagugguguugccgguccugcacccugccgccgcugagguucaagggcgaggacggguguugguacggcauggagauccgucccgugaaggagaaggaggagaauuuggucaaaucgaugguuagcgcuggguccggggaggucgacagcuucucccuugggcugcuuugcaucagcaucaugaucgaggaaguaaugcgcagucgguggagccgcaagaugcugaugacugggacgcucgccguguuuuuccugcugaucauggggcagcucacguggaaugaccugauucggcucugcaucauggucggggcgaacgccuccgaucgaaugggcaugggcacaaccuaccuggcccugauggccaccuucaaaaugcgcccaauguucgcgguggggcuccuguuccgccgccugacuagucgggagguucugcuccugaccaucggccuaucucucgucgcaagcguggagcugccuaacaguuuggaggagcucggggacggucuggcgaugggcaucaugauccugaaguuacugaccgacuuccagagccaucagcugugggccacccuacugucccugacguucaucaagaccaccuucagccuccauuacgccuggaagaccauggcuaugguccucuccaucgugucauuguuuccccucugcuuaucgacgacuagccaaaagacuaccuggcucccggugcuccugggcucgcuggguugcaaaccgcucaccauguuccugaucgccgaaaacaagaucugggggcguaagucuuggccacugaacgagggcaucauggccgucgguaucgugucaauucuucuguccagccuguuaaagaacgacgugccccuggccgggccccugaucgccggcgggaugcucaucgcguguuauguuaucucuggaagcagcgccgaccuaucgcuggaaaaggccgccgaggucuccugggaagaggaggcagagcacagcggggcgucccauaacauucucguugaagugcaggacgacggcaccaugaagaucaaggacgaggagcgggacgacacccuuaccauccugcucaaggccacccugcuagccgucucggggguauacccguuaucgauucccgccacccuuuucgucugguacuucuggcaaaagaagaaacagcguagcggcgugcugugggacacucccaguccgcccgagguggagcgggcaguccucgacgauggcaucuaccgcauuaugcaacgggggcuguugggccguucacaggugggagugggcgucuuccaagagaacguguuccauacaauguggcacgugacacguggggcgguccugauguaccagggcaagcgccucgagccuaguugggccagcgugaaaaaggaccugauuuccuacggcggugguuggaggcuccagggguccuggaacacgggcgaggagguccaggugaucgccguugagcccgguaagaacccaaagaacguacagacagcaccgggcaccuuuaagaccuccgagggcgagguaggggccaucgcgcucgauuucaaaccaggcacgagcggguccccaaucgugaaucgcgagggcaaaaucgucggccuauacgggaauggcgucgugaccaccagugggaccuacgugucagccauagcccaagcgaaggcgucucaggagggcccccugccggaaaucgaggaugaggucuuccgaaagcguaacuuaacgaucauggaccugcaucccggaagcgggaagacccggagauaucugccagccaucgugcgggaggccaucaagcgcaagcuccgaacacugaucuuagcgccgacuagagugguugccucagagauggccgaggcccucaagggcaugcccauacgcuaccagacgaccgccgucaagagcgagcacacaggaaaagagaucguggaccuaaugugccaugccacuuucacgaugcgccugcuuucuccuguccgcguucccaacuacaacaugauaauaauggacgaggcccacuucaccgauccgagcucuauagcggccagaggcuacauuagcacccgugucgggaugggcgaagcugccgccaucuuuaugacagcaacgccgcccggguccgucgaggccuucccccagucaaaugcagugauccaggacgaagagcgggacaucccggagcgaucguggaacaguggcuacgaguggaucaccgacuuccccggcaagacagugugguuugucccauccaucaagagcgggaacgacaucgccaauugucugcguaaaaacgggaagcgcgugauacaacuuucgcggaagaccuuugacacggaauaccagaaaacgaagaacaacgauugggauuacguggucacuaccgacauaagcgagaugggggcgaacuuucgugccgaccgggugauagaccccagacgcugccucaagccggugauccugaaggacgggcccgagcgggucauccuggccgggcccaugccagugacgguugccuccgccgcacaacggcgcggccggauaggccgcaaccacaacaaggagggagaccaguacaucuacaugggccagccgcucaacaaugaugaggaucacgcccacuggaccgaagcaaagaugcuucuggacaacauaaacacccccgaggggaucauccccgcgcucuuugaacccgagcgggagaagucggcggcaaucgacggagaauacaggcuucggggggaggcccgcaagaccuuuguggaacugaugcgccgcggggaccuccccguauggcuaagcuacaaagucgccucggagggcuuccaguacagcgaccgccguuggugcuuugacggggagaggaauaaucagguucuggaggaaaacauggauguagagaucuggacgaaggaaggcgagcggaaaaagcuacgcccgcgguggcuggacgcccgcaccuacuccgacccacuagcguuacgagaauucaaggaauucgcggcagggcgccguagcgucuccggcgaccugauacuggagaucggcaagcucccccagcaucugacccagcgcgcccagaacgcccuugacaaucucgugauguugcacaacucagagcaaggcggucgggcguaucgucacgcgauggaggagcugccggacaccaucgagacguugauguuacucgcccucaucgccguacugaccgggggcguuacccuguuuuuccuauccgggcggggccugggcaaaacgagcaucggucugcucugcgugauggcguccagcguccuucuguggauggccagugucgaaccgcacuggaucgcugccucgauuauccucgaauucuuucugaugguuuugcucauccccgagcccgaccgucagcggaccccccaagacaaccaacuagccuacguggucaucggccuccucuuuaugauauugacggucgccgcuaaugagaugggccugcucgaaaccaccaagaaagaccugggaauagggcacguagcaguugagaaccaccaccacgccgccaugcuggauguggaccuacaccccgccuccgcguggacccuuuacgccguggcuacgacaaucauaacccccaugaugcgucauaccaucgagaacacuacggcuaacaucagcuugacggcuaucgcgaaccaagccgcgauccucaugggccuggacaaaggcuggccgaucuccaagauggacaucggggucccucuguuggcccugggcuguuacagucaggugaacccccugacccucacggcagccguauugaugcuggucgcucacuaugcuaucaucggccccggucuccaggccaaggcgacccgggaggcccagaagagaacggccgccggcauaaugaagaacccgaccguugacggcaucgucgccauagacuuagaucccgugguguacgaugcgaaguucgagaagcagcugggccagaucaugcuccugauccuguguaccucacagauccuacucaugcgcaccacuugggcgcugugcgagagcaucacccucgccaccgggccacuuacgacccugugggagggcucgccagggaaguucuggaacacuacgaucgccguaagcauggccaauaucuuccgggguagcuaccucgcuggcgcagggcuggcguucagccugaugaagucccucggcgggggucgcagaggaaccggcgcccagggagaaacccugggggagaaauggaagcggcagcuaaaccagcuauccaagagcgaguucaacacauauaagcgguccggcaucauggagguagaccgcagcgaggcgaaggaaggacugaagcggggcgagacuaccaagcacgccgugucucgagguaccgccaagcugcggugguucgucgagcgaaaccucgucaagccagagggcaaggugaucgaccugggcugcgggcggggcggcuggucuuacuacugcgccggacugaagaaggugacagaaguuaagggauacacuaagggcggccccgggcaugaggagcccaucccuauggcuacguauggcuggaaccugguaaagcuccacuccggcaaggacguguucuucaucccgccagagaagugcgauacccuucugugcgauaucggcgagagcuccccaaacccaacgaucgaggagggaaggacucugcguguacuaaagauggucgagccguggcugcgcgggaaccaguuuuguauaaaaauuuuaaaccccuacaugccgagcguugucgagaccuuagagcagaugcagcggaagcacggcgggaugcuggugcgcaacccccucuccagaaauagcacccacgagauguacugggugaguugcggcaccggcaacaucgucagcgccguuaacaugacgagucgcaugcuguuaaaccgguucacuauggcccaccgcaagccgacauacgaacgcgacgucgaccucggcgcaggcacccggcacgucgccguggagcccgaagucgcaaaccuugacaucauugggcagcgcaucgagaacaucaaacacgagcacaagucaacuuggcacuacgacgaggacaaccccuacaagacgugggcguaccauggcuccuacgaggucaagcccuccggguccgccuccagcaugguuaauggggucguuaaacugcugacgaaaccaugggacguuaucccuaugguuacacagaucgccaugacggauacgacccccuucgggcaacagcgugucuucaaggagaaggucgacacuaggacccccaaggcgaaacggggcacggcucaaaucauggagguuacagcgaaguggcuauggggcuuccucucccgcaacaagaagccgcgcaucugcaccagagaggaguucacccggaagguucgcucaaacgccgcaauaggugccguauucgucgacgagaaccaguggaacuccgcgaaggaggccguagaggacgagagauucugggaucuggugcaccgcgaacgcgagcugcacaaacagggcaagugugccacaugcguauauaacaugaugggcaagcgcgaaaagaaacugggcgaguucgguaaggccaagggcucgcgggccauaugguauauguggcucggggcgcgguucuuggaguucgaggcucugggguuuaugaacgaggaccacugguucucccgggagaacagccucucuggugucgagggggaaggucuccacaagcugggguacauccugcgcgacauaucaaaaauaccaggcggcaauauguacgccgacgacaccgccgggugggacacccggaucaccgaagacgaccugcagaacgaagccaagaucaccgacaucauggagcccgagcaugcgcugcucgccaagucaauauucaagcuaaccuaccaaaacaagguuguccgcgugcagcggcccgcgaagaauggcacuguaauggauguuaucagcaggcgggaccagcgagggaguggccaggugggcaccuauggucuuaacacguucaccaacauggaggcccaacuaaucagacaaauggagagcgaaggcauuuucucuccaucugaacuggagacccccaaccuggccggccgagugcucgacuggcuggagaaacacggcgucgaacgccugaaacggauggccauuuccggggacgacugcgugguaaaacccaucgacgaucgcuucgcuacggcccucaccgcuuugaacgauaugggaaaggucaggaaggacaucccgcaaugggaaccgucaaagggcuggaacgacuggcaacaggugccauuuugcagccaucacuuccaccagcugaucaugaaggacgggcgcgagaucgugguuccgugccggaaccaagacgagcucgugggacgugcccgggucucacagggggcuggcuggagccugagggaaaccgccugccuggggaaguccuacgcccagauguggcagcucauguacuuccaccggcgcgaccugcgccuggcugcgaaugcuaucuguagcgcggucccaguggacuggguccccaccucacgcaccacguggucuauccacgcccaccaccaguggaugaccaccgaggacaugcuaagcgucuggaacagaguauggaucgaagagaaucccuggauggaggauaagacccauaucagcuccuggggcgauguccccuaccugggaaagagggaggaccaguggugugggucacugaucggcuuaacagccagggcgaccugggccaccaacauacagguagccaucaaccagguaaggcgucugauagggaacgagaacuaccuggacuacaugacuucgaugaaacgguucaagaacgagagcgauccggagggagcccucugguga

SEQ ID NO: 24232 - RNA, 9879 nt, Artificial Sequence
  derived and/or modified CDS sequence (opt11) from DENV-1__FJ410263__SS-prME
agcgugaccaugcugcucaugcugaugccgaccgccuuggccuuccaucuaaccacucggggcggagagccacacaugaucguaagcaagcaagagcgugggaagagccuauuauuuaaaaccagcgccggugucaacauguguacacucaucgcaauggaccuuggcgagcugugcgaagauaucaugaccuacaagugcccgcgcaucacagagacagagcccgacgacguggacugcuggugcaacgccaccgacaccugggugaccuacgguacuugcucucagaccggagagcacagacgcgacaaacggagcgucgcccuugcgccucacgucggccuggggcuggaaacccggacugagaccuggaugucgucugaaggcgccuggaagcagauccaacgggucgagaccugggccuugcgccaccccgguuucacggugauugccuuguucuuagcccaugcgauagguaccagcaucacccaaaaggggaucauauucauccuccugaugcuggugaccccauccauggccaugcgcugcgucggcaucggcucacgcgacuuuguugagggucucagcggagcgacguggguggacgucguucuggagcacggcagcugcgugaccacuauggccaaggacaagcccacgcuggacauugaacuccugaagacagaagucaccaaccccgccguauugcggaaauugugcaucgaggcaaagaucuccaacaccacuacugauagccggugcccgacccagggcgaggcaacgcugguugaggaacaggacgcuaacuuuguuugccggcggacauucguggaccggggcugggggaacggcuguggucuguuuggcaaagggagccucaucacgugcgccaaguucaagugugugacuaagcuggaggguaagaucguccaauaugaaaaucugaaguacagcgugaucgucaccguccauaccggcgaccagcaucaagugggaaacgaguccacggaacacggcaccaccgccaccaucacgccccaggcucccacgacggagauccaguuaaccgacuauggggcgcuaacccuggacugcagcccccggacaggccuugacuucaacgaaaugguccugcugaccaugaaagagaaauccugguuagugcacaagcaaugguuccuggaccugccucuccccuggaccagcggggccaguacgucccaggagacguggaaccggcaggaccucuuggugaccuuuaagacggcacacgccaaaaaacaagaggucgugguguuaggcucgcaggagggcgcuaugcacacagcacugacuggugcaaccgaaauccagaccucaggcacaaccacaauauucgccggacaccugaaaugccgccuaaagauggauaagcugacccuaaagggcaugagcuacgucaugugcacuggguccuucaagcucgagaaagagguugccgaaacgcagcacggaacagugcucgugcagaucaaguacgagggcacugacgcccccugcaagauacccuuuagcacccaagaugagaaggggguaacacagaacggccggcugaucacugcgaacccgaucguuaccgacaaggagaagcccgucaauaucgaagccgaaccgccguucggagaguccuauaucguuaucggcgccggugaaaaagcguugaaguugucuugguucaagaaagggagcucaaucggcaagauguucgaggcaaccgcccgcggugcacggcgcauggccauccugggggacacugcgugggacuucgguuccauaggcggcguauucacauccgugggcaagcugguucaucaaaucuuugguaccgccuacgggguucuguuuuccggugugucauggacaaugaagaucggaauuggcguacugcugacguggcucggccugaauagucgcagcacuagccugagcaugacuugcaucgcggucggguugguuacgcuguaucugggcgugauggugcaggccgacuccggaugcgucaucaacuggaagggcagagagcucaagugcgggagcggaauauucgugacuaacgaagugcauacguggacugaacaguacaaguuccaagccgacaguccgaagcgccugucggcggccauagggaaagccugggaggagggggucugcggcauucgaagcgccacacgucuggaaaauaucauguggaaacagauaucuaacgaauugaaccauauccuccuggagaacgacaugaaguucaccgugguaguuggggacgucgccggaauccucgcgcaaggaaagaagaugauccgaccccaacccauggaguacaaauacagcuggaaguccuggggcaaggccaagaucaucggggccgacguucagaacacaacguuuauuauagacgggccuaacacacccgagugccccgacgaccagcgcgccuggaacaucugggagguggaggacuacggauucgggauuuucaccacgaauauuuggcugaaacugcgggacucguacacgcaggugugcgaucaucgccuaaugucggcggccauaaaggacagcaaggccgugcacgccgacaugggguacuggaucgaguccgagaaaaacgagaccuggaagcuggcccgggcaagcuucauagaggucaagaccuguauuuggcccaagagccacacgcuguggucgaacggcgugcucgaaucugagaugauaauaccaaagaucuauggaggcccgaucagccagcacaacuauagacccggguacuuuacccaggccgcuggccccuggcaucuggggaagcuggaguuagacuuugaucugugugaggggaccaccgucgugguggacgagcacugcggcaaccgugggccgucccuucgcacgacuaccgucaccgggaaaaucauucaugagugguguugccggagcuguacguugccaccccuccgguuccgcggggaggacggcugcugguauggcauggagaucaggcccguaaaggagaaggaggagaaccuugugaaguccauggugagcgcuggcagcggugagguagacuccuucuccuugggucuacugugcaucucaaucaugaucgaagaggucaugcgaagccgcuggucccgccgcaugcucaugaccggcacccuggccguguucuuccugcucaucauggggcagcugaccuggaacgaccugaucaggcuuugcaucauggucggggcgaacgcaagcgaucgcaugggcaugggaacgacguaccuggcccugauggcgaccuuuaaaaugaggccgauguucgccgucggccucuuguuccggcgccugaccucccgggaagugcuccuccugacgaucggccucuccuuggucgcguccguggaauugcccaauucauuagaggagcugggcgauggacuugccaugggcaucaugauucuuaaacugcugacugacuuccagucccaccagcugugggcuacccuacugagccucacauuuaucaaaacaaccuuuucccuccacuacgccuggaagaccauggcaaugguccugaguaucgugucccucuuucccuugugcuugucaaccacgucccagaagaccacguggcuccccgucuuacuggggagccucgggugcaagccgcugaccauguuccucaucgccgaaaacaagauauggggacgcagguccuggccguuaaacgaggggaucauggccguaggaauugugagcauacugcuaagcucucuccuuaaaaaugacgugccucuggccgggccccucauagcugggggcaugcugaucgcgugcuacgucauaagcggguccagugccgaccugucccucgagaaggccgcagagguaagcugggaggaggaggcagagcacuccggcgcaagccacaauaucuuagucgaaguccaggaugacggaacgaugaaaaucaaagacgaggagcgcgacgacacucugaccauccugcugaaggcuaccuugcucgccguaucugggguguauccgcugagcaucccagccacccuguucguuugguauuucuggcagaagaagaagcaacgguccgggguguuaugggacacccccagcccccccgagguggagcgcgccgugcuggacgacggcauauaucggauaaugcagagaggccuccugggucggagccaagugggaguugguguauuccaggagaacgucuuucacaccauguggcaugugacgcgcggagccguccuuauguaucaggguaaacgucuagaacccaguugggcaucugugaagaaggaccuuaucaguuauggugggggguggcgucuccaaggaaguuggaacaccggggaggagguacagguuaucgcaguggagccugguaaaaaccccaagaacgugcagacggccccggggaccuucaagacucccgagggagaggugggugccaucgcgcuggacuucaagccggggacuagcggcucacccaucgugaaucgggaggggaagauugugggccuguacggaaacgggguuguaacaacgagcggcaccuacgugucggccaucgcgcaggccaaagcaagucaggagggcccccucccagagauagaggacgagguauuccgcaagagaaaccugaccaucauggacuuacaccccggcagcgggaagacgcggagauaccuccccgcgaucgugcgcgaggccaucaagcgcaaacugaggacucugaucuuggcccccacccgcgucguagccuccgaaauggcggaggcgcugaagggcaugccaauccgguaccagaccaccgccgucaagagcgagcacacuggcaaagagauaguggaccugaugugccacgcaaccuucaccaugaggcuacucaguccaguccgggugccaaacuauaacaugaucauuauggacgaggcccacuucacggaccccagcucgauagcggcccgaggguacaucucgacccggguuggcaugggugaggccgccgccaucuucaugaccgcuacaccgccuggcuccgucgaggcauucccccagagcaacgccgugauccaggacgaagagcgcgacauucccgaacggagcuggaacucaggguaugaguggauuacagacuuccccgguaaaaccgugugguucguucccuccauaaaaagugguaacgacaucgccaacugccugcggaaaaauggaaaacgggugauccagcuaagucggaagacauucgacaccgaauaccaaaagacgaagaacaaugacugggacuacguggucaccaccgacaucagcgagaugggcgcgaacuuucgggccgaccgcguaaucgacccgcggcgcugcuuaaaacccgugauccugaaggacgggcccgagcgggucauccucgccggccccaugccaguaaccgucgccagugccgcacagcgacgggggcggaucggacgcaaccauaacaaggaaggugaccaguacaucuacaugggucagccccugaacaacgaugaagaccacgcgcacuggacggaggcuaagaugcucuuggacaauaucaacacccccgaaggcaucauacccgcucuuuucgaaccggagcgggagaaguccgccgcgaucgacggugaguaucggcugcgcggcgaggcccgcaaaaccuuuguggaacucaugaggcgcggagaccugcccguguggcuguccuacaaggucgcuagcgagggcuuccaauacucggaucggcgcuggugcuucgauggcgaacggaacaaccagguccucgaggagaacauggacguggaaauauggaccaaagagggagagcgcaagaagcugcggccccgcuggcuggacgcgaggacauacuccgacccccucgcccugcgcgaguucaaggaauucgcggccggccgaagaagcguaaguggggaccugauucucgagaucgguaaacugccccaacaucugacccagagggcccagaacgcccucgacaaucuggugauguuacacaacucagaacaaggcggacgagcguaucggcaugccauggaggagcuccccgauaccaucgaaacucucaugcugcuugcccuuaucgccgugcuuacgggcgggguaacacuuuucuuccuguccggucgcggacuggguaagacgagcaucgggcuacugugcgugauggccuccagugugcuacuuuggauggccuccgucgaaccccacuggaucgccgccagcaucauacuggaguucuuccuaaugguacucuugaucccagagcccgaucgccaacgcacgccccaggacaaccagcuggccuacguaguuauugggcucuuguucaugauccuuaccguggccgcaaaugagaugggucuccuagagacuacuaagaaagaccugggaauaggccaugucgccguagaaaaccaccaccaugccgcuaugcuggauguggaccuccauccugcuucggcguggacucuuuacgccguagccaccacgaucaucaccccgaugaugcgacauaccaucgaaaacaccacggcuaacauuucucucaccgccaucgcgaaccaggccgccauccugauggggcuggacaagggcuggccgaucuccaagauggacauuggugucccguugcuggcccugggcuguuacagccaggugaaccccuugacucuaaccgccgccgugcugaugcucgucgcccacuacgcuaucauaggcccggggcugcaggccaaggcgacgcgcgaggcccaaaaacggaccgccgcuggcaucaugaaaaaccccaccguggacgggaucguggcuauagaccuggaccccguaguguacgacgcgaaauucgaaaagcagcugggacagauuaugcuucugauccucugcacgucccaaauccuacugaugaggacgaccugggcucucugcgaaaguaucacgcuggcaacuggcccccugacaacccucugggagggguccccgggcaaauucuggaauacaaccaucgccguuagcauggcgaacaucuuccgcgggagcuaucuagccggcgccggccuggcuuucucucucaugaaaucccucgggggcggcaggcgcggaacgggugcgcaaggcgagacccugggugagaaauggaagaggcaguuaaaccagcugaguaaaagcgaguucaacaccuacaagcgcuccgguaucauggagguagacaggagcgaggccaaggaaggauuaaaacgcggagagacaacgaagcacgccguuucccgaggcaccgccaagcuccgcugguucguugagaggaaccuggucaaacccgaggguaaggugauagaccuggggugcggccgagguggauggucuuacuacugugccggacuuaagaaggugaccgaggucaagggguacaccaagggcgggcccggccaugaggagcccaucccuauggcgacguacggguggaaccuagugaagcugcacaguggaaaagacguguucuucaucccgcccgagaagugcgacacacugcucugcgacaucggggagagcucccccaacccaaccauagaggagggccgaacacugcggguccugaagaugguggaacccuggcuccgggguaaccaguucugcaucaagauccuuaacccguacaugcccucuguggucgagacauuagagcagaugcagcgcaagcacggcggcauguuagugcguaauccccugucccgcaauagcacccacgagauguacugggugucuugugggaccggaaacaucgucagcgcggugaacaugacgucccgcaugcugcucaaucgguucacgauggcccaucgcaagcccacguacgagcgggacguagauuuaggagcgggcacucgccacgucgccguagaacccgagguagcaaaccuggacauaauuggccagcggaucgagaacaucaagcacgagcacaagagcaccuggcacuacgacgaggacaaccccuauaagaccugggcauaucacgguuccuacgaggucaagccuucgggcuccgccagcagcauggugaacgguguggucaagcuccugaccaagcccugggaugugauucccauggucacccagauagcaaugacugauaccacaccguucgggcagcaacguguguucaaagaaaagguggacacucggacccccaaggccaagcgcgggaccgcccaaauaauggaagucaccgcgaagugguugugggguuuccucucgagaaacaaaaagccccguaucugcacgcgugaggaauucacccggaaagugcggagcaaugcagccauuggcgccguguuugucgacgagaaccaguggaauuccgcaaaggaggccguggaggacgaacgcuuuugggaccuugugcaucgggagagggagcugcacaagcaggggaagugcgcgacaugcguguacaauaugaugggcaagcgggagaagaagcuuggggaauuuggcaaggcgaaaggcagccgcgccaucugguauauguggcugggcgcucgguuccuagaguucgaggcccucgguuucaugaacgaggaucauugguuuagccgcgaaaauucucucagcgguguugagggcgaggggcugcacaaguuaggcuacauucuuagagacaucucgaaaauccccggcggaaacauguaugccgacgacacggcaggcugggacacccgcaucacggaagacgaccuacagaaugaggcgcguaucaccgacauuauggaaccggagcacgcgcuccuggcuaaguccaucuucaagcugacguaccagaacaaggugguacguguucagcgccccgccaagaaugguacggugauggacgugaucagccggcgcgaccaaaggggcuccggccagguggggaccuacggccuaaauaccuucacgaacauggaggcccagcugauccgccagauggagucagagggcaucuucucccccagcgaauuggaaacccccaaucucgcagaacguguucuggacuggcuggagaaguacggggucgaacgccugaaacggauggcgaucucgggggacgacugcguagugaagccgaucgacgaccgcuuugcaacagcucugacggcacugaacgacauggguaaaguacggaaggacaucccccagugggaacccucuaagggguggaacgacuggcaacaaguccccuuuugcucccaccacuuccaucagcugaucaugaaggacggucgcgagaucguggucccgugucggaaccaggacgaacuggugggccgcgcccgggugagccaaggugcaggauggucguugcgcgagacggcgugccucgggaagucuuacgcccaaauguggcagcugauguacuuccaccggcgcgaccugcggcucgccgcaaacgcaauauguagcgcuguccccguggauuggauccccaccucacgcaccaccuggagcauccacgcccaccaccaguggaugacgaccgaggacauguuguccgucuggaaucgcgucuggaucgaagaaaacccauggauggaggacaaaacucacaucagcuccuggggcgacgugccuuaccuggggaagagagaggaccaguggugcggcagccucaucggcuugacggcccgggcgacgugggccaccaacauacaggucgccauaaaccaggucagacgccucaucgggaacgagaacuaccucgauuacaugaccuccaugaaacgguuuaagaacgagucggaccccgaaggcgcacugugguag

SEQ ID NO: 24233 - RNA, 9879 nt, Artificial Sequence
  derived and/or modified CDS sequence (opt11) from DENV-1__FJ410264__SS-prME
aguguuaccaugcugcucauguugaugccaacugccuuagccuuccaccuaaccacccggggcggggagccccacaugaucgugaccaagcaggaacggggcaaaagcuugcuguucaaaaccucugccggggugaauaugugcacgcucaucgcaauggaccugggagagcugugcgaggacaccaugaccuauaagugccccagaaucaccgaagccgagcccgacgacguggacugcuggugcaacgccacggacaccuggguuaccuacgggaccuguucucaaacgggggaacacaggcgcgacaagcggagcguggcccucgcuccccacgugggccuggggcuggagacccgcaccgagacauggaugucuagugagggcgcguggaagcagauccaacgggucgagacgugggcccuccgccaccccggguucaccgugaucgcccuguuccucgcgcacgccauaggcaccagcaucacacagaaggggaucauuuucauccuacugaugcuggugacgcccucuauggccaugaggugcgucggcaucggcuccagggacuucguggaagguuugagcggugcgaccuggguggauguagugcuggagcaugggucuugugugaccaccauggccaaggacaagccuacguuagacaucgagcuccugaagaccgaggucaccaaccccgcggugcugcggaagcuuugcaucgaggccaagauuucuaacaccacgaccgacucccgcugcccuacccaaggagaggcaacccugauggaggaacaggaugccaacuucgugugccggcguaccuuugucgaccggggcugggguaacggcugcggucuguucggcaaggggagucuuaucacaugcgccaaguuuaagugcgugacgaagcucgaaggcaagauugugcaguaugagaaccugaaguacuccgucauagugaccgugcacacgggcgaucagcaccaggucgggaacgagagcaccgagcaugggaccaccgccaccaucacgccccaggcccccaccagugagauccaacucaccgauuacggcgcccugacgcucgacugcagcccccggacgggccucgauuucaacgagauggugcugcugaccaugaaagagaaguccuggcucgugcacaaacagugguuccuggaucugccgcuaccuuggaccagcggggcgagcacgagucaggagacguggaaccgccaggaccugcuggugaccuucaaaaccgcccaugcuaagaagcaggagguggucgugcucggcagccaggagggugccaugcacacugcccugacgggggccaccgagauccagaccaguggcaccacgaccauauucgccgggcacuuaaaaugccgacucaagauggacaaguuaacccucaagggcaugucuuacgugauguguaccggcaguuucaaguuggagaaggaggucgccgagacgcagcacggcaccgucuuggugcagaucaaguacgagggcaccgaugcccccugcaaaaucccguucuccacccaggacgagaagggggucauccagaacggccggcugaucacggccaauccgaucgugaccgacaaggagaagcccgugaacaucgaggcggaaccgcccuucggagaguccuacaucguaauaggcgcaggcgagaaggcgcugaagcucucaugguucaagaagggguccucuauaggcaagauguucgaggccaccgcccgaggggcccggcgcauggcuauccugggcgacacggccugggacuucgggaguguuggcgguguauucacgagcgucgggaagcuugugcaccagauuuucggcaccgccuacgggguccuguucuccgggguaagcuggaccaugaagauugggaucggcguucugcugaccuggcucggccucaacucacgaagcacgucccugucaaugacaugcaucgccguggggcucgucacccuuuaccucggcgugaugguccaggccgauuccgggugcgucaucaacuggaagggccgggagcucaagugugggagcggcaucuuugugaccaacgaggugcacacguggaccgaacaguacaaguuccaggcggacagcccgaagcgccuauccgccgccaucgggaaggcuugggaggaggguguaugcggcauccggagcgccacucgcuuggagaauaucauguggaagcagauauccaacgagcucaaccauauccuccuggagaacgacaugaaguucaccgugguggucggggacgucgugggcauccucgcgcaggggaagaaaaugauccggccucagcccauggagcacaaauacagcuggaaguccuggggcaaggccaagaucaucggcgccgauguccagaacaccacguucaucaucgacgggcccaacaccccggaguguccggacgaccagagggcauggaacaucugggagguggaggauuacggcuuugggaucuucaccaccaacaucuggcucaagcugcgagacuccuacacccaagugugcgaccaccgccucauguccgcggcgaucaaggacagcaaggccguccaugccgauaugggcuacuggaucgaaucagagaagaacgagaccuggaaguuagcccgggcguccuuuauugaagugaagacaugcauuuggcccaagucccauacccuguggagcaacggcguguuagaguccgagaugaucauccccaaaaucuacggggguccgauaagccagcacaauuaucgccccggguacuuuacgcagaccgccggccccuggcacuuggggaaacuggagcucgauuucgaccugugcgagggcaccaccguagugguggacgagcacugcggcaaucgagggccgucccugcgcacgaccaccgucaccgguaaaaucauccacgaguggugcugccggucaugcacccugccaccccuccgcuuuaagggggaggacggcugcugguacgggauggaaauccggcccgugaaagagaaggaggaaaaucuggugaagucaauggucagcgccggcagcggcgagguagacaguuucagccugggucuucuuugcaucuccauaaugauugaggaagugaugcgcagccgguggucccgaaaaaugcuaaugaccgggacgcuggccgucuuccugcuacugaucauggggcagcugaccuggaacgaccucauccggcuguguaucaugguaggugcaaaugcgagcgaccgcauggggauggggacgaccuaccuggcgcucauggcaaccuucaagaugaggccgauguucgcgguggggcugcuguuccggcgccugacuucccgugagguccugcuucucacaaucgggcugagccucguugccuccgucgagcuccccaauagccuagaggagcugggcgacgggcucgcuaugggcaucaugauccugaagcugcucaccgacuuccaaucccaucaacugugggccacccugcucagcuuaaccuucaucaagacgacccugucucuucacuaugcauggaagaccauggccaugguacugucgauugugucacuauucccccucugccugagcaccacgucccagaagaccaccuggcugcccgucuuacugggcagccuggguugcaagccgcucacgauguuccucaucacugagaacaagaucuggggacgcaagucuuggccccugaacgaagggaucauggcggugggcguggucagcauccuccuuucaucccugcucaagaacgacgugccacuggccgguccccugaucgccggcggcaugcucaucgccugcuacguuaucagcggguccagcgcagaccugucccucgagaaggcggccgaggucagcugggaagaggaagcugagcacucgggcgccagccauaacauucucguagaggugcaggacgacgggacuaugaagaucaaggacgaggagcgggacgacacccugaccauucugcuaaaggccacccuacuggcggucucgggcguguacccgcuaagcauacccgccacuuuauuugucugguauuucuggcagaagaagaagcaacgcuccgggguccugugggacacccccuccccgcccgagguggaacgggccgugcuggacgacgguaucuaccgcaucaugcaacggggccuccugggccguucccaagucgguguggggguguuccaggagaaugucuuccacacgauguggcacgugacccggggcgccguacugauguaccaggggaagcgccuagagcccagcugggccuccgucaagaaggaccugaucagcuauggcggcggguggcggcuucagggcucuuggaauacgggggaggagguccaggugauugcggucgagcccggcaagaaucccaagaacgugcagaccgcccccgggaccuucaagacccccgagggcgaggucggcgccaucgcccucgacuucaaaccugguacgagcggcucccccaucgucaaccgggaggggaagauugugggcuuauauggcaacggggugguaacgaccagcggcaccuaugugagcgcuaucgcccaggcaaaggccucccaggaggggccgcugccggaaauugaggacgagguguuccggaagcgcaaccucacgaucauggaccugcacccgggcagcgggaagacccggcgcuaccuaccggccaucguccgggaggcaauaaagcgcaaacucaggacucugauccuggcccccacccgcgugguggccuccgagauggccgaagcccucaagggcaugcccauccgcuaucagacuaccgcgguaaagucggagcacaccggcaaggagaucguggaccugaugugccacgcuacauucacaaugcggcugcucagucccgugagggucccgaacuacaacaugaucauaauggacgaggcccacuucaccgaccccagcuccaucgccgcccggggguacaucuccacccgcgugggcaugggggaggcagccgccauauucaugaccgccacgccgcccggcuccguggaggccuucccgcagagcaaugcggucauccaggacgaggagcgggacauccccgagcgcaguuggaacucaggguacgaguggaucacagacuuccccgggaagaccguuugguucgugccguccauaaagagcggcaacgacaucgccaacugccuccggaagaacgggaagcgcgucauccagcugucgcggaagaccuucgacacugaguaccagaagaccaagaauaacgacugggauuacguggugaccaccgacaucagcgagaugggggccaauuuccgcgcggaccgggucaucgauccgcggcggugccucaagcccgugauccugaaggacgggcccgagcgcgugauacuggcgggcccaaugccggugacgguggccuccgccgcacagcggcgugggcggaucggccgcaaccacaacaaggagggcgaccaguacauuuacauggggcagcccuuaaacaaugacgaggaccacgcgcacuggacagaggcgaagaugcugcuggacaacaucaauacacccgagggcaucaucccugcccuuuucgaaccggagcgggagaaguccgccgccaucgacggugaauaccgccuucgcggcgaggcccguaagaccuucguagagcugaugcgccgaggggaccuccccguguggcucuccuacaagguagcgagcgagggauuccaguacucugacagacgguggugcuuugacggcgagcgcaacaaccaaguccuggaagagaacauggacgucgagaucuggacgaaggagggggagcggaagaaacuccgcccccgguggcuggaugcccgcaccuacuccgacccccuggcacuccgggaguucaaggaguuugccgccggccgcagaagcgucuccggggaccugauccuugagaucggcaagcucccucagcaccugacgcaacgcgcgcaaaacgcccuagacaaccucgucauguugcauaacucggagcagggcgggcgggcguaccgccacgccauggaggagcuacccgacacaaucgagacgcucaugcugcuagcgcuaaucgccgugcugaccggaggggugacgcuguucuuucucuccggccgcgggcugggaaaaaccagcaucgggcuucucugcgucauggcguccagcgugcuucucuggauggccuccguggaaccucacuggaucgcggccagcaucauccucgaguuuuuccuuaugguauugcuaauucccgagccggaccgccagcggacgccccaggacaaccaacuggccuacguggugaucggucuguuguucaugauccugacggucgccgccaacgagaugggccuucucgagaccaccaagaaggaccuggguauaggacacguggccgucgagaaccaccaccacgcuaccaugcuggacguagaccuccaccccgcuucggccuggacacuguacgcuguggccaccaccaucaucacaccuaugaugagacacacgaucgaaaacacgaccgcgaacaucagccuaaccgcuauagcaaaccaggccgcuauccucauggggcuggacaagggcuggcccaucuccaagauggacaucggcgugcccuuacucgcgcuggggugcuauucgcaggucaauccccugacguugaccgccgccguacugaugcugguggcgcacuaugcgaucauaggcccggggcuccaggccaaggccaccagagaggcccagaagcgcaccgccgcgggcaucaugaagaaucccacgguggacgggaucguugcuaucgaccuggaccccgucgucuaugacgcaaaguucgagaaacaacugggccagaucaugcuccugauccugugcaccucccaaauccucuugaugcgcacgaccugggccuuaugugagagcaucacgcuugccacgggcccccugaccacgcuuugggaggguuccccuggcaaguucuggaacacgaccaucgcggugagcauggccaacauauuccggggguccuaccucgccggcgccggccucgcauucucgcuuaugaagucccuugggggcggucgccggggcaccggggcccaaggggagacccugggcgagaaguggaagcgucagcugaaucagcuauccaaguccgaauucaacaucuacaaacgguccgggaucauggaaguggauagaagcgaggccaaagaaggccugaagcgcggggagacgacucgccaugcagucucccggggcaccgccaagcugcgcugguuugucgagcgaaaucugguuaagccagaggggaaggucaucgaucucgguugcggccgggggggauggucuuacuacugugcggggcugaagaaggugaccgaggugaagggguacacgaagggcggccccggccacgaggagcccauaccgauggcaaccuacgguuggaaccuggucaagcuccacagugguaaggacguguuuuucacuccccccgaaaagugcgacacccuccucugcgacaucggggagagcucgcccaacccuacgaucgaggagggccggacccuccgcgugcugaagauggucgagccuuggcugagggggaaccaauucugcaucaagauucucaaccccuauaugcccagcgugguggaaacucuggaacaaaugcaacgcaagcacggcggcaugcucguacggaacccucucuccagaaacagcacccacgaaauguacuggguuucaugcgggacuggcaacauagugagcgccgucaacaugacaucacggaugcugcugaaucgcuuuaccauggcccaccgcaaacccaccuacgaaagggacguggaccucggggcuggcacccgccacgucgcggucgagcccgagguggcgaaccuggacaucaucggccaacggaucgagaacaucaagcacgaacacaaaagcacguggcacuacgacgaggacaacccuuacaagaccugggccuaucacgguuccuacgaggucaagccgagcggguccgccagcagcaugguaaacgggguggucaaguuauugaccaagcccugggacguuauucccaugguaacccaaaucgccaugacagacaccacccccuucggccagcagcgggucuucaaggagaagguggacacgcggacgccuaaagcgaagcgcgggacggcccagaucauggaagugaccgcucgguggcuguggggcuuccugucucgcaacaagaagccccggaucugcacccgcgaggaguucacucgaaagguccgcagcaacgcugcuaucggugcuguauucguggacgagaaccaguggaacuccgcaaaggaagccgucgaggacgagcgcuucugggaccucgugcagaaagagcgcgaacugcacaagcaggggaagugcgcgaccugcguguacaauaugauggguaagcgagagaaaaaacugggagaguucggcaaggcaaaggggagccgcgcuaucugguacauguggcuaggcgcccgguuccuggaguucgaggcacugggcuucaugaacgaggaccacugguucucccgcgagaacagccucuccggggucgagggagagggccuucacaaauugggcuauauccuccgggacaucagcaagauaccgggagggaacauguacgccgacgacaccgcgggcugggacacccgcaucacggaggaugaucugcagaacgaggcaaagaucaccgacaucauggagcccgaacaugcacugcucgccacgucaaucuuuaagcugaccuaccaaaacaagguggugcggguccagcgcccggccaagaacgggacggugauggacgugauuagccgccgggaccagcgcggcuccgggcagguugguacauauggccugaauacauucacaaacauggaggcgcagcucaucaggcagauggagagcgaggggaucuuucuuccauccgagcuugagacccccaaccucgccgagcgcgugcuggacuggcuagagaaauaugguguggagcggcucaagagaauggccauuagcggugacgacugcgucgucaagccgaucgacgaccgguucgccacagcccuaacugcgcugaacgacaugggcaaggugcgcaaggacaucccccagugggaaccauccaagggguggaacgauuggcagcaggucccuuucugcagccaccauuuccaccaguugaucaugaaagacggccgugagaucguggugccgugccgaaaccaggacgagcugguuggucgagcucgcgugucucagggggcgggcuggagcuuacgggagaccgccugccucggcaagagcuacgcucagauguggcaguuaauguacuuccacaggcgggaccugcgccucgcggccaacgccaucugcuccgccguacccgucgauugggugcccacgagccgaaccaccuggagcauccacgcgcaccaccaguggaugaccacggaggacaugcugagcguguggaaccgcgucuggaucgaggaaaaucccuggauggaggacaagacccacguguccagcuggggcgaugugccguaccuggggaagcgggaggaccaauggugcggcucccucaucggccuaaccgcccgcgccacaugggccagcaacauacagguugcgaucaaccagguuagacgccugaucgggaacgagaauuaccucgacuacaugaccuccaugaagagguucaaaaacgaaggagaccccgagggcgcacugugguga

SEQ ID NO: 24234 - RNA, 9879 nt, Artificial Sequence
  derived and/or modified CDS sequence (opt11) from DENV-1__FJ410265__SS-prME
agcgugaccaugcugcucauguuaaugccuaccgcccuagccuuccaccucaccacacgggguggggagccccauaugaucgugagcaaacaggagcguggcaagagcuuauuauucaaaaccagcgccggggugaacaugugcaccuugaucgccauggaucugggcgagcugugcgaggauaccaugacauauaaguguccacgcaucacagagaccgagcccgacgacguggacugcuggugcaacgcgacggacaccugggucaccuaugggaccugcagccagacgggcgagcaucggcgcgacaagcgguccguggcccucgcgccucaugugggccucgggcuggagacccgcaccgaaacuuggaugagcuccgaaggcgcauggaagcaaauucagcgggucgagacgugggcccucagacaccccggguuuacugugaucgcccucuuccuggcccacgcgauuggcaccagcaucacccagaaggggaucaucuucauucucuuaauguuaguuacccccuccauggccaugcgcugcgucggcaucggcagccgggacuuuguggaggggcucuccggagccaccuggguggaugucgugcuggaacacgguaguugcgugaccaccauggcgaaggacaagcccacgcuggacaucgagcucuugaagacggagguuaccaaccccgccgugcugcggaagcucuguaucgaggcgaagaucucgaacacuacuaccgacucccgcuguccgacccaaggagaggccacccugguagaggagcaggacgccaacuuugucugccgacgcacguucguggaccggggaugggggaacggcugcgggcuguucggcaaagggucccucaucacgugcgcgaaguucaaaugcguuacaaagcuggaggggaagaucguacaauacgagaaccucaaguacagugugaucgugacaguccacacgggcgaccagcaccagguggggaacgaguccaccgagcacggcaccacagccaccauuacgccccaagcccccaccaccgagauccagcucacagacuacggggcccugacgcuagacuguagcccacgcaccggccuugacuucaacgagaugguccugcugaccaugaaggagaaguccugguugguccacaagcagugguuccuggaucugccucuccccuggaccagcggggccagcacgucccaggaaacauggaaccggcaggaccuguugguuacuuucaaaaccgcccacgccaagaagcaggagguaguggugcucggcucgcaggaaggcgcgaugcacacggcccucaccggugcgaccgagauacagacguccggcacgaccaccauauuugcagggcaccugaagugccgucucaagauggacaagcugacccugaaaggcaugagcuacgucaugugcacgggguccuucaagcucgagaaggagguggcagagacccagcaugggaccgugcugguccaaauaaaguaugagggcaccgacgcgcccugcaagaucccguucucaacgcaggacgagaaagggguuacccagaacggucggcugaucaccgccaaccccaucgugacagacaaggaaaagcccgucaacaucgaggcagagccaccauucggcgaguccuacaucgugaucggcgccggcgagaaggcccugaagcucagcugguucaaaaaggggucgagcaucggcaagauguucgaggccacggcccgcggggcgcggcgcauggcuauccuaggcgacaccgcgugggauuucggcuccauaggcggcguguucacaagcgucggaaaguuggugcaccagauauuuggaaccgccuauggggugcucuucuccggcgucuccuggacgaugaagaucggaaucggcguguuguugaccuggcucggccugaacucccguagcaccucacugagcaugacaugcaucgccgugggucucgugacccuguaccugggcgugauggugcaggcugacuccgggugcgugaucaacuggaagggccgggagcucaagugcgggagcggcauuuucgugaccaacgaaguccacaccuggaccgagcaguacaaauuccaggccgauagcccaaagcgccuguccgcggccaucggcaaggcuugggaggaggggguuugcgguauucggagcgccacccguuuggagaacaucauguggaagcagaucuccaacgagcucaaucacauccugcuagagaacgauaugaaguucacggugguggucggggacguagccggcauucuagcgcaaggcaagaagaugauccggccccagcccauggaguauaaauacagcuggaagagcugggguaaggcaaagauuaucggagccgacgugcagaacacuaccuucaucaucgaugggcccaacaccccggagugccccgacgaucaacgcgccuggaauaucugggaagucgaagauuacggauucgggaucuuuacaacgaacauuuggcugaaacugcgggacagcuacacacaggugugugaccaccgccucaugucugcggccaucaaggacagcaaggcuguucaugccgauaugggcuacuggaucgaaagcgagaagaacgaaacauggaagcuagcccgggcgaguuucaucgaggucaagacgugcaucuggccuaaaucacacaccuuguggagcaacggcguccucgaguccgagaugaucauucccaagauauacggcgguccgauuagucaacauaauuaccgccccggguauuucacccaagccgccggccccuggcaucuggggaagcuagaacucgacuucgaucugugcgagggcaccacggugguaguggacgagcacugugggaauagaggaccgucccugcgcacgaccacagugacgggcaaaaucauccaugagugguguugccggaguugcacucugcccccccuccgcuuccgcggugaggacggcugcugguacgggauggagauuagaccuguuaaggagaaagaagagaaucugguuaaauccaugguguccgccggcagcggagaagucgauagcuucucucucgggcuccuguguaccaguauaaugaucgaagaggugaugcgcagccgcuggucccgaaggauguuaaugaccgggacguuggccgucuucuuccuacuaaucauggggcagcuuacuuggaacgaccugauccgccucugcauaaugguaggcgcuaacgccagcgacaggauggggauggggacaacauaccuggcgcugauggccacguucaaaaugcgcccgauguucgccgugggccuccuguuccggcgccugaccucccgcgaggugcuccugcuuaccaucgggcuaucgcugguugcguccguggagcugcccaacagccuugaggagcuaggcgaugggcuggccaugggcaucaugauucuaaagcucuugaccgacuuccagucccaucagcuuugggcgacacuguuaaguuugacguucauuaagaccaccuuuucccugcauuacgccuggaagacuauggcgauggugcugaguaucgugucccucuuuccgcuguguuuaagcaccaccucccagaagaccacguggcuccccguccugcuggggagccucgggugcaagccgcugaccauguuccugaucgccgagaacaagauuuggggacgccggaguuggccccucaacgaggggauuauggccgucggcaucgugagcauccugcugucuagucuccugaagaacgacgucccccucgccgguccccucauagccggcggcaugcugaucgcguguuacgucaucucagggucaagcgcugaccugucucucgagaaggccgccgaggugucaugggaagaggaagccgaacacuccggcgccagccacaacauacuaguggaaguccaggacgacggaaccaugaagaucaaggaugaggagcgcgacgacacucugaccauucuccugaaggccacgcugcucgcuguguccggcguguacccgcugagcauccccgcuacccuguuugugugguacuucuggcagaaaaagaagcagagguccggugugcucugggacacacccagcccuccggagguggaacgcgccguacuugacgauggcauuuacaggaucaugcagcggggccuguuaggacggucccaggugggcguggggguauuccaggagaacguguuccacaccauguggcacgugacgcguggugcggucuugauguaccaggggaagcggcuggagcccuccugggcgagugugaagaaggaccugaucagcuacggaggcgguuggcgccuccagggcagcuggaacaccggcgaggaagugcaggucaucgccguugaacccggcaagaaccccaagaacgugcaaaccgccccggggaccuucaagacucccgagggugaggugggcgcuauugcucuggacuucaaacccgggacaaguggcucccccaucgugaaccgggaggggaagauugugggccuguacgguaacggagucgugaccaccagcggcacguacgugagcgcaauagcacaggccaaggcgucccaggaggggccgcucccggagaucgaggacgaggucuuucgcaagaggaaccugaccaucauggaucugcacccgggcucggggaagacccgccgcuacuugccggcuaucgugagggaggccaucaagcgcaaacugcggacucugaucuuagcacccacuaggguggucgcauccgaaauggcggaggccuuaaaaggaaugcccauccgauaccagaccaccgcggucaaaucagaacacacaggcaaggagauuguggaccugaugugccacgcaacguucaccaugagguuacuguccccugugagggugccaaacuacaacaugauuaucauggacgaggcucacuucaccgaccccagcuccauagcggcccggggcuacaucagcacccgugugggcaugggggaggccgccgcgaucuucaugacggcgacuccgcccggcuccgucgaagccuucccgcagucaaaugcagucauccaggacgaggagcgcgacaucccagagcgguccuggaacagcggguacgaguggauaaccgauuuccccggcaaaacagugugguucguccccucgaucaagagcggcaacgacaucgccaacugccugcgcaaaaacgggaagcgggugauccagcucucuaggaagacguuugacaccgaguaccagaagaccaagaauaaugacugggacuacguagucaccacggacaucagcgaaaugggcgcaaauuuccgggccgaccgcgugaucgacccgcggcgaugccugaagcccgugauccugaaagaugguccggagcggguuaucuuggccggcccuaugcccgugaccgucgccuccgcggcgcagcgccggggcagaaucggucggaaucacaacaaggagggcgaccaguacaucuacauggggcaaccccugaacaacgacgaggaucacgcacacuggaccgaggccaagaugcugcuagacaacauuaacacccccgagggcaucauuccagcccuguuugaaccggagcgggagaaguccgcagcgaucgacggggaguauagacugaggggagaggcacgcaagacauucguggagcucaugcggagaggggaccugcccguguggcuguccuacaaggucgccagcgaaggcuuccaguacucggaccgccgcuggugcuucgacggcgagcggaacaaccaggugcucgaagagaacauggauguggagaucuggacuaaggagggcgagcgcaaaaaauugcggccccgauggcuggacgcgcggaccuacuccgaucccuuggcucuccgcgaguucaaggaauucgccgccggcaggcgaucugucuccggugaucugauccucgagaucggcaagcugccgcagcaucugacccagcgggcgcaaaacgccuuagauaaccuggugaugcuucacaacucagaacagggugggcgcgcguacaggcacgccauggaggaacuccccgacacgauagagacccugaugcuccucgcccugauagccguucugaccggcggggucacccucuucuuccuguccgggcggggacugggcaagacaagcaucggccuccugugcgugauggccuccagcguacuguuguggauggcgucugucgagccccacuggaucgccgccucuaucauccuggaauuuuuccugauggugcuccugauccccgagccggaccggcagcgcacgccccaagauaaccagcuggccuacguggugaucgggcuccuuuucaugauauuaacuguagccgccaacgaaaugggccuccuagagaccaccaagaaggaucuggggaucggccacgucgccgucgagaaucaccaucaugccgccaugcucgacguggaucugcaccccgccucugcguggacgcuguacgccguggccacaaccaucauaaccccgaugaugcggcacacgaucgaaaacacuaccgccaacauuagccucaccgccaucgcgaaucaggccgccaucuugauggggcuggauaagggguggcccaucuccaagauggacaucggcgucccccuccuggcauuagggugcuacagccaggugaaucccuuaacgcugaccgcggcaguacugaugcuagucgcccacuaugccauuaucggcccgggucugcaggccaaggcuacccgggaggcccagaagcguaccgccgcuggcaucaugaagaaccccacgguggauggaaucguggcuaucgaccuggacccugucguguacgacgcgaaguucgagaaacagcucggccagauuauguuacugauucugugcaccagccaaauccugcuaaugcggacaaccugggcccuaugcgagucaaucacgcuggcuacuggccccuuaaccacgcucugggaggggucgccgggaaaauucuggaacaccaccaucgccgucagcauggcaaacaucuuuagaggguccuaccuggcgggcgccggccuggccuucaguuugaugaagucccucggaggcgggaggcggggaaccggcgcccagggcgagacacuaggcgagaaguggaaacggcaguuaaaccagcugucgaagagcgaguuuaacaccuacaagcgcuccgggaucauggaaguagaccgaucagaagcaaaggagggccugaagcgcggggagacaaccaagcacgccguuucccggggcacugccaagcuccgcugguuuguggagcggaaccuggucaagccagaggguaaggugaucgaucugggcugcggccgcgggggcuggucguacuacugcgcuggacuuaagaaggugaccgaggucaaagguuacacgaagggcggaccgggccacgaggagccaauccccauggccaccuacggguggaaccucgugaaauuacacuccggcaaggacgucuucuucaucccgcccgagaagugcgacaccuuacucugcgacaucggggaauccucgcccaauccaaccaucgaggagggccggacucuucgcguccugaagaugguugagcccuggcuccgggggaaucaauucugcaucaagauauuaaaccccuacaugccgagcgugguggagacccuggaacagaugcagcgcaagcacgguggaaugcucgugcggaacccgcuaagucgcaacuccacccaugagauguacuggguguccuguggaacuggcaacauuguuagcgcggugaauaugacgucccgcaugcugcucaaccguuucaccauggcgcaccggaagcccaccuacgaacgggacguggaccuaggcgccgggacccgccacguagccguggagccugagguugccaacuuagacaucaucggacagcggaucgagaacaucaagcaugagcacaagagcacguggcacuaugacgaggacaaccccuacaagacuugggccuaccacggguccuaugaggucaaaccgagcggcuccgcgucaagcauggugaacggggucgugaagcuguugaccaagccaugggacgugauaccgaugguuacccagauagccaugacagauaccaccccguuuggccaacagcgcguauucaaagagaagguggauacccggacgccgaaggcuaagagagggaccgcccagaucauggaggucaccgccaagugguuauggggcuuucucucccggaacaagaagccccgcaucugcacccgagaggaguucacucgcaaggugcggagcaacgccgccaucggagccguguucguugacgagaaucaguggaacuccgcgaaggaggccguugaagacgagcgcuucugggauuuaguacaccgggagcgugagcugcacaagcaggggaagugcgcgaccugcgucuacaacaugaugggcaaacgggagaagaaacucggggaguucggcaaggcgaaggggucgcgcgccaucugguacauguggcucggagcgcgguuccuggaguucgaggcguuaggcuucaugaacgaggaccacugguucucgagagagaacagccuguccggggucgaaggcgagggucuccacaagcucggcuacaucuugcgggauaucagcaaaauccccgggggcaacauguacgcggacgacacagccggcugggauacccggauaacugaggacgaccugcagaacgaggccaagauuaccgacaucauggagccggagcacgcgcuccuagcuaaguccauauucaagcuuaccuaccaaaacaaggugguccgcgugcagcggccugccaagaaugggaccgugauggaugucaucagccgccgggaccagcgcggcucgggccagguggggaccuacggccucaacaccuucaccaacauggaagcccagcugauccggcagauggagagcgaagggaucuucucccccagcgagcuugagacgccgaaccucgcggagcgcgcgcuggacuggcuggagaaguacggcguggagcggcucaagcguauggccaucuccggugacgauugcgucgugaaaccgaucgacgaccguuucgcaacggcccugaccgcccugaacgauauggggaaaguccgcaaggauaucccccagugggagcccagcaaggguuggaacgacuggcagcaaguaccuuucugcucccaccacuuccaccagcucauuaugaaggacggccgggagaucguggugccgugcagaaaccaagaugagcugguggggcgggcacgcguuagccagggagccggauggagccugagagagaccgccugccucgggaaguccuacgcccagauguggcagcugauguacuuccaucgccgggaccuacgccucgcggccaaugcaaucuguucagccguccccgucgacuggauccccacaucccgaacaaccuggagcauucacgcucaccaucaguggaugaccacagaggacaugcuuuccguuuggaaccgcguguggaucgaagagaaucccuggauggaagacaaaacgcacaucagcuccuggggcgaugucccguaccuagggaagcgcgaggaccaguggugcggcagccucaucggccugaccgcgcgggcuaccugggcaaccaauauccagguggccauaaaccaagugcgccggcugaucgggaacgagaauuaucucgacuacaugaccuccaugaaacgcuuuaagaacgagagcgaccccgaaggcgcacugugguga

SEQ ID NO: 24235 - RNA, 9879 nt, Artificial Sequence
  derived and/or modified CDS sequence (opt11) from DENV-1__FJ461336__SS-prME
agcguuaccaugcugcucaugcucaugccuacagcacuggccuuccacuugaccacccgggguggggagccucacaugaucgugagcaaacaagagcgggggaagagccugcuguucaagaccagcgccggggugaacaugugcacguugauugccauggaccugggagagcugugcgaggacaccaugaccuacaaauguccccgcauaaccgaaaccgagcccgacgacguggacugcuggugcaacgcgacagacacgugggugaccuacgguaccuguucacaaacgggugagcaccggcgcgacaagcgguccguagcccucgcuccucaugugggacugggacuggaaacgcgcaccgagaccuggaugagcucugagggcgcguggaagcaaauccagagggucgagacgugggcgcuccgccaccccggguucaccgugauagcccucuuucuggcacacgcaauuggcaccagcaucacccagaaggggaucaucuucauccuccugaugcuggugacgcccagcauggcuaugcgcugcgucggcaucggcaaccgcgauuucguggaggggcuaucaggcgccaccuggguugacgucgugcuggagcacggauccugcgugacuaccauggccaaggauaagccgacgcuggauaucgagcuccucaagaccgaggucacaaaccccgccgugcuucguaaguugugcaucgaggcgaagaucucuaacaccacuaccgacucccgcugcccgacucagggcgaggccacccucguggaggaacaggacgccaacuuuguuugccggcgcacguuuguggaccgggguuggggaaacggcugcgggcuguuuggcaaggggucccucaucacgugcgccaaguucaagugcgugacaaagcucgagggaaagaucguccaguacgagaaccuaaaguauuccgugaucgugacuguucauacgggcgaccaacaccaaguugggaacgagucuacagagcacggcaccaccgcuaccaucacgccgcaggcgcccaccacagaaauccagcucacugacuacggggcacugacgcuggacuguagcccccggaccggccuggacuucaacgagauggugcugcugaccaugaaggagaaauccuggcucgugcacaagcagugguuccuggaccucccccucccuuggaccuccggggccuccaccagccaggagaccuggaaccggcaggaccugcuggugaccuucaagaccgcccacgccaagaagcaggaggucguagugcucggcucacaagagggugcgaugcacacugcccugaccggcgccaccgagauccaaaccagcggcacgacaacaaucuucgccggacaccugaagugccgccucaagauggacaagcugacccugaaggguaugucuuacguuauguguacggggucuuucaaacucgaaaaggaaguggcggagacccagcauggcacaguucugguccagaucaaguacgagggaaccgacgcacccugcaaaauccccuuuuccacgcaggacgagaaaggggugacccagaacggccggcucaucacugccaacccgaucgugacugacaaggagaaaccaguaaacaucgaggccgagccgcccuucggggaaucguacaucgugauuggcgccggagagaaagcccugaagcuauccugguucaagaagggaaguucgaucggcaaaauguucgaggcgacggcccggggggccagacgcauggcuauccugggcgacaccgcaugggacuucggaagcaucggcggagugcugaccuccgucgggaaguuagugcaccagaucuucggcacggccuaugggguguuauucuccggcgucuccuggaccaugaagaucgggaucggcguguugcucaccuggcugggccugaacagccgcagcaccagccucucaaugacuugcaucgccguggggcuagucacccuguauuuaggggugauggugcaggcagacuccgggugcgucaucaacuggaagggccgggagcugaagugcggcuccggcaucuucgugaccaacgaagugcacacauggaccgagcaauacaaguuccaggcugacagcccuaagcgacugagcgcggccauuggcaaggcuugggaggaaggagucugcggcauccgguccgcuacccgcuuagagaacaucauguggaagcagaucagcaacgagcugaaccacauccugcucgagaacgacaugaaguucaccgugguggugggcgaugucgccggcauccuggcgcaggggaagaagaugauccggccacagcccauggaguacaaguacuccuggaaguccuggggcaaggccaaaaucaucggcgccgacguacagaauaccaccuucauaaucgacggucccaacaccccggagugccccgacgaccagcgcgccuggaauauuugggaggucgaggacuacggcuucgggauuuucacgacuaacauuugguuaaagcuccgggauuccuauacacaggugugcgaucaucgccugaugagcgcagcaaucaaggacuccaaggcugugcacgcagacaugggcuauuggaucgagagcgaaaagaaugaaaccuggaaguuagcccgggcguccuucaucgaagugaagacgugcaucuggcccaagagccacaccuuaugguccaauggcgugcuggagagcgagaugaucauucccaagaucuacggggggccgauuucccagcacaacuaccgcccugguuacuucacccaaaccgcggggcccuggcaccuggggaagcucgagcuggauuucgaccucugcgagggcaccaccguggucguggacgaacacugcgggaaccgggguccuagccuccguaccacaacagugaccgguaagaucauccacgaauggugcugccgcuccugcacgcugccgccgcugcgcuucaggggggaggacggcugcugguaugggauggagauccgccccguuaaggagaaggaagagaaccuagucaagucuaugguguccgcaggcagcggggagguagacucuuucucguuagggcugcucugcaucagcauuaugaucgaggaggugaugaggucucgcuggagccggaagauguuaaugaccggcacacuggccguguucuucuugcugaucaugggccagcugaccuggaacgaccucauccgccuuuguauuauggucggcgccaacgcguccgaccgcauggggaugggcaccaccuaccuggcccucauggcaaccuucaagaugcggccgauguuugcugugggguuacuguuccgccggcucacuucgcgcgaaguucugcuguugaccaucggguugucccuggucgccaguguggagcucccuaacucccuggaggaacugggcgacgggcucgcgaugggcauaaugauccugaagcuauuaaccgacuuccagagccaccagcugugggcuacguuacucuccuuaacguucaucaagaccaccuucagccugcacuacgccuggaagacgauggccaugguccuauccaucgugagcuuauucccacugugccucaguaccaccagccagaagaccacguggcugcccgugcuacucgggucccuggggugcaagccgcuaaccauguuccucaucgcggagaacaagaucuggggccggcggagcuggccccugaaugaggggauaauggcugucgguaucguguccauccugcucuccagccuacugaaaaacgacgucccgcucgccgggccccugaucgccggcggcaugcugauagcaugcuauguuaucuccgggagcuccgcagacuuaagccuggaaaaggccgccgaaguguccugggaagaggaggccgagcacucgggggccucccacaacauccugguggaaguccaagacgacggaaccaugaagaucaaggaugaggaacgggacgacaccuugaccauucugcucaaggcgacgcuccuggccgucagcggcguguacccguuguccauucccgccacacuuuucgucugguauuucuggcagaaaaagaagcaacgcagcggugugcuaugggacaccccgagcccgcccgaggugggccgggccguguuagacgauggaauauaccgcauuaugcagcgggggcugcucggacgcucgcaggucggggugggcguauuccaagagaacguguuccacacuauguggcaugugacgcgcggggcuguccugauguaccagggcaaacgccuggagcccuccugggccagcgucaagaaagaucuaaucucguacggcggcggcuggcggcuacaagggucguggaacaccggcgaggaggugcaggucaucgccguggagcccgggaagaaucccaagaacgugcagaccgcccccgguaccuuuaagacgcccgagggcgaagucggugcaauagcccuggacuuuaagcccggcaccuccgggagccccaucgugaaucgcgagggcaagaucgugggcuuguacgggaacggugucgugaccaccuccgggacguacgugucugcgaucgcccaggccaaagcuagccaggagggcccacugccagagauugaggaugaaguauuccggaagcgcaaccuuaccauaauggaccuccaccccgggucuggcaaaacccggcgcuaccugcccgcgaucgugcgggaagcaaucaagcguaagcugcgcaccuugauccuggcucccacgcggguagucgccuccgagauggccgaagcgcuaaagggcaugccuauacgauaccagaccaccgcagugaaauccgagcacacugggaaggaaaucguggaucucaugugccacgcuacguucaccaugcggcugcuaagcccaguccgcgucccuaacuauaacaugaucauuauggacgaggcccacuuuacggaccccuccagcauagccgcccggggcuacauauccacccgcguggggaugggggaggccgcugccaucuuuaugacggcaacaccacccgguagcgucgaggcguucccgcaguccaaugcugugauccaggacgaagagcgcgacauccccgaacggaguuggaacucaggcuacgaguggauuaccgauuucccaggcaaaacggugugguucgucccaucgaucaagucagguaacgacauugcaaacugccucaggaagaacggcaagcgcgugauucagcugucucggaagacuuucgacaccgaguaccaaaagaccaagaacaacgacugggacuacgucgucacaacggacaucuccgagaugggcgcuaauuuccgcgcugaucgggugaucgacccgcguagaugcuuaaaacccgugauccucaaggacggcccagagcgcguuauccuggccgggcccaugccagucaccguagccucggccgcacagcggcgcggacggaucggccgcaaccauaacaaggagggggaccaguacaucuauaugggccagccucugaacaaugacgaggaccacgcgcacuggacugaggccaaaaugcuccuggauaacaucaauacacccgaagggauuauacccgcguuguuugagccggagcgcgagaagagugccgccaucgacggagaguaccggcuccgcggggaggccaggaagacguucguggagcuaaugcgccggggcgaccugcccguguggcucucauauaagguggccuccgaaggauuccaguacucagacagacgguggugcuuugacggggagcgcaacaaccagguguuggaggagaacauggacguggagauauggaccaaggagggcgagcggaagaaacuacgaccgagauggcuagacgcccguaccuacuccgauccccuggcccugcgagaguucaaggaguucgcugcagggcgccgguccgucagcggggaccucaucuuagagaucgggaagcugccgcagcaccucacccagcgcgcacagaacgcccucgacaaccugguuaugcuccacaacagugagcagggcgggcgggccuaccgccacgcgauggaagaacugcccgacacgaucgagacucugaugcuccuggcgcugaucgccgugcuaaccgguggcguuaccuuguucuuccucagcgggaggggccucggcaagacgaguauuggacugcugugcgugauggcgagcuccgugcuccuguggauggccucugucgagccccacuggauugcggcgaguaucauacuagaguucuuccucauggugcugcugauccccgagccggaccgccagaggacgccccaggacaaccaguuagccuacguggucauaggccugcuguucaugauacugaccguggccgcgaacgagaugggacugcuggagaccaccaagaaggaccucggcaucggacauguggcuguugagaaccaccaccacgcggccaugcuugacguggaccuucacccugccagcgccuggacgcucuaugcaguggccaccaccaucaucacuccaaugaugcgccauacgaucgagaacaccacagccaacaucucccugaccgccauagccaaccaggcggcaauccucauggggcucgacaaaggcuggccgaucagcaagauggacaucgggguuccucuacuggcccucggcuguuacucccaggugaacccccugacguugaccgccgcggugcucaugcuaguggcccacuacgccauaaucgggccggggcuacaagcgaaagccacgagagaagcgcagaagcggaccgccgccggaaucaugaaaaaccccacgguggacggcauuguagccaucgaccucgaccccgucguguaugacgccaaauucgagaagcagcugggccagaucaugcugcucauccuguguaccucucagauccugcucaugcguaccaccugggcccugugcgaguccaucacccuggccacugggccccucaccacccuaugggaggggagcccggggaaauucuggaacacgaccauagccguguccauggccaacaucuuccggggcaguuaccuggccggcgcgggucucgccuucucccugaugaagucccugggugggggccgacgggguaccggcgcccaaggagagacccucggggaaaaguggaaacgccagcugaaccagcugagcaaguccgaguucaacacguacaagagaagcggaauuauggaggucgaccgcuccgaggcaaaggaggggcucaaaagaggcgagaccaccaagcacgcggugucgcgcgggaccgcgaaacugcggugguucguggagcgcaaccuggucaaaccagagggcaagguaauagaccugggcugugggcggggcgggugguccuauuacugugccggucucaagaaggugacggaggucaagggguacaccaagggcggacccggccacgaggagcccaucccaauggccaccuacggcuggaaccugguuaaacugcauagcgggaaggacguguucuuuaucccgcccgagaagugcgacacccuccucugcgacaucggcgaguccagccccaacccgacaaucgaggaggggcguacccugcggguccucaagaugguggagcccuggcuccgcggcaaccaguucugcaucaagauacuuaaccccuacaugcccuccguaguggagacccucgagcagaugcagcggaagcacggcgggauguugguacgcaacccgcugagucgaaacuccacccacgagauguacugggugagcugcggcaccgggaacaucguuuccgccgugaauaugacgucgaggauguuguuaaaccgcuucacaauggcucaccggaagcccaccuacgagcgcgacguggaccugggcgccggaacgcggcacguggccguugagccugagguggcuaaucucgacaucaucgggcagcgcauugagaacaucaagcacgagcacaaguccacuuggcacuacgacgaggacaaccccuacaagaccugggcguaccacggcagcuaugaagucaaacccuccgggagcgcaaguagcauggugaauggcguagugaagcugcugaccaagcccugggacgugauaccaauggucacacagauagccaugacggacacuaccccuuucgggcagcagcgggucuucaaggaaaagguggacaccaggacgcccaaggccaaacggggcaccgcccagaucauggaggugaccgccaaguggcucuggggcuuccugucucggaacaagaagccccgcaucugcacucgugaggaauucacgcggaaggugcgcuccaacgcggccauaggggccguguuugucgacgagaaccaauggaacagcgccaaggaggcgguagaggacgagcgguucugggaucuggugcaccgcgagcgcgaacuucauaagcagggaaagugcgcaacuugcgucuacaacaugauggguaagcgugagaagaagcugggagaguucgggaaagcuaaaggcucccgggccauuugguacauguggcugggugcccgcuuccuugaguucgaggcgcuggguuucaugaaugaggaccauugguucagccgggagaacucccugagugguguggagggggaggguuuacacaagcugggguacauccugcgagacaucuccaacauaccaggcgggaacauguacgccgacgacaccgcggggugggacacccggauuacggaagacgaucuccagaaugaggcccgcaucaccgacaucauggagccugagcacgcccugcuagccaagucaaucuucaaacugaccuaccagaacaaggugguccgcgugcagcggccagccaagaacggcacgguaauggacguaaucucccgccgggaccaacgcgggagcggccagguggguacauacgggcugaacaccuucaccaacauggaggcccagcuaaucaggcagauggaauccgagggcaucuuuagcccguccgaauuggagacacccaaccuggccgagcgcgugcuggacuggcucgagaaguacgggguggagcggcugaagcgcauggccaucagcggagacgacugcguggucaagccgauagaugacagauucgcgacggcccuuacugcccugaacgacauggggaagguccggaaggacaucccgcagugggagccuucaaagggcuggaacgauuggcagcagguaccauucugcagccaccacuuucaccagcuaaucaugaaggauggcagagagaucguugucccgugccgcaaccaggacgaacugguggggcgggcccgcgugucccagggcgccggguggagccucagggaaaccgcgugccugggcaaaaguuacgcccagauguggcagcugauguauuuccaccgacgggauuuaaggcuggccgccaacgccaucugcuccgcggugcccgucgacuggauuccuacgucacggacaaccugguccauccacgcccaccaccaguggaugaccaccgaagacaugcugagcguguggaaccgcgucuggaucgaggagaacccuuggauggaggacaagacacacaucuccagcuggggggauguuccuuaccugggcaagcgcgaggaccaguggugugguucccuuaucgggcugaccgcccgggccacgugggcgacuaauauccaaguggccaucaaccaaguccgccggcuaauaggcaacgagaacuaccucgacuacaugaccuccaugaagcgcuucaagaacgaguccgacccagagggggccuuaugguag

SEQ ID NO: 24236 - RNA, 9879 nt, Artificial Sequence
  derived and/or modified CDS sequence (opt11) from DENV-1__FJ410266__SS-prME
agcguaaccaugcugcucaugcugaugcccaccgcccuggcauuccaccucaccacccgcggcggggagccccacaugauaguaacgaagcaggagagaggcaagagccuguuauucaagaccucugccggggugaacaugugcacgcuaaucgccauggaccugggugaauuaugcgaagacacuaugaccuacaagugcccacggaucaccgaggccgagcccgacgacguggacuguuggugcaacgccacugacacaugggugacuuaugggaccugcagccaaacgggcgagcauagaagagacaaacggagcguggcgcucgcgccccaugugggccugggccuggagacucggacagagacguggauguccucugagggcgccuggaagcagauccagagggucgaaaccugggcccuccgucacccgggcuuuaccgugaucgcccuguuccuggcgcacgccaucggcaccuccaucacgcagaaggguauuaucuucauucuccugaugcuggugacgcccagcauggccaugcggugcgucggcauuggcucccgcgacuuuguggaggggcucagcggcgcuaccuggguugacguagugcuggagcacgggucgugcgugaccaccauggccaaggacaagcccacgcuugauaucgagcuccugaaaacugaggucacaaaccccgcgguacugcgaaagcucugcaucgaggcuaagauuucaaacacgaccaccgauucccgcugucccacucagggcgaggccacgcugauggaggagcaggacgccaauuuugucugccggcgcacguucgucgaccggggcugggggaacggcugcgggcuuuucggcaaaggcagucucauaacgugcgcgaaguucaaaugcgugacaaagcuugagggcaagaucgugcaauaugagaaccuuaaguauuccgucaucgugaccguucauacaggcgaccagcaccaggucgggaacgaaagcaccgagcacgggacuaccgcaaccauaacgccacaggcccccacuuccgagauacagcucaccgacuacggggcccugacacuagacugcagcccccgcacaggccucgacuucaacgagaugguacugcugacgaugaaggagaaguccuggcucguccacaagcagugguuccuggaccugccucucccuuggacaagcggggcgagcaccucccaagagacguggaaucggcaggaccugcugguuaccuucaagacugcccacgcgaaaaagcaggaaguggucguacugggcucgcaggagggcgccaugcacaccgcccugacaggcgcaaccgagauucagacuuccggcacgacgaccaucuucgcgggccaucucaagugcagacugaagauggacaagcugacccugaagggaaugagcuaugugaugugcaccggguccuucaagcucgagaaagaagucgcggagacgcaacacgggaccgugcuuguacagaucaaguacgaaggcaccgacgccccgugcaaaaucccguucagcacccaggacgagaagggggugacgcagaacggcaggcuuaucacagcgaacccuaucgugacagacaaggagaagccugugaacauugaggcggagccgcccuucggcgagaguuacaucguuaucggcgcgggagaaaaggcccugaaacucagcugguucaagaaaggguccagcauugggaagauguucgaggccaccgcccgcggggcgcggcgcauggccauccucggggacacggccugggauuucggguccauagggggcgucuucaccagcguugggaaacugguccaucagauauucgguaccgccuacgggguguuauucuccggugugucuuggaccaugaagaucgggauaggcguauuguugacaugguuaggccugaacagccgcagcacgucccugagcaugaccugcaucgcgguggggcucgugacccuuuauuugggugucauggugcaggccgauuccgggugcgucaucaacuggaagggucgcgaguugaaguguggguccggcaucuucgucacuaaugaggugcacacuuggacagagcaguacaaauuccaggcggacaguccgaaacgcuuaagcgccgccaucggcaaagccugggaggaaggggugugcggcauucggucggcaacccgcuuggagaauaucauguggaagcagauuuccaacgagcucaaccacauccugcuggagaacgauaugaaguucacagucguggugggggacgucguaggcauccucgcgcaggggaagaagaugaucaggccccagcccauggagcacaaguacagcuggaaguccugggggaaagccaagaucaucggcgcggauguucagaacacgaccuucauuaucgacgggccuaauaccccggagugcccggacgaccagcgcgccuggaacaucugggaagucgaggacuaugguuucggaauauuuaccacgaacauauggcugaagcugagagacaguuacacgcaggugugcgaccaccgccucaugucggccgccaucaaggacagcaaggccgugcaugccgacauggguuauuggauagaguccgaaaagaaugagacuuggaagcuggcccgggcgucguuuaucgaggucaagaccugcaucuggccuaagucccauacccuauggagcaacggugugcucgagucggagaugaucauccccaagaucuacggggguccgauaagccagcacaacuaccgccccggguauuucacccagaccgcugggcccuggcacuuggggaaacuggaacucgacuucgacuuaugcgaagggaccaccguggucguagacgaacacugcggaaaccgggggccgucccugcgcaccacuacgguuacaggcaagaucauucaugaauggugcugucggagcugcacguuaccccccuugcgcuucaaaggggaggauggaugcugguacgggauggagauccggcccguaaaagaaaaagaggagaaucuggugaaauccauggugagcgcuggcaguggagaggucgacuccuucagccucgggcuccugugcauuuccaucaugaucgaggaagugaugcgaagucggugguccaagaagaugcuaaugaccgguacccuggcgguguucuugcuccugaucauggggcagcuaacguggaacgaccugauccgcuuaugcaucaugguaggugccaacgcgagcgauaggauggggaugggcacaaccuaccuggccuuaaucgcuacuuucaagaugcgcccaauguuugccgugggacugcuguuuaggcggcucaccucccgcgagguccugcuucucaccaucgggcugagccuggucgccagcguggaacuccccaacagucuggaggaacucggcgacgggcuugcgaugggcaucaugauccugaagcugcucaccgacuuucagucgcaucaacugugggccacccugcucaguuucacguucaucaagaccacguuaucccugcacuacgcauggaagaccauggccaugguccucagcauugugucccuguucccccugugccucagcacgacgucccagaagacuacguggcugccugugcugcucggcagccugggguguaaaccgcugaccauguuccucaucgccgagaacaagauauggggccggaaguccuggccccucaacgagggaauaauggcggucggcguggugagcauccugcucucaucccugcuuaaaaaugacgucccauuggccggaccccugauugccggcgguaugcugaucgcuugcuacgucaucagcgguucaagcgcagaccucucacuggagaaggccgcggaagucagcugggaggaggaggcggagcacuccggagccagccacaacauccuggucgaggugcaggacgaugggaccaugaaaaucaaggacgaggaacgcgacgacacccuaaccauacugcugaaggcgacccuccuggcgguguccggcguuuacccgcuaagcauccccgccacucucuuuguuuggcauuucuggcagaagaagaagcagcggagcggagugcugugggacaccccuagcccgcccgaggucgagcgggccgugcucgacgacgggaucuaucgcaucaugcagcgcggucuguuaggucggucccaggucggcguagguguuuuccaagagaacguguuccacacaauguggcacgucacgcgcggcgccguguuaauguaccagggaaaacggcuggagccgagcugggcgucgguuaaaaaggaucucauuagcuacggcggcggguggcgucugcagggcuccuggaacacgggggaagagguccagguaaucgcuguggagcccggcaaaaaccccaagaacguccagacugcgcccggaaccuucaagacucccgagggcgaagugggcgcaaucgcccuggacuuuaagcccggaacgucgggguccccgauugugaaucgggaggggaagauuguggggcuuuacgguaaugggguuguuaccacgagcggcacguacgucagcgcgaucgcacaagccaaagccagucaggaagguccguugcccgagaucgaggacgagguguuucguaagcggaaccugacgaucauggaccuccaccccggaagcgggaagacccgccgguaccugccggcuaucgugcgcgaggccaucaaacggaagcugcgcacccucauccuggcucccacacgggucguggccagugaaauggccgaggcgcugaaaggcaugcccauacgcuaccagacaacagccgucaagagcgagcacaccggcaaagagaucgucgaccucaugugccacgccaccuuuacuaugcggcugcugucucccgugagagugccuaauuacaacaugaucaucauggacgaagcgcacuucaccgaccccagcucuauugccgcgcggggguacauuagcacacgggucggcaugggggaagcagccgcuaucuucaugaccgccacgccaccagguagcguggaagcguucccgcagagcaacgcugugauccaggacgaagagcgcgacauccccgagaggaguuggaacagcggcuacgaguggauaaccgacuuccccggcaagaccgugugguucguucccuccaucaaaucugggaacgauaucgccaacugccucaggaagaacgggaagcgggucauccagcugucaaggaagaccuucgacacggaguaucagaagacuaagaauaacgacugggacuacgucgugaccaccgacauaucugaaaugggcgcuaacuuccgggcggaccgggucaucgacccacggcgcugccugaagcccgucauccucaaggacgggcccgaacgggugauucuggccggcccaaugccaguuacugucgccuccgccgcccaacgccgagggcgaaucggcagaaaccacaacaaggagggcgaccaauauaucuacaugggucagccccugaacaacgaugaggaucaugcgcacuggacggaggccaaaaugcuccuggacaacaucaacacaccggaaggcauuauccccgcccuguucgagccggagcgcgagaaguccgccgcgaucgacggagaguaccggcuccgcggggaggcgagaaagaccuucguggaacuuaugcggcgcggggaucugcccguuuggcucuccuacaagguggcgucugaggguuuucaguacagcgaccggcgauggugcuucgacggcgagcggaacaaccagguguuggaagagaacauggaugucgagaucuggacgaaggagggggaaagaaagaaguuacggccccgguggcucgacgcccggaccuacuccgacccuuuggccuugcgcgaguucaaggaguucgccgccggccggcgcucuguguccggggaccucauacuggagauugggaagcugccccagcaccuaacccagagggcccaaaacgcccuggauaaucuagugaugcugcacaacagcgagcagggcgggcgcgccuacaggcaugcuauggaggagcuaccagauaccaucgaaacgcugaugcuccuagcccugauugccguccucaccggaggaguuacgcuguuuuuccugaguggacgcgggcucgguaagaccagcaucggccuucugugcguuauggcuuccagcguacuccucuggauggccuccguggaaccccacuggaucgcggccagcauuauccuggaguucuuucucaugguacuguuaaucccagaaccggaccgacaacgcacgccccaagauaaccaacucgccuacgucgugaucggacugcucuuuaugaucuugacgguugccgccaacgagaugggccugcuggaaaccaccaagaaggacuuggggaucggccacguagcgguggagaaccaccaucacgccaccauguuggacgucgaucugcacccggccucggcguggacgcuauacgccgucgcgaccaccaucaucaccccgaugaugcggcacaccauugagaacaccacagccaacauuagccugaccgccaucgccaaccaagcugcgauucugauggggcucgacaaggguuggccgaucaguaaaauggacaucggcgucccucugcuggcccucgggugcuauucccaggugaaccccuuaacgcucacagccgccguccuuaugcugguugcgcacuaugcuaucaucggcccagggcuucaggcgaaagccacccgcgaggcgcagaagaggaccgcggccggcauuaugaagaaccccacgguagacggcaucgucgccaucgaccucgacccgguagucuacgacgccaaguuugagaagcaguuaggccagaucaugcugcuuauccugugcacaagccaaauuuugcucaugcgcaccaccugggcccugugcgagagcaucacgcuggccaccggcccccugacgaccuugugggagggguccccgggcaaguuuuggaacaccacgaucgcuguuucgauggccaacaucuucaggggauccuaccuggcuggugcaggacuagcguucucgcucaugaaaagccucgguggcgggcggcgcggaacgggggcccagggcgagacccucggcgagaaauggaagcgccagcugaaccagcugucuaagucugaauucaacaccuacaagcgcuccggcaucauggagguugaccggagcgaggccaaagagggccugaagcgcggcgagaccacccggcacgcagugucccgcggcaccgcgaagcuacggugguucgucgagcgaaaccuggugaaacccgagggaaaggugauugaccuugggugcggacgaggcggguggagcuacuauugcgccggauugaagaaggucaccgaggugaaaggguacacaaagggaggacccgggcacgaggagcccaucccgauggccaccuacggguggaaucuggugaagcugcacaguggcaaggacguuuucuucacgccgccggaaaagugcgacacgcuccuaugcgacauaggggagagcuccccaaauccgaccauagaggaggggcgcacucugcgggugcuuaagaugguggagccguggcugcgcgggaaccaguucuguaucaagauccucaacccauacaugcccagcgucguggagacccuagagcaaaugcagcggaagcacgggggcaugcuugugcgcaacccgcuuagccggaacagcacucacgagauguacugggucucaugcgggacgggcaacaucgucucggccgugaauaugaccucccguaugcuccugaacagauucacgauggcucaccgcaagcccacauaugagcgugacgucgacuuaggggcgggcacacggcacguggcagucgagcccgaaguagcuaaucucgacaucauuggccagcgcauagaaaauaucaaacacgagcacaagucaacuuggcacuaugacgaggacaaccccuacaagacgugggccuaucacggguccuacgaagugaagccgagcggcuccgccucaagcauggucaacggaguuguuaagcuucugacgaagcccugggacgucauccccauggucacgcagaucgcgaugaccgauaccacuccguuuggccagcagcggguguucaaggagaagguagacacgcgcaccccgaaggcgaagcgggggacagcccagauuauggaagugaccgccaaauggcucuggggcuuccucagccguaauaagaagccccggaucugcacuagggaggaauucacacguaaggugcgaagcaacgcugcgauuggagcggucuucguggacgaaaaucaauggaacagugccaaggaagccguggaggacgagcgcuuuugggaccugguccagaaagagcgcgagcuccauaagcaggggaagugcgcgacuugcguguacaacaugaugggcaagcgggaaaagaaguugggggaguucggcaaagcuaaggggucucgggccauuugguacauguggcugggggcccgauuccucgaguucgaggcccugggcuuuaugaaugaggaccacugguucucccgcgaaaacagccuguccgggguagagggggaggggcuccacaagcugggguacauccuccgcgacaucagcaaaaucccgggggggaacauguacgcggacgacaccgccggaugggacacgcggaucaccgaggacgauuugcagaacgaggccaagaucaccgacaucauggaaccggagcacgcccucuuggcuaccucgauauucaagcucacguaucagaacaaaguaguacgugugcagcgcccagcuaagaauggaaccgucauggacguaauuagccggagggaccagcggggcuccggccaagugggcaccuaugggcugaacacauucacgaauauggaggcgcagcugauucggcagauggagagcgaagguaucuucuugcccggcgagcuggagacccccaacuuggccgagcgcguccucgacuggcucgagaaguacgggguggagcggcuaaagcguauggccaucagcggcgacgacugcgucgugaagccgaucgacgacagauucgccacagcgcuuaccgcccuuaacgacaugggaaaggugcggaaggacaucccucagugggagcccagcaagggguggaacgauuggcagcaaguccccuuuuguucccaccacuuccaccagcugauaaugaaggacggccgggagauaguugugccgugcagaaaucaggaugagcucguagggcgugcccgggucucccaaggcgcgggguggucccugcgggaaacggccugucuaggcaagucauacgcgcagauguggcaacucauguacuuccaccgccgggaccuuaggcucgccgcaaacgccaucuguagcgcggugccuguagacuggguccccaccagucggaccaccuggucaauccacgcgcaccaucaguggaugacgaccgaggacaugcucuccguguggaaucgcguguggaucgaggagaaccccuggauggaggauaagacccaugucagcuccuggggcgacguaccguacuuaggcaagcgagaggaccaguggugcggaucguugaucgggcucacggcccgcgcgacuugggcgagcaacauucaaguggcgaucaaccagguccggcgcuuaaucggcaacgagaacuaccuugauuacaugaccucuaugaagcgguucaagaacgagggggaccccgagggcgcucugugguga

SEQ ID NO: 24237 - RNA, 9879 nt, Artificial Sequence
  derived and/or modified CDS sequence (opt11) from DENV-1__FJ410269__SS-prME
agcgugacgaugcuauuaauguugaugcccacagcccucgccuuccaucucaccacccggggcggugagccacacaugaucgucacaaagcaagagcgagggaaauccuugcuguuuaagaccucagcuggggugaacaugugcacccuuaucgccauggacuugggcgagcugugcgaagacaccaugaccuacaagugcccccggaucacagaagccgagcccgaugacguggacugcuggugcaaugccaccgacaccugggucaccuacgggacaugcucucagacgggcgagcaccggcgcgacaagaggagcguugcgcuggcgccucacguuggccugggguuggagacacgcacggagacuuggauguccagcgagggcgccuggaaacagauacaacggguggagacgugggcccuccgacacccggguuuuacagugaucgcccuauuccuggcccacgccauaggcaccuccaucacacagaaggggauuauuuucauccucuuaaugcuggugacucccagcauggccaugcgguguguaggcaucggcucucgugacuucguggaggggcuaagcggcgccaccuggguagaugucguguuagaacacggcucaugcgugacgaccauggccaaggacaagccuacgcuggacaucgaguuguugaagaccgaggucacaaaccccgcggugcugcggaagcucugcaucgaggcuaagaucuccaauacaacgaccgacucccgcugccccacccagggggaggccacacugauggaagaacaggacgcuaacuucguaugccggcggacuuucgucgaucggggcuggggaaacgggugcggguuguucggcaaagggagccucaucacgugcgcuaaguucaagugcgugaccaaacuggaggggaagaucguacaguacgaaaauuuaaaguacuccgucauugugaccgugcacacgggcgaccagcaccaaguaggcaaugagagcacggaacaugggaccaccgcaaccauaacgccccaagcucccaccuccgagauccagcuaacagacuacggcgcccugacccuggacugcagcccccgcacggguuuggacuucaaugaaaugguccuucugaccaugaaagagaaguccuggcucguccauaagcagugguuucuugaccuuccgcucccuuggacgaguggggccucaaccucgcaagagaccuggaaccggcaagacuugcugguuaccuucaaaacugcucacgccaagaagcaggaggugguaguguuagguucgcaggaaggagcuaugcacaccgcacuuaccggggcgaccgagauccagacauccggcaccacgacaauauucgccgggcacuugaaaugccgccucaaaauggacaagcuaacccugaagggcaugagcuacgucaugugcaccggguccuucaagcucgagaaagaggucgcggagacgcagcauggcaccgugcuagugcagaucaaguacgagggcaccgacgcccccugcaagauccccuucucuacccaagacgagaagggggucauccagaacggcagacugaucacggccaacccgauaguaaccgacaaggagaagcccgugaauauagaggcugaaccgcccuuuggggaguccuacaucgucaucggcgucggcgaaaaagcguuaaagcucagcugguucaagaaaggguccagcauaggcaagauguucgaggccaccgcacggggcgcccggcgcauggcgauccugggagauaccgcgugggacuuuggguccauugguggcguguucaccucagucgguaagcuggugcaccaaaucuuuggcaccgccuacggcguacuguucuccggcgugucguggaccaugaaaaucgggaucggcguucuccugaccuggcucggcuugaacucccgcagcacgucccugagcaugaccuguaucgccgugggccucgucaccuuguaucugggcgugauggugcaggcagacuccgggugcgucaucaacuggaagggccgggagcucaaaugcgggagcgggaucuucgugaccaacgaagugcacacuuggacugaacaauacaaguuccaggccgacagcccgaaacgacuuuccgcugcaaucggaaaagccugggaggagggcgucugcggcauucgguccgucacccggcuggagaauaucauguggaaacagauuuccaacgagcucaaccauauccugcuggagaacgacaugaaguucaccguuguggugggcgacguggucggcauccucgcccagggcaaaaagaugauccggccgcagcccauggagcacaaguacagcuggaaguccugggggaaggccaaaaucaucggcgcggacgugcagaacaccacguucaucauagacgggcccaacaccccggagugcccugacgaucagcgcgcuuggaacauuugggagguggaggacuacggcuucgggaucuuuaccaccaauaucuggcugaagcugcgggacucguacacgcaggccugcgaccaccgccugauguccgccgcuaucaaggacagcaaagccguccaugccgacauggguuacuggauagaauccgagaagaacgagaccuggaagcuggccagggcaaguuucaucgaagugaaaaccuguaucuggcccaagucccacacucuguggucuaauggcgugcuagaauccgaaauggucauacccaaaauuuacgggggccccaucucgcaacauaacuaccgccccggguacuucacgcaaaccgcuggcccauggcaucuggggaaacuagagcucgacuucgacuugugcgagggcaccaccgugguggucgaugagcacugcggcaaccgggggccaucccugcgcacgaccaccgugaccgguaagauuauacacgaguggugcugccgcaguugcacguugccgccacuccgcuucaaaggggaggaugguuguugguacgggauggaaauaagacccguuaaggagaaggaagagaaccuggucaaguccauggugucggcaggcuccggcgaaguagacuccuucucccucgggcuccuaugcauauccaucaugaucgaggaggucaugcgcucccgguggagccggaagaugcucaugaccgggacgcuggccguguuucugcuccugauaaugggccagcugaccuggaacgacuugauccgacugugcaucaugguaggcgccaacgccucagaccgaauggggaugggaacgacauaucuugcguuaauggcuacauucaagaugcgcccgauguucgcugucggacuucuguuccgccgccugaccuccagggagguguuauuacucacgaucgggcugagucuggucgccuccguggagauccccaauucucucgaggagcugggcgauggccuggccaugggcaucaugauccucaaacuguugaccgacuuccagucccaccaacuaugggcgacccugcugagccugacuuucauuaagacgacccugucccugcauuacgccuggaagacaauggccauggugcucagcaucguuucauuauucccccugugucucuccaccacgucccagaaaaccaccugguugcccgugcuucucgguucgcuggggugcaaaccgcugaccauguuccucauugcagagaacaagaucuggggccgcaaguccuggccacugaacgaggguaucauggcggugggggucgugagcaucuuacuuagcucccuguugaagaacgacgugccccucgccgggccccugaucgcaggcggcauguuaaucgcgugcuacgugaucuccggguccagcgcggaccucagccuagaaaaagccgcagagguuagcugggaggaagaggcugagcacuccggagccagucacaacauccuggucgagguccaggacgacggcaccaugaaaauuaaagacgaggagcgcgacgacacucucaccauccugcucaaggccacccuacuggcuguuuccggcguguacccgcugagcauccccgccacccucuucguaugguacuucuggcagaaaaagaaacagcgcuccggcguucuaugggacacaccaagcccgcccgagguggagcgggccguccuggacgacggaaucuaccgcauuaugcagaggggccugcucggccgcucccaggugggcgugggaguuuuccaagagaacguguuucacaccauguggcaugucacccgcggcgccguccugauguaucaggggaagcguuuagagcccagcugggccuccguaaagaaagacuuaaucagcuacggaggaggguggcgacuacaaggcagcuggaacacaggggaggagguacaagucauagcgguggagccggguaagaaccccaagaaugugcaaacagcacccgggacauucaagacaccugagggcgaggucggcgccaucgcccuggacuucaaacccgggaccucgggcucccccauagugaaccgcgaagggaagaucgucggucucuacggcaacgggguggugacgaccaguggcaccuaugugagcgcaaucgcucaggcuaaggccagccaggaggggccgcugcccgagaucgaggacgaggucuuccggaagcguaaccugaccaucauggaucuccaccccggcagcgggaagacgcggcgcuaccugccggccauaguucgcgaggcgaucaaacgcaagcuacggacgcucauccuggcccccacgcgcguggucgccagugaaauggccgaagcccugaaggggaugccuauccgcuaccaaaccacggcggucaagagcgagcauaccggaaaagaaaucguggaccugaugugccacgccaccuucaccaugcggcugcugucccccguccgcgugccgaauuacaauaugauaaucauggaugaggcccacuuuacggacccuucuuccaucgccgcacgaggguauaucagcacccgagugggcaugggugaggcggcagccaucuucaugaccgccacaccgcccggcuccgucgaggccuucccgcaguccaacgcggugauccaggacgaagaacgugacaucccugagcgcuccuggaacagcgguuaugaguggaucacggacuucccaggcaagacggugugguucgugcccuccauuaaaucaggcaaugauauagccaauugccuccggaagaacgggaagcgagugauccagcugucccggaaaaccuucgauaccgaguaccagaagacgaagaauaacgacugggacuacgugguaacgaccgacaucagcgagaugggcgccaauuuucgagccgaccgggugaucgacccgcgccggugccugaagcccgucaucuugaaagacggccccgagcgggugauauuagcgggccccaugccgguuaccguagccuccgcagcacagcggcgggggcggaucggccggaaccacaacaaggagggcgaccaguacauuuacaugggucagccccugaacaacgacgaggaccacgcccacuggacagaggccaagaugcuuuuagacaacauaaauacccccgagggcaucauccccgcccuguucgagccggagagagagaaguccgcagccaucgauggggaguaccgccuccgcggcgaggcccggaaaaccuuuguggagcugaugcgccgcggggaccugccgguguggcucuccuacaaagucgcuagcgaaggauuccaguacucagaccgacggugguguuucgacggcgagaggaacaaccaaguucuggaggagaacauggauguggagaucuggaccaaagagggggagcggaagaaguuacgcccacgguggcucgacgcccguaccuacucggaccccuuagcccugcgagaguucaaggaguucgcugccggaagaagaagcgucuccggagaccucauccuggagaucggcaagcucccgcaacaccucacccagcgcgcucagaacgcccuggacaaccuggugaugcuccacaacagcgagcagggcggacgggcuuaccgucacgcaauggaggagcugcccgacaccaucgagacauuaaugcuccuagcguuaauagcugugcucacaggaggggugacgcuguucuuccucuccggccggggacucggcaaaaccucgaucggauuacugugcgugauggccaguucugugcugcuguggauggcguccgucgaaccccacuggaucgccgcgaguaucauccuugaguucuuccuaaugguguuacugauaccagagccggaccgccagagaacgccccaggauaaucagcuugccuacguuguaauugggcuacuguucaugauacuaaccguagccgccaaugagaugggucugcucgagacgaccaagaaagacuuggggaucggccauguggccguggagaaucaccaccacgcgacgaugcuggacguggaccugcaccccgccuccgccuggacacucuaugcuguggccacuaccaucauuaccccaaugaugcgccacacaaucgagaacacgaccgcgaacaucagccugaccgccaucgcaaaccaggccgccauacugaugggccucgauaaaggcuggccuauuuccaagauggauauaggcgucccauuacuggcacucgggugcuauucucagguaaacccccucacccuuacggcggccgugcucaugcuggucgcccacuacgcgauuaucgguccgggucugcaagccaaggccacccgagaagcccagaagcgcaccgccgcgggaaucaugaagaacccgacaguugacgguaucguugccauagaccucgaccccgucguguacgacgcuaaguucgagaagcagcuaggccagaucaugcugcucauccuaugcacgucccagaucuuacucaugcgcaccaccugggccuuaugcgaaagcauaacacuggccacgggaccccuuaccacccugugggagggguccccgggcaaguucuggaacaccacgaucgcggugucuauggccaauauauuccgggguuccuacuuagcuggcgccggccucgccuucagcuuaaugaagucccucggcggcgggcgacgggggaccggggcgcagggugagacccucggagaaaaauggaaacgccaacugaaucaacuguccaagagugaauuuaacaucuacaagaggucugggaucauggagguagaccgcagugaggcaaaagagggccucaagagaggggagacuacgcgccaugccgugucccggggcaccgcaaagcugcgcugguucguggagagaaaccucgucaaacccgagggcaaggugaucgaccuaggauguggccgcgggggcuggucauacuacugcgcaggguugaaaaaggucaccgaagucaagggcuacaccaagggugggcccggucacgaggagccgauccccauggccacuuacggguggaaccugguuaagcugcacuccgguaaggacguauucuucacucccccggagaagugcgacacccuacugugcgacauuggggagagcucgccgaaucccacuauagaagagggucggacgcugagagucuugaagaugguggaacccuggcugcgcgggaaccaauuuugcaucaagauccugaaccccuacaugcccagcguggucgagaccuuggagcaaaugcagcgcaaacacggcggcaugcuggugcggaauccgcugucccguaauagcacccacgaaauguacugggucuccugugggaccggcaacauaguuagugccgugaacaugaccucgaggaugcucuuaaauagauucacgauggcccaccgcaagcccaccuacgagcgggacguggaucugggugccgggacucgccacgucgcuguggagccggagguggccaaccuagauaucaucggccaacggaucgaaaacauaaagcacgagcauaaaucuacuuggcauuacgacgaggacaaccccuacaaaacgugggcuuaccaugggagcuacgagguuaagccaucaggcuccgcgagcucuaugguaaacggggucgugaaguuacugaccaaacccugggaugugauccccauggucacccagauagccaugaccgacacgacccccuucggucagcagcgcguguucaaggagaagguugacacgcggaccccgaaggcgaagcgcggcacggcccagaucauggaaguaacggcccgguggcucuggggcuuccuuucucgcaacaagaaaccccgcaucugcacucgcgaggaguucacgagaaaagugcgcucaaacgccgcaauuggugcugucuucgucgaugaaaaucaguggaacagcgccaaggaagccguggaagacgagcgguucugggaucuggugcagaaagagcgcgaacuccauaaacagggaaagugcgcuacgugcguauacaacaugaugggcaagcgggagaagaagcugggcgaguucggcaaggcgaaagggagccgcgcuauuugguacauguggcugggugcccgguucuuggaguucgaggcccugggcuucaugaacgaggaccacugguucucccgcgaaaacagccuguccgggguugagggagaggggcuccacaagcugggcuacauuuuacgagauauaagcaagauccccgggggcaacauguacgccgacgacaccgcggguugggacacccgcaucacggaggaugaccuccaaaacgaggccaaaaucacggacauaauggagccggagcaugcccuacucgcuacuuccaucuucaaguuaacguaccagaauaagguuguccggguucagcgccccgccaagaacgggaccgucauggacgucaucagccgccgggaccagcgcggcuccggacaagugggcacguacggccuuaacaccuucaccaacauggaggcgcaacuuauccggcagauggagucggagggaaucuuccucccaagcgagcuggagacccccaaucuggcugagcgcgugcucgauuggcucgaaaaacacggcguagagcggcugaagcguauggccaucucgggggacgacugcgucgugaaaccgauugacgacagguuugcgacagcccucaccgcccugaacgacaugggcaaggucaggaaggacaucccacagugggagcccucaaaaggcuggaaugauuggcagcagguacccuucugcagccaccacuuucaccagcugauuaugaaggacgggcgggagauaguugucccgugccgcaaccaggacgagcucgugggccgggcccgcguuucccaaggugcaggcuggagccugcgggaaacggccugcuuaggcaagucauacgcccagauguggcagcucauguacuuccaccgcagagaccugcgccuugcugcuaacgccaucugcuccgccguccccguggacugggugcccacuucucggacgaccuggucaauccaugcgcaucaccaguggaugaccacugaggacaugcucagcguguggaaccgcguuuggaucgaagagaaccccuggauggaggauaagacccauguguccagcuggggugacguccccuaccuggguaagcgggaggaccaguggugcggcucgcugauaggccucacagcccgcgccaccugggccagcaacauccagguggcgaucaaucaggugagacggcugaucggaaacgaaaauuaccuggacuacaugacgucgaugaagcgcuucaagaacgaaggugaccccgagggggcacuaugguga

SEQ ID NO: 24238 - RNA, 9879 nt, Artificial Sequence
  derived and/or modified CDS sequence (opt11) from DENV-1__FJ410273__SS-prME
agcgugaccaugcucuugaugcugaugcccacugcuuuagccuuccaucucacuacacgcggaggggaaccccacaugaucgugucaaagcaagagcggggcaaaucgcuccuauuuaagaccucugccggagugaacauguguacgcucaucgccauggaccugggcgagcucugcgaggacacgaugaccuacaagugcccccgaaucacagaggcugagccagaugacguggacuguuggugcaacgccacagacacgugggugaccuacggcaccuguucucagaccggugagcaccggcgcgacaagcgguccguggcccucgcgccccacgucgggcugggacucgaaacgcgcaccgagaccuggaugucguccgagggcgcauggaagcagauccagcgagucgaaaccugggcccuacgccacccugguuucacggugaucgcccuguucuuagcgcacgccauaggcacgucuauaacgcagaaagguaucaucuucauccuccugaugcugguuacgcccuccauggcgaugcggugcgucggcauaggcucucgcgacuucguggaaggucucuccggcgccacguggguggaugucgugcuggagcacggcaguugcgugaccaccauggcgaaggacaagccaacccuggauaucgagcuccugaagacggaggucaccaauccugcagugcugagaaagcucuguaucgaggccaagauuuccaacaccaccacggacagccgcugcccgacccaaggugaggcuacccuaguggaggagcaggaugcgaacuucgucugccggcguaccuuuguggaccggggcuggggaaaugggugcggccuauucggcaagggaucccuaauuacgugcgccaaguucaagugcgugacaaagcuggagggcaagaucguccaguacgagaacuugaaguacagcgugauagucacugugcacaccggagaccagcaccaagugggaaacgaauccacugagcacgguacuaccgcgaccaucacgccccaggcccccagcacggagauccagcucaccgacuauggggcccugacccuggacugcagcccccggaccggacuugacuuuaacgagaugguccugcugacgaugaaggagaaauccuggcuaguccacaaacagugguuucuggaccugccgcugcccuggacaagcggggccuccacuagccaggaaaccuggaacaggcaagaccugcuugugacguuuaagaccgcccacgcgaagaagcaggagguggugguccuuggcucccaagaaggcgcuaugcauaccgcccucaccggggcgaccgagauccagaccagcggaaccaccacaauauucgccggccacuugaagugccgccucaagauggacaaacugacguugaaggguauguccuacgucauguguaccgggucuuuuaagcuggagaaggaggucgccgagacccagcacggcacaguuuuaguccaaaucaaguaugagggcaccgacgccccguguaagauucccuuuuccacccaggacgagaagggggugacccagaacggccggcuuaucacggcaaacccgaucgugacggacaaggagaagccuguaaauaucgaggccgagccccccuucggugagucguacauagugaucggcgccggagagaaggcgcugaaacucagcugguucaagaaggggagcuccaucgguaagauguucguugccaccgcccguggugcacggcgcauggcaauacugggcgacacggcuugggacuucgggucaaucggcggcguuuuuacguccguugggaaauuagugcaucagaucuucggcaccgcauacgggguccucuuuagcggcguauccuggacgaugaagaucgguaucgggguacugcuaaccuggcucggguugaacucacgcuccaccagccuguccaugaccugcauagccguugggcuugugacacuguaucugggcguuaugguccaggcagauagcggcugcguuaucaacuggaaggggcgggagcucaagugcgggagcggcaucuucgucaccaacgagguacacaccuggacugagcaauacaaguuucaggccgauuccccgaaacgcuuaagugccgcuaucggcaaggccugggaggaaggggugugcggcauccggucagccacccgccucgagaacaucauguggaaacagaucagcaaugagcucaaccauauccugcuggaaaacgacaugaaauuuacuguggucgucggggacguggcgggcaucuugacccaagggaaaaaaaugauacgcccccagcccauggaguacaaguacucguggaaguccugggggaaggccaagaucaucggugccgaugugcagaacacgacauucauuaucgaugggccaaacaccccggagugccccgacgaucagcgcgccuggaacauuugggagguggaggacuacgguuucgggaucuucaccaccaacauauggcugaagcugcgggacuccuacacgcaggugugcgaucacagacuaaugagcgcagcgauaaaggacuccaaagccguccacgcagacaugggcuacuggauagagucggagaagaacgagacauggaagcuggcccgcgcgaguuucaucgaggugaagaccugcauauggcccaaaagccauacgcugugguccaacggcgugcucgagagcgaaaugaucauccccaaaaucuaugggggcccuaucucccagcacaacuaccggccuggguacuucacccagaccgccggcccauggcaccuagguaagcuggagcucgacuuuaaccugugcgaaggcacgaccgucguuguggacgagcacugcgggaaccggggcccaucucuacgcacaacaaccgucacgggcaagaucauccacgaguggugcugccggucaugcacucugccgccucuccgcuucaagggggaggacggcuguugguacgggauggagauaaggcccgugaaggagaaggaggagaaucuggucaagucuauggucagcgcuggcagcggcgagguggauagcuucucgcucgggcuuuugugcauuagcauaaugaucgaagagguuaugcgcucucgguggagccgcaagaugcucaugaccggcaccuuagcaguguucuuccugcucaucauggggcagcugacguggaacgaucugauucggcucugcauuaugguuggcgccaacgcguccgaccggauggggaugggcacuaccuaccuggcccugauggccaccuuuaaaaugaggcccaugcucgcagucggcuuacuguucagacgccucacgucgcgggaggucuuacuccucaccauugggcugucccuggucgccucaguagagcuccccaacagucuggaggagcucggcgauggucuggcgaugggcaucaugauacuaaaacugcucaccgacuuccagagccaccagcugugggcaacccugcucucccuuacuuucauaaaaaccacguauagucugcacuacgccuggaagacuauggccauggugcucuccaucgucucacuguuccccuuaugucucucaacgaccagccagaagaccaccuggcugcccgugcuguugggcucacuggggugcaagccgcugacgauguuccucaucgcggagaacaagaucuggggacgcaaaagcuggccucucaaugaaggcaucauggccgugggcaucgucucuauccugcucuccagccuucugaagaacgacguuccccucgccgggccccugaucgccggcggcaugcugaucgcaugcuaugucauauccgggagcuccgcggacuugucucuugagaaggccgccgagguuucuugggaagaggaggccgagcacagcggcgccucacacaacauauuggucgaagugcaggaugaugguaccaugaagaucaaggacgaggagcgggacgacacccucaccauucugcugaaggcgaccuuguuggccgugagcggggucuacccgcugucaaucccugccacccuguucguuugguacuuuuggcagaagaagaaacagaggucaggugugcugugggacaccccaucuccaccugaggucgagcgagcggugcuggacgaugguaucuaccguaucaugcagcggggccuucucgggaggagccaggugggcguagggguguuccaagagaauguguuccacaccauguggcacgucacccggggcgccgugcugauguaccaagggaagcgccuggagccguccugggcgagcgugaagaaggaccucauuucauacggaggcggguggcggcugcaggguucguggaacaccggggaggagguccaggugaucgccguggaaccuggcaagaacccuaagaacguccagaccgcucccgggacauucaagaccuccgaaggcgaggucggcgcgaucgcccuggacuuuaagcccgggacgucuggcagccccauugugaaccgcgaggggaagauugucggucucuauggcaaugggguggugaccaccucaggcaccuaugucagcgcgaucgcucaggccaaggccagccaggaagggccucugcccgagauagagaaugaaguguuccguaagcgcaaccugacuaucauggaccuccaccccggcagcgggaagacccggcgcuaccugccagcuaucguacgggaggccaucaagcgcaagcugcggacucucauccuggccccgacucgcgucguggccuccgaaauggccgaggcccugaaaggcaugccaauccgcuaccaaacgaccgccgucaaauccgagcacaccggcaaggaaauagucgaccuuaugugccaugccaccuuuacuaugaggcugcugucccccgugcgcgugcccaacuauaauaugauaaucauggaugaagcccacuucaccgacccgaguuccauagcugcccggggauacaucagcacgcgcgucggaaugggugaggccgcugccauuuuuaugaccgcuacgccgcccggcuccguggaggcauucccacaaagcaacgccgugauccaggacgaggagcgggauaucccggagcgcuccuggaacucgggguacgaguggaucacagacuuccccgggaaaacagucugguuuguucccuccaucaaaucaggcaacgacaucgccaacugucuccggaagaacgggaagcgugugauucagcugucgcggaagacauucgauacggaguaccagaagacgaagaauaacgauugggacuaugucguaaccacagacaucagcgagaugggcgccaauuuccgcgcggaucgggugauugacccccgacgcugccugaaacccguuauccugaaggacggaccggagcgcgugauucuggccggccccaugccagucacuguggccuccgccgcccagcggcgcggccggaucggcaggaaccacaauaaggagggagaccaguacaucuacauggggcagccgcugaacaaugacgaggaccacgcgcacuggaccgaggccaagaugcuccuggacaacaucaauacccccgagggcaucauccccgcccuguucgagcccgagcgggagaaauccgccgccaucgauggggaguauaggcuucgaggcgaagcgcguaagaccuucguugagcugaugcgccguggagaccuacccgucugguugagcuauaaggucgccucugagggguuccaguauucugacagacgguggugcuuugacggcgagcguaauaaccaggugcuggaagagaacauggacgucgagauauggacgaaagagggggagcggaagaagcugcguccgcgguggcucgacgcccgcaccuauuccgacccucuagcccugagagaguucaaggaguucgccgccggacgccggucggucuccggagaccuaaucuuggaaaucgguaagcugccgcagcaccugacccagcgcgcccagaacgcccuggacaaccuggucaugcuccacaacagcgaacaaggcggccgggccuaccgccacgcgauggaggaacuaccagacacgaucgagacucucaugcuccuggcccugauugccgugcucaccggcggggucacucuguuuuuccugucgggccgggggcuuggcaagacaucgaucggacugcucugugugauggccuccagcguccuccuguggauggccucgguugagccgcacuggauugcggcaucaaucauucuggaguucuuucucauggugcuccuuauccccgagcccgaccgccagcggaccccccaagacaaccaguuggcuuacguugugaucgggcuacuguuuaugauccucacggucgccgcgaaugagaugggccugcuggaaacuaccaagaaggaccucggaauuggucacgucgcgguggaaaaucaccaccacgccgcgaugcuggacguugaccuccacccagccuccgccuggacccucuacgcugucgcgaccaccaucaucacccccaugaugaggcacaccaucgaaaacacgaccgccaacauaagccugaccgcgaucgccaaccaagcggccauucugauggggcucgacaagggauggccgaucuccaaaauggacaucggcgugccacugcuggcccucgggugcuacagccagguuaaccccuuaacacuuacagcugcuguccucaugcugguugcacacuacgccaucaucgguccugggcugcaggccaaagccacacgggaggcgcagaaacgcaccgcggccgguaucaugaagaaccccaccguggacgguaucgucgcgaucgaccuugaucccgucguauacgacgcgaaguucgaaaagcaguuaggucagauaauguuacucauccuuugcacgucgcaaauccuucucaugcgcaccacgugggcgcugugcgagucaauaacccuggccacaggcccccuuaccacucuaugggaggggucccccgggaaguuuuggaacaccacgauagccgucucuauggccaacaucuuccgagggagcuaccuggccggcgcgggucucgccuuuucccugaugaagucucucggaggcgggcgccgcgggaccggugcccagggcgaaacccucggggagaaauggaagagacaguugaaucagcuauccaaguccgaauucaacaccuacaagaggagcgggaucauggaaguggaucgcagcgaagccaaggagggcuuaaagcguggugagaccaccaagcacgcgguuucccgugggaccgccaaacugcguugguucguagaaagaaaccugguuaaaccggaggggaagguuaucgaucuggguugcggccgcggcggauggagcuacuacugcgccggccuaaagaaagucacagaaguaaagggauacacgaaagggggucccgggcacgaggagcccauccccauggccacauauggauggaaucuggugaagcuacauagcggcaaagacgucuucuucauaccaccagaaaagugcgacacacuccucugcgacaucggggagucauccccgaaccccacaaucgaggagggccgcacgcugagggugcuaaagaugguugaaccgugguugagggggaaccaguucugcauaaagauccuaaacccauacaugcccucgguaguggaaacccucgagcagaugcagcggaagcauggcggcaugcuggugcgcaacccccugucccggaacucaacacacgagauguacugggucuccugcgguaccggcaauauugugagugccgugaacaugacaucccguaugcuccuaaaucgcuucacgauggcgcaucgaaaaccuaccuacgagcgcgacgucgaucugggggccggcacucggcacguggccguggagcccgagguagccaacuuagacaucaucggucagaggauugagaauauaaagcacgagcacaagucuacguggcacuacgacgaggacaaccccuacaagacgugggccuaucacggaucauacgaggugaagcccagcgggagcgcguccucuaugguaaacggggugguuaagcucuugaccaaaccgugggacgucauccccauggugacccagaucgccaugaccgacaccacucccuucggccagcagaggguguucaaggagaaggucgauacccgcaccccgaaagccaaacggggcaccgcccagauaauggaggugaccgcgaaguggcucuggggcuuccugucgaggaacaagaagccgcggaucugcaccagagaggaguucaccagaaagguacgcagcaacgcggcgaucggcgcggucuuuguggacgaaaaucaauggaauuccgcuaaggaggcgguggaggacgaacgguucugggaccugguccaccgcgagcgugaacuccacaagcaggggaaaugcgccacguguguguacaacaugaugggcaagcgcgagaagaaacuuggugaguucggcaaggcgaagggaagccgggccaucugguacauguggcugggcgcgagauuccucgaauucgaagcgcugggcuucaugaacgaggaccacugguuuucccgggagaacucccucucgggugucgagggugaggggcuccauaagcuaggauauauuuugcgcgacaucuccaagauaccagggggaaacauguacgccgacgacaccgcgggcugggauacccggaucaccgaagacgaccuacaaaaugaggccaaaauuacggacaucauggaacccgagcaugcccuguuagccaaguccauauuuaaacugaccuaucaaaacaaaguuguaagaguucagcggccugcaaagaaugguacagucauggacgugaucagcaggcgcgaucagcggggcucuggccaggugggcaccuacggguuaaacacguucacuaacauggaggcccagcucaucaggcagauggaaagcgaggggauuuucuccccgucggaacucgagacccccaaccuggccggccggguccuggauuggcuagagaagcacgggguugagcgccugaagcggauggcuaucuccggcgacgauugcguggucaagcccaucgaugaccgcuucgcgaccgccuugacggcccuaaacgacauggggaaaguucggaaagacaucccgcagugggaacccaguaaaggcuggaacgacuggcagcaagucccauucugcagccaccacuuccaccagcugaucaugaaggacggccgcgagauagucgugccgugccggaaccaggacgaacucgucgggcgcgcgcgggucucccagggcgcaggguggucccuccgcgagaccgcgugccugggcaaaaguuacgcccagauguggcaacugauguacuuccaucgccgcgaccuccgguuagcagccaacgccaucuguagcgccgugccgguggacuggguccccacuucucggacgacauggagcauccaugcccaucaccaguggaugaccaccgaggacaugcugaguguuuggaaccggguuuggaucgaagaaaaccccuggauggaggauaaaacucacaucagcuccuggggagacguccccuacuuaggcaagcgcgaggaccaguggugcggcagccugaucggacugacugcccgggccaccugggccaccaacauucagguugcuaucaaccaggugcgacgccucaucggcaacgagaacuaccuggacuacaugaccuccaugaaaagauucaagaacgagagcgauccagagggggcgcugugguaa

SEQ ID NO: 24239 - RNA, 9879 nt, Artificial Sequence
  derived and/or modified CDS sequence (opt11) from DENV-1__FJ410276__SS-prME
agcgucacuauguuccucaugcuaaugcccaccgcgcuggccuuccaucugacgacccggggcggggagccucacaugaucgugucaaagcaggagcggggcaagucauuacuguucaaaaccucagcuggggugaacaugugcacgcuuaucgcuauggaccucggcgagcugugcgaggauacgaugaccuauaaaugcccccgcauuacagagaccgaaccagacgacguggauugcuggugcaacgccacugacaccugggucaccuacggaaccuguagccagacgggcgaacaccguagggauaagagauccgucgccuuagcgccucaugugggauugggguuggaaacccgcaccgagaccuggaugucauccgaaggcgcguggaagcagauccagaggguggagaccugggcccugaggcaucccggcuucaccgucauugcccuauuccuggcccacgcgaucggcaccaguauuacacaaaaggggaucauauucauacugcucaugcuggugacgccgucaauggccaugcguugcgucggaaucggcagccgugauuucgucgagggguuauccggcgccaccugggucgaugucguccucgagcacgggaguugcgugaccaccauggccaaagacaagcccacguuggacaucgagcuguugaaaaccgaaguaacuaacccagccgugcuccgcaaacugugcaucgaggccaagaucuccaacacgacaaccgacagccgcugcccgacccagggcgaagccaccuugguggaggagcaggacgccaacuucgucugcaggcgcacguucguugaccgaggauggggcaacggcugcggacuguuuggcaaggggucccugaucaccugcgccaaguucaagugcgugacuaagcucgaggggaagaucguccaguacgagaaccugaaguacagcgugauagugaccguucacacgggcgaccagcaccaagugggcaaugaguccacggagcacggcaccaccgcgaccauaacgccgcaggcgccaacgacugaaauccagcugacggacuacggugcccugacucuggacugcagcccucguacaggacuggacuucaacgagauggugcucuuaaccaugaaggaaaaaucguggcuugugcacaaacagugguuccuugaccugccgcugcccuggacaagcggugccucuacaucccaggagaccuggaaccgccaggaccuccuggugaccuucaagaccgcccacgccaagaagcaagaggucgugguucuggguagccaagagggcgcgaugcacacggccuuaaccggcgccacagagauccagaccucgggcacuaccaccauauuugccgggcaccugaagugccgccugaagauggacaagcuaaccuugaagggcaugagcuacgucaugugcaccgguucauucaaguuggagaaggaacucgccgagacccaacauggcaccgugcuagugcaaaucaaauaugagggcacagacgccccgugcaagaucccuuucuugacccaggacgagaagggggugacccaaaacgguaggcuuauuacugccaaccccaucgucaccgacaaggagaagcccgucaacauagaggccgagccucccuucggggagagcuacauagugaucggcgccggcgagaaagccuugaaauuaucuugguucaagaaggggagcagcauagggaagauguucgaggccacggcucgaggggcccggcgcauggccauucugggcgacacagcgugggacuuuggaucuaucgggggcguguucaccucuguggggaagcucguccaucagaucuuuggcaccgcuuacgggguacuguuuaguggaguguccuggacgaugaagauugggaucggcguccugcucacguggcugggccugaauagccgcuccaccucccucuccaugaccuguaucgcaguuggccuagugacguuguacuuaggcgucauggugcaggccgauagcggaugcguaauuaacuggaaaggucgggagcugaaaugcggguccggcauuuuugucaccaacgaggugcacaccuggacugagcaguacaaguuccaggccgacagccccaagcgccuauccgcggcuaucggcaaggccugggaggaggggguaugcgggauccggagugcgacgcgacuagagaacaucauguggaaacaaauaucgaacgagcugaaccauauauugcucgagaacgacaugaaguuuacugucguggugggugacgucgccggcauacuggcgcaagguaaaaaaaugaucaggccucaaccuauggaguacaaguacucguggaagagcuggggcaaagccaaaauuaucggcgccgauguacaaaauaccacuuucauuauugacggucccaacacucccgaaugccccgacgaccagagggccuggaacauaugggaaguggaagauuacggcuucgggaucuucacaacgaacaucugguuaaagcuccgggacucauacacccaggugugcgaccaccgccugaugagcgcagccaucaaggauuccaaggcagugcacgccgacaugggcuacuggauugagagugagaagaacgagaccuggaaguuggcccgggcgucguuuauagaagucaagacgugcauauggccuaaaagccacacuuuauggucuaacgguguccucgagagcgagaugaucauccccaagaucuacggcggaccgaucucccagcauaacuacagaccgggauacuucacccagaccgcgggcccauggcaucuugggaagcuggaguuagacuucgaucugugugagggaacgaccguggucgucgacgagcacugcgggaaccguggaccaucauugcgcaccacaacagugacggggaagauaauccacgaguggugcugccggucguguacauuaccgccccugcgcuuccgcggggaggacggcugcugguacgggauggaaauacggcccgugaaggagaaggaggaaaaccucguuaaaagcaugguauccgcgggaagcggcgaggucgauucauucucccuggggcugcucugcaucagcaucaugaucgaggaagucaugcgcucccgcuggucucggaagauguuaaugaccggaacgcuagcugucuucuuccuucucauuauggggcagcugaccuggaacgaucuaaucaggcugugcaucauggugggugccaacgccuccgaccgcaugggcaugggcacuaccuaucuggcucucauggcaacuuucaaaaugcggccgauguucgccguuggccugcuguucagacgguuaacaagucgggaaguacugcuucucaccauaggacugucccugguggcgagugucgaguuaccgaacucccuagaggagcugggcgacgggcucgcaaugggcaucaugauacugaagcuacuaacugacuuccagagccaucaauuaugggcaacgcuacucucucugacguuuaucaagaccaccuucucauugcauuacgccuggaagaccauggccauggugcucuccauagucagccuuuucccgcucugcuuauccaccaccagccagaagaccacguggcuacccguuuugcucgggucccuggggugcaagccacugaccauguuccucaucgcugagaacaaaaucugggggcgacgcagcuggccccugaacgaggggaucauggccgugggcauagucuccauccuacuaagcagccugcugaagaacgauguaccccucgccggaccccugaucgccggcggcaugcugauagccuguuaugugauuagugggucauccgcagaccuaucucuggaaaaggccgcagagguguccugggaggaagaggccgagcauagcggcgcaucccacaacauccuggucgagguacaggacgacgggaccaugaagauuaaggacgaggagagggacgacacccucaccauccuguugaaggccacucuccuggccgucagcgggguguacccgcuguccauuccagccacucucuucgugugguacuucuggcaaaagaaaaagcagcgcagcgggguccucugggacacaccaagcccacccgagguugagcgugccgugcuggacgacggcaucuaccgcaucaugcagcggggccugcuuggcaggagccagguuggugucgguguauuccaggaaaacguauuccacaccauguggcacgugacgcggggcgccgugcugauguaccaggggaagcggcuggaacccuccugggcgagcgucaaaaaggaucucaucuccuaugguggcggcuggcggcugcagggcucuuggaacaccggggaggaaguucaggucaucgccgucgagcccggcaagaacccgaagaacguacaaaccgcgccagguacguuuaagacgccggagggcgaggugggcgccauagcccuggauuucaagccgggaacguccggcucgcccauugucaaccgcgagggcaagaucguugggcuauacggcaacggggugguaacaaccuccggcacguaugugagcgccauugcccaggcucgagccagccaggaggggccauuaccggaaaucgaggacgagguguucaggaaacguaaccugacaaucauggaccuucaucccggcucuggcaagacgcgccgguaccucccggccauaguccgcgaggcgaucaaacgcaagcuccggacccucaucuuggccccgacgcgcguaguggccagcgagauggccgaggcgcuaaaagguaugcccauucgguaccaaaccacggcggucaagucagagcacaccggcaaggagauuguagaccucaugugccaugccacauucaccaugcgccugcugagcccggugcgggucccaaauuacaauaugaucaucauggacgaggcccacuucaccgacccauccucaauugcagcgcgcggauacauauccacgcgggucggcaugggggaggccgcggccaucuucaugaccgccaccccgcccggcaguguggaggcguucccacaguccaacgccguuauacaggaugaggagagggacaucccggagcguaguuggaacagcggauacgaguggaucaccgacuucccaggcaagacagugugguuugugcccucgauuaaguccggcaaugauaucgcgaacugccuccgcaagaacggcaaaagagucauccagcugagccgaaaaacguucgauaccgaguaccagaaaaccaagaacaacgacugggacuacguugugacaacagacaucuccgagaugggcgcaaacuuccgggccgaucgagucaucgacccgcggcgcugccugaagcccguaauccucaaggacgggcccgagagaguuauccuggccggccccaugccggucacuguggcauccgccgcacaacgacgggggcgcaucgggcgcaaccacaacaaggaaggcgaccaguauaucuauauggggcaaccccugaacaacgacgaagaccaugcgcacuggacugaggccaaaaugcuccuggacaauaucaacaccccugagggcaucauccccgcccuguucgagccugagcgggagaaguccgccgccaucgacggggaguaccgacuccggggugaggcccgcaagacauuugucgaguugaugcggcgaggugaucugccaguauggcucagcuacaaaguggccuccgagggcuuucaguacucagaccggcgguggugcuucgacggcgagcggaauaaccaggugcuggaggagaacauggacguugagauuuggaccaaggagggggagcgcaagaaguugcggccucgcuggcucgacgcccggacuuacagcgacccacuggcccugcgagaguucaaggaguuugccgcgggccggagguccguguccggggaucucauccuggagauagguaagcuaccccagcaccugacccagcgugcccaaaacgcccuugacaaccugguuaugcuacauaacagcgagcaggguggucgcgccuaccggcacgcgauggaagaacugccggacacgauugaaacgcugaugcucuuagcgcuuauagccgugcucaccggggggguuacacuguuuuuccugagcggucgcggucugggcaaaaccuccauagggcuguuaugcgucauggccagcucggucuugcuuuggauggccagcguugagccucacuggaucgcggccuccaucauccuggaguucuuccuuaugguccugcuuauccccgagccggaccggcagcgcacgccgcaggacaaccagcucgcauacguagugaucggguuauuauuuaugauucucacugucgccgcgaacgagaugggccugcuggagacaaccaaaaaggaccucggcauaggucacguggcgguggagaaccaccaccacgccgccaugcuagacguagaccugcacccggcaucagccuggacgcuauacgcaguagccaccaccaucaucacgccgaugaugcgccacacgauagagaauacgacggccaauauuucccugaccgccaucgcaaaccaggcggcgauuuuaauggggcucgacaaaggcuggcccaucagcaaaauggauaucggagugccauugcuggcccucgggugcuacucacagguuaaccccuugacgcugacggccgcggugcuuaugcuuguugcccacuaugcaaucaucggcccggggcugcaagccaaggccacacgggaggcgcagaaacguaccgcagcuggcaucaugaaaaaucccacggucgacgggaucguggccauugaccuggaccccgugguauacgacgccaaauucgaaaagcagcuggggcagauaaugcugcucauccugugcaccagccagauccugcucaugagaaccaccugggcacugugcgaauccaucacgcuggcaaccggcccccucacgaccuugugggaagggucaccagguaaguucuggaauacgacuaucgccguguccauggccaacaucuuuagagguagcuaccuggccggcgccggccucgcauucucccuaaugaaaucccucgggggcgggcggcggggaacaggggcgcagggggagacccucggggaaaaguggaagcggcagcugaaccagcuaagcaaguccgaauucaacacguauaagcgcagcgggauuauggaggucgacaggagcgaggcaaaggagggacucaagcgaggggagacgacgaagcacgcagucagccggggcaccgccaagcuccgcugguucguggagcggaacuuagugaagcccgaggggaagguuaucgauuuaggcuguggccgagggggcuggagcuacuacugugccgggcugaaaaaagugacggaggugaaagguuacacgaagggcgggccugggcaugaagaacccauccccauggccaccuacggguggaaucuggugaagcugcacucaggcaaggauguguucuucauuccacccgagaagugugacacccuccugugcgacaucggugaauccagccccaauccgacgauagaggaaggcagaacccugcgagugcuuaaaauggucgagcccuggcuacgggggaaccaguucugcaucaagauccugaaccccuacaugcccuccgugguggagacccucgaacagaugcaacgcaaacacggcgggaugcuuguccggaacccucucagucgcaacuccacccacgagauguacuggguuagcugcgggacuggcaauaucguguccgcggucaacaugacaagccgcaugcuacugaacagguucaccauggcccaccgcaaaccuacauacgagcgugacguggacuugggugccggaacccgccacguggccguagagccagagguggccaaccucgacaucaucggucagcggaucgaaaauaucaaacaugagcacaagucaacguggcacuacgacgaggauaaucccuacaaaaccugggccuaccacgguucguacgaggugaagcccuccgggagcgcguccagcauggucaacggggugguuaagcuccugacuaagcccugggacgugauccccauggugacacaaaucgccaugacggacaccacgcccuucgggcaacagcgcguuuucaaggagaaaguggacacacggacgccgaaggccaagagagggacggcgcaaaucauggaaguaaccgccaagugguuguggggauuccugagccggaacaagaagccacgcauuuguacccgggaagaguuuacucgcaaaguccgauccaacgcggccauaggcgcgguauucgucgacgagaaccaguggaacagcgccaaggaggcagucgaggacgagcgcuucugggaccuggugcaucgagagcgagagcuacacaagcagggcaagugcgcgaccugcguguacaacaugaugggaaagcgggagaaaaaacugggggaguucgguaaggccaaggggucgcgcgccaucugguauaugugguugggcgcccgguuucucgaauucgaggcgcugggcuucaugaacgaggaccacugguucucucgcgagaacucccuaucugggguugagggcgaggggcuccacaaacugggauacauacugcgggacaucuccaagauacccgggggcaacauguacgccgacgacacugccggaugggacacccgcauuacggaggacgaccuccagaacgaggcccgcauaacagauaucauggaaccggagcacgcacuacucgcgaagagcaucuucaagcucaccuaccagaacaaaguggugcgggugcagcgccccgccaagaacggcaccguuauggaugugaucagccggcgcgaucaaaggggcagcgggcaagucgggacguacggguuaaacaccuuuacaaacauggaagcucaauuaauccgucagauggaguccgaggguaucuuuagccccuccgagcuagagacgcccaaucuggcugagcgcguacuggacuggcucgagaaguacggcguggagcgacugaagcggauggcaauaagcggcgaugacugcgucguuaagccgaucgacgaccgguuugcgacggcccuaaccgcucucaacgacauggggaagguacggaaagauauaccccaaugggagccauccaaggguuggaaugacuggcagcaggucccauucugcucccaccacuuccaccaguugaucaugaaagacggacgggaaaucguggucccaugccggaaccaagacgagcugguaggccgcgcccgggucucgcagggggccggcuggucgcuuagagaaaccgcuugucugggcaagagcuacgcccagauguggcagcuaauguacuuccaccggcgugaccugcguuuggccgcaaaugcgauauguucugccgucccagucgauuggauaccuaccagcagaacaaccuggaguauccaugcgcaucaucaguggaugaccacagaggauaugcugagcgucuggaaccgcguuuggaucgaggaaaaccccuggauggaggacaagacgcacauuuccagcuggggcgaugucccguaccucgggaagcgggaggaccaguggugcggcagccugaucggccugaccgccagggccacuugggcgaccaauauacaaguggccauuaaccaggugcgacgccucaucgguaaugagaacuaccuggacuacaugaccagcaugaagagguucaagaacgagagcgauccugagggggcccugugguga

SEQ ID NO: 24240 - RNA, 9879 nt, Artificial Sequence
  derived and/or modified CDS sequence (opt11) from DENV-1__FJ410278__SS-prME
agcgugaccaugcugcucaugcugaugcccaccgccuuagccuuccaucucaccacccguggcggcgagccccacaugaucgugagcaagcaagagcgggggaagagccugcuguuuaaaacuuccgccggcgucaacaugugcacccucaucgccauggaccuuggcgagcugugcgaggauaccaugaccuacaagugcccccggaucacugagacggagcccgaugacguggacugcuggugcaacgccacggacaccugggucacguacggaacuugcagccagacgggcgagcaccggcgagacaagagauccguggcacuugccccccacgugggccucgggcuggagacccgcacagagaccuggauguccuccgagggcgcguggaagcagauccagcgggucgagacgugggccuugaggcaccccggguucacuguaaucgcccuguuccuggcucacgccaucggcaccagcaucacccagaaggggauaaucuucauccuccugaugcuggugacgcccuccauggccaugcggugcgucggaaucggcagccgcgacuucguggaagggcucuccggcgccaccuggguggacgucgugcuagaacacgggagcugcgucaccaccauggccaaagacaagcccacgcuggacaucgaguuacugaagaccgaggucaccaaucccgcgguacugagaaagcucugcaucgaggcgaaaaucucaaacaccacgaccgacagccgcugcccuacccagggcgaggccacccuaguggaggagcaggacgccaacuuuguuugccggcguaccuucguggaccgaggcugggggaacggcugcggacuguucggaaaggggagccucaucacgugcgccaaguucaaaugcgugaccaagcuggagggcaagaucguccaguaugaaaaccugaaguacagcgugaucguuaccguccacacgggagaccagcaccaaguggggaacgaguccaccgagcacggcaccaccgccaccaucacuccucaagcgcccacuaccgagauccagcucaccgacuacggggcccugacgcuugacugcagcccccgcaccggucucgacuucaacgaaaugguccugcugaccaugaaggagaagucguggcucgugcacaagcagugguuccuggaccuuccccuucccuggaccagcggggccagcacgucccaggagaccuggaaccggcaggaccugcuagugaccuucaagaccgcccacgcaaagaagcaggaggucguggugcuuggcagccaggagggcgcgaugcacacggcccugaccggggcaaccgagauccaaaccucgggcacgacuaccaucuucgccggucaccugaagugccgccucaagauggacaaacugacucugaagggcaugagcuacgucaugugcacuggauccuucaagcucgagaaggagguggccgagacccagcacggcaccgugcugguccagaucaaauaugagggcaccgacgcgccgugcaagauccccuucucuacgcaggaugagaagggggugacgcagaacggccggcugaucaccgccaaccccaucguuaccgacaaggagaagcccguuaacauugaggccgagccgccguucggagagucauacaucgugauuggcgcuggcgagaaagcgcugaagcucagcugguucaagaaggggagcagcaucggcaagauguuugaggccacggcccggggggcccggcgcauggccauacugggcgacaccgcgugggacuucggguccaucggaggcguguucaccagcgucgguaagcugguucaccagaucuucggcaccgcuuacgguguccuuuucagcggcgucucuuggacgaugaagaucgggaucggcgugcugcugacguggcucggccugaacucccgcagcaccucgcugagcaugaccugcaucgcugugggccucaucacccuguaccuaggagucauggugcaagccgacucggggugcgugauuaacuggaagggccgggagcucaaaugcgggagcggcauuuucgucacuaacgaggugcacaccuggaccgaacaguacaaguuccaagccgacagcccgaagaggcugagcgcggccaucggcaaggccugggaggaagggguuugcggcauacggagcgccacccgccuggagaacaucauguggaaacaaaucuccaacgagcucaaccacauccuacuggaaaacgacaugaaguucacggucguggugggggacgucgcuggcauccucgcgcaagggaaaaagaugauccggccccagcccauggaguacaaguacagcuggaaauccuggggcaaagccaaaaucaucggcgccgacgugcagaacaccaccuucauaaucgacgggcccaacaccccggagugccccgacgaccagagggccuggaacaucugggaaguggaggacuacgguuucgggauuuuuacgaccaacaucuggcugaaguuacgggacagcuacacccaggucugcgaccaccgccucauguccgcggccaucaaggacagcaaggccgugcacgccgacaugggcuacuggaucgaguccgagaagaacgagaccuggaagcuggcccgugcaagcuuuaucgaggugaagacgugcaucuggcccaagucccacacccuguggagcaacggcguccucgaguccgagaugaucaucccuaagauauacgggggcccgaucagccagcacaacuaccgcccaggguacuuuacgcaggcggcgggccccuggcaccuggggaagcuggagcucgacuucgauuugugcgagggcaccaccgugguggucgacgagcacugcggcaaccggggaccgucccuucgcaccacaaccgugacgggcaagaucauucacgaguggugcugccggagcugcacccugccgccccuccgcuuucgcggggaggacggcugcugguacgggauggagauccgccccgugaaggagaaggaggagaaccuggucaaguccauggugucggccggcagcggcgagguggauucguucucgcucgggcugcugugcaucuccaucaugaucgaggaggucaugcggagccgguggucccggcgcaugcucaugaccggcacccuggccguguucuuccugcucauaauggggcaguugacguggaacgaccugauccgccucugcauaauggugggcgcgaaugcguccgaccggauggggaugggaaccaccuaccuggcccugauggccacauucaagaugcgcccgauguucgccgucggccuccuguuuaggcgccuuacuucccgcgaggugcuccugcugacgaucgggcucagcuugguggcuuccgucgagcugccaaacucacucgaggagcugggcgaugggcuggccaugggcaucaugauccucaagcugcuaaccgacuuccagucccaccagcucugggccacccuguugagccucacguucaucaagaccaccuucucccuccacuacgccuggaagaccauggccauggugcuuagcaucgucucccucuucccccuaugucugagcacgacuucccaaaagaccaccuggcucccgguguuacugggcagccucggguguaagccucugacgauguuccugauugccgagaacaaaaucuggggccgcagauccuggccccucaacgagggcaucauggccgugggcauagucagcauccugcugagcucccuccugaagaacgacgugccccuggccggaccccucaucgccggcggcaugcugaucgcgugcuaugugaucagcgguucuagcgccgaccugucccucgaaaaggccgccgagguuagcugggaggaggaggccgagcauuccggcgcgagccacaacauccugguggaggugcaggacgacgggaccaugaagaucaaggacgaggaacgcgacgacacccugaccauccuccuaaaggcaacccugcuugccgucucgggcguguacccgcugagcaucccggccacgcuguucgugugguacuucuggcaacgcaagaaacagcgcuccgggguccucugggacacccccagcccgccagaaguggaacgggcagugcuggacgacggcaucuaucggaucaugcagcggggcuugcugggacgcucccagguaggcguggggguguuucaggagaauguguuccacaccauguggcacguuacucggggagcggugcucauguaccaggggaagcgccuggagcccagcugggccuccgucaagaaggaccucauaagcuacggcggcggguggcggcuccagggcuccuggaacacgggggaggagguccaggugaucgcagucgagcccggcaagaaccccaagaacgugcagaccgcccccgggaccuucaagaccccggaaggcgaggucggagccaucgcgcuggacuucaagcccggaaccagcggcucucccauagucaaccgcgagggaaagaucgugggccuguacggcaacggcguggucaccaccucaggcacauacgucagcgccaucgcccaggccaaggcgucccaggaggguccccuccccgagaucgaagacgagguguuucggaagcgcaaucugacaaucauggaccugcaccccggcucagggaagacccggagauaccucccggccaucguccgcgaagccauuaagcggaagcugcgcacccugauccuugcccccacccgggugguggcguccgagauggcggaggcccugaagggcaugcccauccgcuaccagacgaccgccgucaagagcgagcacaccggcaaggagaucguggaccugaugugccacgccacuuucacgaugcggcuccugucccccguccgcguccccaacuacaacaugaucaucauggacgaggcccacuucaccgaccccaguuccauugccgcgcggggguacauaucuacccgcgugggcaugggggaggccgccgccaucuucaugaccgccacuccgcccggcuccguggaggccuucccgcagucaaacgccgucauccaggacgaagagcgcgacauccccgagcgauccuggaacagcggguacgaguggaucaccgauuuccccgggaaaaccgugugguuuguacccuccauuaagagcggcaacgacaucgccaauugccugcgcaagaaugguaagcgcgucauccagcucucccggaagaccuucgacaccgaguaucagaagaccaagaacaacgacugggauuacguggugaccaccgacauuagcgagaugggagcuaacuuccgugcagaccgggucaucgacccgcgccggugccugaagcccguuauccugaaagaugggcccgagcgugugauucuagcugggcccaugccgguaacgguggccuccgccgcgcaacggcgcgggcgcaucggccggaaccacaauaaggagggcgaucaauauaucuacauggggcagcccuugaacaacgacgaggaccacgcccacuggaccgaggccaagaugcugcucgacaacaucaacacccccgagggcaucauccccgcccuguucgagccggagcgcgaaaaguccgccgcgaucgacggggaguaccggcugcgcggcgaggcccggaagaccuucgucgagcucaugcgucgcggggaccugcccguauggcucucuuacaagguggccucggagggcuuucaguacagcgaccgccgguggugcuucgacggggagcgaaacaaccaaguacucgaggagaacauggauguggaaaucuggacgaaggagggggaacggaaaaaguugcgccccagauggcuggacgcccgcaccuacuccgauccccucgcccuaagggaauucaaggaguucgcggccggacgccggagcguguccggggaccugauccucgagaucggcaagcuaccacagcaccugacccaacgugcccagaacgcccucgacaaccuggucaugcugcacaacagcgagcaaggcggucgggcguaccgccacgccauggaggagcuccccgacacgaucgagacgcugaugcuacucgcccugaucgccguguuaaccggcggugugacccucuucuuccucuccggccggggccugggcaagaccagcaucgggcuccugugcguuauggccaguagcguguuauuauggauggcgucgguggagccccacuggaucgccgccagcaucauccuggaguucuucuuaaugguccuccugauccccgagccugacaggcagcgcacgccccaggauaaccaguuggccuacguggugaucgggcuccuguucaugauccugacggucgccgcuaacgagaugggccuccuggagaccaccaagaaagaccugggcaucggccacguggccguggaaaaccaucaccacgccgccaugcucgacgucgacuugcaccccgccagugcguggacccuguaugccgucgcaacgaccaucaucaccccgaugaugcgacauaccauugagaauaccaccgccaacaucagccucaccgccaucgcgaaccaggcagccauccuaauggggcuggacaaggguuggcccaucuccaagauggacauaggagucccacuccuggcccuagggugcuacucgcaggugaacccccucacccugacggccgccgugcugaugcucguugcucacuacgcaaucaucggaccgggacugcaggccaaggcgacccgcgaggcccagaagcgaaccgcugccggcaucaugaagaaucccaccgucgacgggaucguggccauagaccuggaccccguggucuacgacgcgaaguuugagaagcagcucggccagaucaugcugcucauccucugcacaucccagauccugcuaaugcgcaccacuugggcccucugcgaaagcaucacccuggcuacuggcccccugaccacccucugggagggguccccgggcaaguucuggaauaccacaaucgccgucagcauggcaaacaucuuccggggauccuaucuggcgggugcgggccuggcauucagccuaaugaagucccucggcggcgggcgccgggggaccggggcccagggcgaaacucugggcgagaaguggaagcgccagcucaaccagcuauccaagagcgaguucaacaccuauaagcggucugggaucauggaaguggaccgcagcgaagcgaaggagggccugaagcgcggggagacgaccaagcacgcaguaucccgcggcaccgccaagcuccggugguucguggagcgaaaccugguaaagcccgaggggaaaguuauagaccugggcugcggccgcgggggcuggagcuacuacugugccggucugaaaaaggugaccgaggugaagggcuacacgaagggcggccccggccacgaggagcccauuccgauggccacuuacggguggaaccucgucaagcugcacagcggcaaggacguauucuucaucccgcccgaaaagugugacacccugcucugugacaucggggagagcagucccaacccgaccaucgaggagggccgcacgcugcggguucugaagauggucgagcccuggcuccgcgggaaucaguucugcaucaagauccugaaccccuacaugcccagcgugguggagacccuggagcagaugcagcggaaacacggcggcaugcucguccguaacccgcugucacgcaacucuacccaugagauguacugggugucaugcgggacgggcaacaucgugagcgcggugaacaugaccucccggaugcugcucaaccgcuucaccauggcccaccggaagcccaccuacgagcgcgacguggaucucggggcaggcacgcggcacguggccguagagcccgagguggccaaccuggacauuauuggccagcggaucgagaacaucaagcaugagcacaagagcaccuggcacuacgacgaagacaaccccuacaagacaugggcguaccacggguccuacgaggugaagccgagcggcucugccucgagcauggucaacgggguagucaagcuccugaccaagcccugggacgugauacccauggugacccagaucgccaugaccgacacgacccccuucggccagcagcggguguucaaggagaagguggacacccgcaccccgaaggccaagcgggggaccgcccagaucauggaggugaccgcgaaguggcuguggggcuuccuguccaggaacaagaagccccggaucuguacccgcgaggaguucacccggaagguccgcucuaacgccgccaucggcgccguguucguggacgagaaccaguggaauucggcgaaggaggccguugaggacgagcgguucugggaccuggugcaccgcgagcgggagcuccauaagcagggaaagugcgcuacgugcguguacaacaugaugggcaagcgcgagaagaagcucggggaguucggcaaggcaaaggggagccgcgccaucugguacauguggcugggugcccguuucuuagaguucgaggcccucggcuucaugaacgaggaccacugguuuucccgggagaauucgcucaguggcgucgaaggcgaggggcugcacaagcucggauacaucuugcgcgacaucagcaagauacccgggggcaacauguacgcugacgacaccgccggcugggauacccgcaucaccgaggacgaccugcagaacgaggcccggauuacggacaucauggagccggagcacgcgcuuuuggccaaguccaucuuuaagcugaccuaccagaacaaggucgugagaguccagcggcccgccaagaacgggaccgugauggaugugaucagcaggagggaccagcgcggcagcgggcaggucggcaccuacggccucaacacguucaccaacauggaggcccagcugauccggcagauggagucugaggggaucuucucccccagcgagcuggagacccccaaccucgccgagcgcgugcuggacuggcuggagaaguacgguguggagcggcucaagcgcauggcgaucucuggggacgacugcgucgugaagccgaucgacgaccgguuugccacggcacugacggcccugaacgacaugggcaagguucggaaggacaucccccaaugggagcccucgaagggguggaacgacuggcagcagguccccuucugcucccaccauuuccaccagcucaucaugaaggacggccgggagauaguggugccgugccgcaaccaagacgagcuggugggccgcgcccgcgugagccagggggcgggcuggagcuuacgggagaccgccugccuugggaaguccuaugcucagauguggcagcugauguacuuccaucgccgggaccugcgcuuagccgcuaacgccaucuguucggcugugccugucgauuggaucccgacaucccgcaccacgugguccauccacgcccaccaccaguggaugaccaccgaggacaugcuguccguguggaaccggguguggauugaggagaaucccuggauggaggacaagacccacaucagcucguggggcgacgugccguaccuggggaagcgcgaggaccagugguguggcagccuuauuggccugacggcccgggcuaccugggccacuaacauccagguggcaaucaaccaggugcgccgccugaucgggaacgagaacuaccucgacuacaugaccuccaugaagcgcuucaagaacgagagcgaccccgagggcgcccugugguga

SEQ ID NO: 24241 - RNA, 9879 nt, Artificial Sequence
  derived and/or modified CDS sequence (opt11) from DENV-1__FJ410279__SS-prME
agcgugaccauguuacucaugcugaugccgaccgcucuggccuuucaccucaccaccagaggcggggagccccacaugaucgugagcaagcaagagcggggcaagagccugcuguucaagacuagcgcuggggugaacauguguacauuaaucgccauggaccugggggaguuuugcgaggacacgaugaccuacaaaugcccccggaucaccgaggccgagcccgacgauguggacugcuggugcaacgccacagacacgugggugacauacgggaccuguucccagaccggcgagcaccggagggauaagcgauccguugcucuagcgccccacgucggccucggacuggaaacgaggacggagacuuggaugucuucggagggcgccuggaagcagauucagcggguggagacaugggccuugcgccaccccggguucacagugaucgcccucuuucucgcgcacgccauaggcaccagcaucacccagaaggggauaaucuucauucugcugaugcuggugacccccuccauggccaugagaugcguaggcaucggcucacgcgacuucguggaggggcuguccggcgcuacguggguggaugucgugcucgagcacgggagcugugugaccaccauggcgaaggacaagccgaccuuggacaucgaacugcuuaaaacggaggucaccaacccagcuguacugcgaaagcugugcauagaggccaagauauccaacacgacgacggauagccgcugcccgacacagggcgaagcgacccucgucgaggagcaggaugccaacuucgucugccggcguacauucguggaccgggguugggggaacggaugcgggcuguucggcaagggguccuugaucacgugcgcaaaguuuaagugcgugaccaagcucgagggcaaaaucguccaguaugagaaccugaaauauagcgugaucguuacaguccacacuggagaccagcaucagguggggaacgaaucuacugagcacggcaccacugcgacuaucacuccacaggcccccagcacggagauccagcugaccgacuacggggcccucacccuagacugcagcccccguaccggccuggauuuuaacgagaugguccuccucacaaugaaggaaaagucauggcuggugcauaagcagugguuccucgaccugccgcugcccuggaccucuggggccuccaccagccaggagaccuggaaccggcaggaccuccuagugacguuuaaaaccgcccaugcgaagaagcaggaggucgucgugcuggguucccaggagggcgccaugcacaccgcccuuacaggggccacggagauacagaccucuggcacgacuacgaucuucgccgggcaccuaaagugcaggcugaagauggacaagcucacccugaaaggcauguccuacguaaugugcaccgggagcuucaaacuugagaaggagguggcggagacccagcacggcacgguccucguccaaaucaaguacgaaggcaccgacgcgcccugcaagauucccuucuccacucaggacgaaaagggggugacacagaacggccgccugauaaccgccaacccuauuguuaccgacaaggagaagcccgucaacaucgaggcggagccgcccuucggggagagcuacaucgugaucggcgcgggcgaaaaggcccugaagcuguccugguucaagaaggggagcuccaucgguaaaauguucgaggccaccgcccgcggcgcccgucgcauggccaucuuaggcgacaccgcaugggacuucggguccauugguggcguguucacuuccguggggaagcugguacaccaaauauucggcaccgccuacgggguguuauucagcggcgucuccuggaccaugaagaucgguaucggcgugcuccugacguggcugggccucaauagccgcuccacgagccuuucaaugacauguaucgcugugggguuagucacccucuaccucggcgugauggugcaggccgacagcggcugcgucaucaacuggaagggaagggagcugaagugcgggucgggcaucuucgugaccaacgaggugcacacguggaccgagcaguacaaguuccaggccgauaguccgaagcgccuuagcgccgccaucggaaaggccugggaggaaggggucugcgggauccgguccgcgacccgccuagagaacauuauguggaagcaaauuagcaacgagcugaaccacauccuccuugagaacgacaugaaguuuaccgugguggucggggauguggcaggcauccuggcucaggggaagaagaugauaagaccccagccgauggaauacaaguauaguuggaaguccuggggcaaggccaagaucaucggggccgauguacagaauaccacguucaucaucgacgggcccaacaccccagagugucccgacgaccagcgggcguggaacaucugggaagucgaggauuacggcuucggcaucuucaccaccaacaucuggcucaaacugcgggacucauacacacaggugugcgaccaccgcuugaugagugccgccaucaaggacuccaaggccgugcaugcugacaugggcuauuggaucgagucagaaaagaacgagaccuggaaacuugcuagagcuagcuucauagaagucaaaaccuguaucuggcccaaaagccacacgcugugguccaauggcgugcucgagagcgagaugaucauucccaagaucuacgggggcccgaucucccagcacaauuaccgccccggguauuuuacccagaccgcuggccccuggcacuuagggaagcuggagcucgacuucgaccucugcgagggcaccaccguugucguugacgagcacugcggcaaccgggggcccucucuacggacgaccaccguuacgggcaagaucauucaugaguggugcugccgguccugcacgcugccgccccugcguuucaagggagaggauggcugcugguacgguauggagauucggcccgucaaggagaaggaggagaaccuggucaagagcaugguuagcgcgggcucaggugaggucgacagcuucucccuggggcucuuguguauaagcaucaugaucgaggaggugaugcgaucuagauggagccgcaaaaugcugaugaccggcacccucgccguuuucuuucugcugauuauggggcagcuuaccuggaacgaccuaauccggcugugcaucaugguuggggcgaacgcaucggaccgcauggggaugggcacgacguaccucgcacugauggcuaccuucaaaaugcgcccgauguucgccgugggacuucuguuucggcguuuaaccucccgugaagugcugcucuugacgaucggucugucccucgucgcgagcgucgaguugccgaacucccuugaggaacucggcgaugggcuggccaugggcaucaugauccugaagcuguugaccgacuuccaaagccaccagcugugggccacccugcugucccugaccuucaucaagacgaccuucucccuccauuacgcguggaagaccauggcgaugguccuauccaucguuagcuuauucccacuaugccuuucaacgacuucgcaaaagacaacuuggcugcccgugcuacugggcucccuggggugcaagccucucaccauguuucugauugccgagaacaagaucuggggcaggaaaagcuggccccugaacgagggcaucauggccgucggcaucgucaguauuuuauuguccagccugcucaaaaacgacgugccucuggccggaccccugaucgcuggcggcaugcucaucgcauguuacgucaucuccggaagcuccgcagaccuaucucuggagaaagccgccgagguuucuugggaggaggaggccgagcacagcggggcgucccacaacauccucguggagguacaggacgacgggacgaugaagaucaaggacgaagaacgggacgacacgcuaacuauccugcucaaggccacgcugcuggccguaagcggaguauacccgcucuccauccccgcgacccuguuccugugguacuucuggcagaaaaagaagcagagaagcggcguacucugggacacgcccagcccgcccgagguggaacgggccgugcuugacgauggcauauaccgcaucaugcagcggggccugcuggggcgaucccaggucggcgugggggucuuucaagagaacguguuccacaccauguggcacgugacccgaggcgcgguccucauguaccagggaaagcggcuggagcccuccugggccagcgucaagaaggaccugauauccuacggcggaggguggcgacuccagggcagcuggaacacaggcgaggagguccaggugauagcugucgagcccgggaaaaaucccaagaauguccagacggcccccgggaccuucaagacuuccgagggcgaggucggcgccaucgcgcuagacuucaagccagggacaagcgggucucccaucguuaaccgcgagggcaaaauaguuggccuguacggaaacggggucgucacgaccuccgggaccuaugugagcgccaucgcccaggccaaagcgucccaggaagggccucucccggagauagaggacgagguuuuccggaaacguaaccuaaccauuauggaccugcaccccggcagcgguaagacacggagguaccugcccgcaaucguccgggaggcaaucaagcgcaagcugcgcacccugauccuggcaccgaccagaguuguugcuucggagauggcggaagcccugaagggcaugccuauacgcuaccagaccacggccgucaagucugagcacaccggcaaggagaucguggaccucaugugccacgcaaccuucacaaugcggcuccucucccccguaagggugcccaacuacaacaugauaaucauggacgaggcccacuucaccgauccgagcucgauugcggcccgggguuacaucucuacccggguugguaugggggaggccgccgccaucuucaugaccgccacgccgccgggcuccguugaggcguucccgcagagcaacgccgucauucaagacgaggagcgggacaucccggaacgcucauggaacagcggguacgaguggaucacggacuuccccggcaaaaccgugugguuuguacccaguauaaaguccggcaaugauaucgccaacugcuugcggaagaacggaaagcgcguuauccagcucucccggaagaccuucgacacugaguaccagaagacgaagaacaacgauugggacuaugugguaaccaccgacauauccgagaugggcgcgaacuuucgcgccgaccgggucaucgacccccgacgcugcuugaagccggugauccuuaaggaugggccggagcgcguuauccucgccggucccaugccugucaccguggcuuccgccgcgcagcggcgcgggaggaucgggcgcaaccacaacaaagagggcgaccaguacauuuauaugggccagccucugaacaacgacgaggaccaugcccacuggacggaggccaaaaugcugcucgacaacaucaauaccccggaggggauaauccccgcacuguucgaaccagagcgggagaaaucggccgcgaucgauggugaguaccgguuacgcggcgaggcucggaagaccuuuguggagcucaugagacgcggggaucuuccgguguggcucagcuacaagguggccuccgagggcuuccaauacagcgaccgccgguggugcuucgauggcgagcgcaacaaccagguccucgaggagaacauggacguggagaucuggaccaaagagggugagcgcaagaaguuacgccccagaugguuagacgcgcggguguacuccgacccccucgcccuacgggaguucaaggaguucgccgccggccgacggagcguauccggggaccugauccuagagauaggcaagcucccccaacaccugacgcagcgcgcccaaaacgcccucgacaaccuggugauguuacacaacagcgagcaggguggacgugcguaccgacacgcuauggaggagcucccagacaccaucgagacccugaugcuauuggccuugaucgcugugcuaaccggugggguuacucucuucuuccugucgggccgggggcugggcaagacgagcaucggccuccuaugcgugauggccuccagcgugcugcuguggauggcuuccgucgaaccccacuggaucgcggcuagcaucauccuggaguucuucuugauggugcuccugauacccgagccugacagacagcggaccccacaggacaaucagcuugccuacguggugaucgggcuccuuuucaugauccugaccguggccgcgaaugagaugggucuccuggaaaccacgaagaaagacuuagggaucggccacguggccgucgagaaccaccaccaugccgccaugcuagauguggaucugcacccugccuccgcguggacgcuauacgccguagccaccaccaucaucacaccgaugaugcgccacaccauugaaaacaccaccgccaacaucagccuaaccgccaucgcgaaccaggccgccaucuuaaugggccuggacaagggcuggcccauaaguaagauggacauaggugucccccuccuggcccugggguguuacucucaggugaacccucucacacugacugcggcgguacugaugcucgucgcgcacuacgccaucaucggccccggguugcaggcgaaggccacccgggaggcccagaaacgcaccgccgccggcaucaugaaaaauccgaccguggacgggaucguugccaucgaccuggacccugugguauaugacgcgaaguucgagaagcaacugggccagaucaugcugcucauccucugcaccucgcagauccugcugaugagaaccacaugggccuuaugcgagagcaucacccuggcaacgggcccgcugaccacucucugggaggggucccccggcaaguucuggaacaccaccaucgccguuagcauggccaauaucuuccgggguagcuaccucgccggcgcuggacuggcauucucccucaugaagucccucggaggagggcgcagggggaccggggcccaaggagaaacgcucggcgagaaauggaagcgccaguuaaaccagcugucgaaguccgaguucaacacguacaagcgguccgggauuauggaggucgacaggagcgaagcgaaggagggccugaagagaggggagaccaccaagcacgcugugucacgcggcaccgcaaagcuccgcugguucguggaacgcaaccuagucaagccggaggggaaagugaucgaccugggcugcgggcgcggcggguggaguuauuacugcgccggguuaaagaaggugaccgaggucaagggguacacgaagggcgggcccggccacgaggagccaauccccauggcaaccuacggguggaaccuugugaaacugcacuccggcaaagacguguucuucaucccgcccgagaagugugacacacugcucugugacaucggggagagcucucccaaccccaccaucgaggagggucgcacccugaggguccugaagaugguggagccguggcuccgcgggaaccaauuuugcauuaagauccugaaccccuacaugcccucaguggucgagaccuuagagcagaugcagcggaagcacggcgggaugcucgugcgcaacccacugucccggaauagcacucacgaaauguacuggguguccugcggcaccggcaacaucguuagcgcggugaacaugaccucacgcaugcugcuuaaucgguuuacgauggcccaccgcaaaccaaccuacgagagagauguggaccugggggcaggaacgcggcaugucgccguggagccagagguggccaauuuagacaucaucgggcaacgcaucgagaacaucaagcacgagcauaagagcacuuggcacuacgacgaggacaacccuuacaagaccugggcguaucacggguccuaugaggucaaacccucgggcagcgccuccucaaugguuaauggggucgugaagcucuugaccaaaccgugggacgugauccccauggucacucagauagcgaugacggacaccaccccuuucggccagcaacggguguucaaggagaagguagacacgaggacccccaaggcaaagcgggggacggcccagauuauggaggucaccgccaaguggcugugggguuuccucucccgcaauaagaagccgcgaauaugcacccgcgaggaguucacacggaagguacgcagcaacgccgcaauuggcgccguuuucgucgacgagaaccaguggaacuccgcgaaggaggcaguggaggacgagcgcuucugggaccuggugcaccgcgagcgagagcuccacaagcaggggaagugcgcaaccugcgucuauaacaugaugggcaagcgcgagaagaagcuaggggaguucggcaaggccaaggggagccgggccaucugguacauguggcugggugcgcgcuuccuggaguucgaggcgcucggguucaugaacgaggaccacugguucucucgcgaaaacagccuguccggcguggagggcgaggggcuucacaagcucggcuacauccugagagacaucaguaagaucccagguggcaauauguacgccgaugacaccgccggcugggauacacggaucacugaggacgacuugcaaaacgaggccaagauuaccgacauuauggaacccgagcacgcucuccuggccaagagcauuuucaagcugaccuaccaaaacaaggugguccgcgugcagcggccggccaagaacgggaccgugauggacgucaucagccgcagggaucagcggggcuccggccaagucggcaccuacggccucaacacuuuuaccaauauggaggcgcagcucauccgccagauggaaagcgaggguaucuucuccccgagcgaguuggagacgcccaaccucgccggccgggugcuggauuggcuagagaagcacggugucgagcggcucaagcggauggcgaucuccggcgacgacugcguggugaagccaauugacgaucgcuucgccacugcccugaccgcccugaaugacaugggcaaaguacggaaggacaucccgcagugggaaccuagcaagggcuggaacgacuggcagcagguccccuucugcagccaccacuuccaucagcucaucaugaaggacggcagagagaucgucguccccugcagaaaccaagacgagcugguggggcgcgcccgggugagccagggcgcggguuggagccugcgggaaacagcaugucucggcaaguccuacgcgcagauguggcaacugauguauuuccaccggagagacuugaggcucgccgcgaacgccauaugcucggcggucccgguggacugggugccaacaucccgcacaaccuggagcauacaugcucaccaccaauggaugaccacggaggacaugcugucuguuuggaaucggguguggauagaagagaaccccuggauggaggacaagacccacaucucguccuggggcgacgugccauaccuaggcaaacgcgaggaccaauggugcggcucacuuaucggauugaccgcccgggcgacaugggccacgaauauccaggucgccaucaaccaggugcgccgccugaucggaaaugagaauuaccucgacuauaugaccuccaugaagagguucaagaacgaaagcgauccggagggggcccugugguga

SEQ ID NO: 24242 - RNA, 9879 nt, Artificial Sequence
  derived and/or modified CDS sequence (opt11) from DENV-1__FJ410283__SS-prME
agcgugacaaugcuacuaaugcuaaugccaaccgcccuggccuuccacuugacgacccggggcggggagccucacaugaucgugagcaagcaggagcgggggaagagccugcucuucaagaccagcgcagggguuaacauguguacuuugauugccauggacuuaggcgaguuaugcgaggacaccaugacguauaagugccccagaaucaccgagacugagcccgacgacguggauugcuggugcaacgccacugauacuugggugaccuacgggacaugcagccagacgggcgagcaucggcgggacaaacgauccguagcacucgcgccccacgugggccuggggcuggagacacgcacagagacguggaugagcuccgagggggccuggaagcagauccagcggguugagacgugggcuuugcggcacccaggguucaccguaaucgcccucuuccuggcccaugcgaucggcacaagcaucacccagaaaggcauuaucuucauccugcugaugcuggugacuccaagcauggccaugagaugugucgggauuggcagccgcgacuucguggaagggcucuccggggccacguggguggacgucgugcuagagcacgggucgugcguuacgaccauggccaaggacaagcccacgcuggacaucgaacuccuaaagaccgaggucacuaaccccgccgugcuccggaagcuuugcaucgaggcgaagaucuccaacaccacgaccgauagcaggugcccuacacagggcgaggccacucuggucgaggagcaggacgcuaacuucgucugccggcgcacguuugucgaccguggcuggggaaacggcugcggucucuucggcaaggggucccucaucacgugcgccaaguucaagugcgugacgaagcuggagggcaaaaucguccaauacgagaaccuuaaauacucagugaucgugacgguccacacgggcgaccagcaccagguggguaaugaaucuacggagcacggcacuaccgccaccaucacgccccaagcgccaaccacggagauacagcucaccgacuacggggcgcugacguuagacugcuccccucgaaccggccucgacuucaaugagauggugcuguuaaccaugaaggagaaguccuggcucguccauaagcagugguuucuugaccugccccuacccuggaccucaggugccagcacgagucaggagaccuggaacaggcaagaucuacugguuaccuucaagaccgcucacgccaagaagcaggaagucgugguguugggaagucaggagggcgccaugcacacggcccugacuggcgcuaccgagauccagaccagugguaccaccacaaucuucgccggacaccugaaaugccgccucaaaauggacaagcugacccugaagggcaugagcuacgucaugugcacggggucauucaaguuggaaaaagagcuggccgagacgcagcacggcacgguguuggugcagaucaaguacgaggggaccgacgcccccugcaaaauccccuucucuacccaggacgaaaagggggucacccagaacggcaggcugaucacugccaacccgaucgucaccgacaaggagaaacccgugaacaucgaggcggagccacccuuuggcgagucguacaucgucaucggggccggcgaaaaggcgcucaagcugagcugguucaagaaagggaguagcaucgggaagauguucgaggccacagcgcguggagcccgccgcauggccauccucggugacaccgcgugggacuucgguuccaucggcggcguguucaccucugcugggaagcucgugcaccagaucuucggcaccgccuacgggguccuguucuccggcguguccuggacgaugaagauaggcauaggcgucuugcucaccuggcuuggccugaacucccgcucuaccagucucagcaugaccuguaucgccgucggacugguuacgcuguaccugggagugaugguccaagccgacuccggguguguaauuaauuggaagggccgggagcugaagugcggaagcggcauauucgugacaaaugaaguacacaccuggaccgaacaguacaaguuccaggcugauucgcccaagcgccuguccgccgcuaucgguaaggccugggaggagggggugugcggcauccggucggccacccguuuggagaacaucauguggaagcagaucucgaacgaacugaaccacauccugcucgagaacgacaugaaguucacaguggucguaggggacguagcuggcauccuggcccaggggaagaagaugauucggccccagcccauggaauacaaguauucauggaaguccuggggaaaagcuaagaucaucggagccgacguccagaacaccacuuucaucaucgacggcccaaacaccccggaaugccccgacgaccagagggcguggaacaucugggagguugaggacuacggcuucggcaucuucacaaccaacaucuggcugaagcugcgggacagcuauacacaggugugcgaccaccggcugauguccgccgcuaucaaggauucaaaagccgugcacgccgauaugggguauuggaucgaauccgagaagaacgaaaccuggaaacuugcgcgggccagcuucauugaggugaaaacgugcaucuggccgaagucgcacacccucuggagcaacggcguccuggaguccgaaaugauaaucccaaaaaucuacgggggcccgaucagccagcauaacuaccgcccgggcuacuuuacgcaaaccgccggccccuggcaucuggggaagcucgagcuggacuucgacuugugugagggcaccaccguagugguggacgaacauuguggcaaccgggggccguccuugcgcaccaccacggucacgggaaaaaucauccacgagugguguugccggagcugcacacugccuccccugcgauuccgcggggaagaugguugcugguacgguauggagauccgcccagugaaggaaaaggaggagaaccucguaaagaguauggugucugccggcagcggcgagguggacuccuucucgcucggccugcucugcauuuccaucaugaucgaggaaguuaugaggagccgcuggucccggaagaugcugaugacaggaacgcuggccgucuuuuuucuccucaucauggggcagcugacuuggaacgaccucauccgacugugcauaauggucggcgcgaacgccagcgacaggauggggaugggcaccaccuaccuggcccucauggccacuuucaaaaugcggccgauguucgccgucggacugcuguuccgccgacucaccucccgcgaggucuuacuacucaccauagggcugagccugguugcuuccguggagcuccccaacagucuggaggagcugggcgacgggcucgccaugggaauaaugaucuuaaagcugcucaccgacuuccaaagucaucagcugugggccacguuauuaagccugacauucauaaagaccacuuucucccugcacuaugcauggaagacaauggccauggucuuaagcaucgugucccuguucccgcugugucuaagcacaacuagccagaagacgaccuggcuuccagugcugcucggcagccuggggugcaagccgcugaccauguuccucaucgccgagaacaaaaucuggggacggcgguccuggccccugaacgaggggaucauggccgugggcaucgugagcauccuucucaguucgcugcuuaagaacgacgucccccucgccgggccccugaucgccggcggcaugcugaucgcgugcuacguaaucucaggguccagugccgaucucucuuuggaaaaggcggccgagguguccugggaggaagaagccgagcacuccggggcgagccacaacauccucguugaaguucaggaugacgggaccaugaagauuaaggacgaggagcgagacgacaccuuaaccauccuacugaaagcaacguugcuggccguguccggcguauacccgcugucuauucccgccaccuuguuuguaugguacuucuggcaaaagaaaaaacagcgcuccgggguucugugggacacccccuccccccccgaggucgaacgggccguucuggaugacggcaucuaucgcaucaugcagcgggggcugcucggucgcucccaagugggcgucgggguguuucaggagaacguguuccacaccauguggcacgucacaagaggcgcggugcugauguaccaggggaagcgcuuagagcccagcugggccuccgugaagaaggaccucauuagcuauggcggcgguuggcgcuuacagggcuccuggaauacgggggaggaaguccaagugaucgccguugagcccggcaagaaucccaaaaacguccagaccgcgcccgggaccuucaagaccccagagggcgaggugggugccaucgcgcucgacuucaaaccuggcaccagcgguucccccauuguuaaccgcgaagggaagaucgucggccucuacggcaacggaguggugaccacgagcgguacguaugucagcgccaucgcccaggcaaaggcgucccaggaggggccgcugcccgagaucgaggaugagguguuucggaagcggaaccucacuaucauggaccugcacccaggcagcgggaagacccggcgcuaccuaccagccauagugcgugaggcaaucaaacguaaguuacgaacacucauccucgcuccuacacgggugguggcauccgagauggcggaggcccugaagggcaugccuauccgcuaccagaccaccgccgucaagagcgagcauaccggcaaagaaauugucgauuugaugugccaugccacuuucaccaugcggcugcugucccccgugagagugccgaauuacaauaugaucauaauggacgaagcgcacuucaccgacccgucauccaucgcggcccggggguacaucagcaccagaguaggcaugggggaggccgcggccaucuucaugacggcgacuccgcccggguccguggaggccuucccgcagucuaacgcagugauccaagaugaggagcgggacauucccgagagguccuggaacagcggauaugaguggaucaccgauuuccccggaaagaccgugugguucguccccuccaucaaaagcgguaacgacaucgcuaacuguuugcggaagaauggaaagcgugugauacagcugucucggaaaacuuucgacaccgaguaccaaaagaccaagaacaacgacugggauuacgucgugaccacggacaucuccgaaaugggcgcaaacuuucgcgcagacagaguaauagacccacgucggugucugaagccggucauccucaaggacggaccggagcgcgucauucuggccggccccaugccggugaccgucgccucugcggcacaacgccgcggacggaucggccguaaccauaauaaggagggcgaccaguacaucuacaugggacagccccucaacaacgaugaggaccacgcccacuggacggaggccaagaugcuccuggacaacaucaacacaccagagggcaucaucccggcccuguucgagccggagcgcgagaaguccgccgcgaucgacggggaguaccggcuccgcggugaggcccgaaagacuuucguggagcuaaugcgccgcggggaccugccaguauggcucuccuacaagguggccucggaggguuuccaauauuccgacagacgguggugcuuugacggcgagcgcaacaaucaggugcuagaggaaaacauggacguagagaucuggaccaaggaaggggagcggaagaagcugcgccccagguggcuugaugccagaaccuacagcgauccccuggcccugcgggaguucaaggaauucgcggccggccgucgcagcguguccggcgaccucaucuuagaaaucggcaagcugccgcagcaccucacccagcgcgcccagaacgcccucgacaauuuaguuaugcugcacaauagcgaacagggaggucgggcguaccgccacgccauggaggagcugccugacacgaucgagacccugaugcuccuggcacugaucgccgugcucaccgguggaguuacucuguucuuuuuguccggccggggccucggcaagaccagcaucggccugcugugcguaauggcaaguucuguccuccuguggauggcguccguggagccccacuggaucgccgccucaaucaucuuggaguucuuccucauggugcugcugauccccgagccggaccgucagcggacuccccaggauaaucagcuggccuacgucgugauugggcugcuguucaugauacucaccguggccgcgaaugaaaugggccuguuggagaccacaaagaaagaucuagguauuggccauguugccguggaaaaccaccaccacgcagcuaugcuugacguggaccugcauccagccuccgccuggacgcucuacgcgguugccaccaccaucaucacaccgaugaugcgccacacaauagagaacacaaccgccaacaucuccuugaccgcuaucgcuaaucaggcagcuauccugauggggcucgacaaaggauggcccauuuccaagauggacaucgggguaccucuccuggcccucggguguuacagccaggugaauccgcuuacguugaccgcggcgguccucaugcugguggcacacuacgccaucauuggaccgggacugcaggccaaggcgacucgcgaggcccagaagagaaccgccgcuggaaucaugaagaauccaacugucgacgggaucgucgcaauugaccucgaucccgugguguacgaugcuaaauuugagaagcagcugggccagauaaugcugcuaauccugugcacgucucagauacugcucaugcgcacgacuugggcucugugcgagagcaucaccuuggcaaccggcccccuuaccacacugugggagggaucaccgggaaaguucuggaacacuaccaucgccguaagcauggcuaacaucuuccgggguuccuaccuggcgggcgccggccuugccuucagccugaugaaaagccucgguggcgggcgucgggggacaggggcccagggagagacgcucggcgagaaauggaagcgccagcugaaucagcuguccaagagcgaguucaacacauauaagcggagugggauuauggagguggaccgcagcgaggcuaaggagggccucaagcgcggcgagaccaccaagcacgcuguuucuagggguaccgcaaagcugcggugguucguugagaggaaccuggugaagcccgaggggaaagugauugaccuggguuguggccgcgguggguggagcuacuauugcgcugggcucaaaaaggucacggaggugaagggguacacaaaagggggcccgggccaugaggagcccauuccgauggccaccuacggguggaaccuggugaaacugcacuccggcaaggacgucuuuuucauuccgccagagaagugcgauacacuccugugcgauaucggugagagcucgccuaacccgacgauugaggagggacggacccugcgggugcucaagaugguggagcccuggcugcgcggcaaccaguucugcaucaaaaucuugaaccccuacaugcccucugucguggagacccucgagcagaugcagcggaagcauggcggcaugcuggugcgcaauccgcuuucgcggaacagcacucacgagauguacugggucuccugcgggacagguaacaucgugucugcugugaauaugacgaguaggaugcuccugaauagauucaccauggcccaccggaagcccaccuacgaacgagacgucgaccugggggcgggaaccaggcacguggccguggagcccgagguagcaaaccucgacauaaucggacagagaaucgagaacaucaagcaugaacauaaaagcaccuggcacuacgacgaagacaaccccuauaagaccugggcguaucacggauccuacgaagucaagcccucugguuccgcaagcucgauggugaacgggguggugaagcuuuugaccaagccuugggacgucaucccuauggugacucagaucgccaugacggacacaacgcccuucggccagcagcgggucuucaaggagaaggucgacacccggacgccgaaggccaagcgagggaccgcccagaucauggagguaaccgcgaaguggcucuggggcuuccugucccgcaacaagaagccccguauuugcacccgcgaggaguucacgcggaaggugcgcucaaacgccgcgaucggagccgucuuuguggaugaaaaccaguggaacagugcgaaggaggccguggaagacgaacgguucugggaccugguacaccgcgagcgugagcuucauaagcaggggaaaugugcuaccugcguauacaauaugaugggcaagcgcgaaaagaaguuaggggaguuugguaaagcuaaggggucgcgagccauaugguacauguggcugggcgcucgauuccucgaauucgaagcucuagguuucaugaacgaagaccacugguuuucgagggagaacagucuauccggagucgagggcgagggccuacacaaguuaggguacauccugcgcgauaucucgaagauccccggcggcaauauguacgccgacgacaccgccggaugggacaccaggaucacugaggacgaccuccaaaacgaggcgcgcaucacagacaucauggagccggaacacgcacugcuggcgaagucaauauucaagcugaccuaucagaacaagguuguacgcgugcaacgacccgcgaagaacgggacugucauggacguaauaagcagacgggaccagcgcggcuccggucagguggggaccuacggccugaauaccuucaccaacauggaggcccagcugauccggcagauggagagcgaggggaucuucucccccagcgaacucgagacgcccaaccuggccgaacgcguccuggacuggcucggcaaguacgggguggagcggcugaagcgcauggcaaucuccggugacgacugcgugguaaagccgauagacgaucgcuucgcuacugcccucaccgcgcucaacgacauggggaaggugcgcaaggacaucccucagugggagcccucaaagggcuggaacgacuggcaacagguccccuucugcucccaccacuuccaccagcugaucaugaaagacggccgggagauuguugugccgugcaggaaccaagaugagcucguaggccgggcccgcgucagccagggcgcuggguggagucuccgagagacugccugucuggggaaguccuaugcacagauguggcagcuaauguacuuccaccggcgggaccuccgucuggcggcuaaugccauaugcuccgccgugccuguagauuggauucccacuucccgaacgacguggaguauucacgcccaccaccaguggaugaccacagaagacaugcugucugucuggaaccgcguuuggauagaagaaaacccauggauggaagacaagacccacauaaguuccuggggugacgugcccuaucucgguaagcgggaggaccagugguguggcucuuugaucgguuuaaccgccagggcgaccugggccacuaacauccaggucgccaucaaccaggugcgccgacucaucggaaaugaaaacuacuuagacuacaugaccuccaugaagcgcuuuaaaaaugagagcgaucccgagggggcccuaugguga

SEQ ID NO: 24243 - RNA, 9879 nt, Artificial Sequence
  derived and/or modified CDS sequence (opt11) from DENV-1__FJ410284__SS-prME
agcgugacgaugcugcucaugcugaugcccaccgcucuggcauuccacuuaaccacgcgcggcggggagccccacaugaucgugaccaagcaagagcgcggaaagagccugcuguucaagaccagcgcgggggugaacaugugcacccucaucgccauggaccugggcgagcugugcgaggacaccaugaccuacaagugcccucggaucaccgaggccgagcccgacgacguggacuguuggugcaacgccaccgacaccugggugaccuacgggaccugcagccagacgggcgagcaccggcgcgacaagcggagcguggcccuugcgccccacgucggcuuaggguuggagacgcgaaccgagaccuggauguccagcgagggcgccuggaagcaaauccagcgggucgagacgugggcccuccgccaccccggcuucaccgugaucgcccuauuccuagcgcacgccaucggcaccuccaucacucagaaggggaucaucuuuaucuuacugaugcuagugacgccgaguauggccaugcgaugcgucggcaucggcucacgcgauuucguggaagggcucagcggggcaacuuggguugacguaguguuagagcacggguccugcgucaccaccauggcuaaggacaagcccacgcuggacaucgagcuccugaagaccgaggucaccaaccccgcgguccugcggaagcucugcauagaggccaagaucucaaacaccaccaccgacucccgcugcccuacccagggcgaggccacccugauggaggaacaggacgcgaacuucgugugccggagaacguucgucgaccgggggugggggaacggcugcggucuguucggaaaggggagccucaucacgugcgccaaguucaagugcguaaccaaacuggagggaaagaucgugcaguacgagaaccugaaguacucugucaucgugaccgugcacacgggcgaccagcaccaggucgggaacgagagcaccgagcacggaaccacagcgaccauuacgccgcaggcccccaccuccgagauccagcucaccgacuacggagcccuaacccuggacugcucgccccguacgggccuugacuucaacgagauggugcugcugaccaugaaggaaaagucuuggcucgugcacaagcagugguuccucgaccugccgcuccccuggacuuccggggccagcaccucccaggagacauggaacaggcaagaccugcuggugaccuucaagaccgcccacgcgaaaaagcaggagguggucgugcucggaagccaggagggcgccaugcacacagcccugacgggagcuacagagauccagaccagcggcaccacgaccauauucgccgggcaccugaagugccgccucaagauggauaagcugacccugaagggcaugagcuacgugaugugcaccggguccuucaagcucgagaaggaagucgcggagacgcagcacggaaccguguuaguucagaucaaauacgagggcacugacgcccccugcaaaaucccauuuucaacccaggacgagaagggggucauccagaacggccggcugaucacggccaacccgaucgugaccgacaaggagaagcccgugaacaucgaggccgagccgcccuucggcgaguccuacaucguuauuggcgugggcgagaaggcgcugaagcugaguugguucaagaaggggagcuccaucgguaagauguucgaggccacagcccgcggggcccggcgcauggccauccugggcgacaccgcgugggauuucggguccaucggcggcgucuuuacgagcguggggaagcuggugcaucagaucuucggcacugccuacgggguccuguuuuccggcgucagcuggaccaugaaaaucgggauuggcgugcugcugacguggcucggccugaacucccgcagcacgucucugagcaugaccuguaucgccguggggcucgucacccuguaccugggcgugauggugcaggcggacucugggugcgucaucaacuggaaggggcgggagcucaaaugcggcagcggcaucuucgucaccaacgaggugcacacuuggaccgagcaguacaaguuccaagcugauagcccgaagcgccuguccgcggccauaggcaaagccugggaggagggggucugcggaauccggagcgccacccgccuggagaauaucauguggaagcagaucuccaacgagcucaaccacauccugcuggagaacgauaugaaguucaccguggugguuggggacguggugggcauccucgcccaggggaagaaaaugauccggccccagcccauggagcauaaauacagcuggaaguccuggggcaaggcgaagaucaucggcgccgacguccaaaauaccacguuuaucaucgacgggcccaacaccccggagugccccgacgaccaacgcgccuggaacaucugggagguggaagacuacggcuucgggauauucaccacaaacaucuggcugaaacugcgggacagcuacacgcaggccugugaucaccgccucaugucagcggccaucaaggacaguaaggccgugcacgccgacaugggcuacuggaucgaguccgaaaagaacgagaccuggaagcuggcucgggcgagcuucaucgaggucaagacuugcaucuggcccaagucccauacccuguggucuaauggcgugcucgaguccgagauggugauccccaagaucuacgggggccccaucucccagcacaacuaccggccuggcuacuucacgcagaccgccggacccuggcaccuagggaagcuugaacucgacuucgaucugugcgagggcaccaccgucguaguggacgagcacugcggcaaucgagggccgucccuacguacgaccaccguuaccggcaagaucauacacgaguggugcugucggucaugcacguuaccgccacuccgcuucaagggggaagacggcugcugguacgggauggagauccggcccgugaaggagaaggaagagaaccugguaaaguccauggucagcgcuggcagcggcgagguggauuccuucagccucgggcugcugugcaucuccaucaugauugaggagguaaugcgcucgagguggucucgaaagauguugaugaccggcacccuggccgucuuccugcuccugaucauggggcaacugaccuggaacgaccucauccgccugugcauaauggugggcgccaaugcgagcgaccgcauggggaugggcacgaccuaccuggcccucauggccacguucaagaugcgcccgauguucgccguaggccugcuguuccggcgccucaccagccgggagguccugcugcucacgaucgggcuaagccugguggcuucugucgagcuccccaacagccuggaggagcugggcgacgggcucgcgaugggcaucaugauccugaagcugcucacagacuuccagucccaucagcugugggccacccugcucagccugaccuucaucaagacgacccugucccugcacuacgccuggaagacuauggccauggugcugagcaucgugucccuguuuccccucugccuuagcaccacgucacagaaaaccaccuggcugcccguccucuugggcagccucggaugcaagccgcucaccauguuccucaucgccgaaaacaagauuuggggccggaaguccuggccccugaacgaggggaucauggccguaggcguggucagcauccuccugagcucccugcucaagaacgacgugccccuggccgggcccuugaucgccggcggcaugcucauugccugcuacgugaucucaggguccagcgcggaccugucccucgagaaggccgccgaggucucuugggaagaggaggccgagcacuccggcgccagccacaacauccucguggaggugcaggacgacgggacgaugaagaucaaggacgaggagaaggacgacacccugaccaucuugcucaaggcgacccugcuggccgucuccgggguguacccgcucagcaucccggccacccuguucgugugguacuucuggcaaaagaagaagcagcggucggggguccuuugggacacgcccagcccacccgagguggagcgcgcugugcuggacgacggcaucuacagaaucaugcagcgcggccuccuggggcggucucaggucggcguggguguguuccaggagaacgucuuccacaccauguggcacgugacccgcggcgcagugcugauguaucagggcaagcggcucgaacccagcugggcguccguaaagaaggaccucaucagcuacggcggcgguuggcgccugcagggcuccuggaacacuggggaagaaguccaggugaucgcagucgaacccggcaaaaacccgaagaacgugcagacggcgcccgggaccuucaagacccccgagggcgaggugggugccaucgcccucgacuucaagccagguaccagcggcucccccaucgucaaccgggaggggaagaucgugggccuguacggcaacgggguggucacgacaagcggcaccuacgugagcgcgaucgcccaggccaaggccucccaggaagggccgcugcccgagaucgaggacgagguguuucguaagcggaaccucaccaucauggaccugcaucccggcagcgggaagacgcgccgguaccugcccgcgauuguccgcgaggccaccaagcggaagcuccgcaccuugauccuggcaccgaccagagugguggccagcgagauggcugaggcgcucaagggaaugccaauucgcuaccagacaaccgccgucaaaagcgagcacacgggcaaggagaucguggaccugaugugccaugcaaccuucacgaugcgccugcucucccccgugcggguuccgaacuacaacaugaucauuauggacgaggcccacuuuaccgaccccucguccaucgccgcgcgcggguacaucagcacccgggugggcaugggcgaagccgccgccauuuucaugaccgccacgccgcccggcucaguggaggccuucccacagagcaacgccgucauccaggaugaggagcgagacauccccgagcgguccuggaacuccggguacgaguggauuaccgauuuccccggcaagaccgugugguuugugcccuccaucaagagcggcaacgauaucgccaacugccugcgcaagaacgggaaacgcgucauccagcuuucccgaaagaccuuugacacggaguaccagaagaccaagaacaacgacugggacuacguggugaccaccgacaucagcgagaugggcgccaacuuccgggcggaccgggucauugacccgcggcgcugccucaagcccgugauccugaaagacgggcccgaacgggucauccuggcuggccccaugccugugacuguggccuccgccgcccagcgccgggggcgcaucggacggaaccauaauaaggagggcgaccaguacauuuauauggggcagccccucaacaacgacgaggaucacgcgcacuggaccgaggccaagaugcugcuggacaacaucaacacccccgagggaaucauccccgcccucuucgagcccgagagagagaaguccgccgccaucgacggggaguaccggcuacgcggcgaggcgagaaagaccuucguugagcugaugcggcgcggagaccuccccguguggcuguccuacaagguggccucggagggcuuccaguacagcgaccggcgcuggugcuucgacggggagcggaacaaucagguuuuagaggagaacauggacguugagaucuggacgaaggaaggggagcgcaagaagcuccggccacgcuggcuagacgcccggacuuacuccgauccccuggcccucagggaguucaaggaguucgccgcgggccggcgcagcguguccggugaccugauccuugagaucgggaagcucccgcagcaucugacccagagagcccagaaugcuuuggacaaccucguuaugcugcacaacagcgaacagggcgggcgcgccuaccggcacgcgauggaggaauugcccgacacuauugagacguugaugcuacuggcccucaucgccgugcugaccggcggggugacccuguucuuccucuccggcagggggcugggcaagacaagcauaggccuucucugcgucauggcaaguagcgugcugcuguggauggcauccguggagccccacuggaucgcggccagcaucauccucgaguuuuuccucaugguccugcucauccccgagccggaccggcagcguacgccccaggacaaccagcuggccuacguggugaucggccuccuauucaugauccucacgguugccgccaacgagaugggccugcucgagacuaccaaaaaagaccuggggauuggccacguggcgguggagaaccaccaccacgccacgaugcuggacgucgaccuccaccccgccuccgccuggacgcuguacgcaguggcgaccacgaucaucacccccaugaugcggcauacgaucgagaacacuaccgccaacaucagccugaccgcuaucgcgaaucaggccgcgauccucauggggcuagacaagggauggcccaucuccaagauggacauuggagugccccuccucgcucuggggugcuacucgcaggucaacccccugacgcucaccgccgccguccuaaugcugguggcgcacuacgccaucaucgggccggggcuccaggccaaggcuacccgugaagcucagaagcggaccgcggccggcaucaugaagaacccuacggucgacgggaucguggccaucgaccuggacccuguggucuacgacgccaaauucgagaagcagcugggccagaucaugcuccugauccugugcaccucccagaucuugcugaugcgcaccaccugggcacugugugagagcaucacgcucgcgacuggcccccugaccacccugugggaggggaguccgggcaaguucuggaauacgaccaucgccgugagcauggccaacauuuuccgcggguccuacuuggccggcgccgggcuggcguucucacugaugaagucccuagggggcgggcggcgcggcaccggcgcccagggugagacucugggggagaaguggaagcggcaguugaaccagcucuccaagagcgaguucaacaucuacaagcgcuccgggauuauggagguggaccggagcgaggccaaagagggucugaagcgcggggagacgacccgccacgccgucucccgcggcacugccaagcugcguugguucguggagcgcaaccuaguaaagcccgaggggaaagucaucgaccucggcugcggccgcggcgggugguccuacuacugcgccgggcugaagaaggugaccgaggugaagggguacacuaagggcgggcccggccacgaagagccuaucccgauggccacguacggguggaaccuggugaagcuccacuccggcaaagauguguucuucaccccgcccgagaagugcgacacccuacugugugacaucggggagagcucccccaacccgacaaucgaggagggccgcacccuccgggugcugaagaugguugagcccuggcugcgcgggaaccaguucugcaucaagauccucaaucccuacaugccgucggucguggagacccuggagcagaugcaaaggaagcaugguggcaugcuggugcgcaacccgcucucccggaacagcacacacgagauguacuggguguccugcgggaccggcaacaucgugagcgccgucaacaugacgucccgcauguugcucaaccgguucaccauggcacaccgaaagcccaccuacgaacgcgacguggaccucggcgcgggcacccggcacguggccguagaacccgagguggccaaccuggacaucaucggccagcgcaucgagaauaucaagcacgagcacaagagcacauggcauuacgaugaggacaaccccuacaagaccugggccuaccacgggucuuacgaggucaaaccgagcggcucugccagcagcauggugaacgggguggucaagcuguuaaccaagcccugggacgugauccccauggugacgcagauugcgaugacggacaccacccccuucggccaacagcgggucuucaaggagaagguggacacccgcacgccgaaggccaagcgggggaccgcccagaucauggaggugaccgcccgcugguuauggggcuuccugucccggaacaagaaaccccgaauuugcacccgggaggaguucacgagaaaggugaggagcaacgccgcgaucggggccguguucguggacgagaaccaguggaacuccgccaaggaggccguggaggacgagcgcuucugggaucucgugcagaaggagagagagcugcacaagcaggggaagugcgcuaccugcguguacaacaugaugggcaagagggagaagaagcugggggaauucgggaaagccaaggggagccgggccaucugguauauguggcucggcgcccgcuuccuggaguucgaggcgcugggcuucaugaacgaggaccacugguucucacgggagaacagccucagcggggucgagggcgaggggcugcacaagcuggguuacauccuccgcgacaucucuaagauccccgggggcaauauguacgcggacgacaccgccggcugggacacccggaucacggaggacgaccugcagaacgaagccaagaucaccgacauuauggagcccgagcacgcccugcucgccaccuccauuuuuaagcugaccuaccagaacaagguggugcgcgugcagcggcccgcgaaaaacggaaccgugauggaugucaucagccgccgcgaccagcggggcuccgggcaggucggcacuuauggccuaaacaccuucacuaauauggaggcccaacuuauccgccagauggagagcgaggggaucuuccugcccuccgagcuggagacgccaaaucucgccgagcgagugcuggacuggcuagagaaacacggcguggaacgccucaagcggauggccaucagcggggacgacugcgucgugaagcccaucgaugaucgcuucgcaaccgcgcugacagcccugaacgacaugggcaaggugcggaaggacaucccacagugggagcccuccaagggguggaacgacuggcaacaaguccccuucugcucacaccacuuucaccagcucaucaugaaggacggccgagagaucguggugccgugccggaaccaggacgaguuggucggccgcgcccgggugucccagggggccggcuggagccugagagaaacagccugccucgguaagagcuacgcgcagauguggcaguugauguacuuccaccggcgcgacuuacggcuggccgcgaacgccaucugcuccgcggugcccguagacugggugccgaccagccgcaccaccuggaguauccacgcccaccaccaguggaugaccacggaggacaugcucagcguuuggaaccgaguguggaucgaggagaacccauggauggaggacaagacccacguauccagcuggggcgacgugcccuaccuggggaagcgcgaggaccagugguguggcucccucaucggccugacggcccgggcuaccugggccagcaacauucaggucgcgaucaaccaaguacgcagacugaucgggaacgagaacuaucucgacuacaugaccaguaugaagcgguucaagaaugagggcgaccccgaaggggcccugugguga

SEQ ID NO: 24244 - RNA, 9879 nt, Artificial Sequence
  derived and/or modified CDS sequence (opt11) from DENV-1__FJ410285__SS-prME
agcgugaccauguuacuuaugcugaugcccaccgcccuugccuuucaccucaccacccgcggcggcgagccgcacaugaucguuagcaagcaggagcguggcaaaagccuguuauucaagaccagugccggagugaauaugugcacucucaucgccauggaccugggggaacugugugaggacaccaugaccuacaagugcccccggauaaccgagacugagcccgacgacguggacugcuggugcaacgcuaccgauacaugggugaccuacgggaccugcagccaaaccggcgagcaucggcgcgacaaacggagcguggcgcuggcgccucacguggggcuggggcucgagacccgcacugagacuuggaugagcuccgagggcgccuggaagcagauccaacggguggagacuugggcccuucgccacccggguuucaccgugaucgcccuguuccuggcgcacgugaucggcaccaguaucacccagaagggaauaaucuucauacuccugaugcuggugacacccucgauggcaaugaggugcgugggcaucggaucccgcgauuucguggaggggcucuccggcgcuaccugggucgauguggugcucgaacacgggagcugugucacgaccauggcgaaagacaagccuacgcuggacauagagcuccugaagaccgaggugaccaaccccgcggugcugcgcaagcucuguauagaggcgaagauuaguaacaccacgaccgacagccgcugcccgacucagggcgaggcaacucuugucgaggagcaagacgcuaacuucgugugccgaaggacguuuguggaccggggcugggggaacggcugcgggcuguucggcaaaggaucccucaucacgugcgccaaguuuaaguguguuaccaagcuggaaggcaagaucgugcagcacgagaaccugaaauacucggugaucgucaccguucacacgggggaccagcaccaggucgguaaugagucuaccgagcaugguaccacagccaccaucacgccccaggcccccacuaccgagauccaguugaccgacuacggggcgcugagccuggacuguagcccacggacgggccucgacuuuaacgagauggugcuucugaccaugaaggagaaguccugguuaguacacaagcagugguuccuggaccugccgcuccccuggacgucgggggccuccacgucucaggagacguggaaccggcaagaccuauuagucaccuucaagaccgcccacgccaagaaacaagagguuguggucuuggggucccaggagggcgccaugcacaccgcgcuaacuggggccacggaaauccagaccagcggcaccacgaccaucuucgcagggcaucugaagugccgacucaagauggacaaacugacccugaaaggcaugucauacgugauguguaccgggaguuucaagcucgagaaagaaguggccgagacgcagcauggcacuguccugguccagaucaaguaugagggcacggacgcucccugcaagauacccuuuucgacacaagacgagaaaggagugacucagaacggccggcugauuacagcgaacccgaucgucaccgacaaggagaagcccgugaacaucgaggccgagccgcccuucggggagagcuacaucaucauaggcgccggagagaaggcucugaaacuauccugguucaagaaggggagcuccaucggaaagauguucgaggcgaccgcccgcggggcgcggaggauggccauccugggcgacaccgccugggacuucgggagcaucggcggcguauucacaaguguagggaagcuggugcaccagaucuucggcaccgccuacgggguucuguuuucuggcgucuccuggacgaugaagaucgggaucggcguacuccuuacuuggcucggccugaacagccgauccaccagccuguccaugaccugcaucgccgugggguuggucacccuauaccugggcgucaugguucaggccgacagcggguguguuauuaacuggaagggcagagaguugaagugcgggagcgguauauucgugacgaacgaggugcacacauggaccgaacaguacaaguuccaggcggacuccccaaagcggcugagcgcggcaaucgggaaagccugggaagaaggggucuguggcauccguuccgccacccgacuggagaauaucauguggaagcagauaucgaacgagcucaaccacauacuacuggagaacgacaugaaauucaccgugguggucggggauguagcuggcauccuagcacaggggaagaagaugauccggccccagcccauggaguacaaguacuccuggaaaaguugggggaaggcgaagauaaucggcgccgacguucaaaacacgaccuucaucaucgaugggcccaacaccccggagugccccgacgaccagcgcgcauggaauaucugggagguggaggauuacggcuucgguauauucaccacgaacaucuggcugaaacugcgggacuccuacacgcaggucugcgaccaccgccucaugagugcggcgaucaaagacaguaaggcuguacacgccgauaugggguacuggaucgagucugagaagaaugagacuuggaagcuggcccgggcuuccuuuauagaggucaagaccugcaucuggcccaagagccauacguuaugguccaacggcguguuagagagcgagaugaucauuccgaagauuuacgggggaccaaucucccagcacaacuauaggccugguuacuucacccaaacugcaggucccuggcaccugggcaaacuugagcucgacuucgaccugugugagggcaccacgguugugguggacgagcacugcggaaaccgugggcccagcuugcgcaccacuaccgugacagguaagauuauucacgaguggugcugccgauccugcacgcugccaccguuacgcuuucgcggugaggacgguugcugguacgggauggagauccgccccgucaaggagaaggaggagaacuuagucaagaguauggugagcgccggccccggcgaagucgacucguucagccucgggcugcucugcaucuccaucaugaucgaggaggugaugcggagccgcuggucccggaagaugcugaugacuggaaccuuagccguguucuuccugcucaucaugggacaacugacauggaacgaccuaauacgccugugcaucauggucggugcuaaugccucagaccgcauggggauggggacaaccuaccuagcgcucauggccaccuuuaagaugcgccccauguucgccgugggcuugcuguuccgucggcugacaucccgcgaggugcuccuauugaccaucgggcucagccugguagcgucgguugaguugcccaauagccucgaggagcugggcgacggucuggcgauggggauuaugauucucaagcuccucgcagacuuucagucccaccaguugugggccacgcugcugucacucacuuucaucaagacaaccuuuucccugcacuacgcauggaagacaauggccaugguccugagcaucgugagccuauucccccugugccugaguacuacgucccaaaagacgaccugguugccgguguuauugggcagccucgggugcaagccccugacgauguuucuaaucgcggagaacaagauauggggccggcgcagcuggccccucaacgaagguauaauggccgucggcaucgugagcauccugcugagcucgcuucugaagaacgacgugccccuggccggcccgcugauugcgggcggcauguuaaucgccugcuaugucaucagcgggucaagcgcggaccuaucacuugagaaggccgccgaggucagcugggaggaggaagccgagcacuccggagccucccauaacauacugguggagguccaggacgaugggacgaugaagaucaaggaugaggagcgggacgacacccugacgauccucuugaaggcgacccugcucgcugugucgggcguguacccccuauccauccccgcaacccucuucguaugguauuucuggcagaagaagaaacagcgcucggggguguugugggauacgcccucaccgcccgaggucgaacgggcuguccuggacgacggaaucuaucgcaucaugcagcggggccuuuuggggcgcucccaagucggcguuggggucuuccaggagaacguguuccacacuauguggcacgugacgcggggugccgugcugauguaccaggggaaacgccucgagcccagcugggcuuccgugaagaaagauuugaucaguuacgggggcggauggcggcuccagggcucguggaacaccggagaggaagugcaggucaucgcaguggagccaggcaaaaaccccaaaaacguccagacggcccccggaacuuucaagaccccagaaggagaggucggcgcuauugcccuugacuucaagccugguaccagcgggagcccgaucguaaaccgcgaggggaagauagugggccuguacggcaacggcgucgucacgacuagcggcaccuacgucagcgccaucgcacaggccaaagccucccaggaggggccucuccccgaaaucgaagacgaagucuuccggaagcgcaauuuaaccaucauggaccugcacccugggagcggaaagacgcgacgcuaccugcccgcgaucgugcgagaggccauaaagcgccgcuugagaacccugauccucgcacccacucgcguggucgccucugagauggcggaggcucucaagggaaugcccauucgguaucagaccacggccgucaagagcgagcacacgggcaaggagaucguggaccuaaugugccacgccaccuucaccaugcgguugcuguccccgguacgggugcccaacuacaacaugaucaucauggacgaggcccauuucacggaccccucauccaucgccgcgaggggguacaucagcacccgagugggcaugggagaggccgccgccaucuuuaugaccgccacgccgcccggcuccgucgaagccuucccacagagcaaugccguaauccaggacgaggagcgcgauauccccgagcggucauggaacagcggguacgaguggaucacugacuuucccggaaagaccgugugguucgugccguccaucaaaucuggaaacgacaucgccaacugccugcgcaagaacgggaagcgcgucauccagcucaguaggaaaacauucgacaccgaguaccagaagacuaagaacaacgacugggacuauguaguaaccaccgacaucagcgaaaugggcgccaauuuccgggcugaccgugugaucgaucccaggcgcugccugaagccugugauccugaaggacgggcccgagcgcgucauacucgcuggcccgaugccugugaccgucgccuccgcggcucaaaggcggggccgaauuggccgcaaccacaauaaggagggcgaccaauauaucuacaugggacagccucuaaauaaugaugaggaucacgcgcacuggacagaagcaaagaugcugcucgacaauaucaauacccccgaggguauuaucccagcccuguuugagccagagcgagagaaaagugcugccaucgacggggaauaccgccuaaggggagaagcccgcaagacguuuguagaacucaugcggcgcggugaccuacccguguggcuguccuacaagguagcgagcgagggcuuccaguacucagaccggcgcuggugcuuugacggcgaacguaacaaccaggugcuugaagagaauauggacguagaaauuuggaccaaggagggggagcgcaagaagcugcggccccgcuggcucgacgccaggacguauuccgacccgcucgcgcugcgcgaguucaaagaguucgcggcgggcaggcgcagcgucagcggagaccugauccuagagaucggcaaguugccccagcaccuuacccagcgagcccagaacgcccucgauaaccuggugaugcuccacaacagcgagcagggcggccgagccuaucgucacgcgauggaggaacucccugacaccaucgagacccucaugcugcucgcccugaucgccgugcucacggguggugucacacucuucuuccuuuccggccgcggguuagguaagaccagcaucggucucuugugcgugauggcaucuagcgugcugcuuuggauggccuccgucgagccccacuggaucgcagccagcauuauccuugaguucuuccuaauggugcuucugauaccggagcccgacagacagcgcacgccccaagauaaccagcuggcauacguggucaucggguugcuauucaugauccuaacuguggccgccaacgagaugggccugcucgagacuaccaaaaaggaccuggggaucggccacguggccguagagaaccaccaccaugccgccaugcucgacguggaucuccacccggccuccgcguggacccuguacgcgguggccaccacuaucaucacccccaugaugcgccacacaaucgagaauacuacagccaacaucucauugacagcaaucgccaaucaagcugccauacugaugggccuggacaagggguggcccauuuccaaaauggacaucggcgucccccuccuggcccugggcugcuacucccaggucaacccguugacacugaccgccgcggugcuuaugcucgucgcccauuacgccaucaucggccccgggcugcaagccaaggccacgcgggaagcccaaaagcgaacagccgccggcauuaugaaaaaccccacagucgacgggauaguggccauagaccuggaccccguugucuacgacgccaaguuugagaagcagcucggccagaucaugcuccugauccucugcaccucucagauacugcugaugcggacgaccugggcguugugcgagagcauaacacuggcgacuggcccgcuuacgacccugugggaggggucccccggcaaguucuggaacacgaccaucgccgugagcauggccaauaucuuccgcgggucuuaccuagcgggcgcuggccuugccuucucacucaugaagucccuagggggcggucggcgcgggacuggcgcccagggcgagacccugggcgagaaauggaagcggcagcucaaccagcugagcaaauccgaguucaacaccuacaagcgcuccgguaucauggagguagaccggagcgaggccaaggaaggccugaagagaggggaaacuacaaagcacgcggugucccguggcaccgcaaagcuccgcugguucguggagcguaaccuggucaagcccgaagguaaggugaucgaucucggcuguggccgagggggcuggagcuacuauugcgcaggccugaaaaaggugaccgagguuaagggcuacaccaagggcggccccggccacgaggagccaauccccauggccacguacggguggaaccucguaaaacuccacuccgguaaggauguguuuuucaucccgccagagaagugcgauacccugcucugcgacaucggggaaucguccccgaauccgaccaucgaggagggccggacccuucgcguguuaaagaugguugagccuugguugagagggaaucaguucugcaucaagaucuugaacccguauaugccaucagucguagagacgcuggaacaaaugcagcgcaagcauggcgggaugcucgugcggaacccacuaucccgcaacagcacacaugagauguacuggguguccugcgggaccggaaacaucgugucagcugugaacaugaccucucgcauguugcucaaccgguucaccauggcgcaccgcaaacccacguacgaacgggacguggaucugggggccggcacgcgacacgucgccguggagcccgagguggccaaccuggauaucaucggccagcggaucgagaacaucaagcacgagcacaaaagcaccuggcacuacgacgaagauaacccguauaagaccugggcuuaucauggcuccuacgagguaaagccaucuggcuccgcaucuagcauggugaacggcgucgugaagcuccugacgaagcccugggacgugauccccauggucacccagaucgccaugaccgacaccacuccguucggccaacagcgcguauucaaggaaaaaguagauacccggacccccaaagccaaacgcggcacugcccagaucauggagguaacggccaaauggcuguggggcuuccucucccgaaacaagaaaccgcgcaucugcacccgggaggaguucacucgcaaggugcggagcaacgcggccaucggugccguguucgucgacgagaaccaguggaacuccgccaaggaagcgguagaggaugagagguucugggaucuggugcaccgcgaacgagagcuucacaagcaagggaagugugcgaccugcgucuacaacaugaugggcaagcgcgagaagaaguuaggggaguucggaaaggccaaagggucccgcgcaauuugguacauguggcugggcgccagguuccuggaguucgaagcucucggcuucaugaacgaggaccauugguucucucgcgagaacucucugucugggguggagggcgaggggcugcauaagcucgguuacauccugcgugacaucagcaagauccccggcggcaacauguaugcggacgacaccgcuggcugggacacucgcaucaccgaggacgaccugcaaaacgaggcucgcauaaccgacaucauggagcccgagcacgcccugcucgcgaaguccauauucaagcugaccuaccagaacaaggugguccggguccagcgcccugcaaagaacgggaccgugauggacgucaucagccggagggaucagcggggcuccggccaggucgggaccuacggccucaauacauucacgaauauggaggcccaacuaauacgccagauggagagcgaggggaucuucucccccagcgaacuggagaccccaaaccucgccgagcgagugcucgauuggcuggagaaguaugguguugagaggcucaagcggauggcuaucuccggggacgacugcgugguaaaaccgaucgaugaccgcuucgcgaccgcccugacggcccugaaugacaugggcaagguccggaaggacaucccgcagugggagcccucuaagggguggaacgacuggcagcaggucccguucuguagccaccauuuccaucagcucaucaugaaggacggccgcgagaucguggucccaugccggaaccaggacgaacugguaggucgagcccgggugucacagggagccggcuggagccugcgcgagacggcgugucucggaaagucguacgcccagauguggcagcuuauguacuuccaucggcgcgacuuacggcucgccgccaaugcaauuuguucagccgugcccguggacuggauccccacgucacgcaccaccuggagcauccacgcccaucaccaguggaugacgaccgaggacaugcuguccguguggaaccgcguauggaucgaggagaauccguggauggaggacaaaacccacauaagcuccuggggcgacguccccuacuuagggaagcgggaggaccagugguguggcucucucaucggacugacagcccgcgccacgugggcgaccaacauacagguggccauaaaccagguccgccgccugaucgggaacgagaacuaucucgacuauaugacguccaugaaacguuucaagaacgagagcgaccccgagggcgcccugugguaa

SEQ ID NO: 24245 - RNA, 9879 nt, Artificial Sequence
  derived and/or modified CDS sequence (opt11) from DENV-1__FJ410286__SS-prME
ucuguuacuaugcugcuuaugcucaugccgacggcccuggccuuccaccugaccacccgcggcggggagccucacaugauagugucaaagcaggagcggggcaagagccugcuguucaagaccagcgcggggguaaauaugugcacccucauugcgauggaucuaggcgaacugugcgaggacacgaugaccuacaaguguccucggauaaccgaggcggagccugacgauguggacugcugguguaaugcgaccgauacauggguuaccuacggaaccugcagucagaccggggaacaccgacgcgagaagcgaucaguggcccuggcgccacacguagggcugggccuggagacacgcacagagaccuggaugucauccgagggcgccuggaagcagauccagcgggucgagacaugggcauugaggcacccaggguucacggugaucgcucucuuccuggcucacgccauaggcaccucuaucacccagaagggcauuaucuucauccugcugauguuagugacgcccaguauggccaugcgaugugugggcaucggcagucgcgacuucguagaggggcucaguggcgccacguggguugaugucgugcuagagcacggcucaugugugaccacuauggccaaggacaagccgacucuagacauagagcucuugaagacagaagucacgaacccugcggucuugcgcaaacuuuguauugaggcuaagaucuccaacacgaccacggacagccgcugucccacccagggcgaggccacccucguggaggaacaggacgcuaacuuugucugccgccguaccuuuguggaccggggcugggggaacggcuguggacuauucgguaagggcucccuucugacaugcgcgaaguuuaagugcgugacaaagcucgagggcaagaucguacaauacgagaacuugaaauacucggugauaguaacuguucacaccggggaccagcaccaaguagguaacgagaguacggaacacgguaccacugcgaccauuacgccccaggcccccacgacagaaauucaguugacggacuacggagcccugacacucgacugcucaccacggacaggacuagacuucaaugagaugguccuuuuaacuaugaaggaaaagucuuggcucgugcauaaacagugguuccuggaccuccccuugcccuggaccagcggagccagcaccucccaagagacguggaaucggcaggaccuucucguaaccuucaaaaccgcccacgccaagaagcaggaggucguugugcuaggaagccaggagggugccaugcacaccgcucugacgggugcgacagaaauucaaaccuccgguacgacuaccauuuuugcggggcaccucaagugcagguuaaagauggacaagcuaaccuuaaaggguaugagcuacgucaugugcacggggucguucaaguuggagaaagaaguugcggaaacucaacacgguaccgugcugguacagaucaaguacgagggaacagaugcgcccugcaaaauccccuucucuacucaagacgggaagggggugacgcagaacgggcgucugaucaccgccaacccgauagugaccgacaaggaaaagcccgucaauaucgaggcggagccaccuuucggagaguccuacauaguaaucggcgcaggggagaaggcccucaagcuaagcugguucaagaagggcucgagcauaggaaaaauguucgaggcaacagcccgaggcgcgcgacggauggcgaucuugggugacacggcgugggacuucggcucgaucggcggaguauuuaccagcgucggcaagcucguccaucagaucuucggcaccgcuuacggcgugcuauucagcggugugaguuggaccaugaagauaggaaucggggugcuacucacguggcugggucuaaauucacggagcacguccuuaagcaugacgugcaucgccguaggacugguuacuuuguacuugggaguaaugguacaggcggauuccggcugcguaaucaacuggaaggguagagagcuaaagugcggcuccggcauauucgucacgaacgaggugcacacauggaccgagcaguauaaguuccaggcagacagccccaagcgccuguccgcugccauugggaaggccugggaggagggugucugugggauccgcagcgccacccgucuagaaaauaucauguggaagcagauuaguaacgaacugaaccacauccuacucgagaacgacaugaaauucacugugguagucggcgacguggcgggaauuuuaguucaaggcaaaaagaugauccggccccaaccaauggaguacaaguacagcuggaaguccugggggaaagccaaaaucauuggagccgauguccaaaacucgacguucaucauagacggccccaauaccccggagugucccgacgaccagcgcgccuggaacaucugggaaguggaggacuacggauuugguauuuuuaccacuaauaucugguugaagcuccgggacuccuacacccaggugugcgaccaccgccugaugucagcggcuauuaaagacucaaaagcaguccacgccgacauggguuacuggaucgagagcgaaaagaacgagacguggaagcuagcgcgggcgagcuucaucgaagucaagacgugcaucuggcccaagagccacacccucugguccaacgggguguuagaaagugaaaugaucauccccaagauacacggcgggccgauuucccagcacaacuaccgucccggguacuuuacgcagaccgccggaccauggcaucuggggaagcucgaacuggacuucgacuuaugcgagggcacaaccgucgugguggacgagcacugcggcaaccggggcccaucacucaggacgaccaccgucacggggaagaucauccacgaaugguguugccgguccugcacguugccaccccugcgguuccggggagaagacgggugcugguauggcauggagauccgucccgucaaggagaaagaagagaaucuugugaaguccaugguaucggcggggaguggggaagucgacucuuucucgcucgggcugcuuuguaucagcaucaugauagaggaggugaugcguuccagauggagcaggaagaugcuuaugaccggcacacuagcagucuucuuuuuacuuaucaugggccagcugaccuggaacgaccuuaucaggcugugcaucaugguaggggcuaacgcuuccgaccgcauggggaugggcacuacguaccuggcccucauggccaccuucaaaaugcggcccauguuugccguaggucugcuguuucgccggcucaccagcagggagguccuccugcucacgaucggccugucccucguggccuccgucgaguugcccaacucucuggaagaauuaggugacggccuagcgaugggcaucaugauucuaaaacuccucaccgacuuucaaagcuaccagcuaugggcuaccuuauuaucacugaccuucauaaagacgaccuuuagccuucacuacgccuggaagaccauggccauggugcuaucgaucgucagccuauuccccuugugccucuccacuacgagccagaagaccacuuggcugcccgugcugcucggcucacugggcugcaagccgcuaacuauguuccuuaucgcggaaaacaagaucugggggcgcaaguccuggccuuuaaacgaaggcaucauggcuguggggaucguguccauucugcugaguagcuugcugaagaacgacgucccccucgcaggccccuuaauugccggagggaugcugauagcaugcuacgugaucagcggcagcucggcggaucucagucucgaaaaggccgcugagguguccugggaagaagaggccgaacacagcggggcuucccacaacauccuaguggaagugcaggacgauggaacgaugaaaauuaaggacgaagaacgugacgauacccucaccauccugcugaaggcgacccuccuagcggugagcgggguguauccucugagcauccccgccaccuuguucguguggcacuucuggcagaaaaagaagcagagaucgggcgugcugugggauacuccuagucccccugagguagagagagccgugcuggacgaugggaucuaccgaaucaugcaacgcggccuguuaggccggagccaggugggcgucggcguauuucaggaaaacguguuccacacaauguggcacgucacgcgcggggccgugcuaauguaccaagggaaacgacuugagcccucuugggcuagcgugaaaaaggacuugaucuccuacggcgggggcuggcgcuuccaggggucuuggaacacaggggaggagguccaagugauagccguggagccggggaaaaaucccaagaacguacagacggccccggggaccuucaagacgcccgagggcgaggugggggcgaucgcacucgauuucaagccaggcaccuccggcagccccauugugaaccgggaaggcaaaauagucggccuguacgguaacggcguggucacaaccagcgguacuuaugucuccgcgauagcccaagccaaggccucucaggaggggccgcucccugaaaucgaggacgaaguuuuccgcaagcggaaccugaccaucauggaccuccaccccggguccgguaagacuagaagguaccucccggcuauugugagagaggccauaaaaaggaagcugcggacccuaauucuugcgcccacccgcgucgucgccagcgaaauggccgaggcucugaagggaaugcccaucagauaccagacgacggccgugaaguccgagcacacugggaaggagaucguagaucuaaugugccacgccaccuucacaaugcgccuccuaagccccgugcgggugccgaacuacaacaugaucauuauggacgaggcucacuuuacggaccccagcucgaucgccgcgcgcggcuacauaucaacucgagucgggaugggugaagccgcagcgaucuucaugacggcgacaccucccgggagcauggaggcauucccgcaaucgaaugcuguaauccaagacgaggaacgagacauccccgaacgcagcuggaacuccggauaugaguggaucacugacuucccuggcaagaccguaugguucgucccuucuauuaaggccggcaacgacauugccaacugccugcgcaagaauggcaaacgggucauucaacugucccguaagaccuucgacaccgaguaccaaaagacgaagaacaacgacugggacuacguagucaccacggacauaucagagaugggggcgaacuuccgcgccgaccgggugaucgacccgcgaaggugccugaagccggugaucuuaaaggaugggccagagcgggucaucuuggccggaccuaugccggugaccgucgcguccgccgcgcaacgccgcggucgcauagggcggaaucacaauaaggagggagaccaguacauuuacaugggacagccacucaacaacgacgaagaucacgcgcacuggacggaagcuaagaugcugcucgacaauaucaacacccccgaggggaucauucccgcacuuuuugagccggagcgcgagaaguccgccgcaaucgacggugaauaucgccuccguggcgaagcacgcaagacuuucguggagcucaugaggagaggggauuugcccguuuggcuguccuacaaggucgcauccgaaggcuuccaguacagcgaccggcggugguguuuugacggugagcguaacaaccaaguacucgaggagaauauggauguggagaucuggacgaaggagggcgagcguaagaaacuucguccgcgcuggcuggaugcccggacuuauucggacccgcucgccuuaagagaguucaaggaguucgcugccggacggcggucaguauccggugaccucaucuuagagauugggaaacugccccaacaccugacccagagagcucagaacgcucuggauaaccucgugaugcugcacaauagcgaacagggcgggcgcgcguaccgucacgccauggaggaacucccggacacaaucgaaacccucaugcuguuggcgcugaucgccgugcuuaccggcggagugacacuauucuucuuauccgggaagggcuugggcaaaaccaguaucggccuucugugcgugauggccuccagcgugcugcucuggauggcuuccgucgagccgcacuggauugccgcguccaucauccuggaguuuuucuugaugguucuacugauccccgaaccggaccgucagcgaacgccucaggacaaccaacuggcauaugugguaauuggccuccuguucaugauacugaccguggccgcaaacgagaugggguuacucgagacgacuaaaaaggaccugggcaucggacacguugccgucgagaaccaccaucacgcagccauguuggacguggaccuucaccccgcgucggcuuggaccuuguacgcgguggcaaccacuaucaucacaccgaugaugaggcacacaauugagaauaccaccgccaacaucucgcucacagccaucgcgaaccaggcggccauacugauggggcuggacaagggguggcccaucucaaagauggauaucggggucccccuucuggcccuggguugcuauagccaggugaacccccucacccugacugcggcggugcuaaugcucgucgcccacuacgccaucaucgggccgggccugcaagcuaaggcgacgcgggaagcucagaagcggacagcugccggcaucaugaagaaccccacgaucgacggcaucguggccaucgaucuagauccagugguguacgaugcgaaguuugagaaacagcucggccaaaucauguuauuaauccucugcacaagucaaauucugcugaugcgcaccaccugggcacuuugcgaguccauaacccuggcgaccgggccccuuacgacccugugggaaggcuccccagggaaguucuggaacaccaccaucgcuguuagcauggccaacauuuuccggggcucuuaccuggcgggcgccgguuuggccuucagcuugaugaagagucugggaggcggacgccgcgguacgggagcccagggcgagacccuaggggagaaguggaagaggcagcugaaccagcuguccaagucugaguuuaacaccuacaagcgguccgggauuauggagguugaccguagcgaggcaaaagaggggcugaaacgcggggagaccacaaagcaugccgucucuagggguacggccaagcuccggugguucguggagagaaaccuuguuaagcccgaggggaaagugauugaccugggcugcggucggggcggguggagcuacuacugcgcaggcuuaaagaaggugacggaggugaagggcuacaccaagggcggucccggacacgaggaacccaucccgauggcaacguacggauggaaccucguaaagcugcacuccgggaaagaugucuucuucaucccgcccgagaagugcgacacccugcucugcgacauuggcgaaagcucccccaaccccaccauagaggaggggcgcacccuaagggugcugaaaauggucgaacccuggcucaggggcaaccaauucugcaucaagauccugaaccccuacaugccaagcgugguggagacgcuggagcagaugcaaagaaagcauggagggauguuggucagaaacccccuaucccgcaacagcacccacgagauguauugggugucuuguggcaccgggaacauagugagcgcugucaacaugacgucucgcaugcuccuaaaccgguucaccauggcccaccgcaaacccacguaugagagggaugucgaccugggcgccggcacuagacauguugccguggagccggagguugccaaccuggacauuaucgggcagcgcaucgagaacaucaagcacgagcacaagagcaccuggcauuacgacgaggacaaccccuauaagacaugggcguaucacggcuccuacgaagugaaacccagcggguccgccucauccaugguaaacggagucgucaagcuccuaaccaaaccaugggaugugauccccaugguuacccagaucgcaaugaccgacaccacgcccuucggucagcagcggguguucaaagaaaagguggauacucggaccccaaaagccaagcgggggaccgcccaaauaauggagguaacggcgcgauggcuguggggcuuucucucccggaauaaaaagccccgcauuugcacacgggaagaguucaccagaaaaguuagguccaaugccgcaauuggggccguguuugucgacgagaaccaguggaacucggcaaaggaagccguagaggacgacagauucugggaccugguacaccgugagcgagagcuacacaaacagggcaagugugcgacuuguguguacaacaugauggggaagagggagaagaaacuuggcgaguucgggaaggcuaaagggucaagagccaucugguauauguggcugggagcucgguuuuuagaguucgaagcccugggguucaugaacgaggaccacugguuuuccagagagaacucuuuaucuggcgucgagggggaaggacugcauaagcucggguacauccugcgggacauaagcaagauccccggaggcaacauguacgccgacgauacggccgggugggacaccaggaucaccgaggacgauuuacagaacgaagcgaagauuaccgauaucauggagccggaacacgcccuccuagccaagaguaucuucaagcugacguaccagaauaaggugguucgcguccagcgcccggccaagaacggcaccgugauggacguaaucagucgccgggaccagcgcgggaguggacaggugggaacuuacgguuugaacaccuucacaaacauggaagcacagcugauccggcagauggagagcgaaggcaucuuccugcccaacgagcucgaaaccccaaaucuagcggggaggguacuggauuggcuagagaaguacgguguagagaggcugaagcgcauggcaauauccggagaugauugcgugguuaagccgaucgaugaccgguucgccacagcccucacugcucugaacgauaugggcaaagugcgcaaggacaucccccagugggaacccagcaagggcuggaaugacuggcagcagguaccguucugcucucaccauuuccaccagcugauaaugaaggacgggcgggagaucguggugccgugcagaaaccaggacgaacugguggggagggcacgggugucgcaaggggcagguuggagcuugcgagagacggcgugucucggaaaaagcuacgcgcagauguggcagcucauguacuuccaccgccgggaccuccgccuggccgcgaacgcuauaugcagcgccgugccaguugauugggugcccacaucuaggaccacuugguccauucacgcccaccaucaguggaugacgacggaggacaugcuguccguauggaaccgggucuggauugaggagaaccccuggauggaggauaagacccguauuucuuccugggaagacgugccguaccucgguaaacgcgaggaucaguggugcggcagccuuaucgggcugacggccagagcgacgugggcaaccaacauccaagucgccaucaaucaggucaggagacuaaucgguaaugagaacuacagugacuacaugaccagcaugaagcgauucaagaacgagagugagcccgagggagcccugugguga

SEQ ID NO: 24246 - RNA, 9879 nt, Artificial Sequence
  derived and/or modified CDS sequence (opt11) from DENV-1__FJ461339__SS-prME
ucagugaccaugcuguugaugcugaugccgaccgcccuugccuuccaccugaccacccggggcggggagccgcacaugaucgugagcaaacaggagaggggcaagagccuguuguucaagacuucugcgggggugaacaugugcacacucaucgcaauggaccugggcgaguucugcgaggacacuaugaccuacaagugcccucgcauuacagaagccgaacccgacgacguugacugcuggugcaacgccacagacacgugggugaccuacgggaccugcucccagaccggcgaacaccggagggacaaaaggucgguggcccuggcgccucaugugggccucggucuggagacgcgcacugagacguggaugagcuccgagggcgccuggaagcaaauccagcgggucgagaccugggcccugcgccaucccggcuuuacggugaucgcccucuuccucgcgcacgccaucggcacaagcaucacccagaaggggaucauauuuauucugcucaugcugguaacccccuccauggccaugcggugcgugggcaucgggucccgagacuuuguggaaggccugucaggcgccacguggguggaugucguucucgagcacgggagcugcguuaccaccauggcuaaggacaaacccacccuggacauugagcuccucaagacggaggugaccaaucccgcugugcugcggaagcugugcaucgaggccaaaauuuccaacaccaccacggacagccgaugucccacacagggggaagcaacccucguggaggagcaggacgcaaacuucgucugccggcgcacuuucgucgaccguggcuggggcaacggcugugggcuguucggcaaaggguccuugauuacgugcgccaaguucaagugugugaccaaacucgagggcaagauuguccaguaugaaaaccugaaguacagcgugaucgugacuguccacaccggcgaccagcaccagguggggaacgaguccacggagcacggcaccaccgccaccaucacgccccaggccccaagcaccgagauccagcugaccgacuacggggcacucacucuggacugcaguccccggaccggauuagacuucaaugagaugguccucuuaacgaugaaagagaaauccuggcucguacacaaacagugguuccucgaccugccacugcccuggacaagcggagccuccacuagccaggagaccuggaaucgccaggacuuacuugugacguuuaagaccgcccacgcgaagaagcaggagguagugguguuaggcucccaggagggcgccaugcacaccgccuugaccggggccacggagauccagaccuccggcaccaccacaaucuucgccggucaccugaagugucgauugaagauggacaaguugacccugaagggcauguccuacgucaugugcaccgggagcuucaaauuagagaaggagguggcggagacacagcacggaaccgugcucguucaaauuaaguacgaaggcaccgacgcccccugcaagauccccuucucuacgcaagaugagaagggugugacccagaauggccggcuuaucacugccaaccccauagugacggacaaggagaagcccgucaauauagaagccgaacccccuuucggcgagagcuacaucguaaucggcgcaggcgagaaggcccugaaguuguccugguucaaaaaagggagcuccaucgggaaaauguucgaggcgaccgcccgcggggcccggcgaauggcgaucuugggcgauaccgccugggacuucgggagcaucggaggagucuucacguccguagggaagcuggugcaucagaucuucggcaccgccuacggcgugcuguucucuggcguauccuggaccaugaagaucgggauuggcgugcucuuaaccuggcugggccucaauucacgcuccacgagccuguccaugaccugcaucgccguggggcuggucacucucuaccugggugucauggugcaggccgacagcgguugcgucaucaacuggaagggccgugagcuuaagugugggucagggauauucguaacuaacgaggugcacacuuggaccgagcaauacaaguuccaagcggacuccccgaaacgccucagugccgccauaggcaaggccugggaagaaggagucuguggaauacgguccgccacacgccuggagaacauuauguggaagcagaucagcaacgagcugaaucauauccuccuggagaacgacaugaaacugaccgugguugucggggacguggcgggcauccuugcccaggggaagaagaugauccggccccagcccauggaguacaaauacuccuggaaauccuggggcaaggcaaagaucaucggcgcggacgugcagaacacuacguucauuaucgacggucccaacacucccgagugccccgacgaccagcgcgcguggaacaucugggaggucgaagacuauggauuugggaucuucaccaccaauaucuggcuaaagcugcgggacagccacacccaggugugcgaucaccgccucaugucugccgccaucaaggacuccaaggccgugcacgcagacaugggcuacuggaucgaaagcgagaagaacgagaccuggaagcuggcccgggcuuccuuuaucgaggugaaaaccugcaucuggcccaagucacacacgcuaugguccaacggcguccuugagagugagaugauaauccccaagaucuacggaggcccgauuucccagcacaauuaccgccccggguacuucacacaaaccgccggccccuggcaccuggggaagcuugaacucgacuuugaccugugcgaggguaccaccguggucguggacgagcauugcggaaaucgggggccgagccuacgaacaacuacugugacuggcaagauuauccacgagugguguugccgguccugcacgcucccgccucuuagguuuaagggggaggacgguugcugguacgggauggagauccgucccgucaaggaaaaggaggagaaccuggucaagucgauggugagcgccggcuccggcgaagucgacucuuuuucacucgggcugcuguguaucagcauaaugaucgaagaggugaugcgcucccgguggagccgcaagaugcucaugaccggcacccuggccguguucuuccugcucaucauggggcaauugaccuggaacgacuugaucagacucugcaucauggucggugcgaaugccuccgaccgaauggggaugggcacgaccuaccuggcuuugauggccaccuucaagaugcgcccgauguucgccgucggccuucuuuucagacgccucaccagccgggagguguuacugcugacgaucgggcucuccuuggucgccuccguggagcugcccaacucgcuagaggagcugggcgacgggcuggccaugggcaucaugauacucaagcuacugacugauuuccagccccaccagcuuugggccacccuucuguccuugacuuucauucggacaaccuucagucuccauuaugcauggaaaaccauggcuaugguacugagcaucguaucucucuucccccuuugucugagcacaacgucccaaaagaccaccuggcucccggugcuccugggcagccuuggcugcaaaccauugacgauguuccugaucgcagagaacaagaucuggggaagaaagucauggccccucaacgagggcaucauggccgucggcauugugucaauccugcucucuucgcuccugaagaacgacguaccccuagccggaccgcuaaucgccgggggcaugcuaauugcguguuacguaaucucgggguccagcgccgaccugucccucgagaaggccgcggaggugagcugggaggaggaggccgagcauuccggcgcaagccauaacaucuugguggaagugcaagacgacggaacgaugaagaucaaggacgaggagcgcgacgacacacugaccaucuuauugaaagccacacuguuagccguauccggcguguacccccugaguauccccgcgacacucuucgucugguacuucuggcagaagaagaaacagcgguccgguguacugugggacacgccgagcccgccugagguggagcgcgcaguucuagaugacggcaucuaccggauuaugcagcgaggucugcuggggcggucccaggugggcguaggggucuuccaggagaacguuuuccacacgauguggcacgugacccgcggcgcgguccucauguaucaggggaagcgacuggaaccuagcugggcuuccgugaagaaggaccugaucagcuacggcggcggguggcgccuacagggcuccuggaauacaggugaggaggugcaggucauagccguggagcccggcaaaaacccgaagaauguacagacggcccccgguaccuucaagaccagcgagggagaggucggcgccaucgcauuggauuucaagccggggaccuccggcucgccuaucgugaaccgggaagggaagaucguuggccuguacggcaacggagucgugacgaccagcggcaccuacguuuccgccaucgcccaggcuaaggcgucacaggaggggccauugcccgagauugaggaugaggucuuccgcaagcgaaaccugaccauaauggaccugcaccccggcuccgguaagacgcgacgguaucuaccggccaucgugcgcgaggccauuaagcgccgccugcgcacccucaucuuagcccccaccagggucgucgccagcgagauggcggaggcccugaaaggcaugcccauccgauaccagaccacggccgugaaguccgaacacaccggcaaggagauuguggaccugaugugccaugccaccuucacaaugaggcuccugagcccgguccgcgugccgaacuauaacaugaucauuauggaugaggcccacuucacggacccauccagcauugcggcccguggguacauuuccacccgcgugggcaugggggaagccgccgcgauuuucaugacagcgacgccgcccgggagcguagaggcguucccgcagucgaacgccgugauacaggacgaggagcgggauauccccgagcgcagcuggaacuccggguacgaguggaucacagacuucccuggaaagaccgugugguucguccccagcauaaagagugggaaugacaucgccaacugccugcggaagaacgguaagcgcgugauacaacuaagccgcaagaccuucgacaccgaguaccagaaaacgaagaacaacgacugggauuacgugguuaccaccgacaucucggaaaugggggcgaacuuucgcgcugaucggguuaucgacccgagacggugucugaagccagugauccugaaggacggcccggagagggucauucuugccggccccaugccagugaccguugccagcgccgcucagagacgcgggcggauaggccgcaaucacaacaaggagggcgaccaguacauuuacauggggcagccccugaacaacgacgaggaccacgcccacuggacggaggccaagaugcuguuggacaacaucaacacaccugaggguaucauacccgcucuguucgagccggagcgcgagaagucugccgccauugacggggaguaucggcuaagaggugaggcccgaaaaacuuucgucgagcugaugagacgcggagaccugccuguguggcugagcuacaaggucgccucggagggcuuucaguacuccgaccgccggugguguuuugacggcgaacguaacaaccaggugcucgaggagaacauggacguggaaaucuggacuaaggagggggaacguaagaagcuacguccucgguggcuggacgcgcgcacguacagcgaccccuuggcuuugcgggaguucaaggaguucgcggccggccgcaggucggugagcggggaccuaauccuggaaaucggcaagcugccacagcaucugacgcagcgugcccaaaacgcccucgacaaccugguuauguugcacaacuccgagcagggcgggcgagcguaccgccacgccauggaggagcucccagacaccaucgagacccugauguuacucgcccuuauugccguccugacggguggggucacccuuuucuuccugagcggccgggggcuggggaaaacauccaucggccuccuaugugugaucgcuagcagcgugcucuuauggauggcgagcguggagccccauuggauugccgccuccauaaucuuagaguucuuccugaugguguuacugauucccgagccagaccgccagcggacgccccaggauaaucagcuggcguacgugguuauuggucuccuguucaugauccugacgguggccgcgaacgagaugggacuucuggagacgaccaaaaaagacuuggggaucgggcacguggccgucgagaaccaccaccacgccgccaugcucgacguggaccugcaccccgccagcgcguggaccuuguaugcgguggcgacgacaaucaucacgcccaugaugcgacacaccaucgagaacacgacggccaacaucagucucacggccaucgcgaaccaagcggccauccugaugggguuggauaagggauggcccauaagcaaaauggacaucggugucccccugcuagcccuggggugcuauucccaggugaauccccuaacccuuacggcggccgugcuuaugcucgucgcccacuacgccaucauuggcccggggcugcaagcgaaagcuacgcgcgaggcucagaagcggaccgccgccggcauaaugaaaaauccuacaguggaugggauuguggccaucgaccucgaccccgucguguacgaugcgaaguucgagaagcagcucgggcagaucaugcugcugauccucugcacuagccaaauccugcugaugcgcacgaccugggcccucugcgagucuaucacccuggccaccggccccuuaacgacccuaugggaagggagcccgggcaaguuuuggaacacgaccaucgcugugucaauggccaauaucuucagagggagcuacuuggcgggcgucggucuugcuuucagccucaugaagucccucgggggcggccgccgagggaccggggcccagggagagacucuaggcgagaaguggaaaagacagcucaaccagcugagcaaguccgaguucaacacuuacaagcggagcgggauuauggagguggaucgcuccgaggccaaagagggacugaagcgcggggagaccacgaagcacgcggugagccgcggcaccgccaagcuccggugguuuguggagcgcaaucucgugaagcccgaggggaaggugauagaccugggcugcgggcgcggugggugguccuacuacugcgccggccugaaaaaagucaccgaggucaagggguacaccaagggcggccccggccacgaggagcccaucccgauggccacguacggauggaaccucguuaagcugcacagcggcaaggaugucuucuucaucccucccgagaagugcgacaccuuguuaugcgacaucggggaguccagcccaaacccgaccaucgaggagggccgcacccugcgcguucucaagaugguggagcccuggcugcgcggcaaccaguucuguaucaagaucuugaacccauacaugccguccguuguugagacacuggagcagaugcagcggaagcacggcggcaugcuaguucgcaacccacugucucggaacuccacccacgagauguauugggucagcugcgggaccggcaacaucguguccgccgugaacaugaccagccgcaugcugcugaacagauucaccauggcgcaccggaaacccacauacgaacgagacgucgaccugggggcuggcacccggcacguagcuguagagcccgaggucgccaaccucgacaucauuggccagcgcauugaaaacauuaagcacgagcacaaguccaccuggcacuaugacgaggacaaccccuacaaaacgugggcuuaccauggcucguacgaggugaaaccguccggcucagccagcuccauggucaacgguguggucaaguuguugacgaagccgugggacgucauaccaauggugacccagauagccaugaccgauaccacuccauucggccagcagcggguguucaaggagaaggucgacaccagaaccccgaaggccaagcgggggaccgcccaaaucauggaggugacggccaaguggcuguggggauucuugagcaggaauaagaagccgcggauaugcacccgcgaggaguucacgcgcaaggugagauccaacgcggccaucggcgcuguuuucguggacgaaaaccaauggaacagcgccaaagaggcuguggaggacgaacgguucugggauuuaguccaccgcgagcgggagcugcacaagcaggggaagugcgcgaccugcguguauaacaugaugggcaagcgcgagaagaagcugggggaauucggcaaggccaagggguccagggccauaugguacauguggcugggggcccgcuuucuggaguucgaggcgcuaggcuucaugaacgaggaccacugguuuucgcgggaaaacucauuaagcgggguggagggcgaggggcugcacaagcuuggcuauauccuucgcgauaucuccaagauccccggggguaauauguacgcggaugacacggccggcugggacaccagaaucacugaggacgaccugcagaacgaggccaagauuacggacaucauggagccggagcacgcccuccuggccaagagcaucuucaagcugacguaucagaacaaggucgugcgagugcagcgccccgcuaagaauggcaccgucauggacguuaucagccggcgcgaccagcggggauccggccagguggguacuuacggccuuaacacguucacgaauauggaggcccagcugauccgccagauggaaucagaagggaucuucagccccuccgaacuggagacaaguaaccuagccggccggguccuggacuggcuggagaagcacgggguggaacgacucaagcggauggccauuaguggcgaugacuguguugucaagcccaucgaugaccgcuucgcgaccgcacugaccgcccuaaaugacaugggcaaggugcggaaggacaucccgcagugggagcccagcaaggguuggaaugacuggcagcaggucccguucugcagccaccacuuccaccagcucaucaugaaggacggccgcgagaucgucgugcccugcaggaaccaggacgagcugguggggcgcgcccgggucucccagggcgccgggugguccuugcgcgagacggccugcuugggcaaguccuaugcgcagauguggcagcugauguacuuucaccggcgcgaccugagauuagcugccaacgcuaucugcagcgccgugccaguugacuggguccccaccucccgaaccaccuggagcauccacgcccaccaccaguggaugacgaccgaggacaugcugucgguguggaaccggguuuggauagaggagaacccguggauggaggacaagacccacgucagcuccuggggcgacgugcccuaucugggcaagcgcgaggaccaguggugugguagccucaucgggcugaccgcccgagccaccugggcgaccaacauucagguggcgaucaaucaggugcggcgucugcucgggaaugaaaauuaucuggauuacaugaccucgaugaaacgguucaagaacgagagcgacccggagggagccuugugguga

SEQ ID NO: 24247 - RNA, 9879 nt, Artificial Sequence
  derived and/or modified CDS sequence (opt11) from DENV-1__FJ882515__SS-prME
ucggugacaaugcugcuaaugcugaugcccaccgccuuggccuuucaccucacaacccggggcggggagccccacaugaucgugaccaagcaggagcgggggaagagccugcuuuucaagaccagcgccggggugaacaugugcacccucaucgccauggaccuuggcgaguugugugaagacaccaugacguacaagugcccucgcaucaccgaggccgagccugacgauguugacuguuggugcaacgccacggacaccuggguuaccuacggaaccuguagccagacgggcgagcacaggcgcgacaaacggagcguggcacuggcgccccacgugggccuggggcuggagacacguacagagaccuggauguccagcgaaggcgccuggaagcagauccagcgggucgagacgugggcccuccgccacccaggguucaccgugauagcccuauuucuggcgcacgcuaucggcaccuccauuacccaaaaggggaucauuuucauucuccugaugcuggugacgccgucaauggccaugcgaugcgucgguaucggcucccgcgauuucguggaggggcucagcggagccaccuggguggacguugugcuggagcacgggagcugugucaccaccauggccaaggacaaacccacgcuggacaucgagcuucugaagacagagguuaccaaccccgcgguccugcggaagcuuugcauagaggccaagauuagcaacaccacgacagacucccguugcccaacccagggagaggccacccugauggaggagcaggacgccaacuucguuugucgucgcacguucguugaccggggcugggguaacggcugcgggcuguucggaaaggggucacucaucacgugcgccaaguucaagugcgugaccaagcuggagggcaagauugugcaguaugagaaucugaaguauucaguaauugucaccgugcacacgggcgaucagcaccaggucgggaaugaguccacggagcacggcacaaccgcgaccaucacgccccaggcccccacuuccgaaauacagcucaccgacuacggggcccugacccuggauuguagcccccgcacuggcuuggacuucaaugagaugguacugcucaccaugaaagagaagucguggcucguccauaaacaaugguuccuggaccugccgcucccauggaccagcggcgccagcaccucccaggaaacauggaauaggcaggaccugcugguaaccuucaagacagcacacgcgaagaagcaggagguggucgugcucgguagccaggagggcgccaugcacaccgcacuuacgggggccaccgagauccagaccuccggcacaacgacuaucuucgccgggcaccugaagugccgccucaagauggauaaguuaacccugaaaggcaugagcuacgugauguguacgggguccuucaagcuggagaaggaagucgcggagacgcagcauggcacuguuuugguucagaucaaguacgaaggcaccgacgcacccugcaagauacccuucucgacccaggaugagaagggggucacgcagaacggccggcugaucacagcgaacccgaucgucaccgacaaggagaagcccgugaacaucgaggccgagccuccuuucggggagucuuacaucgucauaggcgcgggcgagaaggcgcugaagcucagcugguucaagaaggggagcagcauaggcaagauguucgaggccaccgcucgcggugcccggcgcauggcgauccugggugacacggcaugggacuuugguuccaucggaggcguguucaccagcaucgggaaauuagugcaccagauuuuugggacagccuaugggguccucuucucuggcgucucuuggaccaugaagauugggauuggagugcuacugacguggcucggccugaacucccguagcaccucccugagcaugacuugcauagcagucgggcucguuacccuguaccugggcgugaugguccaggcggacuccgggugcgugauaaacuggaagggccgggaacucaagugcgggagcggcauuuuugugaccaaugagguccacacauggaccgagcaauauaaauuccaggcagauagcccgaagcgucuguccgcagccaucgggaaggccugggaagagggggucugcgguauucggagcgccacccgucuggagaacauaauguggaagcagaucucaaacgagcucaaccacauucuguuggaaaacgacaugaaguucacaguggucgugggagacgugguagguauccucgcgcagggcaaaaagaugauuaggccccagccaauggagcacaaguacagcuggaagucguggggcaaggcuaagauuaucggcgccgaugugcagaacacgacguucaucaucgaugggcccaacaccccggagugcccggacgaccaaagggcuuggaauauaugggagguagaggacuacggauucgggaucuuuacgacgaacauuuggcugaagaugcgggacagcuacacccaggucugcgaccaccgccucauguccgcggccaucaaagacagcaaagccgugcacgccgauaugggcuacuggaucgagucugagaagaacgagaccuggaaguuggcccgggcgagcuucaucgaggugaagaccugcaucuggcccaaaucccacacgcuguggagcaacggcguccuggaguccgagaugaucaucccuaaaauauacgggggcccgaucagccagcacaacuaccgcccgggguacuuuacccagaccgccggccccuggcaccucgggaagcuggagcuggauuucgaccucugcgagggcaccacggugguggucgaugagcacugcggcaaccgggggccgagccugcgcaccacaaccguaacgggcaagaucauccacgaguggugcugccgcagcuguacccugccaccccugcgcuucaagggugaggacggcugcugguaugggauggagauccgaccagugaaggagaaagaggagaaccugguuaaguccaugguaagcgccggaagcggagaggucgacuccuuuagccuggggcuccugugcaucuccaucaugaucgaggaggucaugcgcagccgguggucccguaagaugcugaugaccggcacccuugccguuuuucugcugcucaucauggggcagcugacuuggaacgaccugauccggcucuguaucauggugggcgccaacgcgagcgaucgcaugggcaugggcaccacauaucuggcccugauggccaccuucaagaugcgcccgauguucgccgucgggcuacuguuucggcgauugacaucucgggaggugcuacugcugaccaucggucucucucugguggccuccgucgagcugcccaacucucucgaagagcugggcgacgggcuggcgaugggaauuaugauccuuaagcuacugaccgacuuccaaucccaccaacuuugggccacucuccugagcuugacguucauuaagacuacauuguccuuacacuaugccuggaagacgauggccaugguccuguccaucgucucuuuaaucccccugugccuaagcacgacaucccagaaaaccacguggcugcccgugcugcucgggagccuagggugcaagccgcugacgauguuccucaucgcggagaacaagaucuggggacgcaaguccuggccccugaacgaggggaucauggccgugggcgucgugagcauccuacucuccucccugcucaagaacgacguuccccucgcggggccccuaaucgcggguggcauguuaaucgccuguuacgucauaagcggguccagcgcggaccuguccuuagagaaggccgccgaggugagcugggaggaagaagccgagcacuccggagccagccacaacauucugguggagguccaagacgaugggaccaugaagauaaaggaugaagagcgggacgacacgcucaccauccugcugaaggcgaccuuacuggccgugagcggaguguacccacugagcaucccggccacgcucuuugucugguacuucuggcagaagaaaaaacagagauccggggugcuaugggacacgcccagcccgcccgagguggaacgggccguccuggacgacggcaucuaccgcaucaugcagcggggacuauuaggccgcucacaggugggcgugggcguuuuccaggagaacguguuccauaccauguggcacgugacccggggcgcgguccugauguaucaggggaagcgccuugagcccagcugggcgucaguuaagaaggacuugaucucuuacggcggcggguggcggcugcaaggauccuggaacaccggggaggagguccaggucaucgccguggaacccgguaaaaauccuaaaaacgugcaaaccgccccgggaacuuucaaaacacccgagggagaagucggggccaucgcgcuggauuuuaagcccgggacgagcggcucccccaucgugaaccgcgagggcaagaucguggggcucuacggcaacggggucgugaccacuagcggcaccuacgugagcgcgauagcccaggccaaagcgucgcaggaggggcccuuacccgagaucgaggacgaagucuucaggaagcgcaaccuaacgauaauggaccuccauccaggcagcgggaagacccggcgcuaccuuccggcgauugugcgggaggccaucaagcgcaaacugaggacccucaucuuagcccccacccgcguaguugcuuccgaaauggccgaggcgcuuaagggcaugccaauccgcuaccagacgaccgcuguaaagagcgagcacaccgguaaggagaucguggaccucaugugccacgcuaccuucacgaugcgguuauuaaguccgguccgugugccgaacuacaacaugauuaucauggaugaggcccacuucaccgaccccucaucaaucgcugcacggggcuacaucagcacccgcgugggcaugggggaggccgcugcaaucuuuaugacagccacgcccccuggcuccgucgaagcguuuccgcagagcaacgccgugauccaagacgaggagagggacauacccgaacgcuccuggaauucuggguacgaauggaucaccgacuuucccggcaagaccguuugguucguccccuccaucaagagcggcaacgacauagccaacuguuugcggaagaacggaaagcgugugauccagcuaucgagaaagaccuucgacacggaguaccagaaaacgaagaacaaugacugggacuacguugucaccaccgacauuagcgaaaugggcgcuaacuuucgcgcugaccgggugaucgacccccgccggugccugaaaccugugaucuuaaaggaugggcccgaacgagugauucuggccggccccaugccugucacggucgccuccgccgcccagcgccgcgggcggaucggucgcaaccacaacaaggagggcgaccaguacaucuacaugggacaacccuuaaacaacgacgaggaccacgcucauuggaccgaagccaagaugcuccuggacaacaucaacacccccgagggaaucauccccgcccuguucgagccggagcgggaaaaguccgccgccauugacggggaguaccgucuccgcggcgaggcccgaaagaccuuuguggagcugaugcgccgcggggaucugcccguguggcucuccuacaagguggcuagcgagggguuccaguacagcgaucgccggugguguuuugacggcgagcgcaacaaccaggugcuggaagagaacauggacguggagaucuggaccaaggagggagagagaaagaagcugcgcccccgguggcucgacgcacguaccuacuccgauccccucgcccuucgggaauucaaggaauucgccgccgggcgccggagcguauccggcgaccucauccuugagaucgguaaacucccucagcacuuaacacaacgggcccaaaacgcccuggacaaccuagucaugcuccacaauagugagcagggcgggcgggcauaccgacacgcgauggaggagcugcccgacaccaucgaaacgcugaugcuccuggcccugaucgccguccucaccggaggaguuacucuuuucuuccuuuccgggcgggggcucggcaaaacgucuaucggacuccuaugcgugauggcgucuucagugcuccuguggauggccaguguggaaccccacuggaucgcggccucuaucauacuggaguuuuuccucaugguuuugcugauccccgagccggacagacagcggacgccccaggacaaccagcucgccuacgugguuaucgggcugcuauucaugauccucacgguggccgccaacgagaugggccugcuggagaccaccaaaaaggaccucgggaucggccacguggccguagagaaucaccaccacgccaccauguuagacguggaucuccaccccgccuccgcuuggacgcucuacgcgguggccacgacgaucauaaccccgaugaugcgccacacgauagagaacaccaccgccaacauaagcuugacagcgaucgcuaaccaggccgcuauccugaugggccucgacaagggcuggcccaucucuaagauggacaucggcguccccuuacuggcauuagguugcuacagccaggugaacccuuuaacgcugaccgccgccgugcucaugcuaguugcgcacuacgccaucaucggaccggggcugcaggccaaggccacccgggaggcacagaaacgcaccgcggccgguaucaugaaaaaccccacgguggaugggauaguggccaucgaccucgaccccguuguguacgacgccaaguucgagaagcaacucgggcaaaucaugcugcucauacucugcaccucacaaauccugcucaugcgcaccaccugggcccugugcgaaagcauuacacuggcgaccggcccccucaccaccuugugggaggggagcccuggcaaauucuggaacacuaccaucgcagugaguauggccaacaucuuccgaggguccuaucucgcgggugccggcuuagcguucagccugaugaagucccuugggggcgggcgccgggggaccggugcccagggagagacccucggggagaaguggaagcggcagcuuaaccagcuguccaagagcgaauucaacaucuacaagcgaaguggcauuauggaggucgaccgcagcgaggcaaaggagggcuugaagcgcggggagacgacccgccacgcagugucccggggcacggcgaagcugcgaugguucguggagcggaacuuagucaaacccgagggcaaagugauagaccuggguugcggccgagggggcuggagcuacuacugcgcagggcucaagaaagugaccgaggucaaaggcuacacaaagggggggcccggccacgaggagcccauucccauggccaccuacggguggaaccuggugaaacugcacuccggcaaggacguuuucuuuacgccaccggagaagugugacacccuccugugcgacaucggggagagcuccccgaacccgacgauagaggaggggcggacccugcgcguccucaagaugguagaacccuggcugcgggggaaccaguuuugcaucaagauccugaaccccuacaugcccucaguuguugaaacccucgagcagaugcagcgcaagcacggcggcaugcuggugcguaacccgcuuuccagaaacaguacccacgagauguacuggguuagcugcgguacaggcaacaucguuagcgccgucaacaugacuagccggaugcuccugaaccgauucaccauggcccaccgcaagcccacuuacgagaaggacgucgaucugggggcgggcaccaggcacgucgccguggaacccgagguggccaaccuagauaucaucggccaacgcaucgagaauauuaagcaugagcacaaaagcacguggcauuacgacgaggacaaccccuacaagacaugggcuuaccacggguccuacgaggucaagccaagcggaagugccaguucgauggucaacggggucgugaagcuucugaccaagcccugggacgugaucccuauggucacacagauugcgaugacggacaccacccccuucggccagcagcggguguucaaagagaagguggacacucgcacgcccaaggccaagcgggggaccguccaaauuauggagguuacugcgcgcuggcucuggggcuuccuauccagaaacaagaagcccaggaucugcacccgggaggaguucacgcggaaaguaaggagcaacgccgccaucggcgcggucuucguagacgaaaaucaauggaauuccgccaaggaggccguggaagacgaacgcuucugggaccugguccagaaggagcgggagcuacacaagcagggcaaaugcgcgaccuguguauacaacaugauggggaaacgcgagaagaaacugggggaguucgguaaggcuaaggggagccgggccauuugguacauguggcugggcgcacgcuuccucgaguucgaagcccugggcuucaugaacgaagaucacugguucucccgggagaacagccugucugggguggagggcgaggggcuccacaagcugggcuacauccugcgcgacauuagcaagauccccgguggcaacauguaugccgacgacaccgcgggcugggacacccggaucacggaagacgaccuccaaaaugaggccaagaucaccgacaucauggagccggagcacgcccugcuggccaccuccaucuuuaagcuuaccuaucaaaacaaggucgugcgcgugcaacggcccgccaaaaacgggacugucauggacguuaucucacgccgugaccaacgaggcuccggacaggugggcaccuacggccugaacaccuucaccaacauggaggcgcagcugauccgccagauggagagcgaggguaucuuccucccaucagaguuggagacgccaaaccucgccgaacgggucuuagacuggcuggagaaguacgggguggaacgccugaagcggauggcuauuagcggugacgacugcguugucaagccgaucgacgaccgguucgccaccgcccugaccgcguugaacgacaugggcaaggugcggaaagacaucccccagugggagccguccaaggguuggaacgacuggccccaggugccgcacugcagccaccacuuccaccagcucaucaugaaggacggccgagagauagugguccccugccggaaccaagacgagcuugugggacgagcccggguaucacagggcgccggcuggagccugcgagagaccgccugucugggcaagagcuacgcccagauguggcagcucauguacuuccaccggcgagaccuccggcuggcggccaacgccauauguuccgccgugccugucgacuggguaccgacgagccgaaccacauggucaauccacgcgcaccaucaguggaugaccacggaagacaugcuuucuguguggaaucggguauggauagaagagaacccguggauggaggauaagacucaugucuccuccuggggggauguacccuaccuaggcaaaagagaggaccaguggugcgggucccugaucggccucaccgcccgagccaccugggccagcaauauacagguggccaucaaucaggugcgccgccugaucgggaaugagaacuaccuggacuauaugacguccaugaaacgguucaagaacgaggacgaccccgagggcgcgcuaugguga

SEQ ID NO: 24248 - RNA, 9879 nt, Artificial Sequence
  derived and/or modified CDS sequence (opt11) from DENV-1__FJ882517__SS-prME
agugugaccauguugcuaaugcugaugccaaccgcccuggcguuccaccucacuacccggggcggggagccccacaugaucgucagcaagcaggaacggggcaagagccugcuguucaagaccucagcgggggucaauaugugcacccucaucgccauggaucucggcgaguucugcgaggacacgaugaccuacaaaugcccccgcaucacugaggcugagcccgaugacgucgacugcuggugcaacgccaccgacacgugggugacauacgggaccuguagccagacgggcgaacaccgucgggacaagcgguccguugcccuggcgccccacgugggccucggccuggagacacgcaccgagacuuggaugucguccgagggcgccuggaagcagauccagcggguggagaccugggcccugcgccacccgggguucacggugaucgcccucuuccuggcgcaugccaucggcaccagcaucacccaaaaggggaucaucuucauccugcucaugcuggugaccccuaguauggccaugcgcugcgucggcaucggcucccgcgacuucguugaggggcuguccggggccacguggguggaugucguacuagaacacgggagcugcgucaccaccauggcgaaggauaagcccacccuagauauugagcugcucaagacggaggucaccaaccccgccgugcugcggaaacugugcaucgaagccaagaucuccaauacuaccacggacagucgcugcccgacccagggcgaggccacccucguggaagagcaggacgccaacuucgucugccggcgcaccuucguggaccguggcugggggaaugguugcgggcuguuugguaaagguucccuuaucacgugcgcaaaguucaagugcgugaccaaacucgaggguaagaccguccaauacgaaaacuugaaguacagcgugaucgugacuguccacacgggugaccagcaccagguggggaacgaguccaccgagcacgguaccaccgcgaccaucacgccccaagccccaucgacggagauccagcugacggacuacggggcacucacccuggacugcagcccccggacggggcuggacuucaacgaaauggugcuccugacgaugaaggagaaguccuggcuggugcauaagcagugguuccucgaccugccgcugcccuggaccuccggggccuccaccucucaagagaccuggaaccggaaggaucuccuggugacauuuaagaccgcccacgcgaaaaagcaagaggucguaguguugggcucucaagaaggcgccaugcacaccgccuugacgggggcuaccgagauccagaccagcggcacgaccaccaucuucgccggccaccugaagugucguuuaaagauggacaaacucacccuaaaggguauguccuacgugaugugcacagggagcuuuaagcuggagaaggaaguggcggagacgcagcacgguacgguguuggugcagaucaaguacgaggggaccgacgcccccugcaagauacccuucuccacccaggacgagaagggugucacgcaaaacggcaggcugaucaccgccaauccgaucgugacggacaaggagaagccagucaacauugaggcagagccuccguuuggagaguccuacaucgugauaggggcaggcgaggaggcuuugaagcugagcugguuuaagaaggggagcuccauaggcaagauguucgaggcgaccgcgcgcggcgcccgucgcauggccauucucggcgacacggccugggacuucgggagcaucggugggguguucacgucagucgggaaguuaguccaccagauuuucgggaccgcguacggggugcuguucaguggggucaguuggacgaugaagauugggaucggcguccuccucacguggcugggccucaacucgcgcagcaccagccugucgaugaccugcaucgccguggggcuggugacccuuuaccugggcgugaugguccaagccgauuccgggugcgucaucaacuggaagggacgggagcugaagugcggaagcggaaucuucgucacaaacgaagugcacaccuggaccgagcaguacaaguuccaagcggauuccccgaaacggcucagcgccgcuaucggcaaggcuugggaggaggggguaugcggcauccgguccgccacccgucuggagaauaucauguggaagcagauaagcaacgagcucaaccacauccuccuggagaacgauaugaaguuuaccgugguggucggggacguggcgggcauccuggcucaggggaagaagaugauccggccccagcccauggaguacaaguauuccuggaagaguuggggcaaggccaaaauuaucggggccgacgugcagaacacgaccuucaucaucgacgggccgaauacucccgagugccccgacgaucagcgcgcguggaauauaugggagguugaggacuacggcuucgggaucuucaccacgaauaucuggcuuaagcugcgagacuccuacacccaagugugcgaccaccgcuuaaugagcgcagccauuaaggacucgaaggcggugcaugccgacaugggcuacuggauagagagcgagaagaacgagacauggaagcuugcgcgggccagcuucaucgaggucaagaccugcauuuggcccaagagccacacccuguggucaaauggcgugcuugagagcgagaugaucaucccuaaaaucuaugggggcccgaucucccagcacaacuaccgccccggguauuucacccagacggccggccccuggcaccucgggaagcuggagcucgacuucgaccucugcgagggcaccacaguggugguggacgagcacugcggcaaccgggggccgagccugagaaccaccaccguuacgggcaagauuauccacgaguggugcugccggagcugcacuuuaccuccgcugcgcuucaaaggggaggacgggugcugguacgggauggaaauccggccagucaaggagaaggaggaaaaccuggucaagagcauggucuccgccggcuccggugagguugacagcuucucccuggggcuccugugcaucagcaucaugaucgaggaggugaugcgcagucguuggagccgcaagaugcucaugacgggaacucuggcuguguucuuccugcugauaauggggcagcucaccuggaaugaucugauccgacuguguaucauggucggcgcgaacgccucggaccgcaugggaaugggcaccaccuaccucgcgcuaauggugacuuucaagaugcgcccgauguucgcagucgggcuccuguuccggcgccugacgagccgggaaguccugcuccugaccaucgggcugucccuaguggccagcgucgagcugcccaacagccuggaggagcucggcgacggacuggcgaugggcauaaugauucucaaguuacuaacugacuuccagagccaccagcugugggccacccuccugucccugacguucaucaagaccacauucagucuccauuacgccuggaagaccauggcuaugguacugucaauagugucgcuauucccccucugccugaguaccaccagccagaagacaacguggcugcccguacuccugggcucccuggguugcaagccccucacgauguuccugaucgccgagaauaagaucuggggccgcaagagcuggcccuuaaacgaaggaaucauggccgugggcaucgugagcauuuuauuguccagccuguugaagaacgaugucccacuggcggggccccugaucgccggagguaugcucauagcuuguuacgugauaucagggagcucugcggaccugagccuggagaaggccgcugaggucucgugggaggaggaggcagaacacagcggcgccucccacaacauacucgucgaggugcaagacgacggaaccaugaagaucaaggacgaagagcgugacgauacccugaccauacuccuaaaggcgacccugcuggcuguaagcggcgucuacccgcucuccauccccgccacgcuguucgugugguauuucuggcagaagaagaagcagcgcagcggcgugcucugggacaccccuucaccgcccgaagucgagcgggccgugcucgacgauggcaucuaccgcauaaugcagcggggcuuacugggucgcagccaggugggcgucggggucuuccaggagaacguguuccacaccauguggcacgucacccggggcgcggugcugauguaucaggggaagcgccucgaacccuccugggccuccgugaagaaggaucuuauuuccuacggugggggguggcggcugcagggcagcuggaauacuggggaagagguucaggugaucgccguggagcccggcaaaaauccuaagaacgugcaaaccgccccggggaccuucaagacguccgagggcgaggugggcgccauugcccucgauuucaagcccgggaccagcggcagccccaucgugaauagagaggggaagaucgugggccuguacggaaacggaguggugaccaccuccgguaccuacgucagcgcgaucgcccaggccaaggccucccaggaggggccgcugccggaaauugaagacgaggucuuuagaaagcgcaacuugacgauuauggauuuacaccccggcucggguaagacccgacgcuaccuucccgcgauaguucgggaggccaucaagcgcaagcuccggacgcugaucuuagcccccacccgcgucguggccuccgagauggcggaggcacucaaaggcaugccaauccgcuaccagacgaccgcugucaagucagagcacaccggcaaggagaucgucgaccugaugugccacgcaaccuuuacaaugcgccugcucucuccagugagagugcccaacuacaacaugaucaucauggacgaggcccacuuuacugacccgagcucuaucgccgcgcggggguauaucagcacucgcgucggcaugggcgaggccgcugccaucuucaugaccgccacgccgccuggcuccguggaagcguucccccagucaaacgcagugauucaggacgaggagagggacauccccgagcgcuccuggaacagcggcuaugaguggaucaccgacuuccccggaaaaacagugugguucgugccauccaucaagagcggcaacgauauagcgaacugccuucggaaaaacggcaagcgcgugauccagcuguccaggaagaccuuugacacggaguaccagaagacaaaaaacaacgacugggacuaugucgugaccacggacaucagcgagaugggugccaauuuccgcgcggaccgcgugaucgacccccgccggugccucaagccggucauccugaaagacggacccgagcgagugauacuggccggccccaugcccguuacgguggccuccgccgcgcagagacgcgggcguauaggccgcaaccacaacaaagagggcgaccaguauauuuacauggggcagccgcucaauaacgacgaagaucaugcgcauuggaccgaagccaagaugcuguuagacaacauaaacacccccgagggcaucauccccgcccucuucgagccugagcgggagaaguccgccgccauugauggggaguaccgccuaagaggagaggcgcgcaagaccuucguggagcuaaugaggcguggcgaccucccugucugguuaagcuacaagguggccuccgagggcuuucaguacagcgaccggcgguggugcuuugacggcgagcgcaacaaccaggugcuggaggagaacauggaugucgagauauggacuaaggagggggagcgaaagaaacucagaccccgcuggcuggacgcccgcaccuacuccgacccccuugcccuccgggaguucaaggaguucgccgcuggacgccguagcguuucgggagaucugaucuuagagauaggcaagcucccccaacaucuaacgcagcgcgcccagaacgccuuggacaaccucgugaugcugcacaauagcgagcagggcgggcgggcauaucgccacgcgauggaggaguuaccggacaccaucgagacccuaaugcuucuggcccucaucgccguccugaccgguggggucacgcuguucuuccucuccggccggggucugggcaagacuagcauaggccugcugugcguuauggcgagcagcguucuguuauggauggccucgguugagccccacuggaucgcggccagcaucaucuuagaguucuuccucaugguccugcucaucccggagcccgaccgccaaagaacuccgcaagacaaccagcuggcguacguaguuaucgggcuccuuuucaugauccuuacgguugcggcaaacgaaaugggccuucucgagaccaccaagaaggaccugggcauuggccaugucgcgguggagaaccaucaccaugccgcgaugcuggacguggaucuccaccccgcauccgccuggacccucuacgcagucgcgacgaccaucaucacccccaugaugcgccacaccaucgaaaacacgacugccaacaucagccugaccgccaucgccaaccaggcagcgaucuuaaugggacuggacaagggcuggccgaucuccaagauggacaucggagugccccuguuagcccugggguguuacagccaggugaacccccugacccucacugccgcaguccucaugcugguggcccacuacgccaucaucggccccggucuacaggccaaggcuacacgcgaggcgcaaaaacguaccgccgccggcaucaugaagaacccgacuguggaugggaucguagcuaucgaccuggaccccgugguguacgacaccaaguucgagaaacaacugggccagaucaugcugcucauucuuugcaccucccagauccuccugaugcgcacaaccugggcccugugcgagagcaucacgcucgcgaccggaccccugaccacauugugggaggggucccccggcaaguucuggaacacuacuaucgccguaagcauggcuaacauuuuccgggggagcuaccuggcuggcgccggccuugcguucucccuuaugaaguccuuaggcggcggccgccggggcaccggggcccagggagagacccugggcgagaaguggaagcgccagcugaaccagcuaagcaagagcgaguucaacacguacaagcgguccgggaucauggagguggaccguagcgaggcuaaggagggccuuaagcgcggggaaaccaccaaacacgccgugucccgcggcaccgcaaaguuacguugguucgucgagcgcaaccucgugaagccagaggggaaggucaucgaccugggcugcggccgcgggggguggagcuacuacugcgcugggcugaaaaaaguaacggaggugaagggguacaccaaaggcgggcccggccacgaggagcccauucccauggccacauacggguggaaccuggugaagcuccacuccggaaaggaugucuuuuucauaccacccgagaagugcgacacucugcugugcgacaucggugaaagcucccccaaccccacgauugaagagggucgaacccuccgggugcuuaagaugguggaaccgugguuacgcgggaaucaauucugcaucaaaaucuuaaaccccuacaugcccagcgugguugagacccuggagcagaugcagcggaagcacggcggcaugcuggugcgcaacccccuaagccggaacagcacccacgagauguacugggucucgugcgggaccggcaacauugugagcgcagugaacaugacgagccgaaugcuccuuaaccgguucaccauggcccaucgcaagcccacuuaugaaagggacgucgaccucggggcuggcacgcggcacguggccguugaacccgaggucgccaacuuagacaucaucgggcagcgcaucgaaaacaucaagcacgagcacaaaagcacguggcacuacgacgaggacaaucccuacaagacuugggccuaccacggcucuuacgaaguaaagcccagcggcucagcuuccagcauggucaacgggguggugaagcugcucaccaaaccgugggacgucaucccgauggugacccagauagcgaugacggacacuacccccuucggacagcagcggguguucaaagagaaaguugacacccgcacgccgaaggccaagagggggacugcccagaucauggaaguuacugccaaauggcuguggggcuuucuguccaggaacaagaaaccccggaucugcacgcgagaggaguuuacacgaaaagugcgcagcaacgccgcgaucggggccgucuucguggacgagaaccaguggaacuccgccaaggaggccguggaagacgagcgguucugggaccucguccaccgugagcgggagcuucauaaacagggcaagugcgcgaccugcguguauaacaugaugggcaagagggaaaagaaguugggcgaguucgggaaggccaaggggagccgggccaucugguacauguggcucggcgcgcgcuuccuggaguucgaggccuuaggauucaugaacgaggaccacugguucucccgggagaauagcuuauccgggguugagggcgagggucugcacaagcugggguacauccuccgcgacaucaguaagauccccgggggcaacauguacgcugacgacaccgccgguugggacacuagaauuacggaagacgacuugcaaaaugaagcgaagaucaccgacauuauggagcccgagcacgccuugcucgcgaaauccauuuuuaagcugacauaccaaaacaagguugugcgcgugcagcgcccggcuaaaaacggcaccgucauggacguuaucucucggcgcgaccagcggggcuccggccagguuggaacguacggccugaacaccuucacgaauauggaggcucagcucauccggcagauggagagugaggggaucuucucccccagcgagcuugagacacccaaccucgccggccgggucuuggauuggcuggagaagcacgggguggagcgccugaagcggauggccauuuccggggaugacugcguggucaagccgaucgaugaccgcuucgccacggcucucaccgcccugaacgauaugggaaaggugcggaaggacaucccgcagugggagcccucgaagggcuggaacgacuggcagcaaguccccuucuguagccaccacuuccaccagcugauaaugaaggacggccgcgagauagucguacccugccggaaccaggacgagcucguggggcgcgcccggguaucccagggggcaggguggagccugagagaaaccgcgugucugggaaaaucuuacgcccaaauguggcagcuaauguacuuccaccggcgcgaccugcggcuggcagccaacgccaucugcucugcgguuccgguggacugggucccuacauccaggacgacuuggucaauccacgcccaccaccaguggaugacaaccgaggacauguuguccguguggaaccggguauggaucgaagagaacccguggauggaggauaagacgcacaucagcagcuggggcgacguccccuaccugggcaagagagaagaccaguggugcggcagccugaucgggcucaccgcccgggcaaccugggccaccaacauccagguggcgaucaaccaggugcgccgccugauaggcaacgaaaacuaucuggacuacaugaccuccaugaagagauucaagaaugagagcgacccagagggggcccucugguga

SEQ ID NO: 24249 - RNA, 9879 nt, Artificial Sequence
  derived and/or modified CDS sequence (opt11) from DENV-1__JQ287661__SS-prME
ucggugaccaugcugcucauguuaaugccuaccgcucucgcauuccaccucacaacucggggcggggaaccccacaugauagugaccaaacaggagcggggcaaaucacuucuguucaagacaucggccggggugaacaugugcacccucaucgccauggacuugggcgagcugugcgaagauaccaugaccuauaagugcccgcggaucaccgaggccgagcccgaugacguggacugcuggugcaacgcaacggacaccugggucaccuacgggaccugcucacagacgggcgagcaccgacgcgacaagagaagcguggcccucgcaccacacgugggccuggggcuggagacccggaccgaaaccuggauguccucugagggcgccuggaaacagauucagagggucgagacgugggccuugcgucaccccggguucaccgugaucgcccuguuucucgcgcacgccauagggaccuccaucacccaaaaggggaucauauucauacucuuaaugcucgugacucccagcauggcgaugcgcugugucgggaucggcucgcgcgacuucguggaggggcucagcggcgcuaccuggguggacgucgugcuggagcauggguccugcgugaccaccauggccaaggacaaacccacacucgacauagagcuccucaagaccgaggucaccaaccccgcggugcugaggaagcucugcaucgaggcgaagaucagcaacacuacuaccgacagccgcugccccacacagggcgaggcaacccuaauggaggagcaggaugccaacuucgugugccggcgcaccuucgucgaccggggcuggggaaacggcugcggccuguucggcaaggggagccuaauuaccugcgccaaguucaagugcgucaccaagcuggagggcaagaucguccaguacgaaaaccugaaguacuccguaaucgugacagugcacacuggcgaccaacaucagguagggaacgagagcaccgagcacgggaccacagcaaccaucacgccccaggcccccacuagcgagauucagcucacagacuacggggcccugacccuggauuguagcccucgcacuggccucgacuucaaugagauggugcuccuuacuaugaaggaaaagaguugguuaguccacaagcagugguucuuggaucuaccgcugcccuggaccuccggggcuucaacaucccaggagacguggaaccggcaggaccugcuggugacguucaagaccgcccacgccaaaaaacaagaaguggucgugcucggcagccaggagggcgccaugcacacugcacugacuggcgccaccgagauccagaccucugguacaacaacaaucuucgcaggacaccucaagugcagacucaagauggacaagcuaacgcugaaaggcaugagcuaugucauguguaccgggaguuuuaagcuggagaaggaggucgcggagacccagcacgggaccgugcuggugcaaaucaaguacgagggcaccgaugcucccugcaagauccccuuuagcacucaggacgagaaggggguuacccagaacgggcggcuuaucacugccaaucccaucgugacagacaaagagaaacccgugaacaucgaggcagagcccccguucggggaguccuacaucguaaucggagcaggcgagaaggcccugaaacugucaugguucaaaaagggguccagcaucgguaagauguucgaggccaccgcccguggggcccggaggauggcgauucugggcgacacggcgugggacuucggguccauaggcggcguguucacgagcaucgggaaguuagugcaccaaaucuuuggcaccgcguacggaguccucuucuccggaguuucuuggaccaugaagaucgggaucggcguacuucuaacuuggcuaggcuugaacuccagaucuaccucccuuuccaugaccugcaucgccguaggucucgucacccuguaucugggcgugaugguacaggccgacucuggguguguuauuaacuggaagggccgggaacuuaagugugggagcggcauauucguaacaaaugagguccacacuuggacggaacaauacaaguuccaggcggacagcccgaaacgccuuuccgcggccaucggcaaggccugggaggagggggugugcggcauccggagcgccacgagacuggagaacgugauguggaagcaaauauccaacgagcugaaccacauauugcuggagaacgacaugaaguucacggucguagugggggaugucgucggcauccucgcgcagggcaagaagaugauccguccccagcccauggagcacaaguacagcuggaaguccuggggcaaagccaaaaucaucggcgcugacguccagaacacuaccuucaucaucgacggcccuaacacaccugagugcccagaugaccagcgcgcauggaacaucugggagguggaggacuacggcuucgggauauucacuacgaacaucuggcugaagaugcgggacagcuauacccaggugugcgaccaccgcuuaaugagugcugccaucaaggacagcaaggccgugcacgccgacaugggguacuggaucgaaagugagaaaaacgagaccuggaagcucgccagggcgagcuucaucgaagucaagaccugcaucuggcccaagucccauacccuguggucuaauggugugcuggagucugaaaugauuauccccaagaucuacgguggcccgauuagccagcacaacuaccgcccaggguauuucacccagaccgccggacccuggcaccucgggaagcuggagcuggacuucgaccucugcgagggcaccacgguagucguggacgagcacugcggaaaccgggggccuucgcuccgcaccaccacgguuacgggcaagauuauacacgaauggugcugucggagcugcacccuccccccccugcgcuuuaagggggaggacggcuguugguaugguauggagauccgcccuguuaaggagaaagaagagaaccuggucaagaguaugguuucagccggcaguggagagguagacuccuucagccugggguugcuguguaucuccauaaugaucgaggagguuaugcgcagccgguggucccgcaagaugcugaugacggguacccucgccguguuccugcugcucaucauggggcaguuaacauggaacgaccuuauccgguugugcaucauggucggcgccaacgcgagcgaccgcauggggaugggaacuaccuaccuggcccuaauggcuacuuucaaaaugcgcccgauguuugccgugggauuacuguuccgacgccugacgucccgggagguucuccuauuaacaauagggcuaucauugguggccuccguugagcuccccaacagccucgaagaacugggcgacggacuggcgauggggauuaugauacuaaagcugcugaccgacuuccagucccaccagcucugggccacucuccugagccucacguucaucaagaccacccuaucgcugcacuacgccuggaaaacgauggcuaugguccucucaaucgugagucugaucccacucugccucagcaccaccucacagaagacgaccuggcugcccguguuauuaggcucuuuaggcugcaaaccauuaacgauguuccucauugcggaaaacaaaauuugggggcgcaaguccuggccccuuaacgaggggaucauggccgugggcguggugagcauccugcucagcuccuuacugaagaacgacgucccccuggccgggccucugaucgccggaggcaugcugauugcuugcuacguaauaagcgggaguagcgcggaccucagucuagaaaaggcagccgagguuaguugggaggaggaagccgagcauuccggagcuagccacaauauacuggucgaggugcaggacgaugggacaaugaagaucaaagacgaggagcgggacgacaccuugacaaucuuacugaaggccacccuccuggccguaucuggaguguacccgcucucuauccccgccacccucuucguaugguacuucuggcagaagaagaagcagcgcuccggaguguugugggauaccccuuccccgcccgaaguagagcgggccgugcuggacgacggcaucuaucgcaucaugcaacguggccugcuagggcgcucccaggugggcguagggguauuccaggagaauguauuccacaccauguggcacgucacccggggcgccgugcugauguaccaagggaagcgccuggagcccucuugggcguccgugaagaaggacuugaucucuuacggcggcggguggcggcugcaggggucauggaacacgggggaggagguccaggugaucgcgguggagcccggaaagaacccaaagaacguccaaaccgcgcccgggaccuuuaaaaccccggagggcgaagugggagcgaucgcccuggacuucaaacccgguacgaguggcuccccaaucgucaaccgcgagggcaagauugucggccucuacggcaacgguguggugaccacaagcggcacguauguaagcgccauugcccaggccaaagccucccaagaggggcccuugcccgagaucgaagacgagguauuucggaagcgcaaccucacaauuauggaccuccaccccggcagcgggaagacccgucgcuaccugccggcgaucgugcgggaggccaucaagcgcaagcuccggacucucaucuuggcccccacccgcgucguggccucggagauggcagaggcgcugaaaggaaugccgauuagguaccagaccaccgccgucaaguccgaacacaccgggaaggagaucguagaccucaugugucacgccacauucacgaugcgucugcuguccccggugcgcguaccgaacuacaacaugaucaucauggaugaggcccauuuuaccgaucccucuuccaucgccgcgcgcggguacaucucuacacgugugggcaugggggaggccgcugccauauucaugaccgcuacgccgcccggcuccguggaggcguucccgcagagcaaugccgugauccaagacgaggagcgggacauucccgaaagauccuggaacucugguuacgaguggaucacggacuuccccggcaaaaccguaugguucgugcccuccauuaagagcgggaacgauauugccaacugcuuacgcaaaaacgguaagcggguaauucagcugagccggaagacguucgacacggaguaucagaagacuaagaauaacgauugggacuacgucguuacgaccgacauauccgagaugggcgcuaacuuccgcgcggaccgggugaucgacccgcgccggugccugaagccagugauauuaaaggacgggccugagcgcguuauucuggccggccccaugccagucacgguggccuccgcggcccagcgccgcgggcggaucggccgcaaccauaacaaagaaggcgaccaguacaucuacauggggcaaccucugaacaacgacgaagaccaugcacacuggacugaagccaaaaugcugcuggacaacauuaacacccccgaggguauuauccccgcacuguucgaaccggagcgggagaaguccgccgccaucgacggggaguaccgucucaggggcgaggcaagaaaaaccuucguggagcugaugcgcagaggggaccugcccgucuggcucuccuauaagguggccucagaggguuuccaguauucugaccgacgcuggugcuucgacggcgaacgcaauaaccaggugcuggaagagaacauggacguagaaauauggaccaaagagggggagcggaagaagcuaagaccccggugguuggaugcccgcaccuacagcgacccccuggcgcugcgggaguuuaaggaguucgccgcaggucgccgauccguguccggugaucucauccuggagauaggcaagcugccucagcauuugacccaacgcgcccagaacgcgcuugacaaccuggugaugcuccacaacagcgagcagggcggaagggccuaccggcacgcgauggaggaacugcccgacacuaucgagacguugaugcuccuggcccugauagcaguccucacaggcggagugacccuguuuuuucugucaggccggggguuagggaaaaccagcauaggccugcugugcgugauggccuccagcguccuccuguggauggccagcguagagccccauuggaucgccgccagcaucauccuagaguucuuccugauggugcugcugaucccagagccagaucgacagcggacaccucaagacaaccagcucgccuacguugugaucgggcuuuuguucaugauccucacgguagccgccaacgagaugggauuacuugagaccaccaagaaggaccucgggaucggccacguugcuguggagaaccaucaccacgcuacaaugcuagacguggaucuucacccugccuccgcauggacgcucuacgccgucgccaccaccaucauuacgccaaugaugcgccacacgaucgagaacaccaccgccaauaucagccugaccgcuaucgccaaccaggcugcgauccugaugggauuggauaagggcuggccaauaagcaaaauggacauaggcgugccccuguuagcucuggggugcuauucucagguuaacccgcugacucugaccgccgccguccucaugcugguggcccacuacgccaucaucgguccggggcugcaggccaaggccaccagggaggcccagaaacgcaccgcggccggcaucaugaaaaauccuacaguggaugggaucgucgccaucgaccucgacccggugguguacgacgccaaguucgagaagcagcugggccagauuauguugcucauccuguguaccucccagauccugcucaugcgcaccaccugggccuuaugcgaaagcaucacgcuugcgaccggcccauugaccacccugugggaagggucccccggaaaauucuggaacacgaccaucgccguaagcauggccaacaucuuuagggggucuuaccuagccggcgccgggcucgcguucagccuaaugaagucccucgggggcgggcgccggggcacgggggcacagggcgagacacucggcgaaaaauggaagagacagcugaaucaacuaucuaaaagcgaguucaacaucuacaagcggucugggaucauggagguggaccgcagcgaggccaaggaggggcucaagcgcggagaaacgacccggcaugcagugagccgcggcaccgcgaagcugcgcugguucgucgagcggaaccuggugaagcccgaggguaaggucaucgaccugggauguggcaggggcggcuggaguuauuacugugccgggcucaagaaggugacugaggugaagggcuacacuaagggcggccccggccacgaggaacccauccccauggcgacguacggguggaaucuggugaagcugcacagcggcaaggacgucuucuucacgccgccugagaagugcgacacgcuccugugcgacauaggugagucgucacccaaccccacgaucgaggagggccggacccugcgcgugcucaaaaugguggagcccuggcugcgggggaaucaauucuguauuaagaucuuaaaccccuacaugccgagcguuguggagacccucgaacagaugcagagaaagcacgggggcaugcuggugcggaauccgcugucccgcaauagcacccacgagauguacuggguauccuguggaaccgguaacaucgugagugccgugaauaugacaagccggaugcuccuuaaccguuucacgauggcucaccgcaagcccaccuacgagaaggacgucgaccugggagcgggcacccggcaugucgccguggagcccgaggucgccaacuuggacaucauuggccagaggauagagaacaucaagcacgagcacaagucaacguggcacuacgacgaagacaaccccuacaagaccugggccuaccacggguccuacgaggugaaaccgucugguuccgccagcucaauggucaaugggguagugaagcuguuaacuaagccuugggacgucauccccauggugacacagauagccaugaccgacaccaccccguucggccaacagcggguguucaaggaaaaaguugauacccgaacgccgaaagccaaacgggggacggugcagaucauggaggucacagcccgguggcucuggggauuccugagccggaacaagaagccccgcaucugcacgcgggaagaguuuacgagaaagguccggagcaaugccgccaucggcgcgguuuucguggacgaaaaccaguggaacuccgccaaggaggccgucgaggaugaacgauucugggaucuggugaagaaggagcgggagcuccacaagcaagggaagugugcgaccugugucuacaauaugaugggcaaacgcgagaagaagcugggggaguuuggcaaggcaaaggggagccgggcuaucugguacauguggcucggcgcccgcuuccucgaguucgaagcccugggcuucaugaacgaagaucacugguucagccgggaaaacucucuguccggugucgaaggcgagggcuugcacaaacugggcuauauccugcgggacaucucaaaaauacccggcggcaacauguaugccgacgauaccgcuggcugggacacccgcaucacggaggacgauuuacaaaaugaggccaagaucaccgacaucauggagcccgagcacgccuugcuagcuacauccaucuucaaacucaccuaccagaauaaaguggugcgcguccagcggcccgcuaagaacgguacggugauggacgugaucagccgccgcgaccagcguggcuccgggcaggucggcaccuacggccuaaacacuuucaccaauauggaggcgcagcugauccgucaaauggagucggaggggaucuuccuccccucugaauuggaaacgccgaaccuggccgaacgcgugcucgacuggcuggaaaaauacggcguggagcgccugaagcggauggcgauaagcggggacgacugcgucguaaagccgauagacgaccguuucgcuaccgcgcucaccgcguuaaacgauaugggcaagguacguaaggacaucccccagugggagcccuccaagggguggaacgauuggcagcagguccccuucuguagucaccacuuccaccagcugaucaugaaggacggccgcgagaucgucguaccaugccggaaccaggacgaguuggucgguagagcccgggucucccagggggccgguuggagccuaagagagaccgcgugccugggcaaaagcuacgcccagauguggcagcuuauguauuuccaccgccgcgaucugcgacucgcagccaaugccauauguucugccgugcccgucgacugggugcccaccucuagaaccaccuggaguauccacgcucaucaccaguggaugaccacggaagacaugcuaucuguauggaaucgggucuggaucgaggaaaacccuuggauggaagacaagacccauguguccagcuggggcgacgugcccuaccuggggaagcgugaggaucaguggugcggcucccugauuggcuuaaccgcacgugcgaccugggccucaaacauccaagucgcuaucaaccagguccgccgccugaucgggaacgagaacuaccuagauuauaugacguccaugaaacgcuucaagaacgagggcgaccccgagggagcguugugguaa

SEQ ID NO: 24250 - RNA, 9879 nt, Artificial Sequence
  derived and/or modified CDS sequence (opt11) from DENV-1__FJ882518__SS-prME
agcgugacuaugcugcucaugcugaugccaaccgcccuggccuuccaucucacgaccagggguggggaaccccauaugaucguuaccaagcaggaacgaggcaagagucugcuauucaagaccagcgcgggcgugaacaugugcacccucaucgccauggaccugggcgagcugugcgaggacaccaugaccuacaaguguccucggaucaccgaggcagaacccgacgauguggacugcuggugcaacgcgacagacaccugggugacguacgguaccuguagccaaacgggagagcaucggcgcgacaagcggucuguggcccucgcuccccacgugggacuggggcuggagacaagaacugagacauggauguccagugagggcgcuuggaagcaaauccagcgggucgaaaccugggcguuacgccacccgggcuucacggugaucgcccuguucuuggcacacgccauagguaccuccaucacccagaaggggaucaucuuuauccuccuaaugcuggugacgcccucuauggcuaugcggugcguuggcaucggcucccgcgacuuuguggagggguuguccggugcuaccuggguggacguagugcuugagcacggauccugcgucaccaccauggcaaaggacaagcccacacuggacaucgagcuccugaagacggagguuaccaaccccgcggucuugcggaagcucugcaucgaagccaagauauccaauaccacgacggacucccguugucccacacaaggcgaggcgacacugauggaggaacaggacgccaacuuugucugccggagaaccuucguugaccggggcugggguaauggcugcggucuguucgguaagggcagccucauuacgugcgccaaguuuaagugcgugacgaagcuggaagggaagaucguccaguaugagaaccugaaguacuccgucaucgugacugugcacacgggggaccagcaccagguggggaacgagagcacugaacacggcaccaccgcaaccaucacgccccaggcccccaccuccgagauccagcugaccgacuauggugcacugacucuugacugcucaccaaggacgggccuagauuucaacgagaugguguuacugaccaugaaagagaagaguuggcucguccacaagcaaugguuucuggaucugccgcucccguggaccagcggggccuccaccucccaggagaccuggaaccggcaggaccugcucguuaccuucaagacugcccacgcgaagaagcaggagguggucguccucggcucccaggagggcgcaaugcacaccgcgcugacgggugcuacugagauccagaccuccggcaccaccaccauauucgcggggcaucugaagugucgccuuaagauggauaagcuaacccugaagggcaugagcuacgugaugugcacaggcucuuucaaguuagagaaggagguagcagagacacagcacggaacugugcuggugcaaaucaaauacgagggcacagacgcccccugcaagauccccuuuagcacccaggaugaaaagggugucacgcagaacgggcggcuaaucaccgcaaauccgaucgucaccgauaaagagaagccggugaacaucgaggcagagccacccuucggcgaaucguauaucgucaucggcgcgggcgaaaaagccuugaagcugagcugguucaagaagggcucaagcaucggcaaaauguucgaggcuaccgcccgcggcgcacgaagaauggcgauccugggggacacggccugggacuucggguccguuggcggcguauucaccucggucgggaagcuggugcaccagaucuucggcaccgccuacgggguccuguucuccggcguuuccuggacuaugaagauugggaucggggugcuccucacuuggcuaggccugaacuccaggagcaccucccugagcaugacgugcaucgccgugggacucgucaccuuguaucugggcguaauggugcaggcagacuccggaugcgucaucaacuggaaggggcgcgagcuaaagugcgggagcgggaucuucgugacuaacgaggugcacaccuggaccgaacaguauaaguuccaggccgacagcccgaagcgccuguccgccgcaauagggaaagccugggaggaaggggucugcggcauccgcagcgcaacgagacuagagaacaucauguggaagcaaauaagcaacgagcucaaccacaucuuacuggaaaaugacaugaaguucaccguaguggucggggacguggugggcauacucgcgcaggggaagaagaugauccggccgcaaccaauggagcauaaguauagcuggaaguccuggggcaaggccaagaucaucggggccgacguacagaauacuaccuucauaaucgauggccccagcaccccggagugcccagacgaucaaagggccuggaacaucugggagguugaggacuacggcuucgggaucuucaccacgaacauuuggcugaaacugcgggauuccuacacccaggugugcgaccaccgacucaugagcgcugccaucaaagacuccaaggcuguccacgcugacaugggcuacuggaucgagagcgaaaagaaugaaaccuggaagcuggcgcgggcgaguuucaucgaggugaaaaccugcaucuggccuaagagccacacauuaugguccaacggcgugcuggaaagcgaaaugaucauccccaagaucuacgggggcccgaucagccagcacaacuaccgccccggauacuucacccagacggccggccccuggcaccuggggaaguuggagcuggacuucgaccugugcgagggaaccacggucguggucgacgagcacugcggcaauagggggccgagcuugcggacaacaaccguaacgggcaaaaucauccacgaguggugcugccguuccugcacacugccgccacuacgcuucaaaggggaggacggcugcugguacgguauggagauucgacccgugaaggagaaagaagagaaccucguuaaguccaugguuucggccggcucgggcgagguugacuccuucucccucgggcuauuaugcaucucaaucaugaucgaagaggucaugcggucccgguggagucggaagaugcucaugacaggcacauuagccgucuuccugcuccugaucauggggcagcugacguggaacgaccucauccggcuguguaucauggucggcgccaaugcguccgaccgcaugggcauggguaccacuuaccucgcccucauggccacauuuaagaugcgcccgauguucgccgugggucugcuauucaggcgccuuacuagccgggagguacugcugcucaccaucgggcugucccugguggccuccgucgagcuccccaacucccuggaggaacugggcgacggucucgcaaugggcaucaugaucuugaagcuguugaccgacuuccagucgcaccagcugugggccacccugcucuccuuaacguucaucaagacgaccuuaucccuccacuaugcguggaagacuauggcuauggugcucuccaucgcgagucuguucccccucugucuguccaccaccucucagaagaccaccuggcugcccgugcuccugggcucccucgggugcaagccgcucacgauguuccugaucaccgagacgaaaaucuggggccgcaagagcuggcccuugaacgaggggaucauggccgugggcguggugagcauacugcuguccagcuugcugaagaaugacgucccccuggccgggccccugaucgccggcggcaugcucaucgccugcuaugugaucagugggucauccgcagaucugucgcucgagaaggcugcagagguguccugggaggaggaggccgaacacuccggggcgucacacaacauccuuguugucgugcaggaugaugggaccaugaagaucaaagaugaggaacgcgacgacacccugacgauucuguugaaggccacccugcuggcggucagcgggguguacccgcucagcauccccgccacacuguucgugugguauuucuggcagaaaaagaagcagcgaagcgguguccugugggacacccccagcccgcccgagguagagcgggccguacuggacgaugguaucuaccgcaucaugcaacgaggccuacuugggcgaagucaagucggcguggggguauuccaggagaacgucuuccauacgauguggcacgugaccagaggagccgugcugauguaccaggggaagcgccucgagcccucgugggcgagcgugaagaaggaccugaucucuuacggaggcggguggcggcugcagggaagcuggaacacaggggaagagguccaagugauugcggucgaacccggcaagaaccccaagaacguccagacagcccccgggacauuuaagacccccgaaggugaaguaggcgccaucgcccucgauuucaaaccugggaccagcggaucacccaucgugaaccgugagggcaagauagugggacuguacggcaauggagucgucaccaccaguggaaccuacguguccgcgaucgcccaagccaaagccucgcaggaggggccacugccagagaucgaggacgaaguguuucggaagcguaacuuaaccauaauggaccugcaccccggguccgggaagacacggcgcuaccugccggcgaucguccgggaagcgaucaagcgcaagcuucgaacgcugauccuagcccccacccgcguggucgcuagcgaaauggcagaggcgcugaaggggaugcccauuagguaccagaccaccgcagugaagagcgaacacacgggcaaagagaucguggauuugaugugccacgccaccuuuaccaugcgguuacugucccccgugcgagucccgaacuacaacaugauuaucauggacgaagcacacuucaccgaccccucuuccauugccgcgcgggguuacaucagcacgcggguggggaugggggaggcagccgcuauauucaugaccgcuacgccccccggcagcguggaggcguucccgcaguccaacgccgucauccaggacgaggagcgggacauaccagagcgauccuggaacuccggcuacgaauggaucaccgacuuccccgguaagacagugugguuuguacccagcaucaaguccggcaacgauaucgcuaacugccuccggaagaacgggaaacgcgucauccaacugucucggaagaccuuugacaccgaauaccagaaaaccaagaacaaugacugggacuauguggugacgaccgauauuuccgagaugggcgccaacuuccgcgcagaucggguaauagacccuaggcggugccucaaacccgucauucugaaggacgggccugagcgcguaauccuggcuggcccuaugccugugaccguggccucagccgcacagcggcgcgggcggaucggccgcaaccauaacaaagagggcgaccaguacauauauauggggcaaccccucaacaacgaugaggaccacgcgcacuggacagaagccaagauguuauuggacaacauuaauacccccgagggcauaauccccgcucuuuucgagccggaacgggagaagagugccgccaucgauggagaguaccgccugcgcggcgaagcgagaaagacauucguugaacugaugcggcguggugaccuucccguguggcuaagcuacaaggucgcaagcgagggcuuucaguacuccgaucggcgguggugcuucgacggugagaggaacaaccagguccuggaggagaauauggacgucgagauuuggaccaaggagggggagcgaaagaaacuacgcccacggugguuagacgcacgcaccuauucggacccccuggcgcuccgggaguuuaaggaauucgccgcgggccgccgcuccgugucgggagaucucauccuggagaucggcaagcucccgcagcaccugacgcagcgcgcccagaaugcucuggauaaccucgucauguugcacaacuccgaacaaggcggccgggccuaccgccacgccauggaggaacugccagacacgaucgagacgcuaaugcugcuggcacucauugcagugcuaacugggggggugacucuguuuuuccucucuggccggggucuggguaagacauccaucggccugcucugugugauggccagcucuguacugcuguggauggcgagcguggagccccacuggauagcggcguccauaauccucgaguuuuuccuuaugguacuacucauucccgagcccgaccgccagcggacuccucaagacaaccagcuggccuacguggugauagggcuacuauucaugauccuuaccgucgccgcuaaugagaugggccuguuggagaccacgaagaaagaccuggguaucggccacguggcgguagagaaucaccaccacgcaaccaugcuggaugucgaucuccauccggccagcgccuggacccuguacgccguugcgacgacgauuaucacuccgaugaugcgccacaccauagagaacacgacggcuaacaucucccugaccgccaucgcuaaccaggcggcuauucucaugggcuuagacaaaggcuggccaaucagcaagauggacauugguguaccccugcucgcccuggggugcuacucccaggucaacccccugacccucaccgccgccguguuaaugcuuguggcgcacuacgcaaucaucgggccaggacuccaggccaaggccacgagggaggcccagaagcgcacugccgccggcauuaugaagaacccaaccguugaugguaucguggcuaucgacuuggaccccguagucuacgacgcgaaguucgagaagcaacuuggccaaauaaugcuauuaauccuaugcaccagucagauccucuuaaugcggacgacaugggcgcugugcgagucgaucacccucgcgacuggcccccugacgacucuuugggagggaagccccggcaaguucuggaacaccacgaucgcagugucuauggccaacauauuccgggggucauaccucgccggcgccgggcuggccuucagccugaugaagucccucgggggcgggcgcaggggcacaggggcccagggagagaccuuaggcgagaaguggaaacgccagcugaaccagcuaucaaaguccgaguuuaacaucuacaagcgaucugggaucauggaaguagaccgcuccgaagccaaggagggccugaaacguggggagacgacgcgccacgccgucucccggggcacggccaagcugcgcugguucguggaacggaaucuggugaagcccgagggcaagguaaucgaccucggcugugggagagggggcuggucguacuacugugcugggcugaagaaggugaccgaggugaagggguauacaaagggcgggcccggccacgaagagccaauccccauggccaccuacggguggaaccucgucaaacugcacucaggcaaagacguguucuucacgccgccggagaagugcgacacgcuucugugcgacaucggggaguccagcccgaacccgacuaucgaagaagggagaacccuccguguucugaagauggucgagcccuggcuacgagggaaucaguuuugcaucaagauucucaacccuuacaugcccuccguggucgaaacucuggagcaaaugcagcgcaagcacggggggaugcuuguucggaacccgcuuagccgcaacuccacgcaugagauguacugggugaguugcgguaccggaaauaucguguccgcugucaacaugaccagccggaugcuguugaaccgcuuuaccauggcccaccgcaaacccacauaugagcgugacguggaccucggggccggaacccgccacguagccgucgaaccagagguggccaaccuggacauuauaggccaacggaucgagaacaucaagcacgagcauaaguccaccuggcacuaugacgaggacaaucccuacaagacuugggccuaccacgggagcuacgaagugaagccgucuggaagcgccucuucaauggucaacgggguagugaagcucuuaacgaagcccugggacgucauccccauggugacccagauagcgaugaccgacaccacgcccuucggccagcagcgggucuucaaagagaagguugauacccggaccccgaaggccaagcgcggcacagcgcagaucauggaggugacggcgcgguggcuauggggcuuccugagccgcaacaagaagccaagaaucugcacccgcgaggaguuuacgcgaaaagugcgcuccaacgccgcgaucggcgccguauucguggaugagaaccaguggaacagcgccaaggaggccguggaggacgagcgguucugggacuuaguacaaaaggaacgcgaguuacacaagcaggggaagugcgcuaccugcguguacaacaugaugggcaaacgggagaagaagcuuggggaguucgguaaggccaagggcucccgcgccauaugguacaugugguugggcgcccgcuuucuggaguucgaggcucugggcuuuaugaacgaggaucauugguucagccgugagaacucccucaguggggucgaaggcgagggguuacacaagcugggcuacauccuccgggacaucaguaaaauacccgggggcaacauguacgcugacgauacggcaggcugggacacccgaaucaccgaggacgaucugcagaacgaggccaagauuacggauauuauggagcccgagcacgccuuacucgcgacgagcaucuucaaacugaccuaccaaaauaagguggugaggguccagcgcccugcgaagaacgggaccgugauggacgugaucucccgacgggaccagaggggaagcgggcaggucggcacuuacggucugaacacauucaccaacauggaggcccagcugauccgccaaauggaguccgaagguaucuuccuaccaucagagcuggaaacccccaaucuugccgagcgcguacucgacugguuagagaaguacggcguagagcggcucaagcgaauggcuaucucuggggacgacugcgucgugaagccgaucgacgaccgguucgccaccgcccugacggcccugaacgauauggggaaggugcgcaaggacaucccccagugggaaccgucgaagggguggaacgacuggcagcaaguccccuucuguucccaucacuuccaucaacuaauuaugaaggacggacgagagaucgugguuccgugccgcaaucaggacgaguuaguaggccgggcccgcgugagccagggggccggguggucacugagggagaccgccugucucgggaagaguuaugcgcagauguggcaacugauguauuuccaccgccgggaucugcggcucgccgcuaacgcuaucuguagcgcggugcccgucgacugggugcccacgucccggaccacguggagcauccacgcgcaccaucaauggaugacaacagaggacaugcuguccguguggaaucgagucuggauugaggaaaauccguggauggaggauaagacucacgugaguucauggggcgacgugccuuaccuggggaagcgggaggaccaguggugcggcucucucaucggccucacagcccgcgccacgugggccuccaacauccagguagcgaucaaucaggugcgccggcugauuggcaacgagaacuaccucgacuacaugacgucaaugaaacgcuucaaaaacgagggcgaccccgagggagcucuuugguga

SEQ ID NO: 24251 - RNA, 9879 nt, Artificial Sequence
  derived and/or modified CDS sequence (opt11) from DENV-1__FJ882519__SS-prME
agcgugaccaugcugcucauguuaaugcccaccgcccuggcuuuccacuuaacgacccgggguggggaaccgcacaugaucguaagcaagcaagagcggggcaagagccuccucuucaagacgucggccgggguaaauauguguacucucaucgccauggaucugggggaguucugcgaggacaccaugaccuauaagugccccaggauuaccgaggccgagcccgacgauguggacugcuggugcaacgccaccgauacgugggugaccuacgggaccugcagccagacgggggagcaccgucgggacaagcgguccgucgcgcucgcuccccacgugggguuagggcuugaaacgcgaaccgagaccuggauguccucggagggcgccuggaaacaaauucaacguguggagaccugggcccugaggcaccccggguucacggugauagcccucuuccuggcccacgccauagguacuagcaucacccagaaagggaucaucuucauccugcuuaugcuggugaccccuuccauggccaugagauguguugggaucggcucucgggacuucguggagggguuaucuggcgcgacguggguggacguaguacucgagcaugguaguugcgugacuaccauggccaaggauaagcccacccuggacauagagcugcucaagacagagguuacaaaucccgccguacugcggaagcugugcauugaggcuaaaaucuccaacaccaccacggacaguaggugcccgacccagggugaggcaacccucgucgaggagcaggacgccaauuuugucugcaggcgcacuuucguggauaggggcugggggaacggcugcggacucuucgggaaggggucccugaucacgugcgcaaaguucaagugcguuaccaagcucgaggggaaaauugugcaguacgagaaccugaaguauagcgugaucgugacaguccacaccggcgaccaacaccagguugggaacgagaguacggagcacggcaccaccgcgaccauuacgccucaggcccccagcaccgagauccaguuaaccgacuacggggcgcucacccuggacugcagcccccgcaccggccuggauuucaacgaaaugguccuccugacgaugaaggagaaguccuggcuggugcacaaacaaugguuccucgaccuaccguuacccuggacuucuggggcguccacgagccaggagacuuggaaccggaaagaucuacugguuaccuucaagaccgcccaugcgaagaaacaggaggucgugguguugggcucccaggaaggcgcaaugcacaccgcacucacgggggccacggagauccagaccuccgguaccaccaccaucuucgccggccaccugaagugccgccucaagauggacaaguugacacugaaaggcauguccuacguuaugugcaccgggaguuucaagcuggagaaggagguugcggagacccaacacgguaccgugcuaguccagaucaaauacgagggcaccgacgcccccugcaaaaucccuuucuccacccaagaugagaagggggugacacagaacggccggcugauuacggccaacccaaucgugaccgacaaggagaagccggucaacaucgaggccgagccgcccuucggugaaagcuacauagugaucggcgcgggggagaaagcccugaagcuguccugguucaagaagggguccuccaucggcaagauguucgaggccaccgccagaggggcgcggcgcauggcuauccucggggacaccgccugggauuucgggagcaucggcgggguguuuacgucggucgggaagcuggugcaucagaucuucggcaccgcguacgggguucuauucagcggcgucuccuggacgaugaagauugggaucggcguguuacugacauggcugggccuuaacagcagauccacgucacuaucaaugaccuguaucgccguggggcuugucacccucuacuugggggucauggugcaagcggacagcgggugcgucaucaacuggaaggggcgggagcugaagugcgggucaggcaucuucgugacaaaugaggugcacacguggacggagcaguacaaauuccaggcggacucaccgaaacgccucagcgcagccaucggcaaggccugggaagagggagucuguggcauccguuccgccacucgucuugagaauauuauguggaagcagauaagcaacgagcugaaccacauucuccuggagaacgauaugaaguuuaccgucgucgugggggacgucgcgggcauacuggcccaggggaagaagaugauacggccucagcccauggaguauaaguacaguuggaaauccuggggcaaggccaagaucauuggcgcagacguucaaaacacuacuuucaucauugacgggccaaacacgccggagugcccugacgaucagcgcgcguggaauauuugggaggucgaagauuacggcuuugggaucuucaccacaaacaucuggcucaaacugcgggacaguuauacucagguuugcgaccaccgacugaugagugcagcaaucaaggacuccaaggccgugcacgccgacaugggauacuggaucgagucagaaaagaacgaaacauggaaguuagcgagagccucauucaucgaggucaagaccugcaucuggcccaagucgcauacccuguggucuaacggcguucuggagagugagaugauuaucccaaaaaucuauggagggccgauaagccaacacaacuaucgccccggguacuuuacgcagaccgccggccccuggcacuuaggaaaacuggagcuggacuucgaccucugcgaaggcacgaccgugguagucgacgaacacugcggcaacagagggccgagccugcgcacgaccacagugacgggaaagaucauacacgaguggugcugccgguccugcacgcugccgccccuccgcuucaagggggaggacgguugcugguacgggauggagauccggcccgucaaggagaaggaggagaaccuggugaaaagcaugguguccgcgggcucaggggagguagacagcuucagccuggggcuccuguguaucaguaucaugaucgaggaggugaugagaucccguuggagccgcaagaugcucaugacgggcacccucgccguguucuuccugcugauuaugggucaguuaaccuggaacgaccuaauacgccugugcauaauggucggugccaacgcuagugacaggaugggaaugggaacgaccuaccucgcccucauggccacguucaagaugcggccuauguuugccgugggccuccuguuccgaaggcuuacgucccgggagguacugcucuugaccaucgggcugucacucgucgcgagcguggagcugccaaacucccuggaggagcucggcgacggacuagccaugggcaucaugauucugaaacuucugaccgauuuucagagccaccagcugugggccacccuccugucccugacuuuuaucaagacgaccuucucgcuccacuacgcauggaaaaccauggcgaugguccuguccaucgugucccuguucccccucugcuuaucaacgacgucgcaaaagaccaccugguuaccggugcuucuaggcuccuugggguguaaaccgcuaaccauguuccugaucgcagagaacaagaucuggggcagaaaaaguuggccccugaacgaagggauuauggcugucggcaucgugucuauccuccugucaagccugcucaagaacgacgugccgcuggccggcccccugaucgcaggcggaauguugaucgcgugcuaugucaucucagggucaagcgcagaccuaucgcucgagaaagccgccgagguguccugggaggaggaggcugagcacagcggcgcgagccauaauauccucguggagguccaagacgaugggacgaugaagaucaaagacgaagaacgggaugacacccuuaccauacuacucaaggccacucugcuggcggugucuggcguguacccgcucuccauaccugcuacccuguucgugugguacuucuggcagaagaaaaagcagcgcucuggggugcugugggauacgcccagcccgcccgagguggagcgggcaguacucgaugacggcaucuaccggaucaugcaaaggggucugcugggccggucccaagucggcgugggaguauuccaggagaacguguuccacaccauguggcacgugacccgaggcgccguccugauguaccaggggaagcgccucgaacccucuugggcgucgguuaagaaggaucugauauccuacggcggcgguuggcgacuacaaggaagcuggaauacaggggaggaggugcaaguaaucgcuguggagcccggcaagaaccccaaaaacgugcagacugcuccuggcaccuucaagaccuccgagggcgagguuggagccauagcgcuagacuucaagcccgggaccucaggcagccccaucgugaaccgcgaagggaagaucgugggccucuacggcaacggggucgugacgaccucugguaccuacgugagcgccaucgcccaggccaaggcgucccaggaggggccccugccugaaauugaggacgaggucuuccggaagcgcaaccucaccauaauggacuugcaccccgggucugggaagacacggcguuacuugcccgccaucgugcgggaggccaucaagcgcaaguugcgcacccuuauccuagcuccgacacgcgugguagccuccgagauggcggaggcccucaagggcaugcccauacguuaccagaccacggcggucaagagcgagcacaccggcaaggagaucgucgaccugaugugucaugcaacguucaccaugcgucugcucucccccguacgcgugccaaacuauaacaugaucaucauggacgaagcgcacuucacggacccgagcuccaucgcggcccgcggguacauaagcacucgcguggguaugggggaggccgccgccaucuucaugacggcgaccccgccggguuccgucgaggccuucccccagagcaaugccgugauccaggacgaggagcgugauaucccggagcgguccuggaacagcggguacgaauggaucacggacuuucccggcaagaccgugugguucgugccguccauaaagucuggcaaugauaucgccaacugccugcggaagaacgggaagcgcgucauucagcugucccgcaagaccuuugacaccgaguaccagaagacgaagaacaacgauugggauuacguggucacaacugacauaagcgagaugggcgccaacuuucgcgccgaccguguuauagacccacggcggugccucaagccggugauacugaaggaugggcccgaacgcguuauccuggccggcccuaugcccgugacagucgccuccgcggcgcagcgucgcgggcggaucggccgcaaccacaacaaggagggggaccaguacauauacaugggccagccgcucaauaaugacgaggaucacgcccacuggacagaggccaaaaugcugcucgauaacauuaacaccccggagggaaucaucccggcccucuucgagcccgagcgagagaaguccgccgcgaucgauggagaguaucgacugcgcggggaggcccggaaaaccuucguggagcugaugcgccgcggggaccucccgguguggcugaguuauaaagucgcguccgaaggcuuucaguauagugaucgucggugguguuuugacggugagcguaacaaccagguccucgaggagaacauggacguggagaucuggaccaaagagggggaacggaagaagcuccgcccccgcuggcuagacgcccgcacguacuccgacccccuggcccuccgggaguucaaagaguucgcggccggucgucguagcguuucaggggaccucaucuuggaaaucggaaagcucccgcagcaccugacucagagagcccaaaacgccuuggauaaccucgugaugcugcacaacagcgaacagggugggcgggcuuauagacaugccauggaggaguugccagacaccaucgagacccucaugcuacuggcccucaucgcggugcugacgggaggggucacauuguucuuccucuccggccgggggcuaggcaaaaccagcaucggccuacucugcgucauggccuccuccguguuacuguggauggcuuccguggaaccccacuggaucgccgcaucaaucauccuagaguucuuccugauggugcuccugauacccgaaccggauagacagcguaccccgcaagacaaucagcuggccuacguugucauaggucugcuuuuuaugauccugacaguggccgcgaaugagaugggccuguuagagacaaccaagaaggaucugggaaucggucauguggccgucgagaaccaucaccacgcggccauguuagacguggaccuucaccccgccuccgcguggacccuguacgcaguggcaaccaccaucaucacccccaugaugcgccacaccaucgaaaacacgacggccaacaucuccuuaaccgcuauagcgaaccaggccgccauucuaaugggccuggauaagggcuggccgauauccaagauggacaucggggucccgcugcuagcccuaggcugcuacagccaggucaacccccugacccucaccgcggccgugcugaugcuggucgcacacuacgcaauaaucggccccgguuugcaggccaaggcuacgagggaggcccaaaaacggaccgccgccggcauuaugaagaacccgaccguggacggcauaguggccauugaccuggaccccgugguguacgacgcgaaguucgagaaacagcuggggcagauaaugcuuuugauccugugcacgucccagauccuccugaugcgcacgaccugggcacugugcgaaagcaucacccucgccaccggcccccuaacgacccugugggagggauccccuggcaaguuuuggaacaccaccaucgccgugagcauggcaaacaucuuucgugggagcuaccucgcgggcgccggucuggccuucucgcuuaugaaaucacuggguggcggacgccggggcacgggggcccaaggugagacacugggcgagaaguggaagcgccaauuaaaccaacuguccaaguccgaguucaauaccuacaagcgguccgguauaauggaaguggaccgcucugaggcaaaggagggacugaaaagaggggagacgacuaagcacgccguaucgcgcggaaccgccaagcugcguugguucguggagaggaaccucgugaaaccugaaggcaaggugaucgacuuaggcugcggccgcggcggguggucauacuacugcgcagggcuaaagaaggugaccgaggugaaaggguacaccaagggugggccuggccacgaggaacccauacccauggcuacguacggguggaaccuagugaagcuccacucaggcaaggauguguucuuuaucccgccagagaagugugacacgcugcugugcgacaucggggaguccucccccaacccaaccaucgaagagggacgaacacuacggguccugaagaugguggagccguggcugagagggaaucaguuuugcaucaagauccucaaccccuauaugccuucuguugucgaaacacuggagcagaugcaacggcgccacggcgggaugcugguucguaacccacucucccguaauagcacccacgagauguauugggugucaugcgggacgggcaacauagugagcgcggugaacaugacauccagaaugcugcugaaucgcuucaccauggcccaucgcaagccgacguacgagcgggacguugaucucggggccggcacccgacaugucgcuguggaacccgaaguggccaaccuggauaucaucgggcaacggaucgagaauaucaagcacgagcacaagagcaccuggcacuacgacgaggauaaccccuacaagaccugggcguaucacggguccuaugaggucaagcccagcgguagcgcaagcagcaugguaaauggugucgugaaguuauuaacaaaaccgugggacgugauccccauggucacccagaucgccaugaccgacaccacgcccuucgggcagcagcgcguguucaaggagaagguggacacucggacccccaaggccaagcgggggaccgcccagaucauggaggucacggcuaaguggcuguggggcuuucuguccaggaauaagaagccgcgcaucugcacccgggaggaguucacccgcaaagugcggaguaacgccgccaucggcgccguauucguugacgagaaccaguggaacuccgcgaaggaggcaguugaggaugagcgcuuuugggaccucguucaccgggagcgcgagcugcacaagcaggguaagugcgcgacuugcgucuauaauaugaugggcaagcgggagaagaaacuuggcgaguucggcaaagcuaaagggagccgugcgaucugguacauguggcuaggcgcgcguuucuuggaguuugaggcgcugggauuuaugaaugaggaucauugguucucccgcgagaacagccucucuggaguggagggcgaggggcugcacaagcugggauacauccuacgcgacaucucgaagaucccuggaggcaacauguaugccgacgacacugccgggugggacacacggaucaccgaggacgaucuacagaacgaggccaaaauaacugacauaauggagcccgagcacgcacuccucgcuaaguccaucuucaagcugacuuaccagaauaagguggugcggguacagagaccggcaaagaauggaacuguuauggacgucauuagucggcgggaccagcguggcuccggacaggugggcacguacggcuugaacaccuucacgaacauggaagcccagcucauacggcaaauggagagcgaggggaucuucucccccagugagcuggagacgcccaaccuagccggccgcgugcucgacuggcuagagaagcacggugucgagcggcugaagagaauggcgauuuccggcgaugacuguguggugaagcccaucgacgaccgcuucgccaccgcacugacagcccugaacgacaugggcaaggugcguaaggacaucccgcagugggagccuagcaagggcuggaacgauuggcagcaaguccccuuuuguagccaccacuuccaccagcugaucaugaaggacggucgggagauagugguccccugccggaaccaagacgaguugguuggucgggcacgcguaucccagggugcgggguggagcuuacgggaaacagcaugccuggggaagucuuacgcccagauguggcagcucauguacuuccaccgccgggaccuacgccuggccgcgaaugccaucugcagugcgguuccgguggacugggucccgaccagucggaccaccuggucgauccacgcccaccaccaguggaugacgaccgaggacaugcucuccguauggaacaggguguggauugaggagaaucccuggauggaggacaaaacccauaucagcuccuggggagacgugcccuaccugggcaagagagaagaccaaugguguggcagccugaucgggcucacagcacgcgcgacuugggcuaccaacauccaggucgcgauuaaccaggugaggcgguugauuggcaacgagaacuaccucgacuauaugaccuccaugaagagguuuaagaacgagagcgacccggagggggcacucugguga

SEQ ID NO: 24252 - RNA, 9879 nt, Artificial Sequence
  derived and/or modified CDS sequence (opt11) from DENV-1__FJ882520__SS-prME
agcgugaccauguugcucaugcugaugcccaccgccuuggccuuccaccucaccacccggggcggggagccccauaugauaguuagcaagcaggaaaggggcaaaagccugcuguucaagaccagcgccggggugaacaugugcacccucaucgcuauggaccugggcgaacuaugcgaggacaccaugacuuauaagugcccucggaucaccgagguggagccggaugacguggauugcuggugcaacaccacagacaccugggugaccuacgggaccugcagccagacgggcgagcaccggcgcgacaagaggagcguagcccuagcaccgcacgucggccuggggcuggagacccgggcagagaccuggaugagcuccgagggcgcguggaagcagauccagaagguggagaccugggcccuccggcaccccggauucacggugaucgcccuguuccuggcacacgcgaucggcacgagcaucacucagaaagggaucaucuucauacuccugaugcuugugaccccguccauggccaugcgcugcgugggaaucggaucacgggauuucguggaggggcuguccggcgccacguggguggacgugguucuggaacacgggagcugcgucacaacaauggccaaggacaagcccacccucgacauagagcucuugaaaacggaggucaccaaccccgccgugcugcgcaagcucuguaucgaggcgaagaucuccaacaccaccacggauagccggugcccgacacagggggaggccacccugguugaggagcaggacgccaacuucgugugccgccggaccuucguggaccgcgggugggggaacggcugcgggcucuucggcaaggggucucucaucacgugcgccaaguucaagugcgucaccaagcuggaaggcaagaucgugcaauacgagaaucugaaguacagcgugaucgucaccguucacaccggcgaccagcaccaggucgggaacgagaguacggaacauggcaccaccgccaccauuacgccccaggcccccacgucugagauccagcucaccgauuacggggcccugacgcuggacugcucgccccggaccggccucgacuucaacgagauggugcugcugacgaugaaggagaaguccuggcucguccacaagcagugguuccuggaccugccucuccccuggaccagcggcgccuccaccagccaggagaccuggaaccgccaggaccuucuggucacguucaagaccgcccacgccaagaagcaggagguggugguccucggcucccaggagggugcgaugcauacggcucugaccggggccacggagauccagaccucggguacaaccacgaucuucgccgggcaucugaagugccggcucaaaauggacaagcuuaccuugaagggcauguccuacgugaugugcaccgggagcuuuaaguuagagaaggagguggccgagacccaacacggcacggucuuggugcagauuaaguacgaggggaccgacgcgcccugcaagauccccuucuccacccaggacgagaagggggugacccagaacggccgccugaucacggccaacccgaucgucaccgacaaagagaaacccgugaacaucgaggccgaaccgcccuucggggaaagcuacaucgugauuggugccggagagaaggcacugaagcucuccugguucaagaaggguucuaguaucggcaagauguucgaggccaccgcccgcggagccaggcggauggccaucuuaggcgacacugcgugggauuucggaagcaucggcggaguauucacguccguggggaaacuggugcaccagauauuuggcaccgccuacgggguccucuucagcggcguguccuggaccaugaagaucgggaucggcgugcugcuaaccuggcucggccugaauucccgcucgaccagccuguccaugaccugcaucgccgucgggcucgugacccuguaucugggggucaugguccaggccgacagcgggugcgugaucaacuggaagggccgcgagcucaagugcgggagcggaauuuuugugaccaaugagguccacacguggaccgagcaguacaaguuccaggccgacagcccgaagcggcugagcgcugccaucggaaaggccugggaagagggggugugcggcauccgcuccgccacccggcuggaaaacaucauguggcgccagaucucaaacgaguuaaaccacauacugcuggaaaacgacaugaaguucaccguggucgugggugacgugguaggcauccuugcccaggggaaaaagaugauccggccccagccuauggaacacaaauacaguuggaaguccuggggcaaagcuaagaucaucggugccgacgugcagaacaccacguucaucauugacgggcccaacaccccggagugccccgacgaccagcgcgccuggaacauaugggagguggaggacuauggcuuugguaucuucaccaccaacaucuggcugaagcugcgggacuccuauacgcagguaugcgaccaccgguugaugagcgccgccaucaaggacuccaaggccguccaugccgacaugggcuacuggaucgagagcgagaagaacgagaccuggaaacuggcccgggccuccuucauugaggugaagaccugcaucuggcccaagagccacacccugugguccaacggcguccucgaguccgagaugaucauccccaagaucuacggaggcccgaucucccagcacaacuaccgacccggauacuucacacagaccgcgggcccguggcaccuggggaaguuagagcucgacuucgaucugugcgagggcaccaccgugguuguugacgagcacugcggcaaccgggggccgucacugcgcacgaccaccgugaccggcaagaucauccacgaguggugcugccgguccugcacgcugccuccccuccgcuucaagggggaagauggcugcugguacgggauggaaauccggcccgugaaggagaaggaagagaaccuggucaagucuauggucucagccggcucaggcgagguggauagcuucuccuuggggcugcugugcaucagcaucaugaucgaggaggugaugcgcucccgguggagccgcaagaugcucaugaccggcacccuggcgguguucuuccugcucaucauggggcagcugaccuggaacgaucugauccggucuugcaucauggugggcgccaacgccagcgaccgcauggggaugggcacgacguaucucgcucugauggccacauuuaagaugcgcccgauguucgccgucggccuucuguuccggcgccuaaccucccgggaggugcugcuccugacuaucgggcugagccuugucgccuccguggagcugcccaacagccuggaggagcuaggcgacggucuggccauggggaucaugauucugaagcuccugaccgacuuccaguccuaccagcugugggcuacgcuacugagccugaccuucaucaagacgaccuucucgcuccacuaugccuggaagaccauggccauggugcugagcauugucucccugcucccccugugucugagcacuacgucccagaagacgaccuggcugcccgugcuacugggcagccugggaugcaagccgcugaccauguuccugaucgccgagaacaaaaucugggggcgcaagagcuggccccucaacgaggggauaauggcggugggcauagucuccauccugcuguccuccuuauuaaagaacgacgugccccuggccgggccccucaucgccggcggcaugcugaucgcuugcuacgugaucagcggguccagcgccgaccugucccuugagaaagcggccgaggucagcugggaggaggaggccgagcacuccggcgccagccacaauauccugguggaggugcaagacgacgggacgaugaagaucaaggacgaggagcgggacgacacccucaccauccuccugaaggccacccugcuagcggucuccggcguguacccguuaagcauucccgccacccuguucgugugguacuucuggcaaaagaagaagcagcguuccgguguucucugggacacgcccagcccgcccgagguggagcgggccgugcuggacgacggcaucuaccgcaucaugcagcggggccugcuggggcggucccaggucgguguggggguguuccaggagaacguuuuccacaccauguggcacgugaccagaggcgcugugcucauguaccaggggaaacgccuggaacccucuugggccuccgucaagaaagaucugauaaguuacggaggcggguggcggcuccagggcagcuggaacacgggggaggagguccaggucaucgcggucgagcccggcaagaaccccaagaacgugcagacggcccccgggaccuucaagacccccgagggcgaggugggcgccaucgcccuggacuucaaaccagggacuagcggcagccccaucgucaaccgcgaggggaagaucgugggccuguacggcaacgggguggucacgaccuccggcaccuacgugagcgcuaucgcacaggccaaggccucccaggagggcccgcuccccgagaucgaggacgagguguuucggaagcguaaccucaccaucauggaccugcacccuggcagcgggaagacgagacgcuaccucccggccaucguccgggaggcgauaaagcgcaagcugcggacacugauccuagccccuacccgcgugguggccuccgagauggccgaggcccugaaggguaugcccauucgcuaccagaccacggcggugaagagcgagcacacuggccgggagauuguggaccugaugugccacgccacauucaccaugcgccuccugucucccguccgggucccgaacuacaacaugaucaucauggacgaggcgcacuucacggaccccuccuccaucgccgcccgcggauacaucagcacccgggugggcaugggggaggcggccgccaucuucaugaccgccacgccgcccggcucaguggaggccuuuccgcaaagcaacgcggucauccaggaugaggagcgcgacauuccugaacgguccuggaacagcggguacgaguggaucacagacuuucccggaaagacagugugguucgugcccuccaucaagucgggcaacgacaucgccaauugccuccgcaagaacgggaagcgugucauccagcuuucccgcaagaccuucgacaccgaguaccagaagacgaagaacaacgacugggacuauguggugacgaccgacauuagcgagaugggcgcaaacuuccgggcggaccgcgucaucgacccccggcgcugccugaagcccgugauccugaaggacgggcccgagcgggucauccucgcgggaccuaugcccguuacaguggccuccgccgcccagcgccgggggcgcaucggccggaaccacaacaaggagggcgaucaauacaucuacaugggacagccccugaacaacgacgaggaccacgcccacuggacggaggcgaagaugcugcucgacaacaucaacacgcccgaggguaucauccccgcccuguucgagccggagcgcgagaaguccgcagccaucgauggggaguaccgccugagaggcgaggcccgcaagaccuucgucgagcucaugcggagaggggaccugcccguguggcugagcuacaaggucgcguccgagggcuuccaguauagcgaccggcgguggugcuucgacggagagcggaacaaccagguccucgaggagaacauggacguggagaucuggaccaaggagggggagagaaagaagcugcggcccagguggcuggacgcccguaccuauuccgacccacucgcccugcgcgaguucaaggaguucgccgccggccggcgcagcguguccggggaucugauccuagagaucggcaaguuaccccagcaccuuacccagcgagcgcagaaugcccucgacaaccuggucaugcugcacaacuccgagcagggaggacgcgccuaccggcaugccauggaggagcuccccgacaccauagagacccuaaugcuacucgcgcugaucgccgugcugacgggcggggugacccucuucuuccucuccggccgcggguuaggcaagacaucgaucgggcuccugugcgucauggcauccagcgcccugcuuuggauggccuccguggagccacauuggauugccgccagcaucauccuagaguucuuccugauggugcucuugaucccggagccggaccggcagcgcacgccccaggacaaccagcuggccuacgucgugaucggacuccuauucaugaucuugacuguggccgccaacgagaugggccuccuggagaccaccaagaaggaccuggggauuggccacgucgcgguggagaaccaccaccacgccaccaugcucgacguggaucugcacccagccuccgccuggacccuguacgccgucgcgacgacuauuaucaccccgaugaugcggcacaccaucgagaacacgaccgccaacaucagccucaccgccaucgcgaaccaggccgcgauccugauggggcuggacaaaggguggccuauauccaagauggacaucggcgugccccuccuggccuuagggugcuacagccaggugaacccccucacccugacggccgcaguuuugaugcucguggcgcacuacgcaauaaucggcccgggauuacaggccaaggccacccgcgaggcccagaagcgcaccgcggccggcaucaugaagaaccccaccguggacgggaucgucgcgaucgaccuggaccccgugguguacgacgcgaaguuugagaagcaacucggccagaucaugcugcugauccucugcacuucccaaauccuguuaaugcggaccaccugggcucucugcgagagcauuacccuggcgacgggcccccuuacaacccucugggaggggucaccaggcaaguucuggaacaccacgaucgcggucaguauggccaacaucuuccgcggcagcuaccuggccggcgccggccuggcguucucgcucaugaagucgcuagggggcgggcggagagggaccggggcucagggcgagaccuuaggcgagaaguggaagcggcagcucaaccagcugucaaagagcgaauucaacaccuacaagcgcuccgggauaauggaaguggacagaagugaggcgaaggagggccugcgccgcggggaaacuaccaagcacgccgugucccgcggaaccgcgaagcuccggugguucgucgagcgcaaccuggugaaacccgaggggaaagugaucgaccuggguugcggccgcgguggguggagcuacuacugcgccgggcugaagaaagucaccgaggugaagggguacaccaagggcgggcccggccacgaagagcccauuccuauggccaccuacggguggaaccucgugaagcuacacuccggcaaagacgucuucuucaucccgcccgagaagugcgacacccugcucugcgacaucggggagagcucccccaacccgaccaucgaggaaggccgcacgcugcgggugcugaagaugguggagcccugguugcgcgggaaccaauucugcaucaagauccugaaccccuacaugcccagcgucguggagacccuggagcagaugcagcggaaacacggcggcaugcucgugcgcaacccccuuucccggaacucuacccacgagauguauugggucuccugcgggaccggcaacaucguguccgccgucaacaugaccucucgcaugcugcucaaucgcuucacaauggcccacagaaaacccaccuacgagcgugacguggaccugggcgcgggcacccggcacguggccguagagcccgagguggccaaccuggacaucaucggccagcgcaucgagaacauuaagcacgagcauaagagcaccuggcacuacgacgaggacaacccauacaaaacuugggccuaccauggguccuacgaggugaagccgagcggcagcgcauccuccauggucaaugggguagugaagcugcugaccaagcccugggacgugaucccgauggugacccagaucgcgaugaccgacacgacccccuuuggccagcagcggguuuucaaggagaaggucgacacccgcaccccgaaggccaagcggggcaccgcccagauuauggaggucaccgcgcgcuggcugugggguuuccucucgcgaaacaagaagccccgcaucugcaccagggaggaguucacccgcaaagugcggagcaacgccgcgaucggcgccgucuucguggacgagaaccaguggaacuccgccaaggaggcaguggaggacgaacgcuucugggaccugguccaccgugagcgcgagcugcacaaacaggggaagugcgcaacgugcguguacaauaugaugggcaagcgggagaagaagcuuggggaguucggcaaggccaaagggagccgcgccaucugguacaugugguugggcgcucgguuccuggaguucgaggcccucggcuucaugaaugaggaccacugguucucccgggagaacucuuuauccgggguggaaggagaggggcuacacaagcucggcuacauccugcgggacaucagcaagauccccgggggcaacauguacgcggacgacacagcgggcugggacacccgaaucacggaggaugaccugcagaacgaggccaagaucacugacauuauggagccggagcacgcccuccuggccaccuccaucuucaagcugaccuaccagaacaaggucgugcgcgugcagaggcccgcgcgcaacgguacagucauggaugugaucagccggcgcgaccagcggggcagcgggcaggugggcacguacggguuaaacaccuucaccaacauggaggcacagcugauccgccaaauggagagcgaggggaucuucagucccuccgagcuggagacccccaaccucgccgagcggguccuggacuggcuggagaaacacggcguggagcgccucaagcggauggccaucuccggggacgacugcguggucaagcccaucgacgaucgcuucgccacggcgcugagcgcccucaacgacaugggcaaggugcggaaagacauaccccagugggagcccagcaagggguggaacgacuggcagcagguccccuucugcucccaucacuuccaccagcucaucaugaaggacggccgcgagaucgucgugccgugccggaaccaggacgagcuggugggccgcgcccgcgucucccagggggccggcuggucccuucgcgagaccgccugucucggcaaaagcuacgcgcagauguggcaacugauguacuuccaccggcgcgaccugcggcucgcagcaaacgcaaucugcuccgcggugccuguggacugggucccuaccagccgcaccacguggucaauccacgcacaucaccaguggaugaccaccgaggacaugcugucgguguggaaccgcguguggauugaagaaaacccauggauggaagacaagacccacaucucaagcuggggcgacgucccguaccuggggaagcgggaggaucaguggugcgggucccucauuggccugacggccagggccaccugggcaaccaacauccaaguggcgaucaaccagguacggcgucugaucgggaacgagaacuaccucgacuacaugacaucaaugaagcgguucaagaacgagucggaccccgaaggcgcccugugguga

SEQ ID NO: 24253 - RNA, 9879 nt, Artificial Sequence
  derived and/or modified CDS sequence (opt11) from DENV-1__FJ882523__SS-prME
agcguuaccaugcuccuaaugcugaugcccaccgcacuugccuuucacuugacgacgcggggcggugagccacacaugauagucacuaagcaggagcggggcaagagccugcuguucaagaccagugcggggguaaauaugugcacccucaucgcaauggaccugggcgagcugugcgaagacaccaugaccuacaagugcccccggaucaccgaggccgagccggacgauguggacuguuggugcaacgccaccgacacuugggugaccuacgggaccugcagccagacgggcgagcaccggcgcgacaagcggagcguugcccucgcuccccacgugggccugggucuggagacccgaacugagaccuggaugagcagcgagggcgccuggaagcagauccagcggguugagacgugggcucuccgccacccgggguuuaccguaaucgcgcuguuccuugcacacgccaucggcaccuccaucacgcagaaggguaucaucuucauccuccugaugcuggugacccccuccauggcuaugcggugcgucggcaucggcucccgcgacuucguggaagggcucuccggcgccaccuggguggaugucguccuagagcacggcuccugugugaccaccauggcuaaggacaagcccacgcuggacaucgaacuccucaagaccgaggugaccaaccccgcgguacugaggaagcucugcaucgaggccaaaaucaguaacaccacgaccgacuccagaugccccacacagggcgaagcaaccuugauggaggagcaggacgccaacuuugugugccggcgcacguucgucgacaggggcugggggaacggcugcgggcuguucggcaaagggucacucaucacaugugccaaguucaaaugcgucaccaagcuggagggcaagaucgugcaguaugagaaucuaaaguauucggucauaguuacugugcacacaggcgaccagcaucaggugggcaacgagagcacugagcacgguaccaccgcgaccaucacgccccaagcaccgacguccgagauccagcucaccgacuacggggcucucacgcuggacugcagcccccgcacgggccucgacuucaacgagauggugcugcugacaaugaaggagaaauccugguuaguacauaaacaaugguuccuggacuuaccucuccccuggaccagcggugccagcaccagucaggaaacguggaaccggcaggaccugcuggugaccuucaagaccgcccacgcaaagaaacaggagguggucgugcuuggcagccaagagggcgccaugcacaccgcccugacgggggccaccgagauucagacaagcggcaccacuacaaucuucgccgggcaccuuaagugccgccucaagauggauaagcugacccuuaagggcauguccuacgugauguguaccgguuccuuuaagcucgaaaaggaagucgccgagacgcagcacggcaccgugcucgugcagauuaaguacgagggcaccgacgccccaugcaagaucccuuucagcacccaggacgagaagggggucacccagaacggccggcugauaacggccaacccgauagugacugacgaggagaagcccgugaacaucgaggccgagccgcccuucggcgagucguauauagucaucggagcgggcgagaaggcccuuaaguuaagcugguuuaagaagggguccucuauuggcaagauguuugaggcuacggcccgcggagccagacgcauggcgauucuuggcgacacggcgugggacuucgggaguaucgggggcguguucaccuccguggggaagcugguccaccaaaucuucggcacugccuauggggugcuguucagcggagugucguggaccaugaagaucgggaucggcgugcuacugacguggcugggucugaauucucgcuccaccuccuugagcaugaccugcauugccguggggcugguuaccuuguaucugggcgucaugguccaggccgacuccgggugcgugaucaacuggaaggggcgggaacuuaagugcggguccggaaucuucguuacuaacgagguccacacauggacggaacaguacaaguuccaggcggacaguccaaaacgccuguccgccgccaucgggaaggccugggaggagggggugugcggcauccgcucggccacucgccuggagaacaucauguggaagcagaucuccaacgaauugaaccauaucuuauuagagaacgacaugaaguucaccgucguggucggggaugucguugguaucuuggcgcaggggaagaagaugaucaggccccagcccauggaacauaaguauagcuggaaguccugggggaaggcaaaaauaauaggggcggacgugcaaaauaccacauucauuaucgacggccccaauaccccggagugccccgaugaccaacgcgcguggaacaucugggagguggaggauuaugguuucggaaucuucaccaccaacaucuggcugaaguuacgcgauagcuauacccaggugugugaccaccgccucauguccgcggccauuaaggacagcaaggccguccacgccgacaugggcuacuggaucgagucagaaaagaacgagaccuggaagcuggcccgggcguccuucaucgaaguaaagaccugcauauggccaaaaucccauacgcuguggucaaacggcgugcucgagagugagaugauaauccccaaaaucuaugggggcccgauaagccagcauaacuacagacccggguauuucacgcagacugccggccccuggcaccuggggaagcuggaguuggacuuugaucugugugagggcacaacgguggucguggacgagcacugcggcaaccgggggcccaguuuaagaaccaccaccgugacgggcaagauaauucaugaguggugcugucgguccugcacccugccgccacuacgauuuaagggggaggacggcugcugguacgggauggagaucaggcccgucaaggaaaaggaggagaaccuggugaagucgauggugagcgcgggaucuggggaggucgacuccuucagccucgggcugcugugcaucuccaucaugaucgaggaggugaugcgcagccgguggucccgcaaaaugcucaugaccggcacacuggccguguuccuauugcugaucauggggcagcugacguggaaugaccuaauccggcucugcaucauggucggggccaacgccagcgaccgcauggggaugggcaccaccuaccuggcacucauggccaccuucaagaugcgcccuauguucgcagugggacugcuguuccggaggcucacgucccgggagguguuacugcuuaccaucgggcuuagccuggucgccuccguggagcuccccaacagccuggaagaguuaggcgacgggcucgcgaugggcaucaugauccugaaacugcuaaccgauuuucagucccaccagcugugggccacccugcucagccugaccuucaucaaaacgacacuuucccuccacuaugccuggaagaccauggcgaugguccuuagcaucgugucccuguucccccuaugccugagcacgaccucccagaaaaccacguggcugccagugcuccugggcagccucgggugcaagccgcucaccauguuccugaucgcggagaacaaaaucugggggcgcaaguccuggccacugaacgaggggaucauggcuguuggcgugguaagcauccuccugagcucccuguuaaagaaugacgucccccuggccggaccacugauugcaggcggcaugcuaaucgccugcuacgugaucagcggaucuagcgccgaccugucgcuggagaaggcggcggaggugagcugggaagaggaagccgaacacuccggagcgagccacaacaucuuggucgaagugcaggacgacgggaccaugaaaauaaaggacgaggagagagacgacacccugacaauccugcucaaggcgacacuccuggccguuagcggcgucuacccgcucagcauaccggcgacccuguucguaugguacuuuuggcagaaaaagaaacaacgcuccggggugcugugggacacgccuagccccccggaaguugagcgagcagugcuggaugacgguaucuaccgcaucaugcagcggggccuccugggacgcagccagguuggcgucggggucuuccaggagaacguguuucacacgauguggcacgucacgcggggcgccgugcugauguaucaggggaaacgccuggaacccagcugggccucugucaaaaaggaccugauuagcuacggcggcgguuggcggcugcagggcuccuggaacaccggagaggagguccaggugaucgccguggagcccggcaagaauccgaagaacguccagaccgcgcccgggaccuucaagacccccgaaggcgaggugggcgccauagcucucgacuucaagccugggacgagcgguucaccaaucgucaaccgggaagggaagaucguaggccuguacggcaacgguguugugaccaccagcggcaccuaugucagugcgauagcccaggccaaggccucccaggagggcccgcugccggaaaucgaggacgagguguuccggaagcgcaaccucacgaucauggaucugcaccccggaagcgggaagacccggcgcuacuugccggcgauagugcgggaggccauaaagaggaaauugcggacccuuauccuggcccccacccgcgucguggcauccgaaauggccgaggcgcuuaaggguaugcccauccgauaucaaaccaccgccgucaagagcgaacauaccggcaaggaaaucgucgaccugaugugucacgccaccuucacuaugcgccugcucucccccgugaggguccccaacuacaacaugaucauuauggacgaggcccacuucaccgaccccagcuccaucgccgcgcguggauacaucagcaccagggucggcaugggagaggccgccgcgaucuucaugaccgccacgccgcccggcuccguggaggcuuucccgcagagcaacgccgucauacaagacgaagagcgggacauccccgaacgcuccuggaacagcggcuacgaauggaucaccgauuuccccggcaagaccgucugguucgugcccuccauaaagagcggcaacgacaucgccaacugccuucggaagaacgggaagcgcgugauccaacugucccggaaaaccuuugacacggaguaccagaaaaccaagaacaacgacugggacuacguuguaacaacugacaucagcgaaaugggcgcuaauuuucgcgcggaucgggugaucgauccgcggcggugccuaaaacccgucauccugaaggacgguccugagcgcgugaucuuggcgggccccaugccugugacgguggccucggccgcccagcgaagggggcggaucggccgcaaccacaacaaggaaggagaccaguacaucuauaugggacagccacuuaacaacgacgaggaccacgcgcacuggaccgaggccaaaaugcugcuggacaacaucaacacgcccgaggggaucauaccugcacuauucgagccggaacgggagaaguccgcagcaaucgacggggaguauagacugcgaggcgaggcgcguaagacguuuguggagcuaaugcgccgcggggaccucccggucuggcuguccuacaagguggccucugagggauuccaguacagcgacaggcggugguguuucgacggcgagcggaacaaccagguguuggaagagaacauggacgucgagaucuggacgaaggagggugagcguaagaagcuccggccgcgguggcuggacgcccgcacauacucggacccccucgcacuccgggaguucaaagaguucgccgcugggcgcagaagcgucuccggggaccugauucuggagaucggcaaacucccgcaacaccugacacagagggcgcagaaugcccuggacaaccucgugaugcuucacaacagcgagcagggcgggcgggccuaccgccacgcgauggaagagcuucccgauaccaucgagacccucaugcuguuggcccucaucgccguccugaccggcggggugacccuguucuuccuguccggccgggggcuggggaaaaccuccauuggccugcucugcgugauggccuccagcguacugcucuggauggcauccguggagccucacuggaucgcggcaagcaucauacucgaguucuucuugaugguucuccucauacccgagccggaccgccagagaacgccccaggacaaccaacuugcguacgucgugaucgggcuauuauucaugauacugaccguagccgcaaacgagaugggccugcuagagacgacaaagaaggaccucgggaucggacauguugcgguggagaaucaccaucacgccacaaugcuagacguggaccuccacccugccuccgccuggacgcuguaugccgucgcgaccacaaucauaacaccgaugaugcgucacacaaucgagaacacaaccgccaacaucagccucaccgccaucgccaaccaggccgcgauccucauggggcuggacaagggcuggcccaucuccaagauggacaucggcgugccgcuccucgcacucggguguuacagccaggugaaccccuuaacgcucacugccgccguccugaugcuggucgcgcauuacgcuaucaucggcccgggacugcaggccaaggcuaccagagaggcacagaagaggaccgcggcggguaucaugaagaaccccaccguggacgggaucguagccaucgaccuggaucccguaguuuacgaugccaaauucgagaagcaacugggccagauuaugcuccucauccugugcaccucccagauacuccugaugagaaccaccugggcccugugcgaaucaaucacucucgcgacgggcccccugacaacucugugggagggguccccgggcaaguucuggaacaccaccaucgccgucagcauggccaacaucuuucgugggaguuaccucgcuggcgcuggccuugcguucucgcugaugaagucccucgguggugggcgccggggcaccggggcacagggggagacccuuggugagaaguggaagcgccaacugaaccagcucucuaaaagcgaguucaacaucuacaaacguucugggaucauggagguggaccguagcgaggccaaggaaggccuuaagcgcggggagacgacgcgccacgccgugagccggggcaccgcgaagcuucgaugguucgucgagcggaacuuagugaagcccgaagggaaggugaucgacuuaggcugcggacgcgggggcuggagcuauuacugugcagggcugaaaaaggugaccgaggugaagggcuacacgaagggcggaccuggccacgaggagcccauucccauggccacauacggguggaaccuggugaagcuacacuccggcaaggaugucuuuuuuacaccgcccgaaaaaugcgacacacugcugugcgacaucggcgagagcucccccaacccgaccaucgaggagggccggacccucagagugcugaagaugguagagcccuggcucagggggaaccaguuuugcaucaagauccuaaaccccuacaugccaucugugguggagacacuugagcagaugcagcgcaagcauggcggcaugcuggugcggaacccgcugucacguaacucgacccacgagauguacuggguuuccugcgggaccggcaauauagugagcgccgugaacaugacuucccgcaugcugcucaaccgcuucacuauggcccaccgcaagcccaccuaugaacgggacguggaucucggggcgggcacccgccacguggccguggagcccgaggucgccaaccuugacaucaucggccagcggauugagaacaucaagcacgagcacaagagcaccuggcacuacgacgaggacaaccccuacaaaaccugggccuaccacgggucuuaugaggugaagccgaguggcuccgccagcagcauggucaacgggguggugaaguuacucaccaaacccugggacgucauccccauggugacccagaucgcgaugacggacacaacacccuucggccagcagcgcguguucaaggagaaggucgacacaaggacgccuaaagccaagcgcgggaccgcccagaucauggaaguaaccgcccgauggcuguggggcuuccugucccgcaacaagaagccccggauuugcacccgcgaggaguucacacggaaagugcgcagcaacgccgcuaucggcgccguguuuguggaugagaaucaguggaauuccgccaaggaggccguggaagacgaaagguuuugggaccucguccagaaggagcgggagcugcacaagcaggggaagugugcgaccugcguguacaacaugaugggcaagcgugagaagaagcugggggaguucggcaaggccaaggggagccgcgccauuugguacauguggcucggagcccgguuccuggaguucgaggcccuaggcuucaugaacgaggaccacugguucucccgcgagaacagccucuccgggguggagggcgagggguugcacaagcugggauauauccuccgggacaucagcaagauccccggaggcaacauguacgcagacgacaccgccggaugggacacacgcaucacggaagacgacuugcagaaugaggcgaaaaucacugacauuauggaaccggagcacgcccugcuggccaccuccauuuucaagcugaccuaccaaaauaaagucgugcgggugcagcgcccagcgaagaacggaacggucauggacgugaucagccgccgggaccaacgcggcuccggccaggugggcaccuacggccugaacacuuucacuaacauggaggcacagcucaucaggcaaauggagagcgaggggaucuucucccccagugagcuugagaucccgaaccuagccgagcgcguucuagacuggcuggagaaauacggaguggagcgacugaagcggauggccauauccggggacgacugcguggucaaaccgaucgacgaccgguucgccacugcgcucaccgcccugaacgacaugggcaaggugcgcaaggacguaccccagugggagccuuccaaaggguggaaugacuggcagcagguccccuucugcagccaccacuuccaccaguugauaaugaaagacggacgggagaucguggugccgugccgcaaccaggacgagcucguaggccgggcccgcgugagccagggggccggcuggagccugcgggaaaccgccugccuggggaaauccuaugcgcagauguggcagcucauguauuuccaccgccgggacuuacgcuuagccgccaacgccaucugcucagcgguaccuguugacugggugcccaccucccggacgacauggagcauacaugcccaucaccaguggaugaccacggaggauaugcucuccgucuggaaccgagucuggauugaagagaaucccuggauggaggauaagacgcauguuagcuccuggggcgacgugccguaucuggggaaaagagaagaucaaugguguggcagucugaucggccucaccgcccgcgccaccugggccaguaacauccaggucgccaucaaccaggucagaaggcuaaucgggaacgaaaacuacuuagacuacaugaccagcaugaagcgcuuuaaaaacgaaggcgacccggaaggggcccucugguga

SEQ ID NO: 24254 - RNA, 9879 nt, Artificial Sequence
  derived and/or modified CDS sequence (opt11) from DENV-1__FJ882524__SS-prME
agcguaaccaugcugcuuaugcucaugcccacugcccucgccuuccaccucaccacucggggcggggagccacacaugaucgugaccaagcaggagcggggcaagucacuguuguucaagaccagcgcuggggugaacaugugcacccugaucgccauggaucugggcgagcugugcgaagacaccaugacuuacaaaugccccagaaucaccgaagccgaaccagacgacguggacugcuggugcaacgccacagacaccugggugaccuacggcaccugcagccagaccggcgagcaucggcgcgacaagcggagcguggccuuagcgccccaugugggccuggggcuugaaacccgcaccgaaacuuggauguccucugagggagccuggaagcagauccagcggguagagacgugggcccucaggcacccgggguuuaccgugaucgccuuauuucuggcgcacgccaucggcacuuccaucacacaaaagggaaucauauucauccuccugaugcuggugacacccagcauggccaugcggugcguagguaucggcucccgcgauuucguggaggggcucagcggagcaaccuggguagacgucgugcuggaacacggguccugcgugaccaccauggccaaggacaagccgacgcuggacaucgagcuccugaagaccgaggugaccaaccccgcugugcugcggaaguugugcaucgaggccaagauuagcaacaccaccaccgacucacgcugccccacccagggcgaggccacccugauggaggagcaagacgccaacuacguguguaggcguacguucguggaccggggcugggguaacggcugcggguuauucggcaagggcagccucaucacgugcgccaaauucaagugcgucaccaaacuggagggcaagauugugcaguacgagaaccugaaguacuccgucaucgugaccguacacacgggugaccagcaccaggucggaaacgagagcaccgagcacggcaccaccgcgaccaucacgccucaggcccccaccuccgagauccaguuaaccgauuacggggcucugacccuggacugcagcccccgcaccggccuggauuucaacgagauggugcugcugaccaugaaggagaaguccuggcucguccacaaacagugguuccuagaccuuccgcuccccuggaccaguggggccagcaccucacaggagacuuggaaucggcaggaucugcugguuacuuucaagaccgcccaugcgaagaaacaggagguggucgugcucggcagccaggagggugccaugcacaccgcccugacaggggccaccgagauccagaccuccggcaccacaacgaucuucgccgggcaucugaaaugccgacucaagauggauaagcugacccugaagggcaugagcuacgugaugugcaccggguccuucaagcucgaaaaggagguggcggagacgcagcauggcacgguucuggugcagaucaaguacgagggcaccgacgcccccugcaagaucccuuucagcacccaggacgagaaaggagucacgcagaacggccggcugaucaccgccaacccgaucguaaccgacaaagagaagcccgugaacaucgaggccgagccgcccuucggggaguccuauaucguaaucggcgcaggcgagaaggcccugaagcucagcugguucaagaaaggaucuaguaucggcaagauguucgaagcaaccgccagaggggcacggaggauggcgauccugggcgacacggccugggacuucgggucuauaggcgggguguucaccagcgugggaaaacugguccaccagaucuucgggaccgccuacggcguccuguucuccggagugucuuggacuaugaaaauagggaucggcguucuccugacguggcucggcuugaacucccgcagcaccucccuaagcaugaccugcaucgcgguggggcucgugacccuguauuuaggcgucauggugcaggccgauuccgggugcgugaucaacuggaaaggucgggagcuuaagugcgggagcggcaucuuugucacgaacgaagugcacaccuggacagaacaguacaaguuccaagcggacucgccgaagcgccugucugcugcgaucgggaaggccugggaggagggggugugcggcauucggagcgccacucgccuagagaauaucauguggaagcagaucuccaaugaguugaaccacauccugcuggagaacgacaugaaguuuaccgucgucgugggugacgucgugggcauccucgcacaggggaagaaaaugauucggccacagccaauggagcacaaguauagcuggaaguccuggggcaaggcuaagaucaucggcgccgacgugcaaaacacgacuuucauaaucgacgggcccaauacuccggaaugccccgaugaucaacgcgccuggaacauaugggagguggaggauuacggcuucgggaucuucaccacgaacaucuggcugaaguuacgggacagcuacacccaagugugcgaccaccgccucauguccgcggcaaucaaggacuccaaggcggugcacgccgacaugggcuacuggaucgagucugagaaaaacgagacguggaagcuggcccgggccagcuucauagaggucaaaacuugcaucuggcccaaaucccacacguuauggagcaacggcguguuggaguccgagaugaucauccccaagauuuauggggggccuaucagccagcacaacuaccgccccgguuacuucacacagaccgccggccccuggcaccuggggaagcuggagcucgacuucgaccugugugagggcaccacgguugucguugacgagcacugcggcaaccgggggcccucccugcgcaccaccaccgugacgggcaagaucauccacgaguggugcugcaggagcuguacccugccgccccuccgcuucaagggggaggacggcugcugguaugggauggagauccggcccgucaaggaaaaggaggagaacuuagugaaguccauggugagcgcgggcuccggcgaggucgacuccuuuagccucggccugcugugcauuuccaucaugaucgaagagguaaugcgcagccgguggucccgcaagaugcucaugacuggcacccuggccguguuccugcuccuuaucauggggcagcugacguggaacgaccuuauccggcugugcauaaugguaggcgcaaacgcgagcgacaggauggggauggggaccaccuaccuggcccucauggccaccuucaagaugcgcccgauguuugccguugggcugcuguuccggcgccucacgucccgggaggugcugcuguuaaccaucgggcugagccuggucgccagcguggagcuaccaaacagccuggaggagcugggcgacggucuggcgaugggcaucaugauuuuaaaguuacucacugacuuccaaagccaccagcugugggcaacccugcugagccuuacguucaucaagaccacccugagucuucacuaugccuggaagaccauggcgaugguccugaguaucgugucccuguuucccuuaugccugagcacgacaagucagaagaccaccuggcugcccgugcuccucggcucgcuggggugcaagccccucacgauguuccuaaucgcugagaauaagaucugggggcgcaagucuuggccacuaaacgaggggaucauggccgucggcguugugucgauccuccugagcucccugcucaagaacgacgucccccuagccgggccccugaucgccggaggcaugcucaucgccugcuacguaaucagcgggucuagcgcggacuuaaguuuagagaaggccgccgaagugucaugggaggaggaggccgagcacuccggcgcaagccacaacaucuuagucgaggugcaggacgacgggacaaugaagaucaaggacgaagagcgggacgacacccugacaauccugcuaaaggcgacccugcuggccgucuccggcgucuacccgcucagcauccccgcaacgcuauuugugugguacuucuggcagaaaaagaagcagcgcuccggggugcugugggacacgcccagcccgcccgaagucgagcgagcagugcuggacgauggcauuuaccgcauaaugcagcggggguugcuugggcgcucccaggugggggucggugucuuccaggagaacguguuccauacuauguggcacgucaccagaggcgccgugcugauguaccaggggaagcgccucgaacccucgugggcguccgucaagaaggaccugaucagcuauggcggcggguggcggcugcagggcucguggaacacgggggaggaaguccaggugaucgccguggagcccggcaagaacccgaagaacguccaaaccgcccccgguaccuuuaagacccccgagggcgaggucggagcaauagcgcuggacuucaagcccgggacgagcggcucucccaucgucaaccgcgaggggaagaucgucggacuuuacggcaacgggguggugaccaccucuggcaccuacgucucagccaucgcacaagcgaaggccucccaggaagguccccugccagagaucgaggacgagguauuccgaaagcgcaaccucacaaucauggaccugcaccccggcagcgggaagacccggcgcuaccugccggcuaucgugcgggaggccauaaagcgcaagcuccggacccuuauccuggccccuacccgcgucguggcuuccgagauggcggaggcgcucaagggcaugcccaucagguaccagacgaccgccgucaagagugagcauacugggaaggaaaucgucgacuugaugugccacgccaccuucacgaugcggcugcucuccccggugcgcgucccgaacuacaacaugaucaucauggacgaggcccacuucaccgauccuagcuccauugcggcccggggguauauuagcacucgagucggcaugggagaggccgcagccaucuucaugaccgcaacaccgcccggcaguguggaagcguuuccgcagagcaaugccgugauccaggaugaggagcgggacaucccugaacgcagcuggaacucuggauacgaguggauaacugacuuccccggaaagaccgucugguucgugcccuccaucaagucuggcaacgacaucgccaacugccugcggaaaaaugggaagcgcgugauucaacuuucccggaagaccuucgacacggaguaccagaagaccaagaacaacgacugggacuaugucgugaccaccgacaucucugaaaugggcgccaacuuccgcgccgaccgggugaucgauccacgccggugccucaagcccguaauacugaaggacgggccggagcgggugauccucgccggccccaugccggucacgguggcuuccgccgcccagcgacgcggaaggauaggccgcaaccacaacaaagagggcgaccaguauauuuacauggggcagcccuugaacaaugacgaggaccacgcgcacuggacggaggccaagaugcuguuagauaacauaaacacccccgagggaauaauccccgcccucuucgagccagaacgggagaaaucagccgccaucgacggagaguaccgacuucgcggcgaagcgcggaagacguucguagagcuuaugcgcagaggggaccucccggucugguuauccuacaagguggcuagcgagggcuuccaauacagcgaccgccgauggugcuucgacggugagcggaauaaccaggugcuggaggagaacauggacgucgagaucuggacgaaggagggggagcggaagaaacuccgcccucgguggcuggaugcccgcaccuacuccgacccccuugcccugcgggaguucaaggaguucgccgcgggcaggcggagcguguccggcgaccuuauccuggaaaucggcaagcucccgcagcaccugacccagcgcgcccagaacgcccuggauaaccucgugaugcuacacaacagcgaacagggcgggagagccuaccgccaugcgauggaggagcugcccgacaccaucgagacgcucaugcugcuggcccucaucgccguacugaccggcggggugacccucuucuuccucucuggacgugggcuggggaagaccuccaucggccuacucuguguuaccgcuuccaguguccugcuguggauggccaguguggagccacauuggaucgcggccucaaucauccuggaguuuuuccugaugguccuauuaauccccgagccggaccgccagcggacgccccaggacaaccagcuggccuacgucgugauuggccuccucuucaugauccugaccguagccgccaacgagaugggccugcucgaaaccacaaagaaggaccuggggaucggccacgucgcgguggaaaaccaccaccacgccacgaugcuagacguggaccuccaucccgccagcgccuggaccuuguacgccgucgcgaccacaauaaucacgccgaugaugcgccacaccaucgagaauaccaccgccaacaucagccugacggccaucgccaaccaggccgccauccucauggggcuagacaaggguuggccgaucuccaaaauggacaucggcgugccccuccucgcccugggaugcuauagccagguaaacccccugacccucacggccgccgucuuaauguuaguggcgcacuacgccaucaucggcccgggucuccaagcuaaggccacaagagaagcccagaaacggacggcugccggcaucaugaagaaccccaccguggacggcaucgucgccaucgacuuagaccccgugguguacgacgccaaguucgagaaacagcugggccaaaucaugcuccuaauccugugcacgucccagauccucuuaaugcgcaccacgugggcccuuugcgagagcaucacccucgcaaccggcccccugaccacgcugugggaaggauccccgggcaaauucuggaacaccaccaucgcugucuccauggccaacaucuuucggggguccuaccucgccggugccggccuggcguucagccugaugaagucacucgggggcgggaggcgcggcaccggggcccagggagaaacgcugggcgagaaguggaagcgccaauuaaaccagcucuccaaaagcgaguuuaacaucuauaagcgauccgggaucauggaaguggaccgcagcgaggcaaaggagggccugaaacggggggagacaacccgccacgccgugucgcggggaaccgcgaagcugcgaugguucgucgaacgaaacuugguaaagcccgaagggaaggugauugaucucggcugcggccgcgggggcuggagcuauuacugcgcggggcugaagaagguuacggaggugaagggcuacaccaaaggcgggccuggccaugaggaacccaucccgauggccaccuacggcuggaaccucgugaagcuucacuccggcaaagaugucuuuuucacgcccccggagaagugcgacacccugcugugcgacauuggggagagcucccccaacccgaccauugaggagggccguacccuccgcgucuuaaagaugguagagcccuggcugcgcgggaaccaauucugcaucaagauccucaaccccuacaugcccagcgucguggagaccuuagagcagaugcagcgaaagcacgguggcaugcuggugcggaacccgcucucccgcaacaguacccacgagauguacugggucuccugcgguacgggcaacaucgugucggccgugaacaugacuucccggaugcugcugaaccgcuucaccauggcccaccgcaagcccaccuacgagcgggacguggauuuaggggcgggcacgcgccauguugccguggagcccgaggucgccaaccuggauaucaucggccagcggaucgagaacauuaagcaugagcacaagagcacuuggcacuacgacgaagacaaccccuacaagaccugggcguaucacgguuccuacgaggugaagccgaguggcucagccucuucuauggugaacgggguggugaagcuacucaccaagcccugggacgugauuccaauggugacgcagaucgcgaugaccgacaccaccccauuuggccagcagcggguguucaaggagaaggucgacacgagaaccccgaaggccaagcgcggaaccgcacagauuauggaggugaccgcucgcuggcuguggggcuuuuuaucccgcaacaagaagccccggaucugcacgcgcgaggaauucacccggaaggugcgcagcaaugcugcgaucggcgccgucuucguggacgaaaaccaauggaacuccgccaaggaggccguggaagaugagcgguuuugggacuugguacagaaggagcgggagcugcacaagcaggggaaaugcgcuaccugcgucuacaacaugaugggcaagcgagagaagaagcugggggaauuuggcaaggcaaagggcagccgcgccaucugguacaugugguuaggcgcccgguuccuggaguucgaggcccugggcuucaugaacgaggaucacugguucucccgcgagaacucgcucuccggcguggagggcgaagggcugcacaagcugggcuacauccuccgggauaucaguaagauacccgggggaaacauguaugccgacgacaccgcggggugggacacgcgcaucaccgaggacgacuuacagaaugaggccaagauaaccgacaucauggagcccgagcacgcccugcucgccaccuccaucuucaagcucacguaucagaacaaggucguacgggugcagcgccccgcuaagaaugggacagucauggacgugaucagccgccgggaccaacgcggcuccggacaagugggaacguacgggcugaacaccuucacgaacauggaggcccaguugauccggcagauggagagcgaggguauuuucucccccagcgagcuggaaauaccgaaccucgccgagcguguccucgacugguuggagaaauacgggguggagcggcugaagcgcauggccaucuccggggacgacugcguggucaagccgaucgacgaccgguucgccacagcacucaccgcccugaacgacaugggcaaagugcgcaaggacgugccacagugggaacccuccaagggguggaacgacuggcagcaggucccuuucugcucucaccacuuccaccagcugaucaugaaggacggcagggagauuguggugccgugccgcaaccaggaugagcucgucggccgggcccgcgugucucaaggggcaggcuggagccugcgggagaccgccugcuugggaaaguccuacgcacagauguggcagcucauguacuuccaccgccgggacuuacgccuggccgccaaugccaucugcagcgcggugcccgucgacugggugccgacgucccggaccaccuggagcauucacgcccaccaccaguggaugaccacggaggauaugcucucgguguggaaccgcguguggaucgaggaaaaccccuggauggaagacaagacacacgugagcuccuggggcgacgugccuuaccuggggaagcgugaagaucaguggugcggcagccugauaggucucaccgcaagagccaccugggccuccaacauccaggucgcgaucaaccaggugcgucgguugaucgggaacgagaacuacuuggacuacaugacgagcaugaagcgcuucaagaacgagggcgaccccgaaggugcccucugguga

SEQ ID NO: 24255 - RNA, 9879 nt, Artificial Sequence
  derived and/or modified CDS sequence (opt11) from DENV-1__FJ882525__SS-prME
uccgugaccaugcugcucauguuaaugcccaccgcccuggccuuccaccucacgacccgggggggugagccccacaugaucgucagcaagcaggagcggggcaagagccuguuauucaagaccagcgcgggcgucaauaugugcacccuaguggccauggacuuaggcgaguucugcgaggauacgaugaccuacaagugcccgcggaucaccgaggccgagcccgacgacguggacugcuggugcaacgcaacugauaccugggugaccuaugggaccugcagccagaccggcgagcaucggcgcgacaagcgguccguggcccuggcgccccacgugggccucgggcuggaaacgcggaccgaaacauggaugagcuccgagggcgcuuggaagcagauccagcgaguggagaccugggcccugcgccaccccggguucacgguaauagcccucuuccuugcacacgccauaggcaccagcaucacccagaaggggaucaucuucauucugcuaauguuggucacccccuccauggccaugcggugcguuggcaucgguagccgcgauuucguggaggggcuaucgggcgccacgugggucgaugugguccucgagcaugggucgugcgugaccaccauggcaaaggacaagcccacccuggauauugagcugcugaagacggaggugacgaacccggcggugcugcggaaguuauguaucgaggccaagaucuccaauaccaccacggacucaaggugcccgacccagggcgaggccacccuagucgaggagcaggacgccaacuucgugugucggcgcaccuucguagauaggggcugggggaacggcugcgggcucuucggcaaagggucccugaucacgugcgccaaguucaagugcgucaccaaacucgagggcaagacgguacaguaugagaaccugaaguacagcgugaucgucaccgugcacacgggcgaccaacaccagguaggcaaugaauccacagaacacggcacaaccgcgaccaucacgccgcaggccccuagcaccgagauccagcugaccgacuacggggcacucacgcuggacugcagcccccggacgggccuggacuuuaacgagauggugcucuuaaccaugaaggagaagaguuggcuggugcacaaacagugguuccucgaucugccgcugcccuggaccagcggugccucuaccucgcaggagacuuggaaccggaaggaccuccuggucaccuucaaaaccgcccacgcuaagaagcaggagguggugguccugggcucccaggaaggcgccaugcacaccgcccucacgggggccaccgagauucagacaagcggcaccacgaccaucuucgccgggcaccugaagugccgauuaaagauggacaagcuaacccugaaggggauguccuacguaauguguaccgggagcuucaaguuagagaaagagguggcggagacgcagcacgggaccguacucguacaaauccgguacgagggcaccgacgcccccugcaagauacccuucuccacccaggacgagaagggcgugacgcagaacggccgacugauaaccgccaacccgaucgucaccgauaaggagaagccggugaacaucgaggccgagccgcccuucggggagagcuacaucgugaucggcgcgggugagaaggcgcuaaagcuguccugguucaagaaggggagcuccaucggcaagauguuugaggccacggcccgcggugcgcggcgaauggcgauucucggagacacugccugggacuuugggagcaucggcggggucuucaccuccguaggaaaacuggugcaccaaaucuucggcaccgccuaugggguccuguucuccggcguguccuggaccaugaagaucgggaucggcgugcuucugacguggcugggccucaacagccgguccaccagccuguccaugacauguauagcggucgggcucgugacccuuuaccugggcgugaugguccaggccgacagcggaugcguaaucaacuggaagggcagggagcugaaguguggaagcggcaucuucguuacgaacgagguccacaccuggaccgaacaauacaaguuccaggcggacuccccgaagcggcucagcgccgccaucggcaaggccugggaggagggggugugcggcauccgcucugccacacggcuggagaauaucauguggaagcagauaagcaacgagcugaaucacauacuccuagagaacgacaugaaguuuaccguggucgugggcgacguagcgggcauccuggcacaagggaaaaagaugauccgcccacagccaauggaguacaaauacuccuggaagagcuggggaaaggccaagaucauaggcgccgacguccagaacacgaccuucaucaucgaugggcccaacaccccggaaugccccgacgaccagagagcauggaacaucugggagguggaggacuacgguuucgggaucuucaccacgaacaucuggcucaagcugcgugacuccuacacccaaguuugugaccaccggcugaugagugccgccaucaaggauaguaaggccguccacgccgacaugggcuacuggauagaaagcgagaagaacgagaccuggaagcucgcgagagccuccuucaucgaagugaagacgugcaucuggcccaagucccacacgcugugguccaacggcgugcuggagagugagaugaucauccccaagaucuacgguggcccgaucucccagcacaacuaccgcccuggguacuucacccaaaccgccggccccuggcaccucgggaaacuggagcuggacuucgacuuaugcgagggcaccacggucgugguugaugagcacugcggcaauaggggaccgagcuugcggaccaccaccgucacgggcaaaaucauccacgagugguguugccgcuccugcacccugccgccccuccgguucaagggggaggacggcuguugguacgggauggagaucaggcccgugaaagagaaggaggagaaucuggucaagagcauggucuccgccggcuccggcgagguggacagcuuuuccuuagggcuccugugcaucagcaucaugaucgaggagguuaugcggucgcgcuggagccggaagaugcugaugaccggcacccucgccgucuucuuccuucugaucaucgggcagcuaacguggaacgaccugauccgccuguguaucaugguuggggcgaacgccuccgaccgcauggggaugggcaccacauaccucgcccugauggccacauucaagaugcgaccgauguucgccguagggcuccuguuucgccggcugacaagccgcgagguccugcuccugacuaucggucuguccuuggucgcgucugucgagcugcccaacucccuggaggagcucggcgacggccuggccauggggauaaugaucuugaagcuccugaccgacuuccagagccaccagcugugggccacccuccugucccugacuuucauuaagaccaccuucucccuacacuacgcguggaaaacgauggcgauggugcuguccaucgugagccuguucccccucugucuguccaccacgagucagaagacgaccuggcugcccguccuccuggggucccuagguugcaagccgcucacuauguucuuaaucgccgagaacaagaucuggggucgucgcagcuggccgcugaacgaggggaucauggcggugggcaucgugagcauucuccuguccagccugcucaagaacgacguaccccuggcggggccccugauagccggcggcaugcucaucgcaugcuacgugaucuccgggaguuccgccgaucuuucacuggagaaggccgccgaagugaguugggaggaggaggcggagcacagcggagcgucccauaacauccucgucgaggugcaagacgacggaaccaugaagaucaaagaugaggagagggacgacacccugacuauccugcucaaggcuacacugcuggccguuagcggcgucuauccgcucuccauccccgccacgcuguuugugugguauuucuggcagaaaaagaagcagcgcagcggcgugcugugggacacacccucuccgcccgaggucgagcgggcagugcuugacgacggcauuuacaggaucaugcagaggggccuguuagggcgaagccaagugggcguugggguguuccaggagaacguguuccacaccauguggcaugucacccggggcgcgguuuuaauguaccaggggaagcgccuugagccgucgugggccagcgugaagaaggaccugaucucguacggcggcggguggagacugcagggcagcuggaacacgggugaggagguccaggugaucgccguggagccaggcaagaaccccaagaacguccagaccgcuccagggacguucaaaaccagugagggagaggugggcgccauugcucucgacuucaagcccgggaccagcgggagccccauaguaaaccgcgagggcaagaucguuggucuguacggcaacggaguagugaccaccucuggcaccuaugucagcgccaucgcccaggccaaggcgucccaggaggggccccuucccgagaucgaggacgaagucuuucggaagcgcaaccucacgaucauggaccugcaccccgggagcgggaaaaccaggcgguaccugcccgccaucgugcgggaggccaucaagcgcaagcucaggacccugaucuuggccccgacacgggucguggccuccgagauggccgaggcccuaaagggcaugcccauccgcuaccagacuacagccgucaagagcgagcacacgggcaaggagaucgucgaccuuaugugucacgccaccuucacgaugcgccuguugucccccgugcgcgugcccaacuacaacaugauuaucauggacgaagcccacuucaccgauccgagcuccaucgcagcccgugguuacaucagcacccgcgucggcaugggugaggccgcagccaucuucaugaccgcgacgccgcccggcuccguggaggccuucccccagagcaaugccgugauacaggacgaggaacgggacauaccggagcgcuccuggaacagcggguacgaauggaucaccgacuuccccggcaagaccgucugguucgugcccuccaucaaaucaggcaacgacaucgccaauugccuccggaagaacggaaaacgggugauacagcugucccggaagaccuucgacacggaguaccagaaaaccaaaaacaacgacugggacuaugucgugaccaccgauaucagcgagaugggcgcgaacuuccgcgccgaccgggugaucgacccuagacggugucucaagccgguuauccugaaggacgggcccgagcgcgugauccucgccggccccaugcccgucacgguugccuccgccgcgcagcggcgugggcggaucggucgcaaccacaacaaggagggcgaccaguacaucuacaugggucagccgcucaauaacgaugaggaccaugcccacuggacggaggcgaagaugcugcuggacaacaucaacaccccagagggcaucauccccgcccucuucgaaccagagcgcgagaagagcgccgcgauagacggggaguaccgucugcgcggagaggcccggaagacguucguggagcugaugcgccggggggaucucccagucuggcugagcuauaagguggccagugagggcuuccaguacagcgacagacguuggugcuucgacggcgagcgcaacaaccaggugcuggaagagaacauggacguagagaucuggacuaaggagggggagcggaagaaacuccgcccccgguggcuggacgcccgcacauacuccgacccccuagcccucagggaguucaaggaguucgccgcugggcgaaggagcguguccggugaccucauccuggaaaucggcaagcucccccagcaccugacgcagcgugcccagaacgccuuagacaaccucguaaugcuacacaacagcgagcagggaggucgggcguacagacacgccauggaggaacucccugacacuaucgagacgcucaugcugcuggcucucaucgccguccugaccggcggggugacccuauucuuccucuccggccgggggcuggggaagaccagcaucgggcugcucugcgugauggccuccagcguccuguuauggauggcguccguggagccccacuggaucgccgccagcaucauccucgaguucuucuugaugguucugcucauccccgagcccgacagacaacggaccccacaggacaaccagcuggcuuacgucgugaucggcuugcucuucaugauucugacgguggccgccaacgaaaugggccugcucgagaccacgaagaaggaccugggaaucggccacgucgccguggagaaccaccaccacgcagccaugcuggacguugaccuucaccccgccuccgcguggacccuauacgccgucgccacgaccaucauaacccccaugaugcgacacacgauugaaaacacgaccgccaacaucagccugacggcgaucgcaaaccaggccgcgaucuugauggggcuggacaagggcuggccuaucuccaagauggacaucggggugccccugcucgcacucggguguuacagccaggugaacccccugacccucacggcugccguccugaugcugguugcgcacuacgcgaucauugggcccgggcuccaggccaaggcgacccgcgaggcccaaaagcggacugccgcgggcaucaugaagaacccaacuguggacgggaucgucgccauagaccuagaucccgugguguaugacgcgaaguuugagaagcagcugggccagaucaugcuccugauccugugcaccucccagauccucuugaugcgcaccaccugggcccugugcgagagcauuacccuagccacgggcccgcugaccacccugugggaggggagccccggcaaauucuggaacaccacgauugcggucagcauggcuaacaucuuccgggggagcuaccuggccggggccggucuugccuucucuuuaaugaagucccucgggggugggcggcggggcaccggggcccagggcgagacccugggcgaaaaauggaagcgccagcugaaccaacucucuaagucugaguucaacacuuacaagcggucggggaucauggagguugaccgcagcgaggcgaaggagggccugaagcgcggcgaaacgaccaagcacgccgugucccgcggcaccgcaaagcugcggugguucgucgagaggaacuucgugaagccggaggggaagguaauugaccuaggcugcggccgcgggggguggagcuacuacugcgcugggcucaaaaaggucaccgaagugaagggcuacacgaaaggggggccgggccacgaggagccaauccccauggccaccuacggguggaaccuggugaagcugcacuccggcaaagacguguuuuucaucccgcccgagaagugcgacacccuccugugugacaucggcgagagcuccccaaaccccaccaucgaggaaggccgaacgcugcgagugcucaagaugguggagccguggcugcgcgggaaccaguucugcaucaagauccugaaccccuacaugcccagcgucguggagacccucgagcggaugcaacguaagcacggcggcaugcuggugcgcaacccccuaucccgcaacuccacccacgagauguacugggucuccugugguacgggcaauaucgugagcgcggugaacaugacuucacgaauguuacuaaaccgguucacgauggcccaccgcaagcccaccuacgagcgggacgucgaccucggggccggcacacgccacguggccguugaacccgagguggccaaccucgacaucaucggccagagaaucgagaacauaaagcacgagcauaagagcaccuggcacuacgacgaggacaacccauacaagacgugggccuaccacgggucauacgaggugaagcccagcggcucggccucaucuaugguuaacggcguggucaagcugcugaccaagccgugggacgucauccccauggugacccagauugccaugaccgacacaacgcccuuuggucagcagcgcguguucaaggagaaagucgacacccggacacccaaggccaagcgcgggacugcccaaaucauggaggugaccgcuaagugguuauggggauuucugucccgaaauaagaagccacgcaucuguacccgggaggaguucacccgcaaggugcgcaguaacgcggccauaggcgccgucuucguugacgaaaaccaauggaacuccgcgaaggaggccguggaggacgagcgauuuugggaccugguacaucgugagcgggagcuccacaaacaagggaagugcgccacgugcguguauaacaugaugggcaagcgcgagaagaagcugggggaguucggcaaggccaaggggagccgcgccaucugguacauguggcugggcgcgcgguuccucgaguucgaggccuuaggcuuuaugaacgaggaucacugguuuaguagagaaaauagccucuccgggguagagggcgagggguuacacaaguuaggcuauauccuacgggacaucucgaagauucccgggggcaacauguacgccgacgacacggccggaugggacacccggauaacugaggacgaucuccagaaugaggccaagaucaccgacauaauggagcccgagcaugcgcugcuggccaagaguaucuucaagcucaccuaccagaacaaggucgugcgcguacagcguccggcuaagaacgggaccgucauggacgugaucagccgcagagaccagcgcggcuccggccaggugggcacguauggccugaauacuuucaccaacauggaggcccagcugauccggcagauggagagcgaggggaucuucucccccagcgaacucgagacccccaaccuggccggacggguacuagacuggcucgagaagcacgggguggagcgucuuaagagaauggcgaucuccggcgacgacugcguugucaaacccaucgacgauagguucgcgaccgcucugacggcccucaacgauauggggaagguacgcaaggacaucccacagugggagcccagcaagggcuggaacgacuggcagcagguccccuucugcucucaccacuuccaucagcugaucaugaaggauggucgugagaucgucguacccugccgcaaccaagaugagcugguggggcgggcucgcguuucacaaggcgcgggguggagccuccgggaaacagccugucugggcaaguccuacgcccagauguggcagcugauguacuuccaccgccgggaccuccgccuggccgcaaacgccaucugcagcgcaguuccaguggacuggguccccaccucucggacuacauggagcauccacgcacaccaccaguggaugaccaccgaggauaugcuguccguguggaaucgagucuggaucgaggagaaccccuggauggaggacaagacccauaucaguuccuggggcgacguacccuaccucgggaagcgagaggaccaguggugcggaucgcugaucgggcugacggcucgggcgaccugggccacaaacauccagguggccaucaaccaggugcgccggcuaauaggcaacgagaacuaccuggauuauaugaccuccaugaagcgcuucaagaacgagagcgacccggaaggggcccugugguag

SEQ ID NO: 24256 - RNA, 9879 nt, Artificial Sequence
  derived and/or modified CDS sequence (opt11) from DENV-1__FJ882526__SS-prME
agcgugaccaugcuucugaugcugaugcccaccgcccuggccuuucaccucacgacccggggcggcgagccccacaugauugugagcaagcaagagcggggaaagagccugcuguucaagaccuccgcuggcgugaauaugugcacccucaucgccauggaccugggggaguucugcgaagauaccaugaccuauaaaugcccccgaaucaccgaggccgaaccggacgacguggacugcuggugcaacgcaaccgacacgugggugacuuaugggaccuguagccaaaccggggagcaccgucgggacaagcgcucaguggcccuggcgccccacgucggccucgggcuggaaacgcgaaccgagaccuggaugucuuccgagggcgccuggaaacagauacagcgggucgagacuugggcccuccgccaucccggguuuacggugauagcccucuuccucgcgcaugcgauagggaccagcaucacgcagaaggggauaaucuucauccuccucaugcuggugacccccagcauggccaugcggugcgucggcauuggcucuagggacuucguggaagggcuguccggcgccacguggguagacgucguacucgagcacgggaguugcguuaccaccauggccaaggacaagcccaccuuggauaucgagcugcucaagacagagguuaccaaccccgcgguacuacggaagcugugcaucgaggccaagauauccaacacgacgacggacagccgcugcccgacccaaggcgaggccacccucguugaggagcaggacgccaacuucgucugccggcgcaccuucguggaucgaggcuggggcaacggcugcgggcuguucggcaaggggagucuaauuacuugcgcaaaauucaagugcguuaccaagcucgagggaaagaucguacaguacgagaaccugaaguauagcgugaucgugacuguccauacuggcgaccagcaccaaguggguaacgaauccacggagcacggaacaaccgccaccaucacaccccaggccccgagcacggaaauccagcucaccgacuauggggccuuaacccucgauugcagcccccggaccggcuuagacuuuaacgagaugguacucuuaacgaugaaggaaaagaguuggcuggugcacaaacagugguuccucgaccuuccgcugcccuggacauccggggccucgacuagccaggagaccuggaaccggaaggaucuccuggugacguucaagaccgcgcacgcgaagaagcaggaggucguuguguugggcucccaggagggcgccaugcacaccgcccucaccggggccacggagauccagaccagcgggaccaccacuauuuucgccggccaccugaagugucgccugaagauggacaagcucacccugaagggcaugucuuacgucaugugcaccgggagcuucaagcuggagaaggaggucgcggaaacccaacacggcacgguccucguccaaaucaaguacgagggcacagacgccccauguaagaucccguucaguacucaggaugagaagggggugacccaaaacggccggcugaucacagccaacccuaucguuaccgacaaggagaagccggucaacaucgaagccgaaccgcccuuuggagaguccuacaucgucauuggcgcgggcgaacgugcucuuaaguuguccugguucaagaagggaagcucaaucggcaagauguucgaggcgaccgcaagaggggcccgccgcauggcgauccucggcgacacggcgugggauuucggaucgaucggcgggguguucacgucugucgggaagcuggugcaccagaucuucggcaccgccuacggggugcuguucagcggcgucuccuggaccaugaagauagggaucggcgugcucuuaaccuggcugggccucaauagccgguccacgagccucagcaugacuuguauagcugucgggcuggucacccucuaccugggcgugauggugcaggccgauagcgggugcguuaucaacuggaagggccgcgaacugaagugcgggagcggcaucuucgugacaaacgaaguucacaccuggaccgaacaguacaaguuccaggcggacucgccgaaacggcucagcgcagccaucggaaaggccugggaagaagguguaugcggcauccgcucugccacucggcuggagaauaucauguggaagcagaucucuaaugagcugaaccacauccuccuggagaacgauaugaaguucaccgucguaguaggggacguagcgggaauccuagcccaggguaaaaagaugauccgcccccagcccauggaguacaaguacuccuggaaguccuggggcaaggcgaagaucaucggugccgacgugcagaacaccacguucauuaucgacggucccaacaccccggagugccccgacgaccagcgugccuggaacaucugggaggucgaagacuauggauucggcaucuucaccaccaacauuuggcucaagcugcgcgacuccuacacccaggucugcgaccaccggcugaugagcgccgcaaucaaggacuccaaggccgugcaugccgacaugggcuacuggaucgagagcgagaagaacgagacuuggaaguuagcgagggccuccuucaucgaggucaagaccugcaucuggcccaagagccacacccuguggucgaaugguguacuggagagugagaugaucauccccaagaucuacgggggcccgaucucccaacauaacuaucggcccggguauuuuacgcagaccgcgggccccuggcacuuagggaagcuggagcuggacuuugaccucugugaaggcaccaccgugguaguugacgagcacugcggcaaccgggggccaucacugaggacuaccacagucaccggcaaaaucauccacgagugguguugucgcuccugcacguuaccgccccugcgguucaaaggagaggacggcuguugguacgggauggagauccguccagucaaagagaaggaggagaaucuugugaagaguaugguaagugccggcuccggcgagguugacagcuucucucucgggcuccuuugcaucagcaucaugaucgaagagguuaugcggucccgcuggagccgaaagaugcugaugaccgggacccucgccguauucuucuuacugaucauggggcagcucaccuggaacgaucugauccggcugugcaucauggucggcgcgaacgccagcgaucgcauggggaugggcacuaccuaccucgcccugauggccaccuuuaagaugcggccgauguucgccgugggucuccuguuccgccggcugaccagccgcgagguucugcuauuaacgaucggucucucgcuugucgcgagcguggaguuaccuaacucccucgaagaacugggagauggacuggccauggggaucaugauacugaaacuccugaccgacuuccagagccaucagcugugggccacccuccugucacugaccuucaucaagacuaccuucagccuccacuacgcguggaagaccauggcgaugguucuguccaucgugucgcuguuccccuuaugccuauccaccacgucccagaagaccaccuggcugcccgugcuccuggggucccuagggugcaagccccugaccauguuccugaucgcggagaacaagaucuggggccgcaaaucauggccuuuaaacgagggaaucauggccgugggcaucgugucuaucuugcugucagcccugcucaaaaacgacgugccccuggcggggcccuuaaucgccggcggcauguugaucgccuguuaugucaucagcgguuccagugcugaccugucccuggagaaggccgccgagguuaguugggaggaagaggcggaacauuccggcgccagccacaacaucuugguugagguacaggacgacgggacgaugaagauuaaggaugaggagagggacgacacgcugaccauacugcuuaaggccacccuucuggccguuucgggcguguauccgcucuccauccccgccacccuguucguuugguauuucuggcaaaagaagaagcaacgguccggggugcugugggacacccccagcccacccgagguagagcgugcgguacucgacgacgguauuuaccggauaaugcagcgcggucuuuuagggcggagucagguggggguaggugucuuccaggaaaauguguuccacaccauguggcaugugacccgcggcgcagucuuaauguaccaagggaaacggcucgagcccucuugggccuccguuaagaaggaccugaucagcuaugggggcgguuggaggcuacagggcuccuggaacaccggcgaagaggugcaggucaucgccguugagcccggaaagaacccuaagaacguccagacggccccaggaaccuucaagacaagugagggcgaagucggagcuaucgcccucgacuucaagccugggacauccggcagccccauagugaaccgggaggggaagauugugggccuguacggcaacggggucgugacuaccaguggcaccuacguguccgccaucgcccaggcaaaggccagccaggaggggccccugccggagaucgaggacgaggucuuuagaaagcggaaccucaccaucauggaucugcaccccggcuccgggaagacgcggcgguaccugcccgcgaucgugcgcgaagccauaaagcgaaaacuccgcacccugauccuugccccgacccgcgugguagcgucggagauggccgaggcccucaagggcaugccuauccgguaccagaccacggccgugaaguccgagcacaccggcaaggagaucguggaucugaugugccaugccacguucaccaugcgccugcucagcccuguccgggugcccaauuacaauaugaucaucauggacgaggcucacuuuacagacccgaguagcauagcugcccgcggguacaucuccacacgagugggcaugggggaggccgccgcaauauuuaugacagccacgccuccgggcagcguggaggccuucccccagagcaacgcggugauccaggacgaagaaagggacaucccugagcggucuuggaacucggguuacgaguggaucacagacuuuccugguaagaccgugugguucguccccagcaucaaguccggcaacgauaucgcgaacugccuucggaagaaugggaaacgugugauccagcugagccguaagaccuucgacaccgaauaccagaagacgaagaacaacgacugggacuacguggucaccacggacaucuccgaaaugggagccaacuuucgggccgaucgcguaauagacccccggcgcugccucaagccgguuauccucaaagacggccccgaacgggucauccuggccggccccaugccugucaccguagcuuccgcggcgcagagacgcgggcguaucggccggaaccacaacaaggagggugaccaguacaucuauauggggcagccgcucaacaaugacgaggaccacgcucacuggacggaagccaagaugcugcuggauaauauaaacacacccgagggcaucauccccgcccuuuucgagccagagcgagagaaguccgcggccaucgacggagaguaccgccugcggggagaggcucgcaagaccuucguggagcuuaugcggcgcggggaccugccgguguggcuaagcuacaagguagccagcgaaggauuccaauacuccgaccggcgcugguguuuugacggcgagcggaacaaccaggugcuggaggaaaacauggauguggagaucuggaccaaggagggggagcggaaaaagcucagaccucgcugguuggaugcccggacguauagcgacccacuggccuuacgcgaguucaaggaguucgcugccggccggcgcucugucucaggcgauuuaauacuggagaucggcaagcucccucaacacuugacccagagggcccagaacgcgcuggacaaccucgugaugcugcacaacagcgagcagggaggucgcgccuaccggcacgcuauggaggagcugccagacacaaucgagacccucaugcugcucgcccucauagccgugcugacuggcgggguuacgcuauucuuucucucuggccgcgggcuuggcaagaccucaaucggguugcucugcgugauggccagcuccgugcuacuguggauggcaucaguagagccccacuggaucgccgccuccaucauccucgaguucuuucugauggugcuccucauccccgagcccgaccgccagagaaccccacaggacaaucaacuggccuacgugguuaucgggcuccucuuuaugaucuugacaguggcggccaacgagaugggacugcuagaaacgacaaagaaggaucuagggaucggccacguggccgucgagaaccaucaccacgcagccaugcuggacguggacuugcaccccgcgagcgcuuggacgcuguacgccguagccaccacgaucauuaccccgaugaugcggcacaccauugagaacacuacggccaacaucucccuuaccgccaucgccaaccaggccgccauccucaugggacuggacaaggguuggccgauuagcaagauggacauuggcgucccgcugcucgcgcuggggugcuauucccaagugaauccccugacccucaccgcugccgugcugaugcucgucgcccauuacgcgaucaucggccccggguuacaggcgaaagcgacgcgcgaagcccagaagcgcaccgccgcgggcauuaugaagaaccccaccguggacggaaucguggcgaucgaccucgaccccgucguguacgacgccaaguucgagaagcaacuggggcagaucaugcuccugauccugugcaccucacagauacuccuuaugcggacgaccugggcucugugcgaguccaucacccucgcuacaggucccuugacgacccugugggaggggagccccggcaaauucuggaacaccacaaucgccguguccauggcgaacauauuccgcgggucguaccuagccggcgccgggcuggcguuuagccugaugaaaucccucggaggagggagacguggcacgggggcgcagggcgaaacgcugggcgagaaauggaagcgacagcucaaccagcuguccaagucagaguucaacaccuacaagcgaagcggaaucauggagguugaccgguccgaggcuaaggaaggucugaaaagaggggaaaccacgaagcacgccgugagccggggcaccgccaagcugcgcugguucguggaaaggaaccuagucaagccggagggcaagguaauugaccugggcugcggcaggggcggcugguccuacuacugcgccgggcuaaagaaggugacugaagucaagggguacaccaaggguggacccggccaugaggagccgauccccauggcgaccuacggguggaaccuggugaagcuccacucuggcaaagacguguucuucaucccgcccgagaagugcgauacccugcugugcgauauuggggaaagcucgccuaaccccaccauagaagaggggcggacccuccgcguccugaaaaugguggagccguggcugcgggggaaccaguucugcaucaagauucuuaaccccuacaugcccuccguggucgagacccucgagcaaaugcagcgcaagcauggcggcaugcugguucggaacccccucagccgcaacuccacccacgagauguacuggguguccugcgggacgggcaacaucguauccgccguaaacaugaccagcaggauguugcugaaccgcuucaccauggcccacagaaagccaacuuaugagcgcgacguagaccucggggccggcacccgccacguggcugucgagcccgagguggcgaaccuggacauuaucggccagcggaucgagaacauaaagcacgagcacaaguccacauggcacuaugacgaggacaaccccuauaagaccugggccuaccacgggagcuacgagguuaagccauccgguagugccuccuccauggugaacggagucgugaagcuacuuacgaagccgugggacguaauccccauggucacccaaauagccaugaccgauacaacgcccuucggucagcagcguguguuuaaggagaagguggacacccggacccccaaggccaagcgugggacagcgcagaucauggaggucacugcaaaguggcuguggggcuuucugagccggaacaagaagccgcgcaucugcacucgagaagaauuuacccgcaaaguucgguccaaugcagccaucggggcaguguuuguugacgagaaccaauggaauagcgccaaggaggccguggaggaugaacgcuucugggaccucguccaccgggagcgcgagcugcacaagcaggggaagugcgcgacuugcgucuacaacaugauggggaagcgggagaagaaauuaggggaguuuggcaaggccaaagggucccgugcaauuugguauauguggcucggcgcccguuuccuggaguucgaggcccugggcuucaugaacgaagaucacugguucagccgagagaacagccucagcgggguggagggcgagggacugcacaagcuggguuauaucuuacgggacaucuccaagauccccggcggaaacauguacgcggacgacaccgcuggcugggacacccgcaucacugaggacgaccugcaaaacgaggcgaagaucaccgauauuauggagccagagcacgccuuacucgccaagagcaucuucaaauuaacguaccagaauaaggugguccgggugcagcgcccggccaagaacgggaccgugauggacgucauaagccgccgggaccagcgcggcaguggucagguaggaaccuacggccugaacaccuucaccaacauggaggcccagcuaauacggcagauggagucagagggaaucuuuagccccuccgagcuggagaccccgaacuuagccggccgcgugcucgauuggcuggagaaacacggggucgagcggcugaagcgcauggccaucagcggcgaugacugcguggugaagccaaucgaugaucgguucgccaccgcccucacugcccucaacgacaugggaaagguccgcaaagacaucccgcagugggagcccucuaagggcuggaacgacuggcagcaggucccuuucuguagccaccauuuccaccagcugaucaugaaggacggccgugagaucgugguccccugccgcaaccaggacgagcucguggggcgagcaagggugagccagggcgcagggugguccuugcgggagacggccugccuaggcaagagcuacgcccagauguggcaacucauguacuuccaccgccgggaccugagacuggcggccaacgcgaucuguuccgcaguccccguugauugggugcccaccagccggaccaccugguccauccacgcccaucaucaguggaugacuacugaggacaugcugagcguauggaaccgcguuuggaucgaggagaaccccuggauggaggauaagacccacaucuccagcuggggcgacgugccguauuuaggcaagcgggaggaccaguggugcgggucccugauugggcugacugcgcgcgccaccugggccacaaauauucagguggcuauuaaccaggugcgccgacugaucggcaacgagaacuaccuugauuauaugaccagcaugaaacguuucaagaacgaauccgacccggagggggcucugugguga

SEQ ID NO: 24257 - RNA, 9879 nt, Artificial Sequence
  derived and/or modified CDS sequence (opt11) from DENV-1__FJ882527__SS-prME
agcgugaccaugcugcuuaugcugaugcccaccgccuuagccuuccaccucacaacccgcggaggagagccccacaugauugugagcaaacaggagaggggcaaaagucugcuguucaagacgucggccggggugaauaugugcacacugaucgcgauggaucuuggugaguuuugcgaagacaccaugaccuauaaaugccccaggauuacagaagccgaacccgaugacguggauugcuggugcaaugcgaccgauaccugggucaccuacgggacaugcagccagaccggcgaacauaggagggacaaaagguccguggcccuggcgccccacguggggcugggguuagaaacgcgcaccgagacauggaugagcagcgagggcgccuggaagcagauucagcggguugaaacaugggcucugagacacccuggguucacugugauagcccuguuccuggcgcacgcaaucggcacuucuauaacccagaaggggaucaucuuuauccugcugaugcugguaaccccauccauggccaugcggugcgucggcaucggcagccgcgauuuuguggaggggcugaguggugcuacguggguugacgucgucuuggagcacgggucuugcgugacgacuauggcuaaggacaagccaacccucgacaucgagcugcuaaaaacugaagucacgaaccccgcggugcuucggaagcuuugcaucgaggcaaagaucuccaacacaaccaccgacagccgcugucccacgcaaggagaggccacgcugguggaggagcaagaugcgaacuucgucugucgacggaccuucguggaccggggcugggggaauggcugugggcucuucgggaaggguucucugaucacaugcgccaaguuuaaaugugugaccaagcuugagggcaaaaccgugcaguacgagaaccuuaaguacucugugauagugacuguacacacaggagaccaacaccagguagggaacgaguccaccgaacauggcaccacagcgaccaucacgccccaagcacccagcacugagauacagcugacugacuacggggcacucacccuggacugcaguccacguacgggacuagauuucaacgaaauggucuugcugaccaugaaagagaaaaguuggcuggugcacaagcagugguuccucgacuuaccccugccguggaccagcggagccuccaccagccaggagacguggaacaggaaggaucugcugguuaccuuuaagaccgcgcacgccaagaagcaggaggucguuguacugggcucccaggagggcgccaugcacaccgccuuaacgggggcaacagagauccagaccagcggaaccacuacuaucuuugcgggacacuugaagugccgccugaagauggacaaguuaacccuuaaggggauguccuacgucaugugcaccggcagcuucaagcuugagaaagaggucgcggagacgcaacacgguacggugcucgugcagaucaaauacgagggcaccgacgcucccuguaagauacccuuuagcacccaggaugaaaagggcgugacgcagaauggccggcucaucaccgccaaccccauagucaccgacaaggagaagccuguuaauaucgaggccgagccacccuuuggggagucauauaucgugaucggagcgggagagaaagcccugaaauugucuugguucaaaaaggggucguccaucggcaagauguucgaggccaccgcaagaggggcccgccgcauggcaauucugggagacacugcaugggauuucgguagcaucggcggaguuuucacaucuguggggaagcugguccaccagaucuucgguaccgccuacgggguguuauucucuggcgucucauggaccaugaagaucggcauuggcguucuuuuaacguggcuggggcucaauagcagaucaaccagccuuuccaugaccugcaucgcaguggggcugguuacccucuaccuaggugugauggugcaggcggacuccgggugcguaaucaacuggaaagggcgagagcucaaguguggcagcggaauuuucguuacaaaugaagugcacacguggacugagcaauauaaauuucaggcggacucuccgaagagacucagcgccgccaucggcaaggcuugggaggagggggucugcggcaucaggagugcuacccgacuggagaacaucauguggaaacagaucaguaacgaacugaaccacauccuccuugaaaacgacaugaaguuuaccguggucgucggugaugucgcgggcauccuggcucagggaaagaagaugauccggccccagcccauggaguacaaguacucguggaagucgugggguaaggcuaagauuaucggugccgaugugcagaacacgaccuuuaucauagacgggcccaacaccccggaauguccggacgaccagcgcgcuuggaacaucugggaggucgaagauuauggcuuugggauuuucaccacgaacaucuggcugaagcugcgggacaguuacacacaggugugcgaccaccgccuuaugagugccgccauuaaagacuccaaggccguucacgccgacaugggcuacuggauagagucugagaaaaaugaaacauggaagcuggcgcgggcguccuucaucgaggucaaaaccugcaucuggcccaaaucucacacgcucugguccaacggagugcuggagagcgagaugaucauucccaaaaucuacggggguccgaucucccaacacaacuaucgccccggguacuuuacgcagaccgccggacccuggcauuuggggaaguuggagcuggacuucgacuuaugcgagggcacuaccguugugguggacgagcauuguggcaaucggggccccagccugcgcaccacgacugucacagggaagaucauacaugaauggugcugucgguccuguacgcugccgccccugcgauuuaagggggaggauggaugcugguauggaauggagauccgacccgucaaagaaaaagaggaaaaccugguuaagucuauggugagcgccggcucgggggaggucgacucuuucuccuuggggcuucugugcauuucaaucaugaucgaagaggugaugcgcucccgcuggucucgcaagaugcuaaugacgggcacgcuugcgguguucuuccuguugauuaugggccagcugacauggaacgaucugaucaggcuuugcaucauggugggcgcgaacgccuccgaccgcauggggaugggcaccacuuaucucgcgcuuauggccacguuuaaaaugcgcccaaugcuagccgugggcuuacuguuucggcgccucacgagucgggagguguuacuccugaccaucggucugagccuggucgcaagcguggagcuucccaauucccucgaggagcuuggggacgguuuagccauggguaucaugaucuuaaaacuacugacggacuuccaaucccaccagcucugggcuacccuucuguccuugacguuuaucaagacaaccuucagccuacacuacgccuggaagaccauggcgaugguucuguccaucgucagccucuucccccugugccuaagcacuacgagucagaagaccaccuggcuuccgguacuccuuggaucccucggguguaagccguuagcgauguuccugauagcagagaacaagaucuggggccguaaaagcuggccucucaacgagggaauaauggccguaggcaucgugucuauucugcugagcagccuccugaagaaugacguuccccuggcggggccccucaucgccggcgguaugcuuaucgccugcuacgucaucucuggcucuagugccgaccugagccuugaaaaggccgcggaagucucgugggaggaagaggcggagcacagcggagccucgcacaacauccuaguggagguucaggacgaugggacgaugaaaauaaaggacgaggagagagacgauacccugacgauccucuuaaaggcaacacugcucgccgugucaggcguguacccccuguccaucccagcuacccuguucguuugguacuucuggcaaaagaagaaacagcgaagcgggguucuuugggauacgccuucaccgcccgagguggagcgggcggucuuagacgacggaauauaccgcaucaugcagagaggccugcuaggucgcucccaggugggaguggggguguuccaagagaauguguuccacaccauguggcaugugacccgcggagccguacuuauguaccagggaaagcgccucgagcccuccugggccucuguuaagaaggaccucauaagcuacggaggcggauggcguuuacagggcagcuggaacaccggugaggaggugcaggucaucgcuguagagcccggcaagaacccgaaaaacguccagaccgccccugggaccuucaagacgucugagggugaggucggcgcaaucgcccuugacuuuaagccugggaccucaggcagccccauugucaacagagagggaaagaucguugggcuauauggcaacgggguggugacgacauccgggaccuacgugagcgcaaucgcacaggcgaaggccagccaggaagggccccucccagagaucgaggaugagguuuuccggaagcgcaaccugaccaucauggaccugcauccaggcagcgggaagacucggagguaucuccccgccaucguucgggaggcaaucaagcgcaagcugcggacccuaauccucgccccgacccgcgugguggcgagugagauggcggaagcauugaagggaaugcccauccgauaccagaccaccgccgucaagucagagcauacugggaaagagauaguugaccugaugugccacgcaaccuucacaaugcgguuauuguccccaguacgcgugccaaacuauaacaugauaaucauggacgaagcucacuucacagacccuagcuccaucgccgcccggggguauauaaguacacgcgugggcaugggggaagcugccgcgauauucaugaccgccaccccgcccggcuccgucgaagcguucccccagagcaaugccgugauacaggacgaggagcgagacauccccgaacgcucuuggaauaguggguacgaguggauaacagacuucccuggcaagacugugugguucguacccuccauuaagucgggaaacgacaucgccaacugccuuagaaagaaugggaagcguguaauacagcucagccgaaagaccuucgacaccgaguaccagaagacgaagaauaaugacugggauuacguagugacaacggacaucagugagaugggcgcuaacuuccgcgcugaccgugugauagauccccgacguugccugaaaccggugauccugaaggacgggcccgagcgggugauacucgccggcccgaugcccgucaccgucgcauccgcagcgcagcggcgcgggcggauaggccgcaaccacaacaaggagggggaccaauacaucuacauggggcagccccugaacaacgacgaggaucacgcucauuggacagaggcuaaaaugcucuuagauaacauuaacaccccugaaggaaucauccccgcgcuguucgagcccgaacgggaaaaauccgcggcuauagacggugaauaccgcuuacguggggaggcucggaaaaccuucguggagcuaaugagacgcggcgaccugccgguguggcugagcuauaaagucgccuccgagggcuuccaguacagcgaccgcagauggugcuuugacggugagcguaacaaccagguguuggaggagaacauggacguugagaucuggaccaaggagggggagcggaagaagcugcggcccagauggcuagaugccagaacguacuccgaccccuuagcccugcgggaauuuaaagaguucgcagcgggccgaagaagcguuucuggggaucuaauccuugagauugggaaacugccucagcaccugacacagcgcgcccagaaugcacucgacaaccuggugaugcuucacaacucagagcagggcgggcgggcguacagacacgccauggaggagcucccagacacuaucgagacccugaugcuguuggcccugauugccgugcugacgggugggguaacuuuguucuuucuguccgggcggggucugggcaaaacgucuauaggccucuuaugcgucauggcuuccagcgugcuccuuuggauggccaguguugaaccucacuggaucgccgccagcaucauccuggaguucuucuugauggugcuacugauccccgagcccgaccgccagcguacuccccaggacaaccagcuggccuacguggucaucgggcuucuuuucaugauccugaccguggcggccaaugagaugggacucuuagagacgaccaaaaaggauuuggggauaggccacgucgccguggagaaucaccaccacgcggccaugcucgacguggaccugcauccugcuucagcauggacgcuguacgcuguggccaccacgaucaucacccccaugaugagacauaccaucgagaacacgaccgcaaacauuagccucaccgcgaucgcaaaccaggcagccauccucaugggguuggacaagggcuggccgauuucgaagauggacaucggggugccacuccuggcacuggggugcuacagccaaguuaacccccucacuuuaacggccgcggugcuaaugcucguggcccacuacgcgauaauuggccccgggcugcaagcgaaggccacgcgggaggcccagaaacgcacugccgcgggcauaaugaagaauccgacuguggacgggauuguggccaucgauuuggacccgguagucuacgacgccaaauucgagaagcaguuggggcagauaaugcuuuuaaucuugugcacgucacaaauccugcugaugcgcacgaccugggcuuugugugaaaguauaacccuggcaaccggcccccugacgaccuuaugggaaggcucccccggaaaguuuuggaacacgaccaucgcuguuagcauggcaaacauauuucgggggagcuaccucgcuggcgccggcuuagccuucucccucaugaagagccuugggggcggaagacggggcacaggggcgcagggcgaaacccugggagaaaaguggaagcgccagcucaaucaguuaagcaagucugaguucaacaccuacaaacgguccgggauaauggaggucgaccgcagugaggcuaaggagggccuaaaacgcggggagacaacgaagcacgcgguaagucgcgggaccgcaaagcuccgaugguucguagaacggaaccuggucaagccggaagggaaagugaucgaccugggcuguggccgaggcggauggagcuauuauugcgccgggcugaaaaaagugacagaggucaagggguacacuaagggcgggccggggcacgaagagcccauacccauggcgacguauggauggaaucucgucaagcuacacuccggcaaggauguauucuuuaucccuccugagaagugugauacacugcuuugcgacaucggugagucgagucccaaccccacgauugaagaagguaggacucugaggguccugaagaugguggaaccgugguugcgcgggaaccaguucugcauaaagauuuugaacccuuacaugccuaguguggucgagacucuggagcagaugcagcggaaacacggcggaaugcuugugcgcaaccccuuaucccgcaacagcacccacgaaauguacuggguguccugcgguaccgggaauaucguaucggccguuaacaugaccucccgcaugcuguuaaaccgguuuaccauggcucaccgaaagccgaccuaugagcgcgacguggaucuaggggcaggcacgagacacgucgcaguggaaccagaaguggcgaaccucgacaucaucggccagcgcaucgaaaacaucaagcacgagcacaagucaaccuggcauuacgacgaggacaaccccuacaagaccugggccuaucacggguccuacgaagucaagccaagcgguucugcuuccagcauggugaacgggguugucaagcuccucacaaaaccaugggauguuauacccaugguaacccagaucgccaugaccgacaccacuccguucgggcagcagcguguguucaaggagaaggucgacacccgaacaccuaaggccaagagaggaacugcacaaauuauggaggucacggccaaguggcuuuggggcuucuugucacgcaacaagaaaccgagaauuuguacccgcgaggaguucacccggaagguucguaguaaugcugcaauaggagcgguguucgucgacgagaaccaguggaauucagccaaagaggcaguggaggacgagcgguuuugggauuuagugcauagagagcgggagcugcacaagcagggaaaaugcgcuaccugugucuacaauaugaugggcaagcgagagaagaaguuaggggaguucggcaaagccaaggggagccgggcgauuugguauauguggcugggcgcacgcuuccuugaguucgaagcccuaggcuucaugaacgaggaccacugguucucucgggagaacagccugucggggguagagggcgaggggcugcacaaacugggauacauucuacgcgacaucuccaagaucccgggcgggaauauguaugccgacgacacagccggcugggacacgaggauuaccgaggacgaccuccagaacgaggcgaagauaaccgacaucauggaaccggagcaugcuuuacuggccaaaucuaucuucaagcugaccuaucaaaacaaagucguccgcgugcagaggccggcaaagaacgggaccgucauggaugucaucucgcgccgcgaucaaagaggcucgggccaggucgggaccuacggacucaacacauucaccaacauggaagcccagcugauccgccaaauggaaagcgaaggaaucuuuuccccgagcgagcuugagacgcccaaucuggccggccgagugcuggacugguuagagaagcacggugucgagagacuuaagcgcauggcaauuucuggagacgacugcguggugaagcccauagacgaccgcuucgcuacggcgcugacggcucugaacgacauggguaagguccgaaaggacaucccgcagugggaaccaagcaaaggcuggaacgauuggcagcaaguccccuucuguagccaccacuuccaccaguuaaucaugaaggauggucgcgaaaucguagucccgugucguaaccaggacgagcucguuggacgcgcacggguaucccagggcgcgggguggagccugcgcgagacggcuugccucggcaaguccuacgcgcaaauguggcagcuaauguauuuccaucggagggaucuacggcucgcggccaacgccaucugcagcgcaguuccgguggacugggugccgaccucucgaacgaccuggucgauacacgcucaucaccaguggaugacgaccgaggacaugcuguccguguggaaccggguguggaucgaagagaaccccuggauggaggauaagacgcacaucagcucauggggcgacgugccuuaccugggaaagcgcgaggaucaguggugugggucacugauugggcuaacggcgagagcuaccugggccaccaacauccagguagccauuaaccagguucggcggcugauuggcaacgaaaacuaccucgauuacaugaccucaaugaagcgcuucaaaaacgagagcgauccggagggggcgcugugguaa

SEQ ID NO: 24258 - RNA, 9879 nt, Artificial Sequence
  derived and/or modified CDS sequence (opt11) from DENV-1__FJ882529__SS-prME
agugugacaaugcuauuaaugcuaaugccgaccgcgcuugcauuucaccugacaacacgagggggcgaaccccauaugaucguuucgaaacaagaaagggggaaaagccuacucuucaagacaagcgcaggagugaauaugugcacccucaucgcaauggaccuaggagaguucugcgaagacacaaugacauacaaaugcccgcgcaucacggaagccgaaccggacgaugucgacuguuggugcaacgcgaccgacacaugggucaccuacggaacaugcucccaaacaggggaacacaggagagacaaaagaagcguggcacuagcgccccaugucggacuaggucucgaaacaaggacggaaacauggaugagcucagaaggggcguggaaacaaauacagcgagucgagacgugggcacuucgccacccgggauucaccguaaucgcccucuuucuugcgcaugcaauagggacaucaaucacgcagaaagguaucaucuucauucuucugaugcuaguaacaccgagcauggcuaugcgcuguguuggcauugggucaagggauuucguggaaggacuaagcggcgccacaugggucgaugucguacucgaacacgggucauguguaacaacaauggcaaaggacaaaccgacucuggacauugaacugcuaaaaacagaaguaacuaacccagcuguccugcgcaaacuaugcauagaagcgaagaucagcaacaccacuaccgauucacgauguccuacccaaggagaagcaacgcucguggaagaacaagaugcaaauuucgugugccguagaacguucguugaccgaggcuggggcaauggcugcggccucuuugguaaaggcuccuuaauaaccugugcaaaauucaagugugucacaaaacuggaaggaaaaauaguacaguaugagaaccugaaguacuccgugaucgugaccgugcauacuggggaccagcaucaaguaggaaacgagucaacugaacaugggacgaccgccacgauuacaccacaagcaccgagcaccgagauacagcuaaccgacuacggcgcacugacgcuggacugcagcccccggacaggucuggacuucaacgaaauggugcuccuaaccaugaaggaaaagucauggcucgugcacaagcaaugguuccuugaccuaccucugccuuggaccuccggugcuucaaccagccaagaaaccuggaacagacaggaucuccuagucacauucaagacagcacacgccaagaaacaagaagucguaguuuuaggaagccaagaaggcgcaaugcacaccgcccuaacgggcgcaaccgaaauccaaacaagugggaccacaacgauauuugcaggacacuugaaaugccgucuuaaaauggacaaacuaacacucaagggcaugucguacgugaugugcacaggcaguuucaaacucgaaaaggaagucgcagaaacgcaacaugggacgguacugguacaaaucaaguacgagggcacagacgcaccauguaagaucccauucuccacacaagacgagaaagguguaacgcagaauggccgauugauuacggccaaucccauugugacagacaaggaaaagcccgucaauaucgaagccgaacccccguucggugagucguacaucguaauaggggcgggggaaaaagcccuuaaguuguccugguucaagaaaggaucuuccauaggcaaaauguucgaagcaacggccagaggggcacgacggauggcgauccucggugauacagccugggacuucggcagcaucggaggcgucuuuaccucgguaggcaagcugguacaucaaauuuucggaaccgcauacggcgucuuauucagcggcgucuccuggacuaugaaaauaggcaucgggguccuauugaccuggcucgggcuuaauaguaggucaacaucacuuucuaugaccuguaucgcagugggacucgucacccuguaccugggcguuaugguacaggcugacagcgggugcgucauuaacuggaagggacgggaacucaagugcggguccggaaucuucguuacuaacgaggugcauacguggacggaacaauacaaauuccaagccgauaguccgaaacggcugagugcggcaaucggcaaagcgugggaggagggagugugcggaauaaggagugcgacuaggcuggaaaacaucauguggaaacagauaagcaacgaguuaaaucacauacuucuggaaaaugacgucaaguucacagucguagucggagauguggcaggaauacuagcacaaggcaagaaaaugauccgaccccaacccauggaauacaaguacuccuggaaaagcugggggaaggcgaaaauaauaggcgcugauguacaaaacacgacuuucaucauugauggaccgaauacgccagagugcccggacgaucagagggcauggaacaucugggaaguggaggauuacggauucggaauauucaccacuaauaucugguugaagcuacgugacuccuacacccaaguuugugaccacagacugaugucugcagcgaucaaggacucgaaagccguacaugccgacaugggguacuggauagaauccgaaaagaacgaaacauggaagcuagcacgugccagcuucauagaggucaaaaccugcaucuggccuaaaucacacacccucuggagcaauggcguucucgagucugaaaugauuaucccgaaaauauacggaggcccaauaucccaacacaacuaccggccggguuacuucacacagacggcgggaccauggcaccuuggaaaacucgagcuugauuucgaccuuugcgaaggcacaacaguggucgucgacgaacacugcggcaauagaggacccucguugaggaccacuacagucacagggaagauaauccaugaauggugcugcaggagcuguacacugccgccgcuccgguucaaaggagaagacggcuguugguacggcauggagauccgccccgugaaggagaaggaggagaaucuagucaaaucgauggucucagcaggcucaggggaggucgacagcuucagccucggacuccuaugcaucuccauaaugauagaggaggugaugaggagccgauggagucgcaagaugcucaugacagggacacuggcgguguucuucuugcugaucaugggccaacucaccuggaacgaccuaauaagauugugcauaaugguuggagcaaacgcguccgacagaaugggcaugggcacgacauaucucgcucugauggccaccuuuaaaaugagaccaauguucgcagugggccuccucuuccgcagauugacaucacgcgaaguccuccugcuaacuauuggccucagcuuggucgcuucgguggaacuaccgaacucgcuagaagaacuaggcgaugggcuggccaugggaaucaugauucucaagcuauugaccgauuuccagucccaucaacuaugggcaacguuacuuucgcuaacauucauuaaaacaaccuucucgcuacauuacgccuggaagacaauggcaaugguacuguccaucgucucccuauucccgcuuugccuguccaccaccucacagaaaacaacguggcugccugugcuauugggaucccucggguguaagccacucacaauguuucucauugcagaaaauaaaauauggggcagaaaaaguuggccauugaacgaagggaucauggcagucggaauagugagcaucuuacucuccucauuacugaaaaacgacguaccgcucgcuggcccgcucaucgcgggugguaugcucaucgccugcuacguaauauccggaucguccgcagaccucagccuggagaaagcagcggaaguauccugggaagaagaggcagagcauucaggagcuagccacaacauccuuguagagguccaagacgacggaaccaugaaaauaaaggacgaggaacgcgacgauacgcuaacgauacugcucaaagccacuuuacuggccgugucaggaguguauccccuuaguaucccagcaacacuuuucgucugguacuucuggcagaaaaagaaacaaagauccggcgugcuaugggacacaccaucuccacccgaggucgaaagggccguccucgaugacgggaucuaccgcauaaugcaacgcggauuacuaggaagaagucaagucggggucggcguauuccaagaaaacgucuuccauaccauguggcauguaacacgcggagcagugcugauguaucaagggaagaggcuugaaccauccugggcauccgugaaaaaggaccuuaucucauacggcggggguuggagguugcagggaucauggaacacaggcgaggaagugcaaguaauugccguggaaccggguaaaaaccccaaaaaugugcagacugcaccgggaacuuuuaagacaucagaaggagagguuggggcgauugccuuagauuucaagccugguacaucaggaaguccgaucgugaaccgggagggaaagaucgucggguuauacgggaacggggucgucacgacuagcggaacauacgucagcgcuauugcacaagccaaagcaagccaagaggguccucuaccggaaauugaggacgaagucuuccgaaaaaggaaucucacaauaauggaccuccacccgggauccgggaagacgcgccgcuauuugcccgcgauugugcgcgaagccaucaaacggaaacugagaacgcucauccuggcucccacgagagucguggccucggagauggcggaagcgcucaaagggaugccgauccgcuaucaaacgacggcaguaaagucggagcauaccgggaaagagaucguagaucugaugugucacgcaaccuucaccaugcggcuccucagccccguaagagucccgaauuacaacaugauaaucauggacgaagcacacuucacagacccgagcagcaucgccgcaagaggguacauauccacgcgggucggaaugggugaggcagcagccaucuuuaugacagcgacaccacccggcagcgucgaggccuucccacaaagcaacgccguaauacaagacgaggaacgggacauuccggaacgcucauggaacaguggguacgaguggauaacggacuuucccgguaaaacaguaugguucguacccaguaucaaauccgguaacgacauagcaaacugccugcgcaaaaacgggaaacgaguuauccagcucagucggaaaacauucgauaccgaauaucagaagaccaaaaauaacgacugggacuacguggucacgaccgacauaucggaaaugggagccaacuuccgcgcagaccgagugaucgacccaagaaggugccucaaacccgucauccuaaaggaugguccagagagaguaauucuagcgggacccaugccaguaacaguggcgagcgccgcacaaagacgcgggcgcauagggcggaaccacaacaaagaaggcgaccaauacaucuacaugggccaaccucuuaacaacgaugaggaccacgcucauuggaccgaggcgaaaauguuacuugacaauauaaauacaccagagggaaucauuccagcgcucuuugaaccagaacgagaaaagucugcagccaucgacggugaauaucgucugagaggggaagcccgcaagacauucgucgaacucaugaggagaggcgaccuccccguuuggcuaagcuacaagguagcgagcgaagguuuccaauauuccgacaggcgguggugcuucgauggggagaggaacaaccaagugcucgaggagaacauggacgucgaaauauggacgaaggaaggggaaagaaagaaacuccgaccaagauggcucgacgcacggacauacucagacccgcucgcccugcgggaauuuaaggaguucgccgcaggcagacgaagcguaucaggagaccucauccuggaaaucggaaagcucccccaacacuuaacucagcgggcacagaaugcacuagacaaccugguaaugcuccacaacagcgagcaaggugggagggcguaccgacacgcgauggaggaacugccggacaccaucgaaacacugauguuacuugcacugauagccguacuaacuggaggggucacacuguucuuucucagcgggagaggccuagguaagaccucaaucgggcuguugugcguuauggccucauccguccuccucuggauggcaagcgucgagccgcauuggaucgccgccucgaucauacuggaguuuuuccuaaugguccuccuaaucccggaaccggacagacaaagaacuccacaagauaaccagcucgcauacguaguuaucggcuuacucuucaugauacuaacggucgcugcaaacgaaaugggauugcucgagacuacgaagaaagaucuagggauuggucacgucgcuguagagaaccaccaccacgcagccauguuggacguagaccuccauccggcaucugccuggacccuuuacgcuguggcgacaacaauuauaacuccgaugaugagacauaccauagaaaacacaacagccaauauaagucuaacggcuaucgcaaaccaggccgccauacucaugggacuggacaaaggauggccaauaucuaaaauggacauaggcgugccauuacuggcauuggggugcuacagccaagugaauccgcucacgcucacagcagcugugcuaaugcucguagcgcacuacgcaaucauaggucccggccuacaggcaaaggcaacaagagaggcacaaaaacgcaccgcggcagggauuaugaaaaacccgacuguggauggaauuguggcaauagaucuggacccggugguguaugaugcuaaauuugagaaacaguugggucaaauuaugcuccuaauccuaugcacaucccaaauucugcugaugagaacaacaugggcacuaugugaaucaauaacacuggcuacaggcccgcuaacaacgcugugggagggguccccggguaaauucuggaacacaacuaucgcagucaguauggccaauaucuuuagggggaguuauuuggcaggcgcaggcuuagcauucucacugaugaaaucacuaggagggggccgcagaggaacgggagcucaaggcgagacacugggagaaaaguggaagaggcaacuaaaccaacuuagcaaaucugaguucaacacguacaagagaagcgguaucauggaaguagaccgcuccgaggcaaaagaaggguuaaaaagaggagaaacaacgaaacaugcgguuucccgagggacugcaaaacuacgcugguucgucgagcguaaucugguaaaacccgagggcaagguaaucgaucucggaugcggaagaggaggauggaguuacuacugugcgggacucaaaaaggucacagaggugaaaggguacacuaaaggcggcccuggccacgaagaaccgauuccaauggcaacauacggguggaaccuaguaaaacuccacaguggcaaggacguauucuucauacccccggagaaaugcgacacacuccuaugcgacauaggugaguccaguccgaacccaaccauagaagagggaagaacacugcgagugcuaaaaaugguggaacccuggcuacgagggaaccaguucuguauuaaaauccucaaccccuauaugccaucagugguggaaacucucgaacaaaugcaaaggaaacauggaggcaugcugguaagaaacccgcuuagucgcaauaguacacacgagauguacuggguuaguuguggcacagguaacauaguuucagcaguaaacaugaccagcagaaugcuacucaacagguucacaaugguacauaggaagccgacauaugagagagaugucgaucuaggagcagguacccgccacgucgcgguggaaccagaagucgcaaaucuagacauaauuggccagaggaucgagaacauuaagcacgaacacaaaucgaccuggcacuacgaugaagacaacccauacaaaacaugggcguaccacggcagcuacgaggugaaacccagcggaucagccuccucaauggucaauggaguggucaagcuauuaaccaagccgugggacgucauacccaugguaacacagauugccaugaccgacacaacgccguucggacaacaacgcguuuucaaagagaaagucgacaccagaacgcccaaggcaaaacgugggaccgcacagauaauggaggucacugcgaaaugguuguggggcuuucucucgcgcaacaagaaacccaggaucugcacccgcgaggaguucacgcguaaaguaagaucgaacgcggccauaggcgcagucuucgucgacgaaaaccaguggaacucagccaaggaagcgguagaagacgagcgguucugggacuuaguccacagagaacgcgagcuacacaagcaaggcaaaugcgcuacgugcgucuacaauaugaugggcaaacgugagaagaagcuaggcgaauuuggcaaagcaaaaggaucucgagcgauuugguacauguggcuaggagcucgguuccucgaguucgaagcacugggcuucaugaacgaggaucacugguuuucgagagagaacagucuuagugggguggagggagaaggacuccauaaauuaggcuacauccucagagacauaagcaagauuccagggggcaacauguacgccgacgacacagcaggaugggacacgagaauaacagaggaugaucugcaaaaugaagcaaagauaacagauauaauggagccagagcacgcgcuccucgcaaagagcauuuucaaguuaacuuaccaaaacaaggugguaagaguccagcggccggccaaaaaugggacggugauggacgugaucucgcguagggaccaaagaggaagcggacaagucggcacuuaugggcucaauaccuucacuaacauggaagcacaacugauaagacaaauggaaucagagggaaucuucaguccaucagaacuagagacucccaacuuagcugggcggguacucgacuggcucgaaaagcacgggguggaaaggcugaaacguauggcaauuagcggagaugacugcgucguaaagccaauugacgaccguuucgcuacagccuuaacagcgcuuaacgauaugggcaaaguacgcaaagacaucccgcagugggagccaagcaaaggcuggaacgacuggcaacagguaccauucuguucccaccauuuccaccaacugauuaugaaagacggucgagagauagucguacccuguagaaaccaagacgaacugguagggcgcgcccgcguaucgcaaggcgccggauggucacuccgcgagaccgcaugcuugggaaaguccuaugcacagauguggcagcuaauguauuuccacaggcgcgaucuccgacuggcggcaaacgcgaucuguagugccguaccugucgacuggguaccgacaagccgcacaacgugguccauccacgcccaccaccaauggaugacaacugaagacaugcugagcgucuggaaccgggucuggauagaagaaaaucccuggauggaagacaaaacgcacauauccucuuggggagacguccccuaccuggguaaacgagaagaucaauggugcgggagucucauaggucugacugcccgggcuacaugggccacaaacauccaagucgcaauaaaccagguaagacgauugauaggcaaugaaaacuaucuagauuacaugacaucuaugaagcgguucaaaaacgaaagcgacccggaaggagcguugugguga

SEQ ID NO: 24259 - RNA, 9879 nt, Artificial Sequence
  derived and/or modified CDS sequence (opt11) from DENV-1__FJ882530__SS-prME
agcgugaccaugcugcucaugcuaaugccuaccgcacuggcuuuucaucugacgacccgagggggggagccccacaugaucgugucaaagcaggagcgcggcaagagccugcuguucaagaccagcgcuggggugaacaugugcacucucaucgcaauggaccuuggcgaguucugcgaggacacuaugacuuacaaauguccccgcaucacugaagcugaaccugaugauguggacugcuggugcaacgccaccgacacaugggugaccuacgggaccuguagccagacuggcgagcaccggcgugacaagcgguccguggcauuggcgccccacgugggccucggccuggagacgcgcacggagaccuggaugagcuccgagggcgccuggaagcagauccagcggguggaaaccugggcccuuaggcaucccggguucacggucauugcccucuuccuggcgcacgcuaucgguaccagcaucacccagaagggcauuaucuucauccugcucaugcuggugacccccuccauggccaugcgcugcgucgguauaggcucgcgagacuucguggaagggcuguccggcgcgacguggguggaugucgugcucgaacacgguucuugcgugaccaccauggccaaggacaaacccacucuggacaucgaguugcucaagacugagguaaccaaucccgcgguacugcggaagcugugcaucgaggcgaagaucaguaacacuaccacggacagccgcugucccacgcagggcgaggccacccucguggaggagcaggacgccaauuuugucugcagaagaaccuucguagaccggggcugggggaacggcugcggccuauucggcaaagggucccugaucacaugcgccaaguucaagugcgucaccaaacucgagggcaaaaccguccaguacgagaaccugaaguacucagugaucguaacgguucacaccggugaccagcaucaggugggaaacgaguccacagagcacgggaccaccgcuacuauuacgccccaggcccccagcaccgagauccagcugaccgauuacggcgccuuaacuuuagacuguagcccccggacgggguuggauuucaacgagaugguccuccugaccaugaaggaaaaguccuggcuggugcacaaacagugguuccuggacuugccuuugccuuggacaaguggggcuuccacgagccaggagacguggaaucgcaaggauuugcugguaacauucaagaccgcccacgcuaagaaacaggagguaguaguacuaggcucccaggagggcgccaugcacaccgcccucacgggggccacggagauucagaccucaggcaccacgaccaucuucgccggucaccugaagugccgcuugaagauggacaagcuuacgcugaagggcauguccuacgucaugugcaccgggaguuucaagcuggagaaggaggucgcggagacucagcacggcaccgugcucguucaaaucaaguacgagggcaccgaugcccccugcaagauccccuucaguacccaggacgagaagggggugacgcagaacggccgccugaucaccgccaacccaaucgucacagauaaggagaaacccgucaacaucgaggcggagccgcccuucggggagagcuauaucgugaucggcgcaggcgagaaagcucugaagcugaguugguucaaaaaggggucuuccaucggcaagauguucgaggccacugcccggggcgcucggcgcauggcaauccugggcgauacggcuugggacuucgggagcaucggcggcguguuuaccuccguggggaaacuggugcaccagaucuuuggcacggccuauggggugcuguucagcggcgucuccuggaccaugaagaucgggaucggcgugcuccuaacguggcugggccucaacagccgcucgaccagccucucaaugaccugcaucgcuguggggcuggucacccucuaccugggcgugauggugcaggcagacagcgggugcgucaucaacuggaagggccgcgaacucaagugcggcagcggcaucuucgugacgaacgagguacauaccuggacagagcaguauaaguuccaagcggacuccccgaagcggcucagcgccgcuaucgggaaagccugggaggagggcguaugcggcauccggucugcaacacgcuuagaaaauauuauguggaaacaaauaagcaacgaguuaaaccauauccuccuggagaacgacaugaaguucaccgugguggucggggauguggcgggcauccuggcccaggggaagaagaugauucggccccaaccuauggaguauaaguacuccuggaaauccuggggcaaagccaagaucauuggcgccgaugugcagaacacgaccuuuaucaucgacgggcccaacaccccggaaugccccgacgaccagcgcgcguggaacaucugggaggucgaggacuacggcuucgggaucuucaccacgaacauuuggcucaagcugcgggacucccacacacagguaugcgaccaccgcuugaugagcgccgcuaucaaggacagcaaggccgugcacgccgacaugggguacuggaucgagagcgagaagaacgaaaccuggaagcuugcgcgggcuuccuucaucgaggucaagaccugcaucuggcccaagagccacacacuaugguccaauggcgugcuggaaagcgagaugaucaucccaaagaucuacggaggccccauaagucagcacaacuaucggcccggguacuucacccagaccgcuggccccuggcaucucgggaaguuagagcuggauuucgaccucugcgagggcacaacaguggucguggaugaacacugcggcaaccgggggccgucucugcgcaccaccaccgugacgggcaagaucauacacgaguggugcugucgguccugcacccugcccccucugagauucaagggagaggacggcuguugguaugggauggagaucaggcccgucaaggaaaaggaggaaaaccuggucaaaagcauggugagcgccggcuccggcgaggucgauagcuucuccuugggauuacucugcaucagcaucaugaucgaggaggugaugcgcucccgguggagccgcaagaugcugaugacgggcacccucgcaguguucuuucugcuaaucauggggcaguuaacguggaaugaccugauacggcugugcaucauggucggcgcuaacgccagcgaccgcauggggauggggacgaccuaccucgcccugauggccaccuucaaaaugcgcccgauguucgccguugggcuccuguuccggcgccugacgucgcgggaagugcuguugcugaccauugggcugucucuugucgcgucgguggaacugcccaacucgcuggaagagcucggugaugggcucgccaugggcaucaugaucuugaagcuacugacagacuuccagucucaccagcuaugggcaacccuucugucccugacguucaucaagacaaccuucucucuccauuacgccuggaagaccauggcgaugguucuuagcaucgugagccuguucccccuuugcuuguccacgacgagccagaaaacaaccuggcugccaguucuccugggcuccuuggggugcaagccgcucaccauguuccugaucgccgaaaacaaaaucuggggccgcaagucguggccccugaacgaagggaucauggcggucggcaucgugagcauccuacuguccagccugcucaagaacgacgugccacuggcagggccucuuaucgcggggggcaugcugaucgcguguuacgucaucagcggaucauccgcggaccugagccuagagaaggcagcggaaguguccugggaggaggaggcagagcacucaggcgcgucccacaauauccucguggagguccaggacgacgguacuaugaagaucaaagacgaagaacgggacgacacccugaccauauugcucaaagccacccugcuagcggugagcggcguguauccguuauccauccccgccacgcuguucguuugguacuuuuggcagaagaagaagcagcgcucggggguucugugggacacccccagcccgccugagguggagcgggcgguccucgacgacggcaucuaucggaucaugcagcggggccugcuggggagaucucagguuggcgugggggucuuccaggagaauguguuccacaccauguggcacguaacuagaggugccgucuuaauguaccaggggaagcgccucgagcccuccugggcgagcgugaaaaaggaucuuaucuccuacggcggcggguggcggcuccaagguagcuggaacacgggagaggaggugcaggucaucgcaguggaacccggcaagaaucccaagaacgugcagaccgcccccggaaccuucaagaccuccgaaggcgaggugggcgccauagcucuggauuucaaacccgggacguccggaucccccauugugaaccgagaggggaagauugugggccuguacggcaacgggguuguuaccaccuccgggaccuacgugagugccauugcacaagccaaggcgucccaggaagguccccuaccggagaucgaggacgagguauuccggaaacgcaaccucacuaucauggaucugcacccggguagcgggaaaacccggcguuaccugcccgcuauuguucgggaggccaucaagcgaaagcuccggacccugauccuugcgccgacccgcguggucgccuccgaaauggcggaagccuuaaagggcaugccaauccgauaccagacaacggcggucaagagcgagcacacaggcaaggagaucguggaccugaugugccacgcuaccuucacgaugcggcuauuaucccccgugcgagugcccaauuacaauaugauuaucauggacgaagcccacuucacugacccgagcuccauagcggccagggguuacaucucaacccgcgugggcaugggggaggccgccgccaucuucaugaccgcgacgccgccgggcuccguugaggccuucccacaauccaacgccgugauucaggacgaggagcgggacauuccggagcgcuccuggaacaguggguacgaauggaucaccgauuuuccgggcaagacaguaugguucguccccuccauuaagagcggcaaugauauugccaacuguuugaggaagaacgggaagcgcguaauccagcugucgcggaagacuuucgacacugaguaucaaaagacuaagaauaacgauugggacuaugucguuacgaccgauaucuccgagaugggagcgaacuuccgcgcagaucgugugaucgauccgcgccggugccucaagccgguuaucuuaaaggacgggcccgagcgagucauucuagccggcccuaugcccgugacgguugcgagcgccgcgcaaaggagagggcggaucggucggaaccacaacaaggagggcgaucaauauaucuacauggggcaaccgcugaacaacgacgaggaccaugcccacuggaccgaggccaagaugcugcuggacaauaucaauacccccgaggguaucauccccgcuuuauucgagccggagcgagagaaguccgccgcaaucgacggcgaguaccggcugcgcggcgaagcccggaagaccuucguggagcucaugcggcgcggggacuuaccgguuuggcugagcuacaaggucgccuccgaagguuuccaguacagcgaccgacgguggugcuucgacggcgaaagaaauaaccaggugcuggaggagaacauggacguggagaucuggacgaaagagggggagcggaagaagcuccgcccccggugguuagacgccagaacguauucggaccccuuagcucuccgcgaguucaaggaguucgcugccggccgccggucugucuccggagaccugauacuggaaaucggcaagcugccccagcaccuaacccagcgcgcucagaacgcccuggacaacuuggugaugcugcacaacagcgagcaaggcggacgggcuuaccgccacgccauggaggagcugccugauaccauugagacgcuaaugcuguuagccuuaaucgccgugcugaccggcggggucacccuguucuuccucucagggcguggccugggcaagacaagcaucggccugcucugcgugauggcauccucagugcugcuguggauggcguccgucgagccccauuggaucgccgccagcaucauccucgaguucuucuuaaugguccuccucaucccugagcccgaccgccaaagaacgccgcaggacaaccagcuggcuuacguugucaucggacuccucuucaugauccugacgguggccgcgaaugagaugggccuguuagagaccaccaagaaggacuuagggaucggccacguagccgucgagaaccaccaccacgcugccaugcuagacguggaucuccaccccgccuccgcguggacccuuuacgccguugccacgacuaucaucacgcccaugaugcgccauaccaucgagaacacaaccgcuaacaucucgcugaccgcuaucgcgaaccaagccgcaauccucauggggcuggacaagggguggccgaucagcaagauggacaucggcguacccuugcucgcccugggguguuacucccagguaaaccccuugacccucacggcggccguguuaauguuagucgcccacuacgcgaucaucggcccaggguuacaggcuaaggccacgcgggaggcccagaaacgcaccgccgccggcauuaugaagaauccuacuguggacgggaucguggccaucgaccuggaccccgucguauacgacgcaaaauucgagaagcaacugggccagaucaugcuccugauccugugcacuucacagauccugcugaugcgcaccaccugggccuugugcgagagcaucacuuuagcgacggggccccugacgacccugugggaaggaucccccgguaaguucuggaacacuacgaucgccgucagcauggcgaauaucuuccgggggucguacuuagcgggcgccggccuggcuuucucucugaugaagucccucgguggcggucgccgggguaccggggcacagggcgagacccugggcgagaaauggaagcgccagcugaaccaauuguccaagagcgaauucaacaccuacaagagauccggcaucauggaggucgauagauccgaggcgaaggaagggcugaagcgcggggagacgaccaagcacgccgugagucgcggcaccgccaagcucagaugguucguggaacgcaacuuagucaaaccggaggggaagguuaucgaccugggcugcggcagaggcggguggagcuacuacugcgccgggcugaagaaggugaccgaagucaagggguacacgaaaggcgggcccggccacgaagagcccaucccgauggccaccuacggguggaaccuugugaagcugcacuccggcaaggacguguucuucaucccgcccgagaagugcgacacccuguugugcgacaucggggaaagcucccccaacccuacaaucgaggaaggccguacgcuacggguccugaagaugguggagccguggcugcggggaaaucaguuuugcaucaagauucugaacccauacaugccuagcguggucgagacacuugagcagaugcagagaaagcacggaggcaugcuagugcggaacccccugucccggaacagcacccaugagauguacuggguguccugcgggaccggcaacaucgucagcgcggugaacaugaccucccgcauguugcugaaccgguucacgauggcacaccggaagccuaccuaugagcgcgacguggacuuaggcgccgggacacggcacguugccguggagcccgagguggccaaucucgacauaauuggccagcgcauagagaauaucaagcacgagcacaagagcacauggcacuacgacgaggacaaccccuauaagacgugggcguaccacggguccuacgaggucaagcccucgggcagcgccagcagcaugguuaacggggucgugaagcugcucacaaagccgugggaugugauaccgauggugacccagaucgccaugaccgacaccacgcccuucggccagcagcggguguucaaagaaaaaguggacacccgcacucccaaggccaagcgggggacggcgcaaaucauggaggucaccgcuaagugguuauggggcuuccuaagucgcaacaagaaaccgaggaucugcacccgggaggaguucacccggaaggugcgcagcaacgcugccaucggcgccguguucguggacgaaaaccaauggaacucggcgaaagaggcugucgaagacgagcgguucugggacuuaguccaccgcgagagagaacugcacaagcaggggaagugcgccacgugcgucuacaauaugauggguaagcgugagaagaagcuuggugaguuugguaaggccaaggggagccgggcgauuugguacauguggcucggcgcgcguuucuuggaguucgaggcccugggcuucaugaacgaggaccacugguuuucgcgggagaauagccuuuccgggguagagggcgaggggcuacacaagcugggcuacauccuccgugacaucagcaaaauccccggaggcaacauguacgcugacgacaccgccgguugggacacccggaucaccgaggaugaucugcagaacgaggccaagaucacggacaucauggagcccgagcacgcgcugcucgccaaguccaucuucaagcuaaccuaccaaaacaagguaguccgcgugcagcgcccugccaagaacgggacggucauggacgucaucagccgucgcgaccagcgggggucgggccaggugggcaccuacggccugaacacguucacaaacauggaggcucagcucauccgacagauggagucugaagggaucuucucacccagcgaguuagaaaccccuaaccuggccggccgggugcucgauuggcuggaaaaacacggagucgagagacugaagcggauggcgauauccggcgacgacugcguggugaagccgaucgacgaccgcuucgccaccgccuugacggccuuaaacgacaugggcaagguacggaaggauaucccucaaugggaacccucgaagggcuggaacgacuggcagcagguccccuucugcucacaccacuuccaccaacuaaucaugaaggacggccgcgagaucguggucccaugccguaaucaggacgagcucgugggccgcgcucgggugagccaaggggcgggguggagccugcgcgagaccgccugucugggcaaguccuacgcccagauguggcagcucauguacuuccaucgucgugaccugcggcuggcggcgaacgccaucugcagcgccgugccgguggacugggugccaacuucccgcaccacguggagcauacacgcccaccaccaguggaugaccaccgaggacauguuguccgucuggaaccggguguggauugaggagaaccccuggauggaggacaagacccauaucucauccuggggcgaugugcccuaccuggguaagcgcgaagaccaguggugcgguagccugaucggguugacggcacgggcgaccugggccacuaacauccaggucgccaucaaucaggugcgccgccugaucggaaacgaaaacuaccuggacuacaugaccuccaugaagcgguucaagaacgagagcgacccagagggagcucugugguga

SEQ ID NO: 24260 - RNA, 9879 nt, Artificial Sequence
  derived and/or modified CDS sequence (opt11) from DENV-1__GQ868605__SS-prME
agugugaccaugcuccugaugcucaugccgaccgcccuggccuuccaccucaccacccggggcggugagccccacaugaucgucacaaagcaggagcgggguaagucccugcuguucaagaccucggugggggugaauauguguacccuaaucgccauggauuugggcgaacugugcgaggacaccaugaccuacaaguguccccgcauaacugaggcugagcccgacgacguugauugcugguguaacgccacugauacuugggugaccuacggcaccugcucccagacaggugagcaccggcgugacaagcguuccguggccuuggcgccccacguaggccuggggcuggagacccguaccgagaccuggauguccagugagggugcguggaagcagauccagcggguggagacgugggcacuacggcaccccggcuucaccguuaucgcccuuuuucuggcccacgcgaucggcacguccaucacccagaaggggaucaucuucauccugcuuaugcuggucacaccuucgauggcgaugcggugcgugggcaucgggucccgggacuuuguggagggguuaagcggcgccaccugggucgauguggugcuggagcauggguccugcgucaccaccauggccaaggauaaacccacucuggacaucgagcuccuaaaaaccgagguaaccaauccggcgguguuaagaaagcucugcauagaggcgaagauaucgaauaccacuacggacucccgcugcccaacccagggcgaagccacccuaauggaagagcaagacgccaacuucgucugccggcgcacguucguggaucggggcugggggaacggcugcgggcuguucggcaagggcagccuaaucaccugcgcgaaguucaaaugcgugacuaagcuggagggcaagauuguccaguacgagaaccugaaguacucagugauaguuacgguccacacgggcgaucagcaccagguggggaaugagagcaccgagcacggaacgaccgcuaccauuacaccgcaggcgcccacgucugaaauacagcucaccgacuauggggcccuuacccuagauugcagcccucgcacgggccuugacuuuaacgagaugguccugcuuaccaugaaagaaaagucauggcucguacacaagcagugguuccuggaccugccgcuccccuggacuucuggggcaagcacuucccaggaaacguggaaccggcaggaccuacuggugaccuuuaaaaccgcgcacgccaagaaacaggagguagugguacuuggcucccaggaaggcgcaaugcauacggcgcucacgggugccaccgagauccaaaccuccggcaccacgacuaucuucgccgggcaccugaaaugccgucucaagauggacaaguuaacguuaaaaggcaugagcuaugugaugugcaccgggucauucaagcuggagaaggaggucgcagagacacagcacggaaccgugcugguccagauuaaguacgagggaaccgacgcgcccugcaagauccccuucagcacccaggacgagaagggggugacgcaaaauggccgcuuaauaaccgcgaauccgaucgugaccgacaaagagaagcccgucaacaucgaagccgaaccgcccuucggagagagcuacaucguuauaggcguuggcgagaaggcuuuaaagcucucuugguucaagaaaggguccucgaucggaaagauguucgaggcgaccgcccgcggagcccggcgaauggccauccugggggacacggccugggacuucgggucuaucgggggcguguucaccucuguaggaaaacuggugcaccagauuuucggcaccgcguacgguguccuauucucaggcguguccuggaccaugaagaucgggauaggcguguuacugacguggcucggccuaaacucucgcagcaccagucugagcaugaccuguaucgccgucggucucgucacccuguacuuaggcgugaugguucaggccgacuccgggugcgugauuaacuggaagggcagagagcucaagugcggaagcggcaucuucgugacgaaugaagugcacacguggaccgagcaguacaaguuucaggccgauagcccuaagcgccuguccgccgcgaucgggaaggcgugggaggagggggucugugguauccggucggccacccgcuuagagaacauaauguggaagcagaucagcaacgagcucaaccacauccugcuugagaacgacaugaaguucaccguggucgugggugauguggucggcauccucgcacaggguaagaagaugauccggccgcagcccauggagcacaaguacagcuggaaguccugggggaaggccaagaucaucggcgcggacgugcaaaacacgacuuucaucaucgauggccccaauacacccgaaugucccgacgaccagcgcgccuggaacauuugggagguggaggacuacggcuucgguauauucaccacgaacauuuggcugaaguuacgggauucauacacccaggucugugaccaccgccucaugagcgccgccaucaaggacagcaaggcgguacacgccgacaugggcuacuggaucgaguccgagaagaacgacacuuggaagcuggcacgggccuccuucaucgagguuaaaaccugcaucuggcccaagucccacacccuauggagcaacggcgugcucgaguccgaaaugaucauccccaaaaucuacgggggcccgauuucgcaacacaauuaccgcccaggauacuucacacagaccgcaggccccuggcaccuugggaagcucgagcucgauuucgaccugugcgaggggacuacgguagugguugaugagcacugcggcaaccgggggccgucccugcgcacgaccaccgugacgggcaagaucauccacgaguggugcugccgguccuguacccugcccccccuccguuucaaaggggaagacggcugcugguacgggauggagauccggccaguuaaagagaaggaggaaaaccuuguaaagucuauggucagcgcggguagcggggaggucgauucuuuuagccucggacugcuguccaucagcaucaugaucgaggaggucaugcgcucccgguggagccgcaagaugcuuaugacuggaacucucgccguguuccuguuacugauuguggggcagcugacguggaacgaccuuauccggcuaugcaucaugguaggcgcaaacgccucugaucgcauggggauggguacaaccuaucuggcccucauggcaaccuucaagaugagaccuauguucgccgucggucuucuguuucggcgauuaacgucacgggaggugcuacuccuuaccaucgggcucucacugguggcaagcguugaguuacccaacucccuggaggaacugggcgacgggcucgccauggggaucaugauccugaagcugcucaccgacuuucagucucaccagcugugggccacccuguuaucccucacuuuuaucaagaccgcacugagccuccacuacgccuggaaaaccauggcuaugguccuguccaucgugagcuuauucccccuuugccuguccaccacgucgcagaaaaccaccuggcugcccguguuauuaggcucccuggguugcaagccgcucaccauguuccugaucgcugagaacaagauuuggggccgcaagagcuggccccugaacgagggcaucauggcggucggcguggugagcaucuuacucaguagccugcucaagaacgacguaccacuggccgggccguuaauugcugggggaauguuaaucgccuguuauguaaucuccgggagcucggccgaccugucucuggagaaggcugccgagguguccugggaggaggaagccgagcauucgggugcgucccacaacauccucgucgaaguccaggacgacgguacgaugaagaucaaggacgaggagcgugacgacacacugaccauauuacugaaagccacccuguuggcggugucgggagucuacccgcucucaauucccgcaacauuauucguuugguacuucuggcaaaagaagaagcaacgcagcggcgugcugugggacacacccucgccgcccgagguggaacgugccgugcuggacgauggcaucuaccgcaucaugcagcgugguuuguuagggcgcucacaggugggcguaggcgucuuccaggagaacguauuccacacgauguggcacguuacccgcggcgccgugcucauguaucaggggaagcgccucgagccgagcugggcgagcgugaagaaggaccugaucuccuaugguggaggguggcggcugcaagguaguuggaacaccggggaggaggugcaggugauugcggucgagccugggaaaaaccccaagaacguccagacggccccggggacguucaagacucccgagggcgaagugggcgcgaucgcccuagacuucaagcccgggaccuccgguagccccauugugaaucgagagggaaagaucguaggccuguacggcaaugggguggugacgaccucuggaaccuacguuagcgccaucgcacaggccaaggcgagccaggagggaccgcugccugaaauagaggacgagguguuccgcaaacgcaacuugaccaucauggaccugcaucccggauccggaaagacgagacgcuaccugccggcaaucgugcgggaggcgaucaagagaaagcuccggacccugauccuggcuccaacacgugucguggcgagcgagauggccgaggccuugaagggaaugcccauccgauaccaaacaaccgcugugaaguccgagcacacaggcaaggaaaucguugaccugaugugccacgccaccuucacaaugaggcuacucagcccgguucgcgugccgaacuacaauaugaucauuauggacgaagcccauuucacggacccauccagcauugccgcccggggguacaucuccacacgcguuggcaugggggaggcggcagcaaucuucaugacggcgacaccccccggcagcguggaggcguucccgcaaaguaacgcaguaauccaggacgaggagcgggacauacccgagcgcucguggaacuccggguacgaguggauaacggacuuccccggcaagaccgucugguucgugcccuccauuaaguccggcaaugacaucgccaacugucugcggaaaaacgggaagcgcgugauacagcugagccggaagacguucgaaaccgaguaccagaaaacgaagaacaacgacugggacuaugucgugacuacagacaucucggagaugggcgccaauuuucgcgccgaccgggucauugauccgcgccggugucuuaagcccgugauucugaaggacgggagcgagcgcgucauccucgcgggccccaugcccgucaccguggcaagugcagcacaaaggcgggggcggaucggccgaaaccacaacaaggagggugaucaauacaucuacauggggcagccgcucaacaacgaugaggaucacgcccacuggacggaggcgaagauguugcuggacaauauuaacacgcccgagggcaucauuccagcccucuucgagccugagcgggagaaauccgcggcaaucgacggcgaguaccgccugcgcggcgaggcccggaagaccuuuguggagcugaugagacgcggcgaccucccggucuggcugagcuacaagguggcauccgaaggcuuucaguauagcgacaggagaugguguuucgauggcgaacgaaacaaccagguguuggaggagaauauggacguggagaucuggaccaaggagggugagcggaaaaagcuccgcccucgguggcuggaugcccguacuuacagcgacccccuggcccuacgggaguucaaagaguucgccgcugggcgccggagcgugucgggggaccugauaaucgagaucggcaaguugccccagcaccucacucagaaggcgcagaacgcccuggacaacuuaguuauguuacacaacagcgagcaaggcgggcgcgcguaccggcacgccauggaggaguuaccggacacgaucgagacccugaugcuccucgcgcugauugcuguccucacgggcggugugacccuauucuuccuuucuggccgcggguugggcaagaccucgaucggccugcucugcgucauggccuccagcguucuccuguggauggccuccguagagccacacuggauugccgcgucgauaauccuggaguucuuccuaauggugcugcugauacccgagccagaccggcaacgcaccccacaggacaaucaacucgccuacgucguaaucgggcuguuauucaugauacuaaccguugccgcaaacgagaugggacugcuggagacgaccaagaaggacuuaggaauuggacacguggccguugagaaccaccaccacgccacuauguuggacguggaucugcaccccgccuccgcguggacccucuacgcgguugccacgaccaucauuacgcccaugaugcggcacacuaucgaaaacacgaccgccaacaucagccucacugccaucgcgaaucaggccgccaucuugauggggcucgacaaggguuggcccaucucaaagauggauaucggcgucccccugcuggcgcucgggugcuacagucagguuaaccccuuaacucugaccgccgccguccucaugcugguggcccacuacgcuauaaucggccccggguuacaagccaaagccacccgcgaggcccagaagcggacggccgcgggcaucaugaagaacccgaccguggacgggauagucgccauugaucucgaccccgugguguacgacgccaaguuugagaagcagcuggggcagauaaugcugcucauccugugcacgucccagauccugcuaaugcgcaccacuugggcccuuugcgaaagcaucacacuggccaccggcccccuuaccacccugugggaggggucccccgggaaguuuuggaacacuacuaucgcggucucgauggccaacaucuuccgggguucguacuuggcuggagccggcuuggccuucucccuuaugaagucccucgggggugggcggcgugguaccggagcucaaggcgaaacccucggcgagaaguggaagcggcaguugaaccagcugagcaaguccgaguucaacaucuacaaaagguccgguaucauggaggucgaucgguccgaagccaaggagggccuaaaacggggggagaccacucggcacgccgugucccgcgggaccgccaagcugcggugguuugucgagaggaaccugguuaagccugaggggaaagugaucgaccugggcugcgggaggggcggguggucauacuacugcgccggguuaaagaaagucacggaagugaagggauacaccaagggaggccccgggcacgaggagcccauccccauggcuacguacggguggaaccucguuaagcugcacuccggcaaggauguauucuucaccccccccgagaaaugcgacaccuuacugugcgauaucggggagagcucacccaaccccacaauagaagagggccgcacucuccggguccucaaaaugguggaaccguggcugcgcgggaaccaguuuuguaucaagauccugaacccauacaugccgagcguuguggagacccucgagcagaugcagcgcaagcacgggggcaugcuggugcgcaacccccugucccggaacagcacccacgagauguacugggucuccugcgggacuggcaacauugugucugccgugaacaugaccagucgcaugcuccugaaccgguucacaauggcccaccgcaaaccgaccuacgagcgcgacgucgaucugggggccggaacccggcauguagcgguagagcccgaaguggcuaaccucgacaucauaggccagcgcaucgagaacauaaagcaugagcacaagagcaccuggcauuaugacgaagauaauccuuacaagacgugggccuaccacggcuccuacgagguuaagcccucggggagcgccuccagcauggucaacgggguggucaagcugcuaaccaagccgugggacguuauacccauggugacccagaucgccaugaccgacacgacccccuucggccagcagcggguguuuaaagagaagguggacacccgcaccccuaaggcgaaacgggggacggcucagaucauggagguuaccgcucgcuggcucuggucauuccugucuaggaacaaaaaaccccgcaucugcacccgggaggaguucacccgaaaagugagguccaacgcugccaucggcgcggucuucguggaugagaaucaauggaacucugcuaaggaggccgucgaagacgaaagauuuugggaucucguucagaaagagcgggaacuccacaaacagggcaagugugccacgugcguguauaacaugaugggcaaaagagagaagaagcugggcgaguuugggaaggcaaagggcucccgggccaucugguacauguggcuuggggcccgcuuccucgaguucgaggcccugggcuuuaugaacgaggaccacugguuuagccgggagaacucucugagcggcgucgagggggagggucuccauaagcugggguacauccuacgugauaucucgaagauacccggcgguaacauguaugcagacgacacggcgggcugggacacuaggauuaccgaggaugaccuccaaaacgaggcuaagauaacggauauuauggagccagagcacgcccugcucgcgacuucaauuuucaaguugaccuaccaaaacaaagucgugcgcgugcagaggccugcaaagaacggaaccguuauggacgugauaucccgcagagaccagcgggggaguggccagguggggacuuacggccugaauaccuucaccaauauggaggcgcagcucauucgacagauggaguccgagggcauuuuccuccccagcgagcuagagacccccaaccuugccgagcgcguccucgauuggcuugagaaacaugggguggagagacugaagaggauggccaucagcggcgacgacuguguggucaagcccaucgacgaucgcuucgcaacggcccucacagcgcugaacgacauggguaagguccggaaggauaucccgcaaugggagcccucuaagggcuggaacgacuggcagcaggucccauucugcagccaccacuuccaccagcuuauaaugaaggacgggcgcgagaucguagugcccugucggaaccaggacgagcucgugggccgcgcacggguuucgcagggcgccggguggagcuugcgugaaaccgcaugccuagggaaaaguuacgcccagauguggcagcuuauguacuuccaucgucgugaccugcggcuggcggccaacgccaucugcagcgcgguaccgguggacugggugcccacaucccgcacgacauggaguauccacgcgcaccaccaguggaugaccaccgaggacaugcucuccguguggaacagaguguggaucgaagagaaucccuggauggaagacaaaacgcacguuucuuccuggggcgacguucccuaucugggcaagcgcgaggaccaguggugcgggagccugauaggccuuaccgcccgggccaccugggccuccaacauccaaguggccaucaaucaaguccgccgccugauaggcaacgagaacuaccuggauuacaugaccagcaugaagcgguuuaagaacgagggggacccggagggagcccucugguag

SEQ ID NO: 24261 - RNA, 9879 nt, Artificial Sequence
  derived and/or modified CDS sequence (opt11) from DENV-1__FJ882534__SS-prME
agcguuacuaugcugcugaugcuuaugcccaccgcccuggcguuccaucucacgacccgcggcggggagccgcacaugaucguauccaagcaggagcggggcaagagccugcuguucaagaccuccgcgggggugaacauguguacguugaucgccauggaccugggagagcuaugugaggacacgaugaccuauaagugcccacgcauaaccgaggccgagccagacgacguggauugcuggugcaacgcuaccgacacaugggucacguacggcaccugcagucagaccggcgagcaccgcagagacaagcgcucuguggcccuugcgccccacgugggccuggggcuggagacgcgcaccgagacguggaugagcuccgagggagccuggaagcagauccagcgggucgagacgugggcgcuccgccauccgggauucacgguaaucgcccuguuccuagcacacgccaucggcaccagcaucacacagaaggggaucauuuuuauacuccugaugcuggugaccccuuccauggcgaugcggugcgucggcaucgggucucgcgacuucguagagggucucuccggcgccacgugggucgauguaguacuggaacacgggagcugcgucacgaccauggcuaaggacaagcccacccuggacaucgagcuccugaagacggaggucacgaaccccgcggugcugcgaaaauuaugcaucgaggccaagaucuccaacaccaccacugacagccgcugcccgacccagggcgaggcgacccugguggaggagcaggaugccaacuucguguguaggcgcacguucgucgaucggggcugggggaacggcugcgggcuguucggcaaagggucccucaucacgugugccaaguucaagugcgugacaaagcucgagggaaaaauuguacaguacgagaauuugaaauacagcgugaucgugaccguccacaccggcgaccagcaccagguaggcaacgaguccacggagcacggcaccaccgcgaccaucaccccccaagcuccuacaaccgaaauucagcucacagacuacggcgcacugacccuggacugcagucccaggacgggacucgauuucaacgagaugguucugcugacuaugaaggagaagaguuggcucgugcauaagcagugguuccuggaucucccgcuccccuggaccagcggggccuccaccucgcaggaaacauggaaucggcaggaccuuuuagugaccuucaagaccgcucacgcgaagaagcaggaggucguggugcucgggccccaggagggcgccaugcacaccgcccucacgggggcaaccgagauccagaccaguggcacgacgacuaucuuugccggccaccugaaaugccgccucaaaauggacaagcugacccugaaggguaugucuuacgugaugugcacugguagcuucaagcuggagaaagagguggcggagacacagcacggcacgguguuggugcagaucaaauacgagggaaccgacgcgccuugcaaaaucccguuuuccacacaggaugagaagggagucacacagaacggcagacugauuaccgcuaacccaaucgugacagauaaggagaagccugucaacaucgaggcugagcccccguucggggagagcuacauagugauuggcgcgggcgagaaggcccugaagcucucaugguucaagaaggggagcuccauaggcaagauguuugaggccacagcccgcggugcgcgccgcauggccauccugggcgacacggccugggacuucgggucaauaggcggcguguuuaccagugucgggaagcucgugcaccagauauucggcacagccuacggggugcucuucagcggcguguccuggacaaugaagaucgggaucgguguacugcugacguggcugggacugaacagucgcaguaccaguuuguccaugaccuguaucgccguuggacucguuacgcuguaucugggcgugauggugcaggccgacagcgggugcgucaucaacuggaagggcagggagcuaaaaugcgguucugggauuuucgugacgaacgagguucacacguggacggagcaguacaaguuccaggcggauucgcccaagcggcuaucagccgccaucggcaaggccugggaggaaggggucugcgguauucgcagcgcuacccgucuugagaacaucauguggaagcagaucagcaacgagcucaaccacauacuucuggagaacgacaugaagcucaccguggucgucggggacguugcaggcauccuggggcagggcaaaaagaugaucaggccgcagccaauggaauacaaguacuccuggaagagcuggggcaaggccaaaaucaucggggccgacgcucagaacacgaccuucaucaucgauggaccaaacacucccgagugcccugacgaucagcgcgcguggaacaucugggagguugaggacuacggguucggcauuuucaccacgaauaucuggcuaaagcucagggacuccuacacccagguaugugaccaccgccuuaugucagcggcaaucaaggacucaaaggccguacacgccgauaugggcuacuggaucgagucagagaagaacgaaacguggaaauuggcgcgggccuccuucaucgagguaaagaccugcaucuggcccaagagccacacgcuuuggucgaacggaguacuggagagcgagaugaucauaccgaagaucuacggcgggcccauaucccagcacaacuaccgacccggcuacuucacgcagaccgccgggccguggcaucuaggcaagcucgaguuagauuucgaccugugcgagggcacaacggugguagucgacgagcauugugggaauagaggccccucacuucgcaccaccaccgugacggggaagaucauccacgaguggugcugucggagcugcacccugcccccccuccgcuuccggggcgaagacggcuguugguauggaauggagauccgcccggucaaggagaaggaggagaaucucgucaaaagcaugguuucugccggcagcggggaaguggacagcuucucccuaggccuccucuguaucucuaucaugaucgaggaggucaugcggucccgcuggagccgcaagaugcuuaugaccggaacucuggccguguucuuccuccuaaucaugggccaacugacuuggaacgaccugauccgccuuugcauuauggugggggcgaacgccucagaccgcaugggaaugggcacuaccuaccuggcccucauggccaccuuuaagaugagaccuauguucgccgucgggcugcuguuucggcggcuaacgagcagagaggugcuucugcuaaccauaggccucaguuuaguggcgaguguagagcuccccaacagccuggaagagcugggggacggccuugccaugggcaucaugauacugaagcuguugaccgauuuucagucccaccaguuaugggcgacucugcucucccugacuuuuaucaagaccaccuucagccugcacuaugcuuggaagaccauggcaauggugcucaguaucgucucacuguucccccuuugccucuccacgaccagccagaagacgacgugguuaccggugcuucuaggauccuuggggugcaagccccugacgauguuccucaucguggagaacaagauuugggggcggaagagcuggccccugaacgagggcaucauggccguagggaucguguccauccugcucagcagccuucugaaaaacgacgugccccucgcagggccacugaucgccggcgggaugcuaaucgccugcuacgucauuucggguagcuccgcggaccucagccuagagaaggccgccgagguauccugggaggaggaggccgaacauaguggugcaagccacaacaucuugguggagguucaggaugauggcaccaugaagaucaaggacgaagagcgcgacgacacccucacaauacugcuuaaggcgacccuacuggccguaucugggguguacccgcuauccauccccgccacgcucuucgucugguacuucuggcagaagaagaagcagcggucaggcgugcugugggacacccccuccccgcccgagguggagcgcgcgguacuggacgacgggaucuaccgcauuaugcaacgggggcuguugggccggagccaggucggaguggguguguuccaggagaauguuuuccacacuauguggcacgugacgcguggugcaguccugauguaccagggaaagcggcuggagcccuccugggcaagcguaaagaaagaucucaucuccuacggugggggauggcgccugcgggguuccuggaacacgggagaggaagugcaaguaaucgcgguggaaccaggaaagaacccgaagaacgugcagaccgccccgggcaccuucaagacgcccgagggcgaggucggggccaucgcccuggacuucaagcccgguacuucugguucccccauaguaaaccgcgagggcaagaucgucgggcuguacgggaauggcgucgugaccaccuccgggaccuacgugagcgcgaucgcucaagcaaaagccagccaggagggucccuuacccgagaucgaagacgaagucuuccgaaagcgcaacuuaaccaucauggaccuccacccgggguccgguaagacacggagguaucugcccgcgaucgugagagaggcaaucaagcgcaaguugcgcacucugauccuggcgcccacgcgggucgucgccagcgagauggcugaggcguugaagggcaugcccauaagguaccagacgacugccgugaaaucggagcacaccgggaaagaaaucguggacuuaaugugccaugccaccuucacgaugcgguuguuaucuccggucagaguccccaacuauaacaugauuaucauggacgaagcgcacuucacugaccccuccagcaucgccgcgcggggguauauaaguacucgcguugguaugggcgaagcggccgcaaucuucaugaccgcuacgccacccgggagcgucgaggcguucccccagaguaacgccguuauccaggaugaggagcgggacauacccgagcgcucguggaacaguggcuacgaguggaucacagauuuccccgguaaaaccgugugguuugucccgagcaucaagucugggaacgacaucgccaacugcuuacggaagaauggcaagcguguuauucagcugagccggaagaccuucgacaccgaguaucagaagaccaagaacaacgacugggacuacgugguaaccacagacauuucggaaaugggugccaacuuccgcgcugaccgcgugaucgacccccgccggugccuuaagcccgucaucuuaaaggauggcccagagcgcgucaucuuagccgggccuaugcccgugacggucgccucugccgcgcaacggcgcggccggaucggucgcaaucacaacaaagaaggggaccaauacaucuauaugggccagccacugaauaacgacgaggaccacgcacacuggacagaggccaagauguuacuggauaacaucaauaccccagaggggauuauucccgcccuuuucgagcccgagcgcgagaagucugccgccguagacggagaguacagacuuagaggggaggcgcggaagaccuucguggaacugaugcgacggggcgaccugccggucuggcucagcuacaaggucgccuccgagggcuuucaguacuccgaccgccggugguguuucgacggcgagcgcaacaaccaggugcucgaggagaauauggaugucgagauuuggaccaaggagggagaacggaagaagcugcgcccccgcuggcucgacgccaggaccuacagcgacccgcucgcccugagagaguucaaggaauucgcagcggggcgccgguccgugagcggcgaucuuauucuagagaucggcaaacugccccagcaccuuacgcagcgcgcccagaacgcccuggacaaccuggugaugcuacacaacuccgagcaaggaggacgagccuaccgccaugccauggaggagcuuccggacacgaucgagacgcuuaugcucuuagcucugaucgccguccucaccgggggcguuacccucuuuuuccugucugggcggggccuggguaagaccuccaucggccugcugugcgugauggccaguuccguccuucuguggauggccagcguggagccccacuggaucgcggccuccaucauccuggaguucuucuuaaugguguugcugaucccagagccugaccgccagcguaccccccaggacaaucagcuagccuacgucgugauaggccuacuguucaugauccucacgguagcugcaaacgagauggggcugcuggaaaccacuaagaaggaccugggcaucggacacguggcgguggagaaucaccaccacgcagccaugcuagauguggaucuccauccggccucugccuggacccucuaugccguugcaacgacgauuauaaccccaaugaugcgccacaccauagaaaacacuaccgccaacaucucccugacggccauugccaaccaagcugccauccugaugggucucgacaagggcuggcccauuucuaagauggauaucggggugccucugcuggcccucggcugcuacucccaggugaacccgcugacucugacagccgcggugcuuaugcugguagcgcacuacgccaucauaggucccggccugcaggccaaggcgacccgcgaggcgcagaagcggaccgcugccggaaucaugaagaacccuaccgucgauggcauugucgccaucgaccuggaccccgugguguacgacgccaaguucgagaaacaauugggccaaaucaugcugcuaauccuauguacgucgcagauccuucucaugcgcaccaccugggcgcugugcgagucuaucacccuggccacggggccucucacuacccuuugggagggcagccccgggaaauucuggaauaccacgauugcggucuccauggccaacaucuucaggggcagcuaccuggccggcgcggggcucgccuucagucuaaugaagagccucggaggaggccggcgggggaccggagcccagggagagacccucggggaaaaauggaagcgucaauuaaaccagcugagcaaauccgaguucaauaccuacaaacggucugguauuauggagguggaucgcagcgaagccaaggaaggucugaagcggggugagacgaccaaacacgcgguuagucgcgguacugccaagcugcgaugguucgucgagcgcaauuuagugaagcccgagggcaaggugauugaccugggcugcgggcggggcgggugguccuacuacugcgccgggcucaagaaggucaccgagguaaagggguauacgaaaggcgguccggggcaugaggagccgaucccgauggccaccuacggguggaaccuggugaaauugcacucggguaaggaugucuucuucauacccccagagaagugcgacacccuccuaugugacaucggcgagucgagcccgaaucccacuaucgaggaggggcgcacgcugcgggugcucaagaugguggagcccuggcugcgcgguaaucaguucuguaucaagauccuaaacccguacaugccguccgucguggagacccucgagcagaugcaacggaaacauggcgggaugcugguacgaaacccccucagccggaacuccacucacgagauguacuggguguccugcggcaccgguaauaucgugagcgccguaaacaugaccagcaggaugcuccugaacagauucacgauggcucaccggaagccuaccuaugaacgcgacgucgaccugggcaccggcacccgacauguggcgguggaacccgaggucgcgaacuuagacaucaucggucagcgcaucgaaaauaucaagcaugagcacaagaguacguggcacuacgaugaggacaaccccuacaagaccugggccuaccacggaagcuacgaggugaagcccucugggagcgccuccagcaugguuaacggcgugguuaagcugcucacgaagcccugggacgucauccccauggugacucagaucgcgaugacagacacuaccccguucgggcagcagcgaguguucaaggagaagguagacaccaggacgcccaaggccaagcggggaacggcccagaucauggagguuaccgcccgcuggcucuggggcuuucugagccguaacaagaaaccccgcaucugcacccgggaagaguucacacgcaagguuagaucgaaugcggcaaucggggccgucuuugucgacgaaaaccaguggaacagcgccaaggaggcuguggaagaugaacgcuucugggaccucguccaucgggagagggagcuccacaagcaaggcaagugcgcgacuugcguguacaacaugauggggaagcgggagaaaaagcugggugaguucgggaaggcaaagggcucucgcgcgaucugguacauguggcugggcgccagguuccucgaguucgaagcccugggguucaugaacgaggaccacugguuuagccgcgagaacucucugagcggcguggagggggaaggccuccacaaguuaggguacauccugcgggauaucuccaagaucccgggcggcaacauguacgcggacgauaccgccgggugggacacccgcaucacggaggacgaucuccaaaacgaggccaagauaacggacaucauggagcccgagcacgcccugcuugccaaggcgaucuuuaagcucaccuaccagaauaagguggugagggugcaacggccugccaagaacggcaccguuauggacgugauaagccguagggaccagcgcgggucuggccaagugggcacuuauggguugaacacuuucacaaacauggaagcgcagcucauucggcagauggagagcgagggaaucuucucgcccagcgagcuagagaccccuaaccuagccgagcgcgcccuggacuggcucgaaaaguacggggucgagcggcugaagcgcauggcgauauccggcgacgauugcguagugaagcccaucgaugaccgguucgccacggcccucaccgcucucaacgacauggguaaaguacgcaaggacaucccccagugggaaccuagcaagggcuggaacgauuggcagcaagugccauucuguucccaccacuuccaccagcugaucaugaaggacggccgggagaucguggugcccugccgcaaccaggacgagcuaguugggcgagccagggugagccagggcgcgggcuggagucuucgggaaacggcaugucucgguaaauccuacgcccagauguggcaacuaauguacuuccaccgucgagaucucagacuggccgcuaacgcuaucugcagcgccguccccguugauugggugccuacuucccggacuacuuggucaauccacgcccaccaccaguggaugaccacggaggacaugcuguccguuuggaaccgcguguggauagaagagaacccauggauggaggacaagacacacauaagcuccugggaggacguaccguaucucgggaagagggaagaccaguggugcggcagccugauaggcuugaccgcacgagcaacaugggcaacgaacauucaaguagcuaucaaccaagugaggcggcucaucggcaaugagaacuaccuggauuauaugaccuccaugaagagguucaaaaacgagagcgaccccgaaggcgcgcugugguga

SEQ ID NO: 24262 - RNA, 9879 nt, Artificial Sequence
  derived and/or modified CDS sequence (opt11) from DENV-1__FJ882536__SS-prME
agcgugaccauguugcucaugcugaugccgacagcccuggccuuucacuugaccacucgcggcggggagccccacaugaucguaagcaagcaggagcgugggaagagccuacuguucaaaaccuccgccggugugaacaugugcacccucaucgccauggaucugggcgagcugugcgaggacacgaugaccuacaagugcccccgcaucaccgaagcagagcccgaugacguggacugcuggugcaacgccacagacaccugggugaccuacgggaccugcucucagaccggcgagcaucggcgcgauaagagauccguggcccuugcgccccacgugggccuaggacucgagacgaggacagagacguggauguccagcgaaggcgccuggaagcagauccagagggucgagaccugggcccuccgccaccccggguucacggugaucgcccuguuccuggcacaugccaucggcacgagcaucacgcagaagggaaucauuuucauccuccugaugcucgugacuccauccauggccaugcggugcgucggaauuggcagccgagacuucguagaggggcuuaguggagcgacguggguggacgucgugcuggagcacgggucuugcgugacgacuauggccaaggauaaacccacccuggacauugaacuccugaagacggaggucaccaacccagcggugcugcggaagcucugcaucgaagcgaaaauuuccaacacaacgacggacagcagguguccgacccagggcgaagccacccugguugaggagcaggacgcgaacuuugucugccggcgcacauucguggaccgcgguugggggaacggcugcgggcuguuuggcaaaggguccuugaucacgugcgccaaauuuaagugcgugaccaagcuugagggcaagaucguccaguacgaaaaccuaaaguacucggugaucguuaccguccacacaggcgaccagcaccagguggguaacgaguccacggagcacggaaccacugcaaccaucacgccccaggccccaacaacugagauccagcucaccgacuacggagcccugacccuggacugcagcccccgcacaggccuggacuucaacgaaaugguccugcugaccaugaaggagaagucauggcucguccacaagcagugguuccuagaccucccccuccccuggacaaguggggccucuaccucccaggagacguggaacaggcaggaccuguuggugaccuuuaagaccgcccacgcgaagaagcaggagguaguaguucucggcucccaggagggcgccaugcacaccgcucugacgggugcgaccgagauucagacguccgggaccacgaccaucuucgccgggcaccugaagugccgauugaagauggauaagcugacccugaagggcauguccuaugucauguguaccggguccuucaaacucgaaaaagaaguggcggagacgcagcacggcaccgugcuaguccagaucaaguaugagggcaccgacgcccccuguaagauccccuucagcacccaggacgagaagggugugacgcagaacggccggcugaucaccgccaacccgaucgugaccgauaaggagaagccugucaacaucgaggccgagccuccauucggggaguccuacaucgugauaggcgcuggcgagaaagcccugaagcugagcugguucaagaagggcuccagcaucggcaagauguucgaggccaccgcucgcggggcccggaggauggcgaucuugggcgauacggccugggacuuuggcuccaucggcggcguguucacuucggucgguaaacuugugcaccaaauuuucgguaccgccuacgggguccuguucuccggcgucagcuggaccaugaaaauagguauaggagugcugcugacauggcucggccugaauucgaggagcaccucgcugagcaugaccugcauugccgugggccuagucacucuguaucugggaguuauggugcaggcagacagcggaugcgucaucaacuggaagggccgggaacucaagugcgggagcggcauauucguuacgaacgaagugcauaccuggacagagcaguacaaguuccaggcggacagcccgaagcgccugucggccgcaauugguaaagccugggaggaaggcgucugcgggauucgaagcgcuacucgccuggaaaauaucauguggaaacagauauccaacgaacucaaucauauccugcuggaaaacgauaugaaacugaccgugguggucggcgacguggccggcauacugggucagggcaagaagaugauccggccccagcccauggaguauaaguacagcuggaaguccuggggcaaagcaaaaaucauaggggccgacgcccaaaacacuaccuucauuauugacggccccaauaccccggagugccccgacgaucagcgcgcuuggaauaucugggagguggaagacuacggguucggcaucuuuacaaccaacauuuggcugaagcuccgggacagcuacacccagguuugcgaucaccgcuugauguccgcggccaucaaggacagcaaggccgugcacgccgacaugggcuacuggaucgaguccgagaagaacgagaccuggaagcuagcccgagccagcuucaucgaggugaagacuugcaucuggcccaagucgcacacgcucuggagcaaugguguccuggagagugagaugaucaucccgaagaucuauggagggccgaucagucaacacaauuaccgcccaggguacuucacccaaaccgccggaccuuggcaccugggcaagcuggaacuggacuucgaucuaugcgaaggcacuacggugguggucgacgaacacugcggcaaccgcgguccuagucuccgcaccaccacugucacgggcaaaaucauccacgaguggugcugucgguccugcacccugccgccccuucgcuuccgcggcgaagacgggugcugguacggcauggagauccgccccgugaaggagaaggaggagaacuuagucaaguccauggucagcgcuggcagcggggagguggacagcuuuucacuaggccuucucuguaucaguaucaugaucgaggaggugaugcggagccgcuggucacggaagauguuaaugacagggacccuggccguguucuuccucuuaaucaugggccagcuaacguggaacgacuuaauccgcuugugcaucauggugggggcgaacgccagcgaucgcauggguaugggaaccaccuaccuggcccuuauggccacuuucaaaaugaggccuauguuugccgucgggcugcuguuccgccgccugacaagccgagaggugcuguugcucaccaucggccugaguuugguggcguccgucgagcucccuaacagucuggaggaguuaggggacggccucgccaugggcauuaugauccugaaguuacucacugacuuccagucucaccagcugugggccacucuucucagccucacauucauaaaaacaaccuucagucuccacuacgccuggaaaaccauggcaauggugcucucuaucgucucccuguucccccugugccucagcacgacaucccaaaagaccaccuggcuucccgugcuucucgggucucugggcuguaagccguuaacgauguuucucaucgcugagaacaaaauaugggggcggaagaguuggcccuuaaacgaagguaucauggccguggggaucgucagcauacuauuaagcagcuugcugaagaaugacgugccucucgcggggccccugaucgccggcggaaugcugaucgccuguuacgugauuucggguuccagcgcagaccucucccuggagaaggccgccgaggucucaugggaagaggaggcagaacacaguggggccagccauaauaucuugguggaggugcaagacgacggcaccaugaagaucaaggacgaagagcgcgacgacacccucaccaucuuacugaaggccacccuguuagcgguuucggggguguacccgcugaguauccccgccacccucuucgucugguacuucuggcagaaaaagaaacagcgcaguggaguacugugggacaccccuagcccgcccgagguggagcgagccgugcuugacgacggcaucuaccggauaaugcagcgcgggcugcucggccguucccaggucggcguggggguguuccaggagaacguuuuccacaccauguggcacgugacccgcggggcggugcugauguaccaggggaaacgacuggagccgagcugggccuccgucaagaaagaucuuauuagcuacggcgggggcuggagguugcgggguagcuggaacacgggcgaggagguccaggugauugcugucgagcccggaaagaauccaaaaaacgugcagaccgcccccggaaccuucaagaccccugaaggcgaagugggugcaaucgcgcuggauuucaagccuggcacgagcgggucccccaucgucaaccgcgaaggcaagaucgugggccucuacgggaacggcguuguuaccaccucaggcaccuacguauccgccaucgcccaggccaaggcgucccaagaggggccgcugcccgagauagaggaugaaguuuucagaaagcgcaaccugacaaucauggaccuccacccagggucaggcaagacccggcgauacuugccagcgaucguacgggaggccaucaaacgcaagcugaggacguugauccuggcacccacccgagugguugccuccgagauggcugaggcccugaaggguaugccgauccgcuaccaaacgaccgccguaaagucggagcacaccggaaaggagaucguggaucuaaugugccaugcuaccuucacaaugcgucugcucucccccgugcgcgucccuaacuacaacaugauuaucauggacgaggcccacuucaccgaccccagcuccauugcggcucgggguuacaucuccacccgaguggggaugggcgaagccgcagcuauuuucaugaccgccacuccgccuggcuccguagaagccuucccgcagaguaacgccgucauccaggacgaggaacgggacauccccgagcgcuccuggaauagcggcuacgaauggaucaccgacuucccugggaagaccgucugguucgugcccagcaucaaaagcggcaaugacaucgccaacugccuucggaagaacggcaagcgagucauccagcugucccggaagaccuucgacacggaguaccagaagaccaagaacaacgacugggacuacguggugaccaccgauaucagcgagaugggugcgaacuuccgcgccgaccgggugauugauccgcgccggugccugaagccggugauccucaaggacggccccgaacgcguaauucuugccgggcccaugcccgucacgguggccuccgcggcgcaacggcgcggccggauaggcagaaaucacaacaaggagggggaccaguacaucuacaugggucaaccccugaauaacgacgaggaccacgcccacuggacugaagcgaagaugcuccuggacaauauuaauacucccgaggggauuaucccugcccuguucgagccggagcgcgagaaguccgccgcgguugacggcgaguaccgucuccgcggggaggcccggaagaccuucguggagcucaugaggcggggagacuuaccuguguggcucuccuacaagguggcuucagagggcuuccaguacagcgaucgccgguggugcuucgacggagagcgaaauaaccaggugcuggaggagaauauggacguagagaucuggacuaaggagggcgaacggaagaagcucagaccccgguggcucgacgcaaggaccuacuccgacccuuuggcccuucgagaauucaaagaguucgcggccgggcgccgauccguauccggcgaccucauccuggagauuggcaaacugccucagcaucucacccagcgcgcucagaacgcccuggacaaccuagugaugcuccauaacuccgagcagggcggccgggcguaccgccacgccauggaggaacugcccgacaccauagagacgcugaugcucuuggcccugaucgccgugcucaccgggggcguuacucucuuuuuccuguccgggcgcggccucggaaagaccagcauaggccugcuaugcgugauggcauccagcguccuccuauggauggccuccguggaaccccacuggaucgccgccucaaucauccuagaguucuuccucauggugcuguugaucccagagccugaccgucagcgaacgccccaagacaaccagcucgccuacguggucaucggccuccuguucaugaucuuaacgguagccgcgaaugagaugggguugcuugagacaaccaagaaggaccucggaaucgggcacguggcaguggagaaccaccaccacgccgccaugcuggacgucgaccugcacccugccuccgcguggacccucuacgccguggccacgacaaucaucacacccaugaugcgucacaccauugaaaauacgacagccaacaucagcuugaccgccaucgcgaaccaggccgccauuuuaaugggguuggacaagggcuggccgaucuccaagauggauaucggcguuccccugcuggccuugggaugcuauagccaggugaacccccucacccugacggcugccguucucaugcuggucgcgcacuacgccauaauagggccuggacuccaggccaaggcuacgcgcgaggcccagaagcggaccgccgccgggaucaugaagaacccuaccguagacgggaucguggccaucgaucucgaccccguaguguaugaugccaaguucgaaaaacagcugggccaaauuaugcugcugauccugugcaccucccagauccugcugaugcgcaccaccugggcccugugugagagcauaacucuggccacugggccacucacaacucugugggaggguuccccuggaaaguucuggaauacgacgauugcagucagcauggcaaacaucuuucggggcucauaccuugcaggcgccggacucgccuucagccugaugaagucccuuggcgggggccgccggggaacaggcgcgcaaggcgagacgcucggggaaaaguggaagcgccaacuaaaucaacugaguaagucggaguuuaacacauauaagagauccggcauaauggagguggaccgcagcgaggcgaaggaggggcucaagcggggcgagacgacgaaacacgcaguuucucgaggaaccgcgaagcugcggugguucguugagcgcaaccuuguaaagccagaggggaaagugauugaccugggcugugggcggggcggcuggagcuacuacugcgccggccucaaaaaagugaccgaggucaaaggguacacgaagggcgggcccgggcaugaggagccaaucccgauggccacauacggguggaacuuagugaagcuucacagugguaaggacguguucuuuauaccgccggagaagugcgacacacugcugugcgacaucggagaaaguucccccaacccgaccaucgaggaggguagaacgcugcgcguccucaagaugguugagcccugguuacgagguaaucaauucuguaucaagaucuugaaucccuacaugcccagcgucgucgaaacccucgagcagaugcagcguaaacacggcgggauguuagugaggaacccgcugucacggaacagcacccacgagauguacugggugucuuguggcacgggcaacauugucagugcggugaacaugaccucccgcaugcuccucaaccgcuucaccauggcgcaccggaagcccaccuaugagagggacguugaucugggcacuggcacccggcacguggcgguugaacccgagguggccaaucucgacaucauaggccaacgcauagaaaacauuaagcacgagcacaagagcacuuggcacuacgacgaggacaaccccuacaagaccugggccuaucacggcuccuacgaagucaagccgagcggcuccgcgagcagcauggucaacggugucgugaagcugcugaccaagccuugggacgugauacccauggucacacagaucgccaugacggacaccacaccuuucgggcagcagcgggucuucaaggaaaagguagacacccgcacgccaaaggcaaagcggggcaccgcccaaauaauggaggucacggcccggugguuauggggauuccugucacggaacaagaagccucgcaucugcacccgggaggaauucacacgcaaagugaggagcaacgcggccaucggggccgucuucguagacgagaaccaguggaauucugccaaggaggccguggaggaugagcgcuuuugggaccuggugcaucgggagagagagcuucacaagcagggcaaaugcgcgaccugcgucuacaacaugauggggaagcgggagaagaagcugggcgaauucggcaaggccaaaggcagccgcgccauaugguacaugugguuaggagcccgguuccucgaguucgaggcacuuggguucaugaacgaggaccacugguucucccgugagaacagcuugucaggcguggaaggggagggcuugcacaagcuggguuacauccugcgugacaucagcaagauccccggugggaauauguacgccgacgacaccgcggggugggacacccguauaacagaggacgauuugcagaacgaggcaaagaucacagauaucauggagccggaacacgcucugcuggcaaaggccauuuucaagcugaccuaccagaacaaggugguccgugugcagcggcccgcaaagaacggcaccguuauggacgugaucucccgccgggaccagcgcgggagcggccagguggguacauaugggcugaacacuuucaccaacauggaggcgcagcugaucagacagauggaguccgagggcaucuuuucuccauccgaguuggagaccccuaaccuggccgaaagggcgcucgacugguuggagaaguacgggguggagagauuaaagcgcauggccauuucaggcgaugacugcgucguuaagccuauugaugaccgguucgccacggcccugacggcccucaacgacaugggaaagguucggaaggacauaccgcagugggagccuuccaagggcuggaacgacuggcagcaaguccccuucuguagccaccacuuccaccaacugaucaugaaggauggccgggagaucguggugcccugucgcaaccaggacgagcuggucgggcgggcgagagugagccagggcgcaggguggagccuccgggagaccgccugccugggcaaaagcuacgcacagauguggcagcugauguauuuccaccgccgggaccugagauuagcggcgaaugccaucugcagcgccguacccgucgacugggugccuacgagccggacgaccuggagcauccaugcucaccaccaguggaugaccacugaggacaugcugagcguguggaaccgugucuggaucgaggaaaacccauggauggaggacaaaacacacauuucguccugggaggacgugccguaccucgggaagcgcgaggaccaauggugcggcucgcuuaucggccugacagcacgagccaccugggccacaaacauccagguggccaucaaucagguccgccgguuaaucgggaaugagaacuaccuggacuacaugaccagcaugaagcgcuuuaagaaugaguccgaucccgagggcgcccugugguag

SEQ ID NO: 24263 - RNA, 9879 nt, Artificial Sequence
  derived and/or modified CDS sequence (opt11) from DENV-1__FJ882537__SS-prME
agcgugacaaugcugcucaugcugaugcccaccgccuuggccuuucaccugaccacccggggcggggagccccauaugaucguguccaagcaggagcggggcaagucucugcuguucaagaccagcgcuggaguuaacaugugcacccucaucgccauggaccugggcgaacugugugaggauaccaugaccuacaagugcccccggaucaccgaaguagaacccgacgacguugacugcugguguaacaccaccgacacuuggguuacauaugggaccuguagccagacgggcgaacaccggcgcgacaagaggucgguggcccucgcgccccacgucggccugggacuggaaaccagggcagagaccuggaugaguagcgagggggccuggaagcagauacagaagguggaaaccugggccuugcgucaccccggguucacgguuaucgcccuguuucuggcacaugcuauugggaccagcauuacucaaaaggggauaaucuucauccuccugaugcuggucacccccuccauggccaugcgcugugucgggaucgggagccgggacuucguggaggggcucucuggcgccacguggguagacguggugcuagagcacgggagcuguguuaccacgauggcgaaagacaagccaacucucgacauugaguugcugaagacugaggucacuaacccggcugugcugcgcaagcucugcauugaggcgaagaucucuaacaccacaacggacucgcggugcccgacccagggcgaggcuacccugguugaggagcaggacgccaacuucgucugccgcaggacguucguagacagaggcugggggaacggcugcggucuguucggcaaggggagucucaucacgugcgcuaaguuuaagugcgucaccaaacuagagggaaagaucguacaguaugagaauuugaaauacagugucauugugaccguucacaccggugaccaacaucagguagggaaugaguccacagagcacggcacgaucgccacgaucacgccccaggcuccgaccagcgagauccaacucacggacuacggagcccugacccuagacugcagccccagaacuggccucgacuucaacgagaugguccugcugaccaugaaggagaagaguugguuagugcauaaacagugguuccuugaccugccccuaccguggacgagcggggccagcaccagccaggagaccuggaaccgccaggaccuacuggucacuuucaagacggcccaugcuaagaagcaggagguugugguucucggcucccaagagggcgcuaugcacacagcccugaccggggccaccgagauccagacgacagguaccaccaccaucuucgccggucaccugaaaugucggcuaaagauggacaagcuaacgcuaaagggaaugucuuacgugaugugcaccggguccuucaagcucgaaaaggaaguagccgagacacaacacggcacgguccuugugcaaauaaaguacgagggaacugacgcuccuugcaaaauacccuucaguacacaggacgagaaaggggugacccaaaacggcagauuaaucacagccaacccuaucgucacagacaaggagaaaccaguuaacaucgaagccgagccgccguucggggagucuuacaucguuaucggcgcgggcgagaaggcgcugaagcucagcugguucaagaaaggguccaguauuggcaaaauguucgaggcuaccgccagaggcgcccgucgcauggccauacugggcgauacagcaugggacuuugggucuaucggaggcguauucaccuccguugggaaacuggugcaccaaaucuucggaacugccuacggaguccucuucuccggcgugucauggaccaugaagaucggaaucggcgugcuguugacuuggcucggauugaacucccguagcacaucccuuagcaugaccuguaucgccgucgggcucaucacccuguaccugggugucauggugcaggccgauuccggaugcguuaucaacuggaagggccgcgagcucaagugcgggucugguaucuucguaaccaacgaagugcacaccuggaccgaacaguacaaguuccaggccgacagcccaaaacggcucucagcugccaucggcaaggccugggaagaaggggucugcggcauucguagcgcaacucggcuugagaacaucauguggcgccagaucuccaacgaguuaaaccacauccuccuggagaacgacaugaaguucacaguggugguaggggacgugguggggauccucgcgcaggguaaaaagaugguccggccccagcccauggagcauaaguauagcuggaaguccuggggcaaggcgaaaaucaucggcgccgacguacagaacaccacguucaucaucgacggaccaaacaccccagaaugcccugacgaccagcgcgccuggaacaucugggagguugaggacuacggguuugggaucuuuaccaccaacaucuggcugaaguuacgggacagcuauacgcaggucugcgaccaccgccugauguccgcugcgaucaaggacagcaaggccgugcacgccgacaugggcuacuggaucgaguccgagaaaaaugagaccuggaagcuggcccgggcaagcuuuaucgaggugaagaccugcaucuggcccaagucucacacacuguggucaaacgggguccuugaguccgagaugauuauacccaagauauacggcggccccauuagccagcacaacuaccgcccgggcuauuucacgcagacugccggucccuggcaucuggggaagcuggaguuggacuucgaccugugcgagggcacgaccguaguaguggaugagcacugcgggaaccggggcccuagucugcgcaccacgaccgugacuggcaagaucauccacgaguggugcugccgguccugcacguugccgccucuccgcuucaagggggaggacggcugcugguacgggauggagauccggcccgugaaggagaaggaggagaaccugguuaaaagcaugguaucugcaggcuccggcgagguggauuccuucucgcucgguuuacucugcaucuccaucaugaucgaagaggugaugagaagcagaugguccagaaaaaugcucaugacaggcacccuugccguguucuuccuacucaucauggggcagcugacuuggaaugacuugauccggagcugcauaauggucggggccaacgcauccgaccgcauggguaugggcacgacuuaccucgcacugauggccacuuuuaagaugcgcccgauguucgccgucggacugcuguuucggcgacugaccagccgggagguucuguuauuaacaaucgggcugucccucgucgccagcguggagcugccaaacuccuuagaggagcucggcgacgggcuggccauggguaucaugauccugaagcuuuugacagauuuccagagcuaccagcucugggcgacccuccugucacuuacguucaucaagacuacuuuuagcuuacauuaugcauggaagaccauggccaugguguuaucaaucguuagccugcucccgcugugccuauccacgacgagccagaagacaacauggcugcccgugcugcuaggcucccuugguugcaagccgcuaaccauguuucugauagccgaaaacaagaucuggggccgcaaaucuuggccacucaacgaggggaucauggccgucggaaucgucagcauacugcuguccagccuacugaagaacgaugugccccuggccgggccccugaucgcgggcggcauguuaaucgccugcuacgugaucuccggaagcagugccgaucugucucucgagaaagccgccgagguguccugggaggaggaggccgagcacucaggcgccucucacaauauucugguggagguucaggacgacgguacuaugaagaucaaggacgaagagcgagacgacacgcugaccauacuccugaaagccacacugcucgcagucagcggcguguacccguuaucaauucccgccacccuguucgucugguacuucuggcagaagaagaagcaacgcucggggguccucugggacacgccuagcccgccggagguggagcgggccgugcuggacgacggcauuuaccgcauuaugcaaagaggcuuacuggggcgcagccaggucggcguggguguuuuccaagagaacgucuuccauaccauguggcacgugacccggggagccgugcuuauguaccaggggaagaggcucgaaccaucaugggcaagcgucaaaaaggaccuaauuuccuacggcggcggguggcggcuccaggguagcuggaacaccggggaagagguccaagugaucgcgguggagccuggcaagaacccaaagaacguccaaacugcccccgggaccuucaagaccccagagggcgaggugggcgccauugcccuggauuucaagcccgggaccucgggcucuccaauaguuaaccgagaggggaagaucgucggcuuguacggcaacgguguggucacgaccagcggcaccuacgugucggcaaucgcccaggcuaaggccagccaggaggggccacucccagagaucgaggacgagguguuccggaaacgcaaucuaaccaucauggaccuucacccuggcuccgggaagacacggcgcuaccucccggccaucgucagggaagcgaucaagagaaagcuaagaacccugauccuggcgcccacccgcguggucgccagcgagauggccgaagcccucaagggcaugcccauucguuaccagacaacugcggucaagagcgagcacaccggacgggaaauaguggaccuaaugugccacgcaacuuucaccaugaggcuucucagccccgugcgaguaccuaacuacaauaugaucauaauggacgaggcacacuucacggaccccuccucaauugccgcccgcggguacaucuccacccggguagguaugggggaggcggccgccaucuuuaugacggccacgccgcccggcagcguggaggccuucccacaguccaacgcgguuauucaagacgaggaacgcgacauucccgaacggagcuggaacuccggguaugaguggauuaccgacuucccaggcaaaacggugugguucgugcccaguaucaagucaggcaacgacaucgcaaacugucuucgcaagaacgggaaacgggucauccagcucagccgaaaaacuuucgacacagaguaccagaagacgaagaacaaugacugggacuacguggugacaaccgacauauccgaaaugggcgcgaacuuucgggccgaccggguuaucgacccgcggcgcugccugaagcccguaauccuaaaggacggaccugagcggguuauccuugcggggcccaugccggugaccgucgccagcgccgcccagcgcagagggcgcaucggccggaaucacaacaaggaaggugaccaauacaucuauauggggcaaccccuuaacaacgacgaggaccacgcgcauuggacggaagcgaagaugcugcuugacaauaucaauaccccugaaggcaucauccccgcccuguucgagcccgagcgagagaaguccgcugccauagacggggaguaccgccugcggggcgaggcccgcaagaccuucgucgagcucaugcggcgcggggaccugcccgucuggcugagcuacaaaguggcgagcgagggguuccaauauuccgaccggaggugguguuuugacggcgagcggaauaaccaaguccucgaggaaaauauggacguggagaucuggaccaaggagggggaacguaaaaagcugcguccccgauggcuugacgcucggacguacagcgacccacuugcccugcgcgaauuuaaagaguucgccgccggaaggcgcuccgugucaggagauuuaaucuuagagaucggcaagcugccgcagcaucugacgcagcgggcucagaacgcccucgacaacuuaguuaugcuccacaacuccgagcagggcgggcgggccuaucggcacgcaauggaagagcuccccgauaccauagagacccuuaugcugcucgcgcucaucgccguguuaacaggcggggugacccuauucuuccuaucgggccgcggguuggggaagaccuccaucggccuacugugcgucauggcaagcuccgccuuacuuuggauggccagcguggaaccccacuggaucgcggccuccaucauuuuggaguucuuccugaugguacuccugauucccgaaccggacaggcaaagaacgccccaagauaaccagcuggccuaugucgugaucgggcuccucuucaugauccugaccguugccgcaaacgaaaugggccucuuagagacgacaaagaaggaccuggggaucggccaugucgcaguugaaaaccaccaccacgccaccaugcuggacguggaccugcaccccgcaucggccuggacccucuaugccgucgcgacaaccaucaucacccccaugaugcggcacaccauagagaacacaaccgccaauaucuccuugaccgccaucgccaaccaggccgcgauacuuaugggccuugacaagggcuggcccauaucuaagauggauaucggcgugccgcuccuggcucugggcugcuacucccagguaaacccguuaacccuuaccgcggcgguccucaugcugguugcgcacuacgcuaucaucggcccaggccugcaggccaaggccacacgcgaagcccagaagcgaacugcggccggcaucaugaagaaccccaccguggaugggaucgucgccauugaccuggaccccgugguguacgacgccaaauucgagaagcaacucggccagaucaugcuguuaauccucugcacgagccagauucugcugaugcggaccaccugggcgcucugcgaaucuaucacccuggccacgggaccgcugaccacguugugggaaggaagcccgggcaaauucuggaauacaacgauagccguuuccauggccaacaucuuccgcgggagcuaccuggccggcgccgggcuggcuuucagucucaugaagucccucggaggaggccggcgcgggacgggcgcccaaggcgaaacccucggggagaaguggaagcggcagcucaaucagcugagcaagucggaguuuaauacguacaaacgcagcggaauaauggagguggaucgcuccgaggccaaggagggucugaggcgcggagagaccacuaagcaugcgguaagccgaggcaccgcgaagcuccgcugguucguugagcgcaaccuggucaagcccgaggggaaggugauugaccucggcugcggcaggggcgggugguccuacuauugugccggguuaaagaagguaacugaggugaagggguauacgaagggaggccccggccacgaggagccaauuccgauggcgacguacgguuggaaccuagugaaacuacacucgggcaaggacgucuuuuucaucccgcccgagaaaugcgauacccugcucugcgacaucggggaauccagcccgaacccaaccauugaggagggccgcacccugcggguccugaagaugguugagccguggcuacgcgggaaccaguucugcaucaagauccugaaccccuacaugcccuccguaguagagacccuggaacauaugcagcggaagcauggcggcaugcucgugcgcaacccacugagccggaacuccacgcacgaaauguacugggucagcugcgguaccggcaacaucguguccgccgugaauaugaccagccgcaugcugcucaaccgguucacgauggcccacaggaagcccaccuacgagcgcgacgucgaucugggggccggcacccggcacgucgcaguggagccagaggucgcuaaccuggacaucaucgggcagagaaucgagaacaucaaacacgagcauaagucuacauggcacuacgacgaagacaaccccuauaaaacgugggccuaccacggaagcuacgagguaaaaccguccggaagcgccuccucaauggucaacggcguggugaagcuccucaccaagccgugggacgucauccccaugguaacacaaaucgcgaugaccgacacgacccccuucggccaacagcgcguguucaaggagaaggucgacacgcgcacaccgaaggcaaagcggggcacagcccaaauaauggagguuaccgcacgcuggcuguggggcuuucugagccggaacaagaagcccaggauaugcacgcgggaagaguucacacgcaaggugcgguccaacgccgcgauaggcgccgucuucguggacgaaaaccaauggaacagcgcgaaggaggccguggaggacgagagauucugggaccugguccaucgggaaagagagcuccauaagcaagguaagugcgcuacuugcguguacaacaugauggggaagagggaaaagaaacucggagaguuuggcaaagccaaaggcaguagagccaucugguacauguggcuaggugcccgguuccuggaguucgaggcccucggcuucaugaacgaggaccacugguucagccgcgaaaacucccugagcggggucgaaggcgagggguuacacaagcucggcuauauccugcgggacauaagcaaaaucccaggaggcaauauguacgcggacgacaccgcuggcugggacacgcgcauuacugaagaugaccuucaaaacgaggccaagaucacggacaucauggagccggaacacgcccuucuggccaccucuaucuucaagcugaccuaccagaacaaagucgugcgcgugcagcggcccgcgaagaacgggaccgucauggacgucaucagucggcgagaucaacgcggcagcggccaggugggcaccuacggccucaacaccuucaccaauauggaagcccagcugaucaggcagauggaguccgaggggaucuucagccccuccgagcuugaaacacccaaccucgcagagcgcgucuuagauuggcuggagaaguaugggguggagcgccucaaacgcauggcuauaaguggggacgacugcgugguaaagccgaucgaugaccgguucgccacugcgcugaccgcacugaacgacaugggcaaagugcgcaaggacauaccccagugggagcccuccaaggguuggaacgacuggcagcaaguccccuuuugcagccaucacuuccaccagcuuauaaugaaggacggccgggagaucguuguuccaugccgaaaucaagacgagcuaguagggcgggcgcgagucucccagggagccggcugguccuuacgggaaaccgcaugucuggggaaguccuaugcgcagauguggcaacugauguacuuccaccgccgcgaccugcgcuuagcagccaacgcuauaugcuccgccguucccguugacuggguccccaccagccguacaaccuggucuauacacgcacaucaccaauggaugaccaccgaggacaugcugagcguauggaaccgcguguggaucgaggaaaaucccuggauggaggacaagacgcacaucuccagcuggggagauguaccguaucucggcaaacgagaggaccaauggugcggcuccuugaucggcuugaccgcccgagccaccugggcuaccaacauccaggucgcgauuaaccaagugcgcaggcuaaucggcaaugagaacuacuuagauuauaugacauccaugaagcgcuucaaaaacgagucggaccccgaaggcgcccuaugguga

SEQ ID NO: 24264 - RNA, 9879 nt, Artificial Sequence
  derived and/or modified CDS sequence (opt11) from DENV-1__GQ868606__SS-prME
agcgucaccauguugcucaugcugaugcccacagcccuggcauuccaccucaccacccggggcggagagccccacaugaucgugaguaaacaggagcggggcaagucacugcuauucaagaccuccgcagggguuaacaugugcacucugaucgccauggaucugggggaguucugcgaggauacgaugacguauaagugcccgcgcaucaccgaggccgagccagacgauguagauugcuggugcaaugccaccgacacgugggugacauacggcacuugcagccagacuggcgagcaccggcgggauaagcggagcguugcucuggcaccgcaugugggacugggccuggagacuagaacagagaccuggauguccuccgaaggcgccuggaagcaaauacagcgcguugaaacaugggcccuaaggcacccaggguucaccgugauagcucucuuccuggcucacgccaucgguacaagcauuacgcagaaggggaucaucuuuauccuguugaugcuggugacaccuuccauggcuaugcggugugucggcauaggcagccgcgacuuuguggaggguuuauccggggcuacguggguggacgucgucuuggagcacgggagcugcgugaccacuauggcuaaggacaagcccacccuggacaucgagcugcuuaagacggaagugaccaaucccgcgguguuaaggaaguugugcauugaggcgaaaaucucgaacaccacgacagacagccgaugcccuacgcagggcgaggccacccucguggaagagcaagaugcgaacuucgucuguagacgcacuuucguggacaggggaugggggaauggcugcggccuguucggcaaagggucccugauaacgugcgcaaaguuuaagugcgucacgaaguuagaagggaagaccguucaauacgagaaccuaaaguauagcgugauugugacuguccacaccggagaccaacaucaggucgguaacgagagcaccgagcacggaaccaccgcgaccaucacuccccaggccccuucgaccgaaauccagcuuacggacuauggcgcccugacccuagacugcaguccucggaccggccuggacuuuaacgagaugguuuuacugacuaugaaagagaaauccuggcugguacacaagcagugguuucucgaucucccgcugccauggaccaguggugccaguacgagucaggaaacauggaaucggaaagacuugcuggugaccuuuaagaccgcacacgccaagaagcaggagguaguugugcugggcucccaggaaggagccaugcauaccgcccuaacgggcgcaaccgaaauccagaccagcggaacuacgaccaucuucgccgggcaccugaaaugccgacucaagauggacaagcucacucugaagggcaugucuuacgugaugugcacagggucauucaagcuggagaaggagguggcggaaacccagcauggcaccguccuaguucagaucaaguacgaaggaaccgacgccccgugcaagauccccuucucaacccaagaugaaaagggggucacacaaaacggcaggcugauuacugccaauccaauagucaccgauaaggagaagccagucaacaucgaggccgagccaccguucggagagagcuauaucgucaucggcgcgggcgagaaggcccugaagcuuuccugguucaagaaggggaguuccaucggcaaaauguucgaagccaccgcccgcggggcgcggcguauggcgauccucggcgacacugccugggauuucgggagcaucgguggcguguucaccucaguugguaagcucgugcaccagaucuucggcaccgcuuacggaguucuguucucgggcgucuccuggaccaugaagauuggcaucgguguccugcuuacguggcuaggccucaacagccguaguaccagccugagcaugaccuguaucgcggugggccuugucacccucuaucugggcgugaugguacaggcugauucuggaugcgucauuaauuggaagggccgggagcuaaaaugcgggucgggaaucuuuguuaccaacgagguucacacauggaccgagcaguacaaguuccaggcugacuccccuaagcgccugagcgcggccaucggcaaggccugggaggagggcgucugugggauccggucugcuacccguuuagagaacauuauguggaagcagaucaguaacgaacugaaucacauucuucuggagaaugauaugaaguucaccgucguggucggggauguggcgggaaucuuagcucaaggcaagaagaugauuagaccccagcccauggaauacaaguacagcuggaaauccuggggcaaggccaaaaucauaggggccgacguucagaacacgacuuucaucauagacggacccaauacccccgaguguccagacgaucagcgcgcguggaacaucugggaggucgaagacuauggauuugggaucuuuacaacaaacaucuggcucaagcuccgggacuccuacacccaggugugcgaucaucgccugaugucugccgccaucaaggacuccaaagcgguucaugcugacaugggcuacuggaucgaauccgagaaaaaugagacauggaagcuggcgcgggcuuccuucaucgaggucaagacuuguauuuggcccaagagccacacgcuguggaguaacgguguguuggaguccgaaaugaucauaccgaagauuuacgggggcccgaucucacaacauaaccacagacccggauacuucacgcagacugccggccccuggcaccucgggaagcuggaguuagacuuugaccuaugcgaaggcaccaccguugucguagacgagcauugcgguaaccgugggccuucacugcgcaccaccacggugacgggcaagauuauccacgagugguguugccggagcugcacccugcccccccucagguucaagggggaagacggcugcugguacgggauggagauccgacccgucaaggagaaagaggagaauuugguuaagagcauggugagcgcagguuccggagagguggacagcuuuucccugggucugcuguguauuucaauaaugauugaggaggugaugcgcucccguuggucacgcaagaugcugaugaccggcacccucgccguguucuuccuccuuauaauggggcaguugacuuggaacgaucugauccggcuauguauaauggucggcgcuaaugcaagcgaccgcauggggaugggcacaaccuaccucgcgcugauggcuaccuucaagaugcgcccgauguucgcaguugguuuacuguuccggaggcugacgagcagagaagugcugcuccuaaccaucgggcugucacucgucgcgagcguggaguuaccgaauucccuugaagagcucggagacggucuggccaugggcauaaugauucucaagcuccugacagacuuccaaagccaucaguugugggcaacgcuucugucccugacguucaucaagaccaccuuuagccuccacuacgcauggaagacaauggcgaugguccuauccaucguuucauuguucccccucugucuauccacuaccucucagaagacgaccuggcuaccugugcugcugggcagccuggggugcaagccgcucacuauguuucugauugccgaaaacaagaucuggggccgcaagagcuggcccuuaaacgaggggaucauggcaguaggcaucgucagcauacuccucuccagcuugcucaaaaacgacguuccccuugcagggccacugauugccgggggaaugcugaucgcguguuacgucaucuccggaucauccgcggaccugagccucgagaaggcagccgagguauccugggaagaggaggccgagcacagcggagcgucacauaacauucugguggagguccaggaugacggcaccaugaaaauaaaggacgaagagagagacgauacacugaccauccuacucaaggcaaccuugcuggcugugucugggguauacccucucaguauaccggccacgcuguuugucugguacuucuggcagaagaagaaacagcgcagcggaguucugugggacaccccaagcccucccgagguggagcgggcaguccucgacgacgggauauacaggauaaugcaacgaggccuucuggggcgcucccaagucggcgugggaguauuccaggagaauguuuuccacacgauguggcacguuacccggggcgccguccugauguaccagggaaagcgccuugagcccuccugggccucagucaaaaaagaucugauuucguaugguggcggguggcggcugcagggcagcuggaacacuggggaagaggugcagguaaucgcugucgagcccggcaagaaccccaagaacgugcagaccgccccgggaaccuucaagacuagcgagggagaggucggcgcaaucgcgcucgauuucaagcccggcacguccgguagccccauaguaaaccgcgaagguaagaucgugggccuguacggcaacgggguggugaccaccuccggaacauacgugagcgccaucgcccaggccaaggcgagucaagagggaccccugcccgagaucgaggaugaggucuuucggaaacgcaaucucacgaucauggacuuacacccgggcagcgggaaaacgcggagguaucugccagccaucguacgggaggcuaucaagcgcaaguuacggaccuugauauuggccccgacucgcgugguggccucggagauggcagaggcccucaaaggaaugccuauucguuaccagacaacggccgucaagagcgaacacaccgggaaagagauuguggaucugaugugucacgcuacuuucacgaugcgguuacucucacccguccgggugcccaauuacaacaugaucauaauggacgaggcgcauuucacggacccuagcagcaucgcagccaggggguauauuaguacccgcguggggaugggagaggcggccgcgaucuucaugaccgcgacgccgcccggcuccgucgaggccuuuccccagaguaaugccgugauccaagacgaggagcgggacauaccggaaagaagcuggaacagcggguacgaguggaucaccgauuuccccgggaagaccgugugguucguucccuccaucaaaucgggcaacgacaucgcgaacugccuccggaagaaugguaagcgcgugauccagcugagucggaagaccuuugacacggaguaucagaagaccaaaaauaacgacugggacuacguggucacuacggacaucagugagaugggagcgaacuuccgagcggaccgggugaucgauccucgccggugccuuaagcccguaauccugaaagacgggcccgagcgcgucauccuugccggcccgaugcccgucacggucgcuuccgccgcccagcgcagaggcaggaucggccgcaaccacaacaaggagggugaucaguacaucuacauggggcagccacucaauaacgaugaggaccacgcccacuggacagaggccaagaugcugcucgauaacaucaauaccccugagggcaucauucccgcccucuucgaaccggagagagaaaagucggccgcgaucgauggggaguauagacugcgcggggaggcaagaaagacuuucguggagcugaugcgucgcggggaccucccggucuggcugaguuauaaaguggccuccgagggcuuucaguacagcgaucgucgguggugcuucgauggcgagaggaauaaucaaguucucgaggagaacauggacguggagaucuggacgaaagagggcgaacgcaagaaguuacgaccucgcuggcuugacgcccgcaccuacagcgaucccuuggcgcuucgagaauucaaggaguuugcagcggggcgucgguccgucuccggggacuuaauacuagagauaggcaagcucccccagcaucugacccaacgcgcacagaacgcgcuggauaaccucgugaugcugcauaacuccgagcagggcggucgcgcauacagacaugcgauggaggaacugccggacaccauagagacgcucaugcugcuggcgcugaucgccgugcugacuggaggggucacacuguucuuucuaagcggcagagggcuggggaagacaagcaucggacugcucugugugauggccuccagcguucugcuguggauggcauccguggagccccauuggauagccgcuucgaucaucuuggaguucuucuuaauggugcugcuuauaccagagcccgaucgccaaagaacgccgcaggacaaccaauuagccuacgucgugauagggcugcucuucaugauccugacgguggccgcgaaugaaaugggccugcucgagaccaccaaaaaggaucuggggaucggccauguagcgguagaaaaccaucaccacgccgccaugcucgauguggaccuacauccagcuuccgcguggacgcuguaugccguggccacaaccauaaucacuccuaugaugcgccacacaaucgagaacacgaccgcgaacaucagccuuacagccaucgcgaaccaggcugcaauacucauggggcuggacaagggcuggccgaucuccaagauggacaucggggucccauuacuggcacuaggaugcuacucacagguaaauccccugacgcuaacggccgccguacuuaugcuggucgcccacuacgccauuauuggucccgggcuccaggcgaaggcgacccgcgaagcgcagaaaagaaccgcugccggcaucaugaagaacccgaccguggacggcaucguugccauugaccucgaucccgucguguacgacgcaaaguucgaaaagcagcugggccagauaaugcuacucauucuguguacgucccagauccuccugaugcgcaccacaugggcccugugugagagcaucacgcucgccaccggccccuugaccaccuuaugggaaggcagccccggcaaguucuggaacacuacaaucgccguaagcauggccaacaucuuccggggguccuaccuugccggcgccgggcuggccuucucacugaugaagagucucggcgguggccguaggggcaccggggcccagggugaaacccugggcgaaaaguggaagcgccaguugaaucaacucagcaaaucggaauucaauaccuacaagcgguccgggaucauggagguugaccgcagcgaggcgaaagagggcuugaagaggggggagacuacgaagcacgccgugucucgcggcaccgccaagcugcgcugguuuguagagcgaaacuuaguuaagccggagggcaaggucaucgaccugggcugcggucgcggcggauggagcuacuauugugcgggccugaagaaggucacagaggucaagggguacacgaagggaggucccggucaugaggagccuauccccauggccacauacggguggaaucuggugaaauugcacuccggcaaggacguuuucuucauuccgccagagaaaugugacacccuacuaugcgacauaggggaaucuucccccaaccccaccaucgaggagggccgcaccuugcgaguacugaaaaugguggagccuugguuacgcggaaaucaauuuugcaucaagauccuuaauccauacaugccaucugugguagagaccuuagagcagaugcagcgaaaacacgggggaaugcuggugcgaaauccccucagucggaauuccacccacgagauguacuggguuuccugcgggacuggcaacaucgucagugcgguuaacaugaccucccgcaugcuccucaaccgauucaccauggcacaccguaagcccaccuacgagcgcgacguggaccucggggcgggcacccggcacgucgccguagagcccgaaguggcgaacuuagauaucaucggucagcgaaucgagaauaucaagcaugagcacaagucaacguggcacuacgacgaggauaacccauacaagacaugggcguaccaugggucuuaugaaguuaagcccagcgggagcgccuccagcauggucaacggggucguaaagcugcucaccaagcccugggacguuauccccauggucacccagaucgcaaugacggauacuacccccuucggccagcagaggguguuuaaagaaaagguggacacucgaaccccgaaggcgaagcgggggacggcucagaucauggaggucacugcuaaauggcuguggggcuucuugaguagaaacaagaagccgaggauaugcacccgggaagaauucacgagaaaggugcgcagcaaugcagcgaucggagccgucuucgucgacgagaaccaguggaacagugcgaaggaggcuguggaagacgagcgguucugggaucucgugcaccgcgagcgggagcuucauaagcaggggaagugcgcaacgugugucuauaauaugaugggcaagcgcgagaagaaacugggagaguuuggaaaggccaagggcucgcgggccauaugguacauguggcugggcgcccgcuuccuggaauucgaggcucuaggauucaugaacgaggaccacugguucucucgagagaacagccucuccggagucgagggugaggggcuccacaaacugggcuacauccucagggacauaucaaagauccccgggggcaacauguacgccgaugauacagccggcugggauacucguaucaccgaggacgacuugcaaaacgaggcaaagaucacggacaucauggagccagagcacgcgcugcuagccaagucuauuuucaagcugacauaccagaauaagguaguacgcguucagcgcccggccaggaacggaacagugauggacgucaucagccggcgggaccaaagaggcuccggccaagucggcaccuacggccugaacaccuucaccaauauggaggcccagcuaauucggcagauggagucagaggguaucuuuagcccaucagagcuggagacccccaacuuagcgggccgcguccucgacuggcuagagaagcauggcguagagagauuaaagcguauggcgauaagcggcgacgacuguguugugaagccaaucgacgaccguuuugcgaccgcccucacggcccucaaugacauggggaagguccgcaaggacauaccgcagugggaacccagcaaaggcuggaacgacuggcagcagguaccauucugcagccaccauuuucaccagcugauaaugaaggacgggcgggaaaucgugguccccugucgcaaccaagacgagcuggucgggcgggcccgcgucucccaaggugcaggguggucacugcgggagacagcgugucuaggcaaguccuacgcccagauguggcagcucauguacuuccaccggcgggaccugcgcuuagcggcaaacgcuaucuguagcgcugucccgguggacugggugcccaccuccagaacaacauggucaauccacgcucaccaccaguggaugaccaccgaggacaugcucuccgucuggaaccgcguguggaucgaggagaaccccuggauggaggauaagacccauauauccagcuggggcgacguacccuaucugggcaagcgggaagaccaguggugcgguagccugaucgggcuuacggcacgcgcaacgugggccaccaauauacaggucgccauuaaccaaguuagacggcugaucggaaacgaaaacuaccuggacuacaugaccucuaugaagcgcuuuaagaacgaaucggacccggaaggcgcccucugguag

SEQ ID NO: 24265 - RNA, 9879 nt, Artificial Sequence
  derived and/or modified CDS sequence (opt11) from DENV-1__FJ882539__SS-prME
agcgugaccauguugcucaugcugaugcccaccgcccuggccuuccacuuaacaacgcggggcggggaaccccacaugaucgucuccaagcaggaacggggcaagagccugcuuuucaaaaccuccgccggggugaacaugugcaccuuaaucgccauggaccugggcgaguucugcgaagauaccaugaccuauaagugcccgcgcaucaccgaggccgagcccgacgacguggauugcuggugcaacgccaccgacaccugggucaccuacgggaccugcagccagaccggcgaacacagacgggacaagagauccguggcccucgcgccccacgugggucucgggcuggagacgcgcacggaaaccuggaugagcagugagggcgccuggaagcagauccagcgggucgagaccugggcgcugcgccaccccggguucacggugaucgcccucuuccuugcgcacgccauuggcaccagcauuacccagaaggggaucaucuucauccugcugaugcuggugacccccucaauggccaugcggugugucggcauuggcagcagagacuucguggaggggcuuuccggggccacguggguggacgucguccuugagcacggaagcugcgugaccaccauggccaaggacaagccgacccuggauaucgaauuacugaagacggaggucacuaacccggcgguguuacggaagcugugcaucgaggccaagaucucuaacacuaccacggacagccgcugcccgacccagggcgaggccacgcucguggaggagcaggacgccaacuucgugugccggcgcaccuuuguugaccggggcugggggaacgggugcgggcuguuuggcaaagguucccugauaaccugcgccaaguuuaagugcgugaccaagcucgagggcaagaccguccaguacgagaaccuaaaguacagcgugaucgugaccguacacacuggcgaccagcaccagguggggaacgaguccacagagcacggcaccaccgcgacuaucacgccccaagcacccagcaccgagauccagcugacagacuacggggcccucacccuggacugcagcccacggacgggccuggacuucaacgaaaugguccuccugaccaugaaggagaaguccuggcugguucacaagcagugguuccucgaccugccgcuacccuggaccagcggggcccuagcuucccaagagaccuggaaccggaaagaccugcuggugacguucaagaccgcgcacgccaagaagcaagaggucgugguucucggcagccaggagggcgccaugcacaccgcccugacaggggcgacggagauucagaccucaggcaccaccacgaucuucgcggggcaccugaagugccgacuuaagauggacaagcugacccugaaaggcaugagcuaugucauguguaccggcucauuuaagcuagagaaggagguggccgaaacccagcacggcacggugcugguccagaucaaguacgagggcaccgaugccccgugcaagauccccuucagcacccaagacgagaaagggaucacccagaacggccggcugaucacggccaaccccaucgucaccgauaaggagaagccggugaacaucgaggcggagccgcccuuuggggaguccuacaucgucaucggcgccggcgagaaggcccugaagcucagcugguuuaagaagggguccagcaucggcaagauguucgaggccaccgcccgcggggcucgccgcauggcuauccuaggcgacacggcaugggacuucggguccaucggcggcguguucacgagcguggggaagcugguacaccagaucuucggcaccgccuacggggugcuguucuccggcgugagcuggaccaugaagaucgggaucggcguccugcuuaccuggcucggccugaacucccgcucuacgucccugagcaugaccuguaucgccgugggguuagugacccuguaucucggcgucauggugcaggcggacuccgguugcgugaucaauuggaaggggcgggagcucaagugcgguagcggcaucuucgugacaaaugaggugcacacuuggacagaacaguacaaguuucaggccgacucuccgaagcgcuuaagugccgcaaucggcaaggccugggaggagggggucuguggcauccggagcgcgacgcgccuggagaacaucauguggaagcagaucucuaaugagcucaaccacauccuacuggaaaacgacaugaaguucaccguuguggugggggacgucgccggcauccucgcgcaggggaagaaaaugauccggccccaacccauggaguacaaguacucuuggaaguccuggggcaaggccaagauaaucggcgcggacgugcaaaacaccacguuuaucaucgacgggcccaauaccccggaaugccccgacgaccagcgcgccuggaacaucugggagguggaggacuacggcuucgggaucuuuaccaccaacauauggcugaagcugagagacagcuacacgcaggucugcgaccaccgccucauguccgccgcuaucaaggacucaaaggccgugcacgcggacaugggcuacuggaucgaguccgagaagaacgagaccuggaagcuggcccgcgccagcuucauugaagugaagacgugcaucuggccgaaaucacacacccuguggagcaacggcguccucgagucggagaugaucaucccuaagaucuacgggggcccgauaagccagcauaaccaccgccccgguuacuucacgcagaccgccggccccuggcaucuggggaagcuggagcucgacuucgaccugugugagggcaccacugugguggucgacgagcacugcggcaaccgggggccgucccugcgcacgaccacagugaccggcaagauaauccacgaguggugcugccgcagcugcaccuugccaccccuccgcuucaagggggaggacggcugcugguacgggauggagauccggcccguaaaggaaaaggaggagaaccuggucaaguccaugguaagcgccggcagcggcgaaguugacuccuucagccucgggcugcugugcaucuccaucaugaucgaggagguuaugcgcagccgguggucgcgcaagaugcucaugacaggcacccuggcgguguucuuucuguugaucauggggcaguugacauggaacgaccugauccggcucugcaucauggugggcgccaacgccagcgauaggauggggaugggcacgaccuacuuagcccugauggccaccuucaagaugcgcccgauguucgcggucggccuccuguuccggcgccugacguccagggaaguguugcugcugaccaucggacucucguuaguggccuccgucgaguugccuaacagccucgaggagcugggcgaugggcuggccaugggcaucaugauccucaagcugcugaccgacuuccaaucccaccagcucugggcuacccuguugucucucaccuuuaucaagacgacguucucccugcacuacgcguggaagaccauggccauggugcugagcaucgucucccucuucccacugugccugagcaccacgagucagaagacgaccuggcuccccgugcuguuggguagucucgggugcaagccgcugaccauguuccugauugcagagaauaagaucuggggccggaaguccuggccccucaacgaggggaucauggccguaggcaucgucagcauccuguuaaguucccuccugaagaacgacgugccccuggccgggccccucaucgccggcggcaugcuuaucgcgugcuacgugaucagcggguccagcgcagaccuguccuuagagaaggccgccgaggucucaugggaggaggaggcagagcacuccggcgccucacacaacauccuaguggaggugcaggacgacgggacgaugaagaucaaggacgaggagcgggacgacaccuugaccauccuccugaaggcgacccugcucgccgucucuggcguguacccgcugagcauccccgccacccuguucgugugguacuucuggcagaagaagaagcagcgcuccgguguccucugggacacacccagcccacccgagguggagcgggcggugcuugacgacggcauuuaccgcaucaugcagcggggucugcuagggcgcucccagguaggcguggggguguuccaggagaacgucuuucacacgauguggcacgugacccggggugccgugcucauguaccaagggaagcgccuggagccgagcugggccuccgucaagaaggaccugaucaguuacggcggcggguggcggcuccaggggucguggaacaccggggaggagguccaggugaucgcgguggagcccggcaaaaaccccaagaacgugcagacggcccccgggaccuucaagaccucugagggcgaggugggugcgaucgcccuggacuucaagcccgggaccuccgguagccccaucgucaaccgcgaagggaagaucgugggucuguacggcaacgggguggucaccaccagcggcaccuacguguccgccauagcccaggcgaaggccagccaggaggggccccucccggagaucgaggacgagguguuccggaagcgcaaccugaccaucauggaccugcauccaggcuccgggaagacgcgucgcuaccuccccgccaucguccgggaggccaucaaacgcaagcugcggacccugauccucgccccgacccgcguaguggcgagcgagauggccgaggcccugaagggcaugcccauccgcuaccagaccacggccgucaaguccgagcacaccggcaaggagaucguggaccugaugugccacgccaccuucaccaugcgccuucugucacccguucgcguccccaacuacaacaugaucaucauggacgaggcgcacuucacggacccgucaagcaucgccgcccggggguauauuuccacacgcguaggaaugggggaggccgccgcgauauuuaugacugcgacaccgcccggcucggucgaggccuucccgcaguccaacgcugucauacaggacgaggagcgggacaucccggagcgcagcuggaacuccggcuacgaguggaucacggacuucccuggcaagaccgugugguucgugccuagcaucaaguccggcaacgacauagcgaacugccugcggaagaacgggaagcgcgucauccagcucucgcggaagaccuucgacacagaguaccaaaagacgaagaacaacgacugggauuacguggugacuaccgacaucuccgagaugggcgccaacuucagagcugaccgggucaucgacccucgccggugccugaagccgguuauccuuaaggacgggcccgagcgugugauacucgccggccccaugccgguuaccguggcaagcgcggcccaacggcgcgggcggaucggccgcaaccacaacaaggagggcgaccaguacaucuacaugggucagccgcugaauaaugacgaggaccaugcccacuggacggaggcaaagaugcuucucgacaacaucaacacccccgagggcaucauccccgcccuguucgagcccgagcgggagaaguccgcugcgaucgacggggaguaccgccuccgcggcgaggcccggaagaccuucguggagcucaugcgccgcggagaccugccggugugguugagcuacaagguggccagcgagggcuuucaguacuccgaccgccgguggugcuucgacggcgagcgcaacaaccagguccuagaggagaauauggacguggagaucuggaccaaggagggggaacggaagaagcugcgccccagauggcuggaugcucgcacguauagcgacccccucgcgcugcgggaguucaaggaguucgccgccggccgccguuccgugagcggggaccugauccuagagaucggcaagcugccccagcaccugacccaacgcgcccagaacgcgcucgacaaucuggucaugcugcacaacuccgagcaaggagggcgggcauaucgccacgccauggaagaacuaccggacaccaucgaaacacugaugcugcuggcccugaucgccgugcugacgggcggagugacccucuucuuccugagcggucgagggcugggcaaaaccuccaucggccuccugugcgucauggccaguuccguguugcucuggauggccucggucgagccccacuggaucgcggccuccaucauccuggaguucuuucugaugguccuccugaucccggagcccgaccgccagcgaaccccgcaggacaaucagcuggccuacguggugaucgggcuccuguucaugauccugaccgucgcggccaaugagaugggccuccucgagacuaccaagaaggaccuggggauuggccauguggccguggaaaaccaccaccaugccgccaugcucgacgucgaccugcaucccgcgagcgccuggacccuguacgccguggccaccacgaucaucacccccaugaugcgccauaccaucgagaacaccacggccaacaucucccuaaccgcuaucgccaaucaggccgccauccugauggggcuggacaagggcuggccgaucagcaagauggacaucggcgugccccucuuagcucuggggugcuauucccaggucaacccccucacccugaccgccgccguguugaugcugguggcccacuacgcgaucaucggccccggccugcaggcgaaggccacgcgggaggcccagaagcgcaccgccgccggcaucaugaagaacccgaccgucgacgggaucgucgcgaucgaccuggauccaguggucuacgacgccaaguucgagaagcagcucggccagauuaugcugcugauccucugcaccucgcagauacuucugaugcggaccacuugggcacucugugaguccaucacccuggccaccggcccccugacgacucucugggaggguucaccgggcaaguucuggaacacaaccaucgccgugucgauggcgaacaucuuccgcgggagcuaccuagccggcgccggccucgccuucagcuugaugaaaucccuagggggcgggcgacgggggacgggggcgcagggagagacccugggcgagaaguggaagcgccagcucaaccaacugagcaaguccgaguucaacaccuacaagcggagcgggaucauggagguggaucgcuccgaggccaaggagggccuuaagcgcggggagaccacgaagcacgccgucagccgcggcaccgccaagcuccggugguuuguugagcgaaacuuggugaagccggagggaaaggucaucgaccuaggcugcggccgcggcgggugguccuacuacugcgccgggcugaagaaggugaccgaggugaagggguacaccaagggcggccccggccacgaggagcccauccccauggcgacuuacggauggaaccucgucaagcuacacagcgguaaggacguauucuucauaccgcccgagaagugugacacccugcucugcgacaucggggagucgagcccaaaccccaccaucgaggaggggcgcacgcugcgggugcuuaagauggucgagccguggcuccgcgggaaccaguucugcaucaagauccugaaccccuacaugcccuccgugguggagacgcuggagcagaugcagcggaagcauggcggcaugcucguccgcaacccccucagcagaaacuccacccacgaaauguacugggugagcugcgggaccgggaacaucgugagcgccguaaacaugaccagccgcaugcugcuaaacagguucaccauggcccaccgcaagccuacguacgaaagggacguugaccuaggagccggcacccggcacguggccgucgagcccgagguggcgaaucuggacaucauuggccaacgaaucgaaaauauaaagcacgaacauaaguccaccuggcacuacgacgaggacaaccccuacaagaccugggccuaccacgggagcuacgaggugaagcccuccggcagugcuagcuccaugguuaacgggguggucaagcuccugacgaagccgugggacgugauacccauggugacccagauugccaugaccgacaccacgccuuucggccagcagcgggucuucaaggagaaggucgacacucgcacccccaaggccaagcgggggaccgcgcaaauuauggaggugacggccaaguggcuguggggcuuccucucgcguaacaagaagccgcgcaucugcacgcgcgaggaguucacucggaaagucagauccaacgccgccaucggggcgguguucguggaugagaaucaguggaacagcgcaaaggaagccguagaagaugagcgguucugggaccuggugcaccgcgagcgggaacugcacaagcaggggaagugcgcgaccugcguguacaacaugaugggcaagcgcgagaagaagcucggagaguucggaaaagcaaaggggagccgggcgaucugguacauguggcucggggcucgcuuccuggaguucgaggcccucggcuuuaugaacgaggaucacugguuuagccgggagaacagccugucgggagucgaaggcgaggggcugcacaagcucggcuacauccugcgcgacaucuccaagauccccgggggcaacauguacgccgacgacacggccggcugggacacccggauaaccgaggacgacuuacagaacgaggcgaagaucacggacaucauggagcccgaacacgcccuccuggccaagagcaucuucaaacugaccuaccagaacaagguggugcgcguccaacggccggcuaagaacgggaccgugauggacgugauauccaggcgcgaccagcggggcagcgggcaggucggcaccuacggccucaacaccuucacgaauauggaggcccaacugauccgccagauggaguccgaggggauauucagccccucagaacuggagacgcccaaccucgccggccgggugcuggacuggcuggagaagcaugggguggagcggcucaagaggauggccaucagcggcgacgacugcgucgugaagccaaucgacgaccgcuucgcgacggcacugaccgccuugaacgacauggggaaaguaagaaaggacaucccucagugggagccuuccaagggcuggaacgacuggcagcaaguccccuuuugcagccaccauuuccaccagcucaucaugaaggacggccgcgaaaucguggugcccugcagaaaccaggacgagcuggucgggcgcgcgcggguaagccagggcgccggguggucccugcgcgagacggccugccucggcaagucuuacgcccagauguggcaacugauguauuuccaccggcgcgaccugcggcucgcggccaacgccaucugcuccgccgugcccgucgacugggugcccaccagccgaacgaccugguccauccacgcccaccaccaguggaugacgaccgaagacaugcuaagcguguggaaucgggucuggaucgaggagaaccccuggauggaggacaagacacacaucuccagcuggggcgacgugcccuaccugggcaaacgcgaggaccagugguguggcucucucaucgggcugaccgcgcgggcuacgugggcaaccaacauacagguugccaucaaccagguucgccgccugauuggcaacgagaacuaccucgacuauaugaccagcaugaagcgguuuaagaacgaguccgauccggagggggcccugugguga
